United States Patent
Berka et al.

(10) Patent No.: US 7,018,794 B2
(45) Date of Patent: Mar. 28, 2006

(54) METHODS FOR MONITORING MULTIPLE GENE EXPRESSION

(75) Inventors: Randy M. Berka, Davis, CA (US); Ib Groth Clausen, Hillerød (DK); Alexandre Bolotine, Vandoeuvre (FR); Alexei Sorokine, Gif sur Yvette (FR); Alla Lapidus, Walnut Creek, CA (US)

(73) Assignee: Novozymes, Inc., Davis, CA (US)

( * ) Notice: Subject to any disclaimer, the term of this patent is extended or adjusted under 35 U.S.C. 154(b) by 304 days.

(21) Appl. No.: 09/974,300

(22) Filed: Oct. 5, 2001

(65) Prior Publication Data

US 2002/0146721 A1 Oct. 10, 2002

Related U.S. Application Data

(63) Continuation-in-part of application No. 09/680,598, filed on Oct. 6, 2000, now abandoned
(60) Provisional application No. 60/279,526, filed on Mar. 27, 2001.

(51) Int. Cl.
*C12Q 1/68* (2006.01)
*C07H 21/00* (2006.01)
*C12N 15/09* (2006.01)

(52) U.S. Cl. .................. 435/6; 435/174; 435/175; 536/23.1; 536/24.3
(58) Field of Classification Search .............. 435/6, 435/174, 175; 536/23.1, 24.3
See application file for complete search history.

(56) References Cited

PUBLICATIONS

Bork et al. (1998) JMB 283 :707–725.*
Attwood (2001) Science 290:471–473.*
DiRisi et al. (1997) Science vol. 278, pp. 680–686.*
Ye et al. (Joournal of Bacteriology (2000) vol. 182 (16), pp. 4458–4465).*
Maghnouj et al. (Journal of Bacteriology (1998) vol. 180 (24), pp. 6468–6475).*
Watson et al., 1998. *Current Opinion In Biotechnology* 9: 609–614.
Chu et al., 1998, *Science* 282: 699–705.
Ruan et al., 1998, *The Plant Journal* 15: 821–833.
Iver et al., 1999, *Science* 283: 83–87.
Havward et al., 2000, *Molecular Microbiology* 35: 6–14.

\* cited by examiner

*Primary Examiner*—Marjorie A. Moran
*Assistant Examiner*—Lori A. Clow
(74) *Attorney, Agent, or Firm*—Robert L. Starnes

(57) ABSTRACT

The present invention relates to methods for monitoring differential expression of a plurality of genes in a first *Bacillus* cell relative to expression of the same genes in one or more second *Bacillus* cells using microarrays containing *Bacillus* genomic sequenced tags. The present invention also relates to computer readable media and computer-based systems. The present invention further relates to substrates containing an array of *Bacillus licheniformis* or *Bacillus clausii* GSTs.

7 Claims, 1 Drawing Sheet

METHODS FOR MONITORING MULTIPLE GENE EXPRESSION

CROSS-REFERENCE TO RELATED APPLICATIONS

This application is a continuation-in-part of U.S. application Ser. No. 09/680,598 filed on Oct. 6, 2000 now abandoned, and claims priority from U.S. provisional application Ser. No. 60/279,526 filed on Mar. 27, 2001, which applications are fully incorporated herein by reference.

BACKGROUND OF THE INVENTION

1. Field of the Invention

The present invention relates to methods for monitoring expression of a plurality of genes in *Bacillus* cells. The present invention also relates to *Bacillus* genomic sequenced tags and to substrates and computer readable media containing such genomic sequenced tags.

2. Description of the Related Art

Microarray technology is increasingly becoming the method of choice for the quantitative and simultaneous analysis of the expression levels of many thousands of genes. Microarray analyses typically follow the steps of gene selection, microarray synthesis, sample preparation, array hybridization, detection, and data analysis (Watson et al., 1998, *Current Opinion in Biotechnology* 9: 609–614).

PCR-amplified coding sequences of genonic DNA from an organism are particularly useful in microarrays for obtaining global expression profiles where the genome of the organism has been fully sequenced.

Chu et al., 1998, *Science* 282: 699–705 disclose the use of microarrays containing PCR-amplified genomic coding sequences for determining the temporal expression of *Saccharomyces cerevisiae* genes during sporulation.

For other organisms whose genomes have not been sequenced, global expression profiles may be obtained with arraying (1) random genomic DNA segments or clones (e.g., from a genomic DNA library); (2) random cDNA clones (e.g., from one or more cDNA libraries) that are uncharacterized at the DNA sequence level; or (3) random cDNA clones that have been sequenced and partially characterized with respect to putative identification and function.

Genomic sequenced tags (GSTs) are partial genomic DNA sequences. Simply stated, a GST is a segment of a sequence from a random genomic DNA clone that corresponds to part of a specific gene. The use of sequenced GSTs in microarrays compared to genomic clones or random cDNA clones provides several advantages especially for organisms whose genomes have not been fully sequenced. First, since sequence information is available, redundancy and follow-up characterization is minimized. Second, GST microarrays can be organized based on function of the gene products to facilitate analysis of the results (e.g., GSTs encoding enzymes from the same metabolic pathway can be arranged or grouped accordingly).

Ruan et al., 1998, *The Plant Journal* 15: 821–833, disclose the use of microarrays containing *Arabidopsis thaliana* EST sequences for determining the temporal expression of *Arabidopsis thaliana* genes in root, leaf, and two stages of floral development.

Iyer et al., 1999, *Science* 283; 83–87, disclose the use of microarrays containing human EST sequences for determining the temporal expression of human fibroblast cells in response to serum.

Hayward et al., 2000, *Molecular Microbiology* 35: 6–14, disclose shotgun DNA microarrays and stage-specific gene expression in *Plasmodium falciparum* malaria.

Bacteria are used as host microorganisms for the industrial production of enzymes and other proteins whether endogenous or heterogenous to the microorganisms. There is a need in the art to provide methods for monitoring the global expression of genes from *Bacillus* cells to improve the production potential of these microorganisms.

It is an object of the present invention to provide alternative methods for monitoring expression of a plurality of genes in *Bacillus* cells.

SUMMARY OF THE INVENTION

The present invention relates to methods for monitoring differential expression of a plurality of genes in a first *Bacillus* cell relative to expression of the same or similar genes in one or more second *Bacillus* cells, comprising:

(a) adding a mixture of labeled nucleic acid probes isolated from the *Bacillus* cells to a substrate containing an array of *Bacillus* GSTs under conditions where the nucleic acids hybridize to complementary sequences of the *Bacillus* GSTs in the array, wherein the nucleic acids from the first *Bacillus* cell and the one or more second *Bacillus* cells are labeled with a first reporter and one or more different second reporters, respectively; and (b) examining the array under conditions wherein the relative expression of the genes in the *Bacillus* cells is determined by the observed hybridization reporter signal of each spot in the array in which (i) the *Bacillus* GSTs in the array that hybridize to the nucleic acids obtained from either the first or the one or more second *Bacillus* cells produce a distinct first hybridization reporter signal or one or more second hybridization reporter signals, respectively, and (ii) the GSTs in the array that hybridize to the nucleic acids obtained from both the first and one or more second *Bacillus* cells produce a distinct combined hybridization reporter signal. In a preferred embodiment, the *Bacillus* GSTs are the *Bacillus licehniformis* GSTs of SEQ ID NOs. 1–4448. In another preferred embodiment, the *Bacillus* GSTs are the *Bacillus clausii* GSTs of SEQ ID NOs. 4449–8481.

The present invention also relates to computer readable media, substrates containing an array of *Bacillus* GSTs, and computer-based systems.

DETAILED DESCRIPTION OF THE INVENTION

Figure 1:
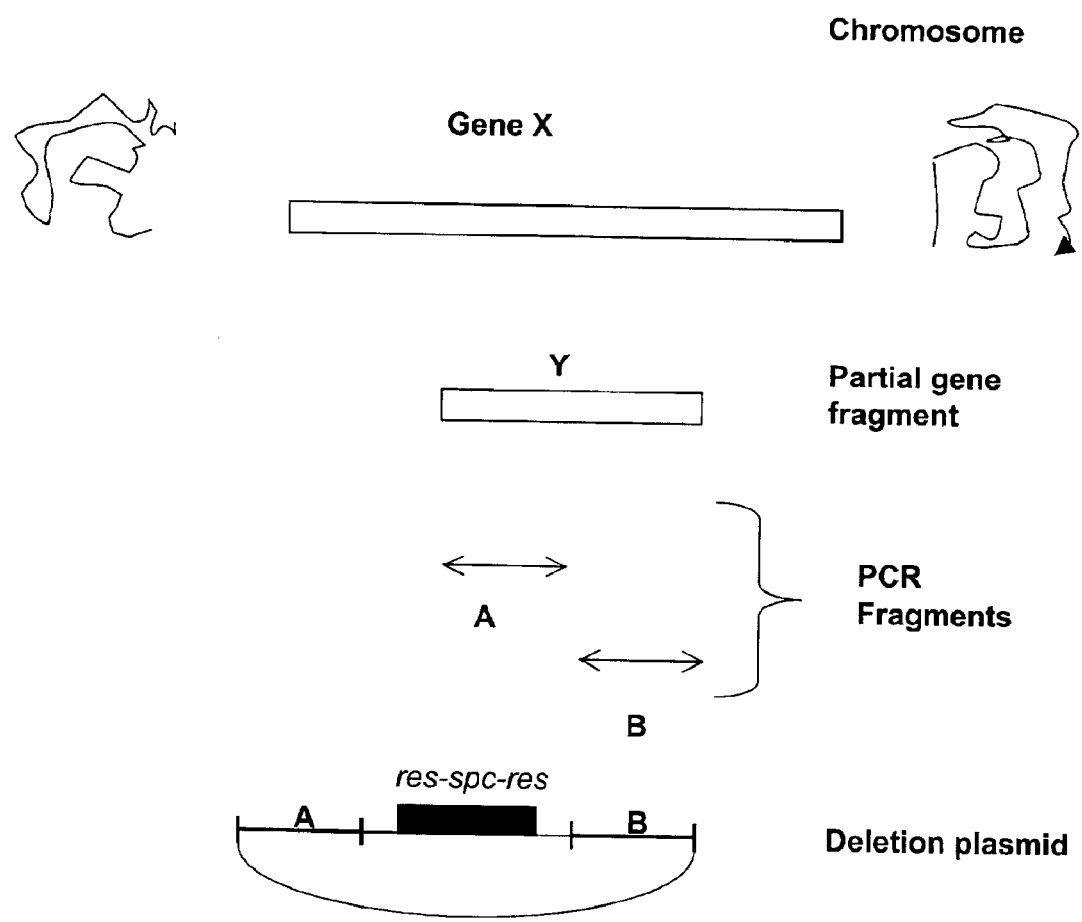
FIG. 1 shows a method to make deletions at specific loci of the *Bacillus licheniformis* or *Bacillus clausii* chromosome utilizing the *Bacillus licheniformis* or *Bacillus clausii* GST sequences described herein.

The present invention relates to methods for monitoring differential expression of a plurality of genes in a first *Bacillus* cell relative to expression of the same genes in one or more second *Bacillus* cells. The methods comprise (a) adding a mixture of labeled nucleic acid probes isolated from two or more *Bacillus* cells in culture to a substrate containing an array of *Bacillus* GSTs under conditions where the nucleic acids hybridize to complementary sequences of the *Bacillus* GSTs in the array; and (b) examining the array under conditions wherein the relative expression of the genes in the two or more cells is determined by the observed hybridization reporter signal of each spot in the array.

The methods of the present invention may be used to monitor global expression of a plurality of genes from a Bacillus cell, discover new genes, identify possible functions of unknown open reading frames, and monitor gene copy number variation and stability. For example, the global view of changes in expression of genes may be used to provide a picture of the way in which Bacillus cells adapt to changes in culture conditions, environmental stress, or other physiological provocation. Other possibilities for monitoring global expression include spore morphogenesis, recombination, metabolic or catabolic pathway engineering.

The methods of the present invention are particularly advantageous when one spot on an array equals one gene or open reading frame because extensive follow-up characterization is unnecessary since sequence information is available, and Bacillus GST microarrays can be organized based on function of the gene products. However, one spot may contain more than one gene especially if random genomic sequences are used.

Genomic Sequenced Tags

The term "genomic sequenced tag" or "GST" is defined herein as a segment of a sequence from a random genomic DNA clone of an expressed Bacillus genome. The term "GST" will be understood to also include two or more Bacillus GSTs assembled into a contig. Bacillus GSTs are generally generated as follows: Total cellular DNA is isolated from a Bacillus cell, digested with a restriction endonuclease or cleaved by sonication, nebulization, or physical methods, size-selected by agarose gel electrophoresis, isolated, and ligated into a vector, e.g., pSGMU2 (Errington, 1986, *Journal of General Microbiology* 132: 2953–2961). The ligation mixture is used to transform competent *E. coli* cells and transformants are selected under selective pressure, e.g., ampicillin selection. Plasmids from the genomic DNA libraries are generated from random selected transformants, isolated, and partially sequenced. The partial sequences are then compared to sequences in various publicly available databases, for example GenBank, EMBL, Swissprot etc., for identification of function and annotated accordingly.

In the methods of the present invention, the Bacillus GSTs are preferably at least about 50 bp in length, more preferably at least about 100 bp in length, even more preferably at least about 150 bp in length, and most preferably at least about 200 bp in length.

The Bacillus GSTs may be obtained from any Bacillus cell but preferably from a Bacillus alkalophilus, Bacillus amyloliquefaciens, Bacillus brevis, Bacillus circulans, Bacillus clausii, Bacillus coagulans, Bacillus firmus, Bacillus lautus, Bacillus lentus, Bacillus licheniformis, Bacillus megateriun, Bacillus pumilus, Bacillus stearothermophilus, or Bacillus thuringiensis cells. In a preferred embodiment, the Bacillus cell is a Bacillus clausii cell.

In a preferred embodiment, the Bacillus GSTs are obtained from a Bacillus licheniformis cell. In a more preferred embodiment, the Bacillus licheniformis GSTs are obtained from Bacillus licheniformis ATCC 14580. In a most preferred embodiment, the Bacillus licheniformis GSTs are selected from the group consisting of SEQ ID NOs. 1–4448, nucleic acid fragments of SEQ ID NOs. 1–4448, and nucleic acid sequences having at least 85%, more preferably at least 90%, and most preferably at least 95% homology to SEQ ID NOs. 1–4448.

In another preferred embodiment, the Bacillus GSTs are obtained from a Bacillus clausii cell. In another more preferred embodiment, the Bacillus clausii GSTs are obtained from Bacillus clausii NCIB 10309. In another most preferred embodiment, the Bacillus clausii GSTs are selected from the group consisting of SEQ ID NOs. 4449–8481, nucleic acid fragments of SEQ ID NOs. 4449–8481, and nucleic acid sequences having at least 85%, more preferably at least 90%, and most preferably at least 95% homology to SEQ ID NOs. 4449–8481.

Microarrays

The term "an array of Bacillus GSTs" is defined herein as a linear or two-dimensional array of preferably discrete elements of Bacillus GSTs, each having a finite area, formed on the surface of a solid support.

The term "microarray" is defined herein as an array of Bacillus GST elements having a density of discrete GST elements of at least about 100/cm$^2$, and preferably at least about 1000/cm$^2$. The GST elements in a microarray have typical dimensions, e.g., diameters, in the range of between about 10 to about 250 μm, preferably in the range of between about 10 to about 200 μm, more preferably in the range of between about 20 to about 150 μm, even more preferably in the range of between about 20 to about 100 μm, most preferably in the range of between about 50 to about 100 μm, and even most preferably in the range of between about 80 to about 100 μm, and are separated from other GST elements in the microarray by about the same distance.

Methods and instruments for forming microarrays on the surface of a solid support are well known in the art. See, for example, U.S. Pat. No. 5,807,522; U.S. Pat. No. 5,700,637; and U.S. Pat. No. 5,770,151. The instrument may be an automated device such as described in U.S. Pat. No. 5,807,522.

The term "a substrate containing an array of Bacillus GSTs" is defined herein as a solid support having deposited on the surface of the support one or more of a plurality of Bacillus GSTs for use in detecting binding of labeled nucleic acids to the Bacillus GSTs.

The substrate may, in one aspect, be a glass support (e.g., glass slide) having a hydrophilic or hydrophobic coating on the surface of the support, and an array of distinct Bacillus GSTs bound to the coating, where each distinct GST is disposed at a separate, defined position.

Each microarray in the substrate preferably contains at least 10$^3$ distinct Bacillus GSTs in a surface area of less than about 5 or 6 cm$^2$. Each distinct Bacillus GST (i) is disposed at a separate, defined position in the array, (ii) has a length of at least 50 bp, and (iii) is present in a defined amount between about 0.1 femtomoles and 100 nanomoles or higher if necessary.

For a hydrophilic coating, the glass slide is coated by placing a film of a polycationic polymer with a uniform thickness on the surface of the slide and drying the film to form a dried coating. The amount of polycationic polymer added should be sufficient to form at least a monolayer of polymers on the glass surface. The polymer film is bound to the surface via electrostatic binding between negative silyl-OH groups on the surface and charged cationic groups in the polymers. Such polycationic polymers include, but are not limited to, polylysine and polyarginine.

Another coating strategy employs reactive aldehydes to couple DNA to the slides (Schena et al., 1996, *Proceedings of the National Academy of Science USA* 93: 10614–10619; Heller at al., 1997, *Proceedings of the National Academy of Science USA* 94: 2150–2155).

Alternatively, the surface may have a relatively hydrophobic character, i.e., one that causes aqueous medium deposited on the surface to bead. A variety of known hydrophobic polymers, such as polystyrene, polypropylene, or polyethylene, have desirable hydrophobic properties, as do glass and a variety of lubricant or other hydrophobic films that may be applied to the support surface. A support surface is "hydrophobic" if an aqueous droplet applied to the surface does not spread out substantially beyond the area size of the applied droplet, wherein the surface acts to prevent spreading of the droplet applied to the surface by hydrophobic interaction with the droplet.

In another aspect, the substrate may be a multi-cell substrate where each cell contains a microarray of *Bacillus* GSTs, and preferably an identical microarray, formed on a porous surface. For example, a 96-cell array may typically have array dimensions between about 12 and 244 mm in width and 8 and 400 mm in length, with the cells in the array having width and length dimension of $\frac{1}{12}$ and $\frac{1}{8}$ the array width and length dimensions, respectively, i.e., between about 1 and 20 in width and 1 and 50 mm in length.

The solid support may include a water-impermeable backing such as a glass slide or rigid polymer sheet, or other non-porous material. Formed on the surface of the backing is a water-permeable film which is formed of porous material. Such porous materials include, but are not limited to, nitrocellulose membrane nylon, polypropylene, and polyvinylidene difluoride (PVDF) polymer. The thickness of the film is preferably between about 10 and 1000 µm. The film may be applied to the backing by spraying or coating, or by applying a preformed membrane to the backing.

Alternatively, the solid support may be simply a filter composed of nitrocellulose, nylon, polypropylene, or polyvinylidene difluoride (PVDF) polymer, or for that matter any material suitable for use.

The film surface may be partitioned into a desirable array of cells by water-impermeable grid lines typically at a distance of about 100 to 2000 µm above the film surface. The grid lines can be formed on the surface of the film by laying down an uncured flowable resin or elastomer solution in an array grid, allowing the material to infiltrate the porous film down to the backing, and then curing the grid lines to form the cell-array substrate.

The barrier material of the grid lines may be a flowable silicone, wax-based material, thermoset material (e.g., epoxy), or any other useful material. The grid lines may be applied to the solid support using a narrow syringe, printing techniques, heat-seal stamping, or any other useful method known in the art.

Each well preferably contains a microarray of distinct *Bacillus* GSTs. "Distinct *Bacillus* GSTs" as applied to the GSTs forming a microarray is defined herein as an array member which is distinct from other array members on the basis of a different GST sequence, and/or different concentrations of the same or distinct GSTs, and/or different mixtures of distinct GSTs or different-concentrations of GSTs. Thus an array of "distinct *Bacillus* GSTs" may be an array containing, as its members, (i) distinct GSTs, which may have a defined amount in each member, (ii) different, graded concentrations of given-sequence GSTs, and/or (ii) different-composition mixtures of two or more distinct GSTs.

However, any type of substrate known in the art may be used in the methods of the present invention.

The delivery of a known amount of a selected *Bacillus* GST to a specific position on the support surface is preferably performed with a dispensing device equipped with one or more tips for insuring reproducible deposition and location of the GSTs and for preparing multiple arrays. Any dispensing device known in the art may be used in the methods of the present invention. See, for example, U.S. Pat. No. 5,807,522.

For liquid-dispensing on a hydrophilic surface, the liquid will have less of a tendency to bead, and the dispensed volume will be more sensitive to the total dwell time of the dispenser tip in the immediate vicinity of the support surface.

For liquid-dispensing on a hydrophobic surface, flow of fluid from the tip onto the support surface will continue from the dispenser onto the support surface until it forms a liquid bead. At a given bead size, i.e., volume, the tendency of liquid to flow onto the surface will be balanced by the hydrophobic surface interaction of the bead with the support surface, which acts to limit the total bead area on the surface, and by the surface tension of the droplet, which tends toward a given bead curvature. At this point, a given bead volume will have formed, and continued contact of the dispenser tip with the bead, as the dispenser tip is being withdrawn, will have little or no effect on bead volume.

The desired deposition volume, i.e., bead volume, formed is preferably in the range 2 pl (picoliters) to 2 nl (nanoliters), although volumes as high as 100 nl or more may be dispensed. It will be appreciated that the selected dispensed volume will depend on (i) the "footprint" of the dispenser tip(s), i.e., the size of the area spanned by the tip(s), (ii) the hydrophobicity of the support surface, and (iii) the time of contact with and rate of withdrawal of the tip(s) from the support surface. In addition, bead size may be reduced by increasing the viscosity of the medium, effectively reducing the flow time of liquid from the dispensing device onto the support surface. The drop size may be further constrained by depositing the drop in a hydrophilic region surrounded by a hydrophobic grid pattern on the support surface.

At a given tip size, bead volume can be reduced in a controlled fashion by increasing surface hydrophobicity, reducing time of contact of the tip with the surface, increasing rate of movement of the tip away from the surface, and/or increasing the viscosity of the medium. Once these parameters are fixed, a selected deposition volume in the desired picoliter to nanoliter range can be achieved in a repeatable fashion.

After depositing a liquid droplet of a *Bacillus* GST sample at one selected location on a support, the tip may be moved to a corresponding position on a second support, the GST sample is deposited at that position, and this process is repeated until the GST sample has been deposited at a selected position on a plurality of supports.

This deposition process may then be repeated with another GST sample at another microarray position on each of the supports.

The diameter of each *Bacillus* GST region is preferably between about 20–200 µm. The spacing between each region and its closest (non-diagonal) neighbor, measured from center-to-center, is preferably in the range of about 20–400 µm. Thus, for example, an array having a center-to-center spacing of about 250 µm contains about 40 regions/cm or 1,600 regions/cm$^2$. After formation of the array, the support is treated to evaporate the liquid of the droplet forming each region, to leave a desired array of dried, relatively flat GST regions. This drying may be done by heating or under vacuum. The DNA can also be UV-crosslinked to the polymer coating.

Bacterial Cells

In the methods of the present invention, the two or more *Bacillus* cells may be any *Bacillus* cell where one of the cells is used as a reference for identifying differences in expression of the same or similar complement of genes in the other cell(s). In one aspect, the two or more cells are the same cell. For example, they may be compared under different growth conditions, e.g., oxygen limitation, nutrition, and/or physiology. In another aspect, one or more cells are mutants of the reference cell. For example, the mutant(s) may have a different phenotype. In a further aspect, the two or more cells are of different species (e.g., *Bacillus clausii* and *Bacillus*

*subtilis*). In another further aspect, the two or more cells are of different genera. In an even further aspect, one or more cells are transformants of the reference cell, wherein the one or more transformants exhibit a different property. For example, the transformants may have an improved phenotype relative to the reference cell and/or one of the other transformants. The term "phenotype" is defined herein as an observable or outward characteristic of a cell determined by its genotype and modulated by its environment. Such improved phenotypes may include, but are not limited to, improved secretion or production of a protein or compound, reduced or no secretion or production of a protein or compound, improved or reduced expression of a gene, desirable morphology, an altered growth rate under desired conditions, relief of over-expression mediated growth inhibition, or tolerance to low oxygen conditions.

The *Bacillus* cells may be any *Bacillus* cells, but preferably *Bacillus alkalophilus, Bacillus amyloliquefaciens, Bacillus brevis, Bacillus circulans, Bacillus clausii, Bacillus coagulans, Bacillus firmus, Bacillus lautus, Bacillus lentius, Bacillus licheniformis, Bacillus megaterium, Bacillus pumilus, Bacillus stearothermophilus, Bacillus subtilis,* or *Bacillus thuringiensis* cells.

In a preferred embodiment, the *Bacillus* cells are *Bacillus alkalophilus* cells. In another preferred embodiment, the *Bacillus* cells are *Bacillus amyloliquefaciens* cells. In another preferred embodiment, the *Bacillus* cells are *Bacillus brevis* cells. In another preferred embodiment, the *Bacillus* cells are *Bacillus circulans* cells. In another preferred embodiment, the *Bacillus* cells are *Bacillus clausii* cells. In another preferred embodiment, the *Bacillus* cells are *Bacillus coagulans* cells. In another preferred embodiment, the *Bacillus* cells are *Bacillus firmus* cells. In another preferred embodiment, the *Bacillus* cells are *Bacillus lautus* cells. In another preferred embodiment, the *Bacillus* cells are *Bacillus lentus* cells. In another preferred embodiment, the *Bacillus* cells are *Bacillus licheniformis* cells. In another preferred embodiment, the *Bacillus* cells are *Bacillus megaterium* cells. In another preferred embodiment, the *Bacillus* cells are *Bacillus pumilus* cells. In another preferred embodiment, the *Bacillus* cells are *Bacillus stearothermophilus* cells. In another preferred embodiment, the *Bacillus* cells are *Bacillus subtilis* cells. In another preferred embodiment, the *Bacillus* cells are *Bacillus thuringiensis* cells.

In a more preferred embodiment, the *Bacillus* cells are *Bacillus licheniformis* cells. In a most preferred embodiment, the *Bacillus licheniformis* cells are *Bacillus licheniformis* ATCC 14580 cells.

In another more preferred embodiment, the *Bacillus* cells are *Bacillus clausii* cells. In another most preferred embodiment, the *Bacillus clausii* cells are *Bacillus clausii* NCIB 10309 cells.

In the methods of the present invention, the cells are cultivated in a nutrient medium suitable for growth using methods well known in the art for isolation of the nucleic acids to be used as probes. For example, the cells may be cultivated by shake flask cultivation, small-scale or large-scale fermentation (including continuous, batch, fed-batch, or solid state fermentations) in laboratory or industrial fermentors performed in a suitable medium. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection).

Nucleic Acid Probes

The nucleic acid probes from the two or more *Bacillus* cells may be any nucleic acid including genomic DNA, cDNA, and RNA, and may be isolated using standard methods known in the art. For example, cDNA probes may be obtained from total RNA isolated from the cells using standard methods and reverse transcribed into total cDNA.

The populations of isolated nucleic acid probes may be labeled with colorimetric, radioactive (for example, $^{32}$P, $^{33}$P, or $^{35}$S), fluorescent reporters, or other reporters using methods known in the art (Chen et al., 1998, *Genomics* 51: 313–324; DeRisi et al., 1997, *Science* 278: 680–686; U.S. Pat. No. 5,770,367).

In a preferred embodiment, the probes are labeled with fluorescent reporters. For example, the cDNA probes may be labeled during reverse transcription from the respective RNA pools by incorporation of fluorophores as dye-labeled nucleotides (DeRisi et al., 1997, supra), e.g., Cy5-labeled deoxyuridine triphosphate, or the isolated cDNAs may be directly labeled with different fluorescent functional groups. Fluorescent-labeled nucleotides include, but are not limited to, fluorescein conjugated nucleotide analogs (green fluorescence), lissamine nucleotide analogs (red fluorescence). Fluorescent functional groups include, but are not limited to, Cy3 (a green fluorescent dye) and Cy5 (red fluorescent dye).

Array Hybridization

The labeled nucleic acids from the two or more *Bacillus* cells are then added to a substrate containing an array of *Bacillus* GSTs under conditions where the nucleic acid pools from the two or more *Bacillus* cells hybridize to complementary sequences of the GSTs in the array. For purposes of the present invention, hybridization indicates that the labeled nucleic acids from the two or more cells hybridize to the GSTs under very low to very high stringency conditions.

A small volume of the labeled nucleic acids mixture is loaded onto the substrate. The solution will spread to cover the entire microarray. In the case of a multi-cell substrate, one or more solutions are loaded into each cell which stop at the barrier elements.

For nucleic acid probes of at least about 100 nucleotides in length, microarray hybridization conditions described by Eisen and Brown, 1999, *Methods of Enzymology* 303: 179–205, may be used. Hybridization is conducted under a coverslip at 65° C. in 3× SSC for 4–16 hours followed by post-hybridization at room temperature after removal of the coverslip in 2× SSC, 0.1% SDS by plunging the array two or three times in the solution, followed by successive washes in 1× SSC for 2 minutes and 0.2× SSC wash for to or more minutes.

Conventional conditions of very low to very high stringency conditions may also be used. Very low to very high stringency conditions are defined as prehybridization and hybridization at 42° C. in 5× SSPE, 0.3% SDS, 200 µg/ml sheared and denatured salmon sperm DNA, and either 25% formamide for very low and low stringencies, 35% formamide for medium and medium-high stringencies, or 50% formamide for high and very high stringencies, following standard Southern blotting procedures.

The carrier material is finally washed three times each for 15 minutes using 2× SSC, 0.2% SDS preferably at least at 45° C. (very low stringency), more preferably at least at 50° C. (low stringency), more preferably at least at 55° C. (medium stringency), more preferably at least at 60° C. (medium-high stringency), even more preferably at least at 65° C. (high stringency), and most preferably at least at 70° C. (very high stringency).

For shorter nucleic acid probes which are less than 50 nucleotides, microarray hybridization conditions described by Kane et al., 2000, *Nucleic Acids Research* 28: 4552–4557, may be used. Hybridization is conducted under a supported coverslip at 42° C. for 16–18 hours at high humidity in 50% formamide, 4.1× Denhardts, 4.4× SSC, and 100 µg/ml of herring sperm DNA. Arrays are washed after removal of the coverslip in 4× SSC by immersion into 1× SSC, 0.1% SDS for 10 minutes, 0.1× SSC, 0.1% SDS twice for 10 minutes, and 0.1× SSC twice for 10 minutes.

For shorter nucleic acid probes which are about 50 nucleotides to about 100 nucleotides in length, conventional stringency conditions may be used. Such stringency conditions are defined as prehybridization, hybridization, and washing post-hybridization at 5° C. to 10° C. below the calculated $T_m$ using the calculation according to Bolton and McCarthy (1962, *Proceedings of the National Academy of Sciences USA* 48:1390) in 0.9 M NaCl, 0.09 M Tris-HCl pH 7.6, 6 mM EDTA, 0.5% NP40, 1× Denhardt's solution, 1 mM sodium pyrophosphate, 1 mM sodium monobasic phosphate, 0.1 mM ATP, and 0.2 mg of yeast RNA per ml following standard Southern blotting procedures.

The carrier material is finally washed once in 6× SSC plus 0.1% SDS for 15 minutes and twice each for 15 minutes using 6× SSC at 5° C. to 10° C. below the calculated $T_m$.

The choice of hybridization conditions will depend on the degree of homology between the *Bacillus* GSTs and the nucleic acids obtained from the two or more *Bacillus* cells. For example, where the nucleic acid probes and the GSTs are obtained from identical *Bacillus* cells, high stringency conditions may be most suitable. Where the cells are from a genus or species different from which the GSTs were obtained, low or medium stringency conditions may be more suitable.

In a preferred embodiment, the hybridization is conducted under low stringency conditions. In a more preferred embodiment, the hybridization is conducted under medium stringency conditions. In a most preferred embodiment, the hybridization is conducted under high stringency conditions.

The entire solid support is then reacted with detection reagents if needed and analyzed using standard calorimetric, radioactive, or fluorescent detection means. All processing and detection steps are performed simultaneously to all of the microarrays on the solid support ensuring uniform assay conditions for all of the microarrays on the solid support.

Detection

Any detection method known in the art may be used. The most common detection method is laser-induced fluorescence detection using confocal optics (Cheung et al., 1998, *Nat. Genet.* 18: 225–230). The array is examined under fluorescence excitation conditions such that (i) the *Bacillus* GSTs in the array that hybridize to the nucleic acid probes obtained from one of the first cell and one or more second cells produces a distinct first fluorescence emission color or one or second fluorescence emission colors, respectively, and (ii) the *Bacillus* GSTs in the array that hybridize to substantially equal numbers of nucleic acid probes obtained from the first cell and one of the one or more second cells produce a distinct combined fluorescence emission color, respectively; wherein the relative expression of the genes in the two or more cells can be determined by the observed fluorescence emission color of each spot in the array.

The fluorescence excitation conditions are based on the selection of the fluorescence reporters. For example, Cy3 and Cy5 reporters are detected with solid state lasers operating at 532 nm and 632 nm, respectively.

Other methods of detection may be used employing colorimetric and radioactive (for example, $^{32}$P, $^{33}$P, or $^{35}$S) reporters, or other reporters using methods known in the art (Chen et al., 1998, supra; DeRisi et al., 1997, supra; U.S. Pat. No. 5,770,367).

Data Analysis

The fluorescence data obtained from the scanned image may then be analyzed using any of the commercially available image analysis software. The software preferably identifies array elements, subtracts backgrounds, deconvolutes multi-color images, flags or removes artifacts, verifies that controls have performed properly, and normalizes the signals (Chen et al., 1997, *Journal of Biomedical Optics* 2: 364–374).

Several computational methods have been described for the analysis and interpretation of microarray-based expression profiles including cluster analysis (Eisen et al., 1998, *Proc. Nat. Acad. Sci. USA* 95: 14863–14868), parametric ordering of genes (Spellman et al., 1998, *Mol. Biol. Cell* 9: 3273–3297), and supervised clustering methods based on representative hand-picked or computer-generated expression profiles (Chu et al., 1998. *Science* 282: 699–705).

Computer Readable Media

The *Bacillus* GSTs described herein may be "provided" in a variety of media to facilitate their use. The term "provided" refers to a manufacture comprising an array of *Bacillus* GSTs. Such manufactures provide a large portion of the genome of *Bacillus* and parts thereof (e.g., an open reading frame (ORF)) in a form which allows one skilled in the art to examine the manufacture using means not directly applicable to examining the genome or a subset thereof as it exists in nature or in purified form.

Thus, the present invention also relates to such a manufacture in the form of a computer readable medium comprising an array of *Bacillus* GSTs selected from the group consisting of SEQ ID NOs. 1–8481, nucleic acid fragments of SEQ ID NOs. 1–8481, and nucleic acid sequences having preferably at least 85%, more preferably at least 90%, and most preferably at least 95% homology to SEQ ID NOs. 1–8481.

In a preferred embodiment, the computer readable medium comprises an array of *Bacillus licheniformis* GSTs consisting of nucleic acid sequences of SEQ ID NOs. 1–4448.

In another preferred embodiment, the computer readable medium comprises an array of *Bacillus licheniformis* GSTs consisting of nucleic acid fragments of SEQ ID NOs. 1–4448.

In another preferred embodiment, the computer readable medium comprises an array of *Bacillus licheniformis* GSTs consisting of nucleic acid sequences having preferably at least 85%, more preferably at least 90%, and most preferably at least 95% homology to SEQ ID NOs. 1–4448.

In another preferred embodiment, the computer readable medium comprises an array of *Bacillus clausii* GSTs consisting of nucleic acid sequences of SEQ ID NOs. 4449–8481.

In another preferred embodiment, the computer readable medium comprises an array of *Bacillus clausii* GSTs consisting of nucleic acid fragments of SEQ ID NOs. 4449–8481.

In another preferred embodiment, the computer readable medium comprises an array of *Bacillus clausii* GSTs consisting of nucleic acid sequences having preferably at least 85%, more preferably at least 90%, and most preferably at least 95% homology to SEQ ID NOs. 4449–8481.

In one application of this embodiment, the *Bacillus* GSTs of the present invention can be recorded on computer readable media. The term "computer readable media" is defined herein as any medium which can be read and accessed by a computer. Such computer readable media include, but are not limited to, magnetic storage media, e.g., floppy discs, hard disc storage medium, and magnetic tape; optical storage media, e.g., CD-ROM, DVD; electrical storage media, e.g., RAM and ROM; and hybrids of these categories, e.g., magnetic/optical storage media. One skilled in the art can readily appreciate how any of the presently known computer readable media can be used to create a manufacture comprising computer readable medium having recorded thereon a nucleotide sequence of the present invention. Likewise, it will be clear to those of skill how additional computer readable media that may be developed also can be used to create analogous manufactures having recorded thereon a nucleotide sequence of the present invention.

As used herein, "recorded" refers to a process for storing information on computer readable medium. One skilled in the art can readily adopt any of the presently known methods for recording information on computer readable medium to generate manufactures comprising the nucleotide sequence information of the present invention.

A variety of data storage structures are available for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data-processor structuring formats (e.g., text file or database) in order to obtain computer readable medium having recorded thereon the nucleotide sequence information of the present invention.

Various computer software are publicly available that allow a skilled artisan to access sequence information provided in a computer readable medium. Thus, by providing in computer readable form an array of *Bacillus clausii* GSTs selected from the group consisting of SEQ ID NOs. 4449–8481, nucleic acid fragments of SEQ ID NOs. 4449–8481, and nucleic acid sequences having preferably at least 85%, more preferably at least 90%, and most preferably at least 95% homology to SEQ ID NOs. 4449–8481 enables one skilled in the art to routinely access the provided sequence information for a wide variety of purposes.

Software utilizing the BLAST (Altschul et al., 1990, *Journal of Molecular Biology* 215: 403–410), BLAZE (Brutlag et al., 1993, *Comp. Chem.* 17: 203–207), GENEMARK (Lukashin and Borodovsky, 1998, *Nucleic Acids Research* 26: 1107–1115), GENSCAN (Burge and Karlin, 1997, *Journal of Molecular Biology* 268: 78–94), GLIMMER (Salzberg et al., 1998, *Nucleic Acids Research* 26: 544–548), and GRAIL (Xu et al., 1994, *Comput. Appl. Biosci.* 10: 613–623) search algorithms may be used to identify open reading frames (ORFs) within a genome of interest, which contain homology to ORFs or proteins from both *Bacillus licheniformis* and *Bacillus clausii* and from other organisms. Among the ORFs discussed herein are protein encoding fragments of the *Bacillus licheniformis* and *Bacillus clausii* genomes useful in producing commercially important proteins, such as enzymes used in fermentation reactions and in the production of commercially useful metabolites.

The present invention further provides systems, particularly computer-based systems, which contain the sequence information described herein. Such systems are designed to identify, among other things, genes and gene products—many of which could be products themselves or used to genetically modify an industrial expression host through increased or decreased expression of a specific gene sequence(s).

The term "a computer-based system" is herein defined as the hardware means, software means, and data storage means used to analyze the nucleotide sequence information of the present invention. The minimum hardware means of the computer-based systems of the present invention comprises a central processing unit (CPU), input means, output means, and data storage means. One skilled in the art can readily appreciate that any currently available computer-based system is suitable for use in the present invention.

As stated above, the computer-based systems of the present invention comprise a data storage means having stored therein a nucleotide sequence of the present invention and the necessary hardware means and software means for supporting and implementing a search means.

The term "data storage means" is defined herein as memory which can store nucleotide sequence information of the present invention, or a memory access means which can access manufactures having recorded thereon the nucleotide sequence information of the present invention.

The term "search means" refers is defined herein as one or more programs which are implemented on the computer-based system to compare a target sequence or target structural motif with the sequence information stored within the data storage means. Search means are used to identify fragments or regions of the present genomic sequences which match a particular target sequence or target motif. A variety of known algorithms are disclosed publicly and a variety of commercially available software for conducting search means are and can be used in the computer-based systems of the present invention. Examples of such software includes, but is not limited to, MacPattern (Fuchs, 1991, *Comput. Appl. Biosci.* 7: 105–106), BLASTN and BLASTX National Center for Biotechnology Information (NCBI). One skilled in the art can readily recognize that any one of the available algorithms or implementing software packages for conducting homology searches can be adapted for use in the present computer-based systems.

The term "target sequence" is defined here as any DNA (genomic DNA, cDNA) or amino acid sequence of six or more nucleotides or two or more amino acids. One skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that searches for commercially important fragments, such as sequence fragments involved in gene expression and protein processing, may be of shorter length.

The term "a target structural motif" or "target motif" is defined herein as any rationally selected sequence or combination of sequences in which the sequence(s) are chosen based on a three-dimensional configuration which is formed upon the folding of the target motif. There are a variety of target motifs known in the art. Protein target motifs include, but are not limited to, enzyme active sites and signal sequences, substrate and cofactor binding domains, transmembrane domains, and sites for post-translational modifications. Nucleic acid target motifs include, but are not limited to, promoter sequences, hairpin structures and inducible expression elements (protein binding sequences), repeats, palindromes, dyad symmetries, and transcription and translation start and stop sites.

A variety of structural formats for the input and output means can be used to input and output the information in the computer-based systems of the present invention. A preferred format for an output means ranks fragments of the *Bacillus licheniformis* or *Bacillus clausii* genomic sequences possessing varying degrees of homology to the target sequence or target motif. Such presentation provides one skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *Bacillus licheniformis* and *Bacillus clausii* genomes. For example, implementing software which utilize the BLAST and BLAZE algorithms, described in Altschul et al., 1990, *Journal of Molecular Biology* 215: 403–410, may be used to identify open reading frames within the *Bacillus licheniformis* or *Bacillus clausii* genome or the genomes of other organisms. A skilled artisan can readily recognize that any one of the publicly available homology search programs can be used as the search means for the computer-based systems of the present invention. Of course, suitable proprietary systems that may be known to those of skill also may be employed in this regard.

Substrates

The present invention also relates to substrates as described herein comprising an array of *Bacillus* GSTs.

In a preferred embodiment, the substrate comprises an array of *Bacillus licheniformis* GSTs selected from the group consisting of SEQ ID NOs. 1–4448, nucleic acid fragments of SEQ ID NOs. 1–4448, and nucleic acid sequences having preferably at least 85%, more preferably at least 90%, and most preferably at least 95% homology to SEQ ID NOs. 1–4448. In a more preferred embodiment, the substrate comprises an array of *Bacillus licheniformis* GSTs selected from the group consisting of SEQ ID NOs. 1–4448. In another more preferred embodiment, the substrate comprises an array of *Bacillus licheniformis* GSTs selected from the group consisting of nucleic acid fragments of SEQ ID NOs. 1–4448. In another more preferred embodiment, the substrate comprises an array of *Bacillus licheniformis* GSTs selected from the group consisting of nucleic acid sequences having preferably at least 85%, more preferably at least 90%, and most preferably at least 95% homology to SEQ ID NOs. 1–4448.

In a preferred embodiment, the substrate comprises an array of *Bacillus clausii* GSTs selected from the group consisting of SEQ ID NOs. 4449–8481, nucleic acid fragments of SEQ ID NOs. 4449–8481, and nucleic acid sequences having preferably at least 85%, more preferably at least 90%, and most preferably at least 95% homology to SEQ ID NOs. 4449–8481. In a more preferred embodiment, the substrate comprises an array of *Bacillus clausii* GSTs selected from the group consisting of SEQ ID NOs. 4449–8481. In another more preferred embodiment, the substrate comprises an array of *Bacillus clausii* GSTs selected from the group consisting of nucleic acid fragments of SEQ ID NOs. 4449–8481. In another more preferred embodiment, the substrate comprises an array of *Bacillus clausii* GSTs selected from the group consisting of nucleic acid sequences having preferably at least 85%, more preferably at least 90%, and most preferably at least 95% homology to SEQ ID NOs. 4449–8481.

Co-linearity of *Bacillus licheniformis* and *Bacillus subtilis* chromosomes

The complete nucleotide sequence of the *Bacillus subtilis* chromosome was recently published (Kunst et al., 1997, *Nature* 390: 249–256) and reveals the exact position of more than 4000 genes in this genome. Several public databases are available for searching and graphic representations of the entire genome.

The method of shot-gun sequencing of the *Bacillus licheniformis* chromosome which is conducted herein does not directly address the specific arrangement of genes on the chromosome. However, since *Bacillus subtilis* and *Bacillus licheniformis* are very closely related organisms according to the literature (Ash et al., 1991, *Letters in Applied Microbiology* 13: 202–206) the linear arrangement of genes on the two chromosomes might be similar.

To investigate this hypothesis, a series of long range PCR amplifications were made using primers to *Bacillus licheniformis* sequences which were identified as homologues to specific genes in *Bacillus subtilis*. Each PCR reaction employs *Bacillus licheniformis* chromosomal DNA as template for primer pairs that hybridizes to two genes in *Bacillus licheniformis* which has a known location, orientation and distance in the *Bacillus subtilis* homologs. If a PCR product of the expected size is synthesized, according to the *Bacillus subtilis* chromosomal map, it can be concluded that the two target genes are placed in the same orientation and at the same distance on both chromosomes.

Multiple PCR reactions as described herein were performed on *Bacillus licheniformis* to investigate the degree of co-linearity to the model organism *Bacillus subtilis*. The results of the PCR mapping indicate that approximately 75% of the *Bacillus subtilis* and *Bacillus licheniformis* gene content are similar or collinear (Lapidus et al., Poster P67 at The 10$^{th}$ International Conference on Bacilli, Baveno, Italy).

This high degree of co-linearity between these two organisms can be exploited when yet unidentified genes or part of genes from the *Bacillus licheniformis* chromosome are to be cloned. By using the *Bacillus subtilis* chromosomal map as model for the *Bacillus licheniformis* chromosome, it is possible to amplify specific genome regions of *Bacillus licheniformis* where a certain gene of interest are predicted to be located according to the *Bacillus subtilis* chromosomal map. Flanking sequence tags to the region can be as far apart as 10–15 kb when long range PCR methods are employed. This method of PCR mapping was used for cloning several genes of specific interest that were not tagged in the primary shot-gun library.

Gene disrupting/deletion

FIG. 1 describes a method to make deletions at specific loci of the *Bacillus licheniformis* or *Bacillus clausii* chromosome utilizing the *Bacillus licheniformis* or *Bacillus clausii* GST sequences, respectively, described herein.

A plasmid denoted "Deletion plasmid" is constructed by cloning two PCR amplified fragments from given gene X region denoted "Y" on a temperature-sensitive parent plasmid. The PCR fragments are denoted "A" and "B", wherein A comprises the 5'-part of the Y fragment; and B comprises the 3'-part of DNA fragment Y. The deleted Y DNA between A and B may be varied depending of the size of the Y fragment. The size of the A and B fragment should be larger than 100 basepairs. A spectinomycin resistance gene flanked by resolvase (res) sites is introduced between fragments "A" and "B" on the plasmid. This spectinomycin resistance gene can later be removed by resolvase-mediated site-specific recombination.

The disrupting/deletion is transferred from the "Deletion plasmid" to the chromosome of a *Bacillus licheniformis* or

*Bacillus clausii* target strain by double homologous recombination via fragments "A" and "B", mediated by integration and excision of the temperature-sensitive plasmid. The resulting strain is denoted "Deletion strain".

The present invention is further described by the following examples, which should not be construed as limiting the scope of the invention.

EXAMPLES

Chemicals used as buffers and substrates were commercial products of at least reagent grade.

Example 1

Construction of *Bacillus licheniformis* Library

*Bacillus licheniformis* ATCC 14580 was used as source of chromosomal DNA for constructing a library. Strain *E. coli* JJC 128F' araD139 Δ(ara-leu)7696 galE15 galK16 Δ(lac) X74 hsdr⁻ hsdm⁺ Str$^R$ F'[lacI$^q$ Δ(lacZ)M15 traD36] was used as a host to construct the genomic bank (Sorokin et al., 1996, *Microbiology* 142: 2005–2016).

Chromosomal DNA from *Bacillus licheniformis* ATCC 14580 was prepared as follows. *Bacillus licheniformis* strain ATCC 14580 was cultivated overnight at 37° C. in 125 ml shake flasks containing 25 ml of LB medium (Sambrook et al., Molecular Cloning: A Laboratory Manual, 2$^{nd}$ ed., Cold Spring Harbor Laboratory Press, N.Y., 1989). The cells were harvested and treated with 10 µg of lysozyme per ml of 50 mM Tris-HCl pH 8.0, 50 mM EDTA, 25% sucrose. SDS was then added to a final concentration of 0.5% followed by proteinase K to 100 µg/ml. The mixture was incubated at 50° C. for 4 hours, and then extracted three times with water-saturated phenol-chloroform (1:1 v/v) at pH 8.0. After precipitation with two volumes of ethanol in 0.3 M sodium acetate pH 4.8, the DNA was removed with a glass rod, washed in 70% ethanol, and stored at –20° C. in water at 100 µg/ml.

Plasmid pSGMU2 (Errington, 1986, *Journal of General Microbiology* 132: 2953–2961) was used as a vector for constructing the chromosomal bank. pSGMU2 was isolated as follows. Cells of *E. coli* JJC 128F', containing pSGMU2, were grown in 4 ml of 2× YT medium (Sambrook et al., 1989, supra) overnight. The cell pellet was resuspended in 100 µl of 50 mM glucose, 25 mM Tris/HCl pH 8.0, 10 mM EDTA solution (TE). Then a 100 µl volume of 10 mg/ml lysozyme was added. After 30 minutes 400 µl of 1% (w/v) SDS, 0.2 M NaOH were added. After cell lysis, 300 µl of 3 M sodium acetate pH 4.8, was added. After 30 minutes on ice, tubes were centrifuged at 13,000 rpm (5000× g) for 1 hour and 0.6 ml of isopropanol was added to the supernatant. After centrifugation as before for 10 minutes, the pellet was dissolved in 100 µl of water and then 100 µl of 9 M lithium chloride was added. After 1 hour at –20° C., tubes were centrifuged at 13,000 rpm (5000× g) for 10 minutes. The pellet was discarded and 500 µl of absolute ethanol was added to the supernatant. The pellet was redissolved in 300 µl of 0.3 M sodium acetate pH 4.8 and precipitated again. After dissolving the pellet in 100 µl of TE, the plasmid preparation was sufficiently pure for fluorescent sequencing.

A library with insert sizes in the range from 1 to 2 kb, was constructed by using pSGMU2. A 20 µg quantity of *Bacillus licheniformis* chromosomal DNA was sonicated using a VibraCell 72408 sonicator (Bioblock Scientific) at minimal amplitude for 10 seconds. The sonication was performed in 300 µl of Bal31 buffer (600 mM NaCl, 20 mM Tris-HCl pH 8.0, 12 mM CaCl$_2$, 12 mM MgCl$_2$, 1 mM EDTA) in a 1.5 ml Eppendorf tube. After sonication the chromosomal DNA was treated with Bal31 exonuclease (New England Biolabs, Inc., Beverly, Mass.) for 5 minutes at 25° C. After water-saturated phenol extraction and ethanol precipitation the DNA was treated by Klenow fragment of DNA polymerase I under the following conditions: 10 mM Tris HCl pH 7.6, 10 mM MgCl$_2$, 0.2 mM each DNTP, at 37° C. for 1 hour. After water-saturated phenol extraction and ethanol precipitation, the DNA was ligated with SmaI-digested pSGMU2 and treated with bacterial alkaline phosphatase. The ligation was performed in 10 mM Tris HCl pH 7.6, 10 MM MgCl$_2$, 1 mM DTT, 1 mM ATP at 10° C. for 6 hours. DNA from the ligation mixture was precipitated with ethanol in the presence of 1 mM glycogen at –20° C.

The DNA was then electroporated into *E. coli* JJC128F' cells using 2.5 kV and 25 mF. The cells were plated on LB agar medium containing 50 µg/ml of ampicillin for selection of transformants and 20 µg/ml of 5-bromo-4-chloro-3-indolyl beta-D-galactopyranoside (XGAL) and 20 µg/ml of isopropyl beta-D-thiogalactopyranoside (IPTG) for selection of inserts. The ratio of white to blue colonies in a successful experiment was 4 to 1. A total of 25.244 plasmids were extracted from the white colonies and were sequenced by forward (M13-21) primer and 877 plasmids by reverse (M13RP1) primer using a Perkin-Elmer Applied Biosystems Model 377 XL Automatic DNA Sequencer, Perkin-Elmer Applied Biosystems, Inc., Foster City, Calif.) with successful sequencing rate of about 90%. The sequencing produced a total of 13.227.856 bases. The total accumulated nonredundant contig length was 3.723.871 basepairs in 1.239 contigs randomly distributed over the chromosome.

Oligonucleotides were synthesized using a DNA Synthesizer "Oligo 1000" (Beckman-Coulter, Fullerton, Calif.). Primers used for Long Accurate PCR were 20–22-mers, chosen to contain 12 GC-bases.

Plasmid DNA for sequencing was prepared as described above. PCR products used for sequencing with dye terminators were purified by the Wizard™ PCR Preps kit (Promega, Madison, Wis.) or agarose gel electrophoresis. Forward and reverse PCR sequencing was performed using BigDye terminator Cycle Sequencing Ready Reaction Kit (Perkin-Elmer Applied Biosystems, Inc., Foster City, Calif.) and a "Perkin Elmer" 9600 thermal cycler or the "Catalyst" station (Perkin-Elmer Applied Biosystems, Inc., Foster City, Calif.). The fragment separation was conducted using an Applied Biosystems Model 377 XL Automatic DNA Sequencer.

The Long Accurate PCR reaction (50 µl) contained the following components as described by Sorokin et al. (1996, *Genome Research* 6: 448–453): 20 mM Tricine, pH 8.7; 85 mM potassium acetate; 1 mM magnesium acetate; 8% glycerol; 2% dimethylsulfoxide; 0.2 mM each dNTP; 0.2 µM each primer; 0.1 µg chromosomal DNA; 2 U rTth (Perkin-Elmer Applied Biosystems, Inc., Foster City, Calif.); and 0.05 U of Vent polymerase (New England Biolabs, Inc., Beverly, Mass.). The Long Accurate PCR used the following cycling conditions: One cycle at 94° C. for 5 minutes; 12 cycles of 10 second melting at 94° C., and 12 minutes annealing-polymerisation-repair at 68° C., and 24 cycles with increasing the extension time 15 seconds for each cycle.

The overall results are summarized in Table 1.

TABLE 1

Summary of whole-genome random clone sequencing of
Bacillus licheniformis ATCC 14580

| | |
|---|---|
| Successful sequencing reactions | 22,468 |
| Total contig length (bp) | 3,723,871 |
| Number of contigs | 1,239 |
| Average contig length (bp) | 3,006 |

Example 2

DNA Sequencing and Analysis of Nucleotide Sequence Data of the *Bacillus licheniformis* GST Libraries Nucleotide sequence data were scrutinized for quality, and samples giving improper spacing or ambiguity levels exceeding 2% were discarded or re-run. Vector sequences were removed with the crossmatch program from the Phred/Phrap package (Ewing and Green, 1998, *Genome Research* 8: 186–194). The sequences were assembled with Phrap also from the Phred/Phrap package.

Annotation of a gene means assignment of a function to a given sequence. The protein encoded genes were found and annotated the following way: The assembled sequences were searched with BLASTX (Pearson and Lipman, 1988, *Proceedings of the National Academy of Science USA* 85: 2444–2448; Pearson, 1990, *Methods in Enzymology* 183: 63–98) against a customized database consisting of protein sequences from SWISSPROT, SWISSPROTNEW, TREMBL, TREMBLNEW, REMTREMBL, PDB and GeneSeqP. The matrix used was BL50. The start and stop position of each hit and the score of the hit where temporarily marked in the sequence. All open reading frames starting with ATG, GTG or TTG where temporarily marked with the start and stop position and a score. The score of the ORF was calculated as 0.5 times the length of the ORF for ORF starting with ATG and 0.25 times the length of the ORF for ORFs starting with GTG or TTG. A non overlapping set of regions with maximal score larger than 100 was found from the temporarily marked sequence. Each region represents a gene. The best hit for each gene is shown in Appendix 1. Functional category assignment was done by fastx homology search against clusters of orthologous genes from ncbi. In Appendix 1, the assignment to a particular functional category is represented by a single letter. "C" means energy production and conversion. "D" means cell division and chromosome partitioning. "E" means amino acid transport and metabolism. "F" means nucleotide transport and metabolism. "G" means carbohydrate transport and metabolism. "H" means coenzyme metabolism. "I" means lipid metabolism. "J" means translation, ribosomal structure and biogenesis. "K" means transcription. "L" means DNA replication, recombination and repair. "M" means cell envelope biogenesis, outer membrane. "N" means cell motility and secretion. "O" means posttranslational modification, protein turnover, chaperones. "P" means inorganic ion transport and metabolism. "Q" means secondary metabolites biosynthesis, transport and catabolism. "R" means general function prediction only. "S" means function unknown. "T" means signal transduction mechanisms.

Structural RNA encoding genes were found by homology (blastn) to tRNA and rRNA genes in *Bacillus subtilis*.

The *Bacillus licheniformis* GST sequences are designated SEQ ID NOs. 1–4448. An "N" in a nucleic acid sequence means that the nucleotide is an A, C, G, or T.

Example 3

Construction of *Bacillus clausii* Library

*Bacillus clausii* NCIB 10309 (National Collections of Industrial and Marine Bacteria Ltd., 23 St. Machar Drive, Aberdeen, Scotland, UK AB2 1RY) was used as source of chromosomal DNA for constructing a library. Strain *E. coli* JJC 128F' araD139 Δ(ara-leu)7696 galE15 galK16 Δ(lac) X74 hsdr⁻ hsdm⁺ Str$^R$ F'[lacI$^q$ Δ(lacZ)M15 traD36] was used as a host to construct the genomic bank (Sorokin et al., 1996, *Microbiology* 142: 2005–2016).

Chromosomal DNA from *Bacillus clausii* NCIB 10309 was prepared as follows. *Bacillus clausii* strain NCIB 10309 was cultivated overnight at 37° C. in 125 ml shake flasks containing 25 ml of LB medium (Sambrook et al., Molecular Cloning: A Laboratory Manual, 2$^{nd}$ ed., Cold Spring Harbor Laboratory Press, N.Y., 1989). The cells were harvested and treated with 10 µg of lysozyme per ml of 50 mM Tris-HCl pH 8.0, 50 mM EDTA, 25% sucrose. SDS was then added to a final concentration of 0.5% followed by proteinase K to 100 µg/ml. The mixture was incubated at 50° C. for 4 hours, and then extracted three times with water-saturated phenol-chloroform (1:1 v/v) at pH 8.0. After precipitation with two volumes of ethanol in 0.3 M sodium acetate pH 4.8, the DNA was removed with a glass rod, washed in 70% ethanol, and stored at −20° C. in water at 100 µg/ml.

Plasmid pSGMU2 (Errington, 1986, *Journal of General Microbiology* 132: 2953–2961) was used as a vector for constructing the chromosomal bank. pSGMU2 was isolated as follows. Cells of *E. coli* JJC 128F', containing pSGMU2, were grown in 4 ml of 2× YT medium (Sambrook et al., 1989, supra) overnight. The cell pellet was resuspended in 100 µl of 50 mM glucose, 25 mM Tris/HCl pH 8.0, 10 mM EDTA solution (TE). Then a 100 µl volume of 10 mg/ml lysozyme was added. After 30 minutes 400 µl of 1% (w/v) SDS, 0.2 M NaOH were added. After cell lysis, 300 µl of 3 M sodium acetate pH 4.8, was added. After 30 minutes on ice, tubes were centrifuged at 13,000 rpm (5000× g) for 1 hour and 0.6 ml of isopropanol was added to the supernatant. After centrifugation as before for 10 minutes, the pellet was dissolved in 100 µl of water and then 100 µl of 9 M lithium chloride was added. After 1 hour at −20° C., tubes were centrifuged at 13,000 rpm (5000× g) for 10 minutes. The pellet was discarded and 500 µl of absolute ethanol was added to the supernatant. The pellet was redissolved in 300 µl of 0.3 M sodium acetate pH 4.8 and precipitated again. After dissolving the pellet in 100 µl of TE, the plasmid preparation was sufficiently pure for fluorescent sequencing.

A library with insert sizes in the range from 1 to 2 kb, was constructed by using pSGMU2. A 20 µg quantity of *Bacillus clausii* chromosomal DNA was sonicated using a VibraCell 72408 sonicator (Bioblock Scientific) at minimal amplitude for 10 seconds. The sonication was performed in 300 µl of Bal31 buffer (600 mM NaCl, 20 mM Tris-HCl pH 8.0, 12 mM CaCl$_2$, 12 mM MgCl$_2$, 1 mM EDTA) in a 1.5 ml Eppendorf tube. After sonication the chromosomal DNA was treated with Bal31 exonuclease (New England Biolabs, Inc., Beverly, Mass.) for 5 minutes at 25° C. After water-saturated phenol extraction and ethanol precipitation the DNA was treated by Klenow fragment of DNA polymerase I under the following conditions: 10 mM Tris HCl pH 7.6, 10 mM MgCl$_2$, 0.2 mM each dNTP, at 37° C. for 1 hour. After water-saturated phenol extraction and ethanol precipitation, the DNA was ligated with SmaI-digested pSGMU2 and treated with bacterial alkaline phosphatase. The ligation was performed in 10 mM Tris HCl pH 7.6, 10 mM MgCl$_2$, 1 mM DTT, 1 mM ATP at 10° C. for 6 hours. DNA from the ligation mixture was precipitated with ethanol in the presence of 1 mM glycogen at −20° C.

The DNA was then electroporated into *E. coli* JJC128F' cells using 2.5 kV and 25 mF. The cells were plated on LB agar medium containing 50 μg/ml of ampicillin for selection of transformants and 20 μg/ml of 5-bromo-4-chloro-3-indolyl beta-D-galactopyranoside (XGAL) and 20 μg/ml of isopropyl beta-D-thiogalactopyranoside (IPTG) for selection of inserts. The ratio of white to blue colonies in a successful experiment was 4 to 1. A total of 6.554 plasmids were extracted from the white colonies and were sequenced by forward (M13-21) primer using a Perkin-Elmer Applied Biosystems Model 377 XL Automatic DNA Sequencer, Perkin-Elmer Applied Biosystems, Inc., Foster City, Calif.) with successful sequencing rate of about 90%. The sequencing produced 3.191.401 bp. The total accumulated nonredundant contig length was 2.022.840 bp in 2.232 contigs randomly distributed over the chromosome.

Oligonucleotides were synthesized using a DNA Synthesizer "Oligo 1000" (Beckman-Coulter, Fullerton, Calif.). Primers used for Long Accurate PCR were 20–22-mers, chosen to contain 12 GC-bases.

The overall results are summarized in Table 2.

TABLE 2

Summary of whole-genome random clone sequencing of *Bacillus clausii*

| | |
|---|---:|
| Successful sequencing reactions | 5,899 |
| Total characters in gel readings (bp) | 3,191,401 |
| Average gel read length (bp) | 541 |
| Total contig length (bp) | 2,022,840 |
| Number of contigs | 2,232 |

Example 4

Analysis of Nucleotide Sequence Data of the *Bacillus clausii* GST Libraries

Nucleotide sequence data were scrutinized for quality, and samples giving improper spacing or ambiguity levels exceeding 2% were discarded or re-run. Vector sequences were removed with the crossmatch program from the Phred/Phrap package (Ewing and Green, 1998, *Genome Research* 8: 186–194). The sequences were assembled with Phrap also from the Phred/Phrap package.

Annotation of a gene means assignment of a function to a given sequence. The protein encoded genes were found and annotated the following way: The assembled sequences were searched with BLASTX (Pearson and Lipman, 1988, *Proceedings of the National Academy of Science USA* 85: 2444–2448; Pearson, 1990, *Methods in Enzymology* 183: 63–98) against a customized database consisting of protein sequences from SWISSPROT, SWISSPROINEW, TREMBL, TREMBLNEW, REMTREMBL, PDB and GeneSeqP. The matrix used was BL50. The start and stop position of each hit and the score of the hit where temporarily marked in the sequence. All open reading frames starting with ATG, GTG or TTG where temporarily marked with the start and stop position and a score. The score of the ORF was calculated as 0.5 times the length of the ORF for ORF starting with ATG and 0.25 times the length of the ORF for ORFs starting with GTG or TTG. A non overlapping set of regions with maximal score larger than 100 was found from the temporarily marked sequence. Each region represents a gene. The best hit for each gene is shown in Appendix 2. Functional category assignment was done by fastx homology search against clusters of orthologous genes from ncbi. In Appendix 2, the assignment to a particular functional category is represented by a single letter. "C" means energy production and conversion. "D" means cell division and chromosome partitioning. "E" means amino acid transport and metabolism. "F" means nucleotide transport and metabolism. "G" means carbohydrate transport and metabolism. "H" means coenzyme metabolism. "I" means lipid metabolism. "J" means translation, ribosomal structure and biogenesis. "K" means transcription. "L" means DNA replication, recombination and repair. "M" means cell envelope biogenesis, outer membrane. "N" means cell motility and secretion. "O" means posttranslational modification, protein turnover, chaperones. "P" means inorganic ion transport and metabolism. "Q" means secondary metabolites biosynthesis, transport and catabolism. "R" means general function prediction only. "S" means function unknown. "T" means signal transduction mechanisms.

Structural RNA encoding genes were found by homology (blastn) to tRNA and rRNA genes in *Bacillus subtilis*.

The *Bacillus clausii* GST sequences, which encode proteins are designated SEQ ID NOs. 4449–8481. An "N" in a nucleic acid sequence means that the nucleotide is an A, C, G, or T.

Example 5

DNA Microarrays

Details of the construction of a typical microarrayer can be found on the world wide web site of Professor Patrick Brown of Stanford University at the following URL: http://cmgm.stanford.edu/pbrown/mguide/index.html. Scanners and computer software for analysis of DNA microarrays are available from several commercial sources such as General Scanning Inc. (Watertown, Mass.), or Axon Instruments (Foster City, Calif.).

Individual *Bacillus* GST clones were purified as plasmid minipreps using Qiagen Biorobot 9600 (QIAGEN, Inc., Valencia, Calif.). The plasmid minipreps were precipitated with isopropanol, aliquoted and stored as described on the web site of Professor Patrick Brown of Stanford University.

The amplified GST targets prepared in this manner were spotted individually onto polylysine-coated glass slides using a microarrayer device as described by DeRisi et al. (1997, *Science* 278: 680–686). The microarrays were probed with fluorescently labeled cDNA prepared by reverse transcription of polyadenylated mRNA (DeRisi et al., 1997, supra) extracted from *Bacillus* cells (Example 2 or Example 4). Conditions for pretreatment of the microarrays, hybridization and washing conditions have been described previously (DeRisi et al., 1997, supra).

To increase the reliability with which changes in expression levels could be discerned, probes prepared from induced or treated cells were labeled with the red fluorescent dye, Cy5 (Amersham Corporation, Arlington Heights, Ill.), and mixed with probes from uninduced, untreated, or "reference" cells were labeled with a green fluorescent dye, Cy3 (Amersham Corporation, Arlington Heights, Ill.). The relative ratio of fluorescence intensity measured for the Cy3 and Cy5 fluorophors corresponding to each GST target in the arrays was determined using ScanAlyze software. This provides a reliable measure of the relative abundance of the corresponding mRNA in the two cell populations (e.g., treated cells versus reference cells).

The invention described and claimed herein is not to be limited in scope by the specific embodiments herein disclosed, since these embodiments are intended as illustrations of several aspects of the invention. Any equivalent embodiments are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control.

Various references are cited herein, the disclosures of which are incorporated by reference in their entireties.

Appendix 1: *Bacillus licheniformis* annotation and divisions into functional categories
Information storage and processing
J 1154–1309 Translation, ribosomal structure and biogenesis
K 1310–1521 Transcription
L 1522–1665 DNA replication, recombination and repair
Cellular processes
D 174–218 Cell division and chromosome partitioning
O 1925–2015 Posttranslational modification, protein turnover, chaperones
M 1666–1835 Cell envelope biogenesis, outer membrane
N 1836–1924 Cell motility and secretion
P 2016–2165 Inorganic ion transport and metabolism
T 4337–4360 Signal transduction mechanisms
Metabolism
C 1–173 Energy production and conversion
G 642–967 Carbohydrate transport and metabolism
E 219–554 Amino acid transport and metabolism
F 555–641 Nucleotide transport and metabolism
H 968–1073 Coenzyme metabolism
I 1074–1153 Lipid metabolism
Q 2166–2287 Secondary metabolites biosynthesis, transport and catabolism
Structural RNA
Z 4361–4448 tRNA and rRNA
Functional category not assigned
R 2288–2621 Functional category not assigned
S 2622–4236 Functional category not assigned

| ID | | Description |
|---|---|---|
| ID0001 | C | NITRATE REDUCTASE ALPHA CHAIN (EC 1.7.99.4). |
| ID0002 | C | PYRUVATE CARBOXYLASE (EC 6.4.1.1). |
| ID0003 | C | QUINOL OXIDASE POLYPEPTIDE I (EC 1.9.3.-) (QUINOL OXIDASE AA |
| ID0004 | C | NITRITE REDUCTASE [NAD(P)H] (EC 1.6.6.4). |
| ID0005 | C | HYPOTHETICAL 79.2 KDA PROTEIN IN ACDA 5' REGION. |
| ID0006 | C | FORMATE DEHYDROGENASE ALPHA CHAIN. |
| ID0007 | C | 2-OXOGLUTARATE DEHYDROGENASE E1 COMPONENT (EC 1.2.4.2) (ALPH |
| ID0008 | C | FORMATE ACETYLTRANSFERASE. |
| ID0009 | C | PUTATIVE FORMATE DEHYDROGENASE. |
| ID0010 | C | 68% IDENTITY PROTEIN TO 1-PYRROLINE-5-CARBOXYLATE DEHYDROGEN |
| ID0011 | C | L-RIBULOKINASE (EC 2.7.1.16). |
| ID0012 | C | YVFW PROTEIN. |
| ID0013 | C | ATP SYNTHASE BETA CHAIN (EC 3.6.1.34) (VEGETATIVE PROTEIN 31 |
| ID0014 | C | CYTOCHROME CAA3 OXIDASE (SUBUNIT I). |
| ID0015 | C | ATP SYNTHASE ALPHA CHAIN (EC 3.6.1.34) (VEGETATIVE PROTEIN 1 |
| ID0016 | C | PTS SYSTEM, MANNITOL-SPECIFIC IIABC COMPONENT (EIIABC-MTL) ( |
| ID0017 | C | L-LACTATE PERMEASE. |
| ID0018 | C | FUMARATE HYDRATASE, CLASS-II (EC 4.2.1.2) (FUMRASE). |
| ID0019 | C | AEROBIC GLYCEROL-3-PHOSPHATE DEHYDROGENASE (EC 1.1.99.5). |
| ID0020 | C | ALCOHOL-ACETALDEHYDE DEHYDROGENASE. |
| ID0021 | C | CitM protein. |
| ID0022 | C | ISOCITRATE DEHYDROGENASE. |
| ID0023 | C | ASSIMILATORY NITRATE REDUCTASE CATALYTIC SUBUNIT (EC 1.7.99. |
| ID0024 | C | HOMOLOGUE OF SUCCINATE SEMIALDEHYDE DEHYDROGENASE GABD OF E. |
| ID0025 | C | HYPOTHETICAL 50.9 KDA PROTEIN. |
| ID0026 | C | PROTON GLUTAMATE SYMPORT PROTEIN (GLUTAMATE-ASPARTATE CARRIE |
| ID0027 | C | NADP-DEPENDENT ALDEHYDE DEHYDROGENASE (EC 1.2.1.3). |
| ID0028 | C | PROBABLE NADH-DEPENDENT BUTANOL DEHYDROGENASE 1 (EC 1.1.1.-) |
| ID0029 | C | NADH DEHYDROGENASE-LIKE PROTEIN. |
| ID0030 | C | HYPOTHETICAL 47.8 KDA PROTEIN. |
| ID0031 | C | PROBABLE MALATE OXIDOREDUCTASE [NAD] (EC 1.1.1.38) (MALIC EN |
| ID0032 | C | HYPOTHETICAL 54.6 KDA PROTEIN. |
| ID0033 | C | HYPOTHETICAL NA+/H+ ANTIPORTER IN ANSB-SPOIIM INTERGENIC REG |
| ID0034 | C | *Staphylococcus aureus* mutant P10B2 virulence gene product. |
| ID0035 | C | CYTOCHROME D UBIQUINOL OXIDASE SUBUNIT I (EC 1.10.3.-). |
| ID0036 | C | SUCCINYL-COA SYNTHETASE BETA CHAIN (EC 6.2.1.5) (SCS-ALPHA) ( |
| ID0037 | C | CITRATE SYNTHASE II (EC 4.1.3.7) |
| ID0038 | C | DIHYDROLIPOAMIDE DEHYDROGENASE COMPONENT OF PYRUVATEDEHYDROG |
| ID0039 | C | METHYLMALONATE-SEMIALDEHYDE DEHYDROGENASE. |
| ID0040 | C | HYPOTHETICAL 44.9 KDA PROTEIN. |
| ID0041 | C | PROBABLE NAD-DEPENDENT MALIC ENZYME (EC 1.1.1.38) (NAD-ME). |
| ID0042 | C | ASSIMILATORY NITRATE REDUCTASE ELECTRON TRANSFER SUBUNIT. |
| ID0043 | C | PUTATIVE BUTYRATE KINASE (EC 2.7.2.7) (BK). |
| ID0044 | C | HYPOTHETICAL 37.1 KDA PROTEIN IN ARA-LACA INTERGENIC REGION. |
| ID0045 | C | 2-OXOISOVALERATE DEHYDROGENASE ALPHA SUBUNIT (EC 1.2.4.4) (B |
| ID0046 | C | PYRUVATE DEHYDROGENASE E2 (DIHYDROLIPOAMIDE ACETYLTRANSFERAS |
| ID0047 | C | IOLS PROTEIN (VEGETATIVE PROTEIN 147) (VEG147). |
| ID0048 | C | 2-OXOISOVALERATE DEHYDROGENASE BETA SUBUNIT (EC 1.2.4.4) (BR |
| ID0049 | C | GLYCEROL KINASE (EC 2.7.1.30) (ATP:GLYCEROL 3-PHOSPHOTRANSFE |
| ID0050 | C | CYTOCHROME C OXIDASE POLYPEPTIDE II PRECURSOR (EC 1.9.3.1) ( |
| ID0051 | C | SUCCINYL-COA SYNTHETASE (ALPHA SUBUNIT). |
| ID0052 | C | PROBABLE NADH-DEPENDENT FLAVIN OXIDOREDUCTASE YQJM (EC 1.-.- |

-continued

| | | |
|---|---|---|
| ID0053 | C | HOMOLOGOUS TO CITRATE-SODIUM SYMPORT. |
| ID0054 | C | YFMT. |
| ID0055 | C | ELECTRON TRANSFER FLAVOPROTEIN ALPHA-SUBUNIT (ALPHA-ETF) (EL |
| ID0056 | C | MALATE DEHYDROGENASE (EC 1.1.1.37) (VEGETATIVE PROTEIN 69) ( |
| ID0057 | C | SUCCINATE DEHYDROGENASE FLAVOPROTEIN SUBUNIT (EC 1.3.99.1). |
| ID0058 | C | *Corynebacterium thermoaminogenes* acn protein. |
| ID0059 | C | PYRUVATE DEHYDROGENASE E1 COMPONENT, ALPHA SUBUBNIT (EC 1.2.4 |
| ID0060 | C | PYRUVATE DEHYDROGENASE BETA SUBUNIT PDHB (EC 1.2.4.1). |
| ID0061 | C | PROTON/SODIUM-GLUTAMATE SYMPORT PROTEIN (GLUTAMATE-ASPARTATE |
| ID0062 | C | GLYCEROL-3-PHOSPHATE DEHYDROGENASE [NAD(P)+] (EC 1.1.1.94) ( |
| ID0063 | C | SUCCINATE DEHYDROGENASE IRON-SULFUR PROTEIN (EC 1.3.99.1). |
| ID0064 | C | LIPOAMIDE ACYLTRANSFERASE COMPONENT OF BRANCHED-CHAIN ALPHA- |
| ID0065 | C | QUINOL OXIDASE POLYPEPTIDE II PRECURSOR (EC 1.9.3.-) (QUINOL |
| ID0066 | C | PHOSPHATE ACETYLTRANSFERASE (EC 2.3.1.8) (PHOSPHOTRANSACETYL |
| ID0067 | C | *Bacillus subtilis* ypgA clade protein. |
| ID0068 | C | H(+)/SODIUM-GLUTAMATE SYMPORTER. |
| ID0069 | C | ACETATE KINASE (EC 2.7.2.1) (ACETOKINASE). |
| ID0070 | C | HYPOTHETICAL 49.2 KDA PROTEIN. |
| ID0071 | C | PUTATIVE L-LACTATE PERMEASE YVFH. |
| ID0072 | C | PUTATIVE MALATE DEHYDROGENASE (EC 1.1.1.37). |
| ID0073 | C | L-LACTATE DEHYDROGENASE (EC 1.1.1.27). |
| ID0074 | C | CITRATE SYNTHASE I (EC 4.1.3.7). |
| ID0075 | C | PUTATIVE MALOLACTIC ENZYME (EC 1.-.-.-) [INCLUDES: MALIC ENZ |
| ID0076 | C | FDHD PROTEIN HOMOLOG. |
| ID0077 | C | HYPOTHETICAL 37.6 KDA PROTEIN. |
| ID0078 | C | HYPOTHETICAL 35.0 KDA PROTEIN IN RAPJ-OPUAA INTERGENIC REGIO |
| ID0079 | C | NITRATE REDUCTASE GAMMA CHAIN (EC 1.7.99.4). |
| ID0080 | C | HYPOTHETICAL 36.6 KDA PROTEIN IN QOXD-VPR INTERGENIC REGION. |
| ID0081 | C | HYPOTHETICAL 49.0 KDA PROTEIN. |
| ID0082 | C | MALATE SYNTHASE (EC 4.1.3.2). |
| ID0083 | C | YTHA. |
| ID0084 | C | *Glycerol dehydrogenase.* |
| ID0085 | C | FERRIC LEGHEMOGLOBIN REDUCTASE-2 PRECURSOR. |
| ID0086 | C | OXIDOREDUCTASE, N5, N10-METHYLENETETRAHYDROMETHANOPTERINREDUC |
| ID0087 | C | NITRO/FLAVIN REDUCTASE (EC 1.-.-.-). |
| ID0088 | C | *Corynebacterium thermoaminogenes* acn protein. |
| ID0089 | C | HYPOTHETICAL 48.5 KDA PROTEIN. |
| ID0090 | C | ISOCITRATE LYASE (EC 4.1.3.1). |
| ID0091 | C | ARABINOSE OPERON PROTEIN ARAM. |
| ID0092 | C | HYPOTHETICAL 48.1 KDA PROTEIN. |
| ID0093 | C | PHOSPHOENOLPYRUVATE CARBOXYKINASE. |
| ID0094 | C | HMP (FLAVOHEMOGLOBIN). |
| ID0095 | C | ATP SYNTHASE A CHAIN (EC 3.6.1.34) (PROTEIN 6) |
| ID0096 | C | GLYCEROPHOSPHORYL DIESTER PHOSPHODIESTERASE (EC 3.1.4.46) (GL |
| ID0097 | C | PUTATIVE MALOLACTIC ENZYME (EC 1.-.-.-) [INCLUDES: MALIC ENZ |
| ID0098 | C | HYPOTHETICAL 27.9 KDA PROTEIN IN PHRC-GDH INTERGENIC REGION. |
| ID0099 | C | FDRA PROTEIN. |
| ID0100 | C | ATP SYNTHASE GAMMA CHAIN. |
| ID0101 | C | (PYRUVATE). |
| ID0102 | C | DIHYDROLIPOYL TRANSACETYLASE AND LIPOAMIDE DEHYDROGENASE OF |
| ID0103 | C | PROTOPORPHYRIN OXIDASE. |
| ID0104 | C | PROBABLE PHOSPHATE BUTYRYLTRANSFERASE (EC 2.3.1.19) (PHOSPHOT |
| ID0105 | C | BH1977 PROTEIN. |
| ID0106 | C | ASSIMILATORY NITRATE REDUCTASE ELECTRON TRANSFER SUBUNIT. |
| ID0107 | C | ACONITATE HYDRATASE (EC 4.2.1.3) (CITRATE HYDRO-LYASE) (ACON |
| ID0108 | C | *Arabidopsis aldehyde dehydrogenase* (ALDH)-1. |
| ID0109 | C | METHYLMALONATE-SEMIALDEHYDE DEHYDROGENASE (EC 1.2.1.27) (METH |
| ID0110 | C | PUTATIVE NAD(P)H NITROREDUCTASE YDFN (EC 1.-.-.-). |
| ID0111 | C | YTHB. |
| ID0112 | C | NIFU-LIKE PROTEIN. |
| ID0113 | C | ISOCITRATE LYASE. |
| ID0114 | C | ALDEHYDE DEHYDROGENASE (ALDHT) (EC 1.2.1.3). |
| ID0115 | C | PUTATIVE DEHYDROGENASE SUBUNIT. |
| ID0116 | C | ATTL. |
| ID0117 | C | YTHA. |
| ID0118 | C | PROBABLE NAD-DEPENDENT MALIC ENZYME (EC 1.1.1.38) (NAD-ME). |
| ID0119 | C | ORF starting with ATG of length 1209 |
| ID0120 | C | HYPOTHETICAL 27.0 KDA PROTEIN IN SPOQA-MMGA INTERGENIC REGIO |
| ID0121 | C | PHOSPHOENOLPYRUVATE CARBOXYKINASE (ATP) (EC 4.1.1.49). |
| ID0122 | C | CITRATE SYNTHASE-LIKE PROTEIN. |
| ID0123 | C | NITRATE REDUCTASE DELTA CHAIN (EC 1.7.99.4). |
| ID0124 | C | ORF starting with ATG of length 1167 |
| ID0125 | C | MALATE DEHYDROGENASE I (EC 1.1.1.37) (EC 1.1.1.82). |
| ID0126 | C | 2-OXOGLUTARATE DEHYDROGENASE (FRAGMENT). |
| ID0127 | C | HYPOTHETICAL OXIDOREDUCTASE IN CSTA-AHPC INTERGENIC REGION. |
| ID0128 | C | ORF starting with ATG of length 1134 |
| ID0129 | C | YFHC PROTEIN. |
| ID0130 | C | HYPOTHETICAL 49.2 KDA PROTEIN. |
| ID0131 | C | GLYCEROPHOSPHORYL DIESTER PHOSPHODIESTERASE. |

-continued

| ID0132 | C | PROBABLE ALDEHYDE DEHYDROGENASE YWDH (EC 1.2.1.3). |
| --- | --- | --- |
| ID0133 | C | ALCOHOL-ACETALDEHYDE DEHYDROGENASE. |
| ID0134 | C | ELECTRON TRANSFER FLAVOPROTEIN BETA-SUBUNIT (BETA-ETF) (ELEC |
| ID0135 | C | PROBABLE NADH-DEPENDENT FLAVIN OXIDOREDUCTASE YQIG (EC 1.-.- |
| ID0136 | C | CYTOCHROME OXIDASE SUBUNIT II. |
| ID0137 | C | ORF starting with ATG of length 854 |
| ID0138 | C | PUTATIVE NAD(P)H NITROREDUCTASE YFKO (EC 1.-.-.-). |
| ID0139 | C | PUTATIVE SECRETED HYDROLASE. |
| ID0140 | C | SA0799 PROTEIN. |
| ID0141 | C | PUTATIVE NAD(P)H NITROREDUCTASE 12C (EC 1.-.-.-) (VEGETATIVE |
| ID0142 | C | PUTATIVE ACYLPHOSPHATASE (EC 3.6.1.7) (ACYLPHOSPHATEPHOSPHOH |
| ID0143 | C | *Corynebacterium glutamicum* MCT protein SEQ ID NO: 544. |
| ID0144 | C | MANGANESE-DEPENDENT INORGANIC PYROPHOSPHATASE (EC 3.6.1.1) (P |
| ID0145 | C | FOF1-ATP SYNTHASE EPSILON SUBUNIT. |
| ID0146 | C | ORF starting with ATG of length 624 |
| ID0147 | C | ORF starting with ATG of length 615 |
| ID0148 | C | GLYCEROL-3-PHOSPHATE DEHYDROGENASE [NAD(P)+] (EC 1.1.1.94) ( |
| ID0149 | C | PUTATIVE FLAVODOXIN. |
| ID0150 | C | PPOBABLE FLAVODOXIN 2. |
| ID0151 | C | BH0367 PROTEIN. |
| ID0152 | C | ELECTRON TRANSFER FLAVOPROTEIN (BETA SUBUNIT). |
| ID0153 | C | ORF starting with ATG of length 555 |
| ID0154 | C | HYPOTHETICAL 17.0 KDA PROTEIN. |
| ID0155 | C | ATP SYNTHASE C CHAIN (EC 3.6.1.34) (LIPID-BINDING PROTEIN). |
| ID0156 | C | ATP SYNTHASE B CHAIN. |
| ID0157 | C | HYPOTHETICAL OXIDOREDUCTASE IN ANSR-BMRU INTERGENIC REGION. |
| ID0158 | C | ACETOIN DEHYDROGENASE (TPP-DEPENDENT) ALPHA CHAIN. |
| ID0159 | C | HYPOTHETICAL 45.4 KDA PROTEIN IN SSPB-PRSA INTERGENIC REGION |
| ID0160 | C | MENAQUINOL-CYTDCHROME C REDUCTASE CYTOCHROME B SUBUNIT. |
| ID0161 | C | ORF starting with ATG of length 399 |
| ID0162 | C | MENAQUINOL-CYTOCHROME C REDUCTASE CYTOCHROME B/C SUBUNIT. |
| ID0163 | C | ORF starting with ATG of length 330 |
| ID0164 | C | ORF starting with ATG of length 294 |
| ID0165 | C | ORF starting with ATG of length 225 |
| ID0166 | C | ORF starting with ATG of length 210 |
| ID0167 | C | HYPOTHETICAL 50.9 KDA PROTEIN. |
| ID0168 | CHR | YVCT PROTEIN. |
| ID0169 | CHR | 376AA LONG HYPOTHETICAL DEHYDROGENASE. |
| ID0170 | CP | YUFT PROTEIN. |
| ID0171 | CP | HYPOTHETICAL 52.1 KDA PROTEIN. |
| ID0172 | CP | NADH DEHYDROGENASE SUBUNIT 5 (EC 1.6.5.3) (NADH-UBIQUINONEOX |
| ID0173 | CR | ORF starting with ATG of length 803 |
| ID0174 | D | CHROMOSOME PARTITION PROTEIN SMC. |
| ID0175 | D | YUKA PROTEIN. |
| ID0176 | D | GLUCOSE INHIBITED DIVISION PROTEIN A. |
| ID0177 | D | YHAN PROTEIN. |
| ID0178 | D | STAGE III SPORULATION PROTEIN E. |
| ID0179 | D | STAGE V SPORULATION PROTEIN E. |
| ID0180 | D | CELL DIVISION PROTEIN FTSZ. |
| ID0181 | D | HYPOTHETICAL 53.5 KDA PROTEIN IN SPOIIE-HPT INTERGENIC REGIO |
| ID0182 | D | CELL DIVISION PROTEIN FTSA. |
| ID0183 | D | ROD SHAPE-DETERMINING PROTEIN MREB. |
| ID0184 | D | MREBH PROTEIN. |
| ID0185 | D | MRP PROTEIN HOMOLOG. |
| ID0186 | D | MREB-LIKE PROTEIN (MBL PROTEIN). |
| ID0187 | D | PROTEIN GID. |
| ID0188 | D | STAGE II SPORULATION PROTEIN D. |
| ID0189 | D | YTPT. |
| ID0190 | D | CELL DIVISIDN PROTEIN FTSX HOMOLOG. |
| ID0191 | D | SPOIIE PROTEIN. |
| ID0192 | D | STAGE V SPORULATION PROTEIN E. |
| ID0193 | D | ORF starting with ATG of length 1990 |
| ID0194 | D | HYPOTHETICAL 33.2 KDA PROTEIN IN FLHF-CHEB INTERGENIC REGION |
| ID0195 | D | CELL-DIVISION ATP-BINDING PROTEIN. |
| ID0196 | D | MINICELL-ASSOCIATED PROTEIN DIVIVA. |
| ID0197 | D | STAGE V SPORULATION PROTEIN E. |
| ID0198 | D | *Neisseria meningitidis* ORF 567 protein sequence SEQ ID NO: 16 |
| ID0199 | D | ORF starting with ATG of length 1410 |
| ID0200 | D | MAF PROTEIN. |
| ID0201 | D | SEPTUM SITE-DETERMINING PROTEIN MINC. |
| ID0202 | D | HYPOTHETICAL 43.3 KDA PROTEIN IN QOXD-VPR INTERGENIC REGION. |
| ID0203 | D | AMIDASE ENHANCER PRECURSOR (MODIFIER PROTEIN OF MAJOR AUTOLY |
| ID0204 | D | SEPTUM SITE-DETERMINING PROTEIN MIND (CELL DIVISION INHIBITO |
| ID0205 | D | HYPOTHETICAL 43.3 KDA PROTEIN IN QOXD-VPR INTERGENIC REGION. |
| ID0206 | D | CAPSULAR POLYSACCHARIDE BIOSYNTHESIS. |
| ID0207 | D | DIARRHEAL TOXIN. |
| ID0208 | D | HYPOTHETICAL 13.9 KDA PROTEIN. |
| ID0209 | D | HYPOTHETICAL PROTEIN HI1677. |
| ID0210 | D | CHROMOSOME PARTITION PROTEIN SMC. |

| | | -continued |
|---|---|---|
| ID0211 | D | HYDROXYPROLINE-RICH GLYCOPROTEIN DZ-HRGP PRECURSOR. |
| ID0212 | D | ORF starting with ATG of length 510 |
| ID0213 | D | ORF starting with ATG of length 477 |
| ID0214 | D | BH2986 PROTEIN. |
| ID0215 | D | ORF starting with ATG of length 417 |
| ID0216 | D | *Arabidopsis thaliana* protein fragment SEQ ID No: 42012. |
| ID0217 | D | HYPOTHETICAL 43.3 KDA PROTEIN IN QOXD-VPR INTERGENIC REGION. |
| ID0218 | D | ORF starting with ATG of length 273 |
| ID0219 | E | GLUTAMATE SYNTHASE [NADPH] LARGE CHAIN (EC 1.4.1.13) (NADPH- |
| ID0220 | E | 5-METHYLTETRAHYDROFOLATE S-HOMOCYSTEINE METHYLTRANSFERASE (EC |
| ID0221 | E | 5-METHYLTETRAHYDROPTEROYLTRIGLUTAMATE--HOMOCYSTEINE METHYLTR |
| ID0222 | E | ASPARAGINE SYNTHETASE [GLUTAMINE-HYDROLYZING] 3 (EC 6.3.5.4) |
| ID0223 | E | PERMEASE. |
| ID0224 | E | PROBABLE PEPTIDASE YUXL (EC 3.4.21.-). |
| ID0225 | E | PROBABLE GLYCINE DEHYDROGENASE [DECARBOXYLATING] SUBUNIT 2 (E |
| ID0226 | E | HYPOTHETICAL 54.1 KDA PROTEIN IN DEOD-ARGE INTERGENIC REGION |
| ID0227 | E | ASPARAGINE SYNTHETASE [GLUTAMINE-HYDROLYZING] 1 (EC 6.3.5.4) |
| ID0228 | E | ARGININOSUCCINATE LYASE (EC 4.3.2.1) (ARGINOSUCCINASE) (ASAL |
| ID0229 | E | YBGF PROTEIN. |
| ID0230 | E | PROBABLE GLYCINE DEHYDROGENASE [DECARBOXYLATING] SUBUNIT 1 (E |
| ID0231 | E | HYPOTHETICAL PROTEIN YWRD. |
| ID0232 | E | *Gamma glutamyl* transpeptidase. |
| ID0233 | E | YVBW PROTEIN. |
| ID0234 | E | PROBABLE ASPARTOKINASE (EC 2.7.2.4) (ASPARTATE KINASE). |
| ID0235 | E | HOMOSERINE DEHYDROGENASE (EC 1.1.1.3) (HDH). |
| ID0236 | E | YUSX PROTEIN. |
| ID0237 | E | AMINO-ACID PERMEASE ROCE. |
| ID0238 | E | PUTATIVE L-AMINO ACID OXIDASE PRECURSOR. |
| ID0239 | E | LEUCINE DEHYDROGENASE (EC 1.4.1.9) (LEUDH). |
| ID0240 | E | ACETYLORNITINE DEACETYLASE (YOKP). |
| ID0241 | E | TRYPTOPHAN SYNTHASE BETA CHAIN (EC 4.2.1.20). |
| ID0242 | E | ORNITHINE CARBAMOYLTRANSFERASE, CATABOLIC (EC 2.1.3.3) (OTCA |
| ID0243 | E | YKBA PROTEIN. |
| ID0244 | E | AMINOPEPTIDASE AMPS (EC 3.4.11.-). |
| ID0245 | E | ORNITHINE AMINOTRANSFERASE (EC 2.6.1.13). |
| ID0246 | E | CHORISMATE SYNTHASE (EC 4.6.1.4) (5-ENOLPYRUVYLSHIKIMATE-3-P |
| ID0247 | E | HYPOTHETICAL 39.7 KDA PROTEIN IN GLNQ-ANSR INTERGENIC REGION |
| ID0248 | E | AMINO ACID CARRIER PROTEIN ALST. |
| ID0249 | E | 2,4-DIAMINOBUTYRATE DECARBOXYLASE. |
| ID0250 | E | THREONINE SYNTHASE (EC 4.2.99.2). |
| ID0251 | E | HISTIDINOL DEHYDROGENASE (EC 1.1.1.23) (HDH). |
| ID0252 | E | CARBAMATE KINASE (EC 2.7.2.2). |
| ID0253 | E | 3-ISOPROPYLMALATE DEHYDRATASE LARGE SUBUNIT (EC 4.2.1.33) (IS |
| ID0254 | E | PEPTIDASE T (EC 3.4.11.-) (AMINOTRIPEPTIDASE) (TRIPEPTIDASE) |
| ID0255 | E | PREPHENATE DEHYDROGENASE (EC 1.3.1.12) (PDH) |
| ID0256 | E | NAD-SPECIFIC GLUTAMATE DEHYDROGENASE (EC 1.4.1.2) (NAD-GDH). |
| ID0257 | E | ARGININOSUCCINATE SYNTHASE (EC 6.3.4.5) (CITRULLINE--ASPARTA |
| ID0258 | E | YBGH PROTEIN. |
| ID0259 | E | YKVY PROTEIN. |
| ID0260 | E | PUTATIVE AMINOTRANSFERASE B (EC 2.6.1.-). |
| ID0261 | E | Peptide with glutamine synthetase activity. |
| ID0262 | E | YURG PROTEIN. |
| ID0263 | E | ARGININE DEIMINASE (EC 3.5.3.6) (ARGININE DIHYDROLASE). |
| ID0264 | E | THREONINE DEHYDRATASE (EC 4.2.1.16). |
| ID0265 | E | ASPARTOKINASE 2 (EC 2.7.2.4) (ASPARTOKINASE II) (ASPARTATE K |
| ID0266 | E | YDFO PROTEIN. |
| ID0267 | E | PUTATIVE PEPTIDASE IN GCVT-SPOIIIAA INTERGENIC REGION (EC 3. |
| ID0268 | E | PROBABLE AMINOMETHYLTRANSFERASE (EC 2.1.2.10) (GLYCINE CLEAV |
| ID0269 | E | 2,4-DIAMINOBUTYRATE DECARBOXYLASE. |
| ID0270 | E | HYPOTHETICAL TRANSPORT PROTEIN IN EXPZ-DINB INTERGENIC REGIO |
| ID0271 | E | PROBABLE CYSTEINE SYNTHASE (EC 4.2.99.8) (O-ACETYLSERINESULF |
| ID0272 | E | YJCJ PROTEIN. |
| ID0273 | E | PROBABLE 4-AMINOBUTYRATE AMINOTRANSFERASE (EC 2.6.1.19) (GAM |
| ID0274 | E | DNA FOR 25-36 DEGREE REGION CONTAINING THE AMYE-SRFA REGION, |
| ID0275 | E | PROJ. |
| ID0276 | E | *B. subtilis* AnsB homologue. |
| ID0277 | E | AROMATIC AMINO ACID TRANSPORTER. |
| ID0278 | E | YFLA PROTEIN. |
| ID0279 | E | GLYCINE OXIDASE (EC 1.5.3.-). |
| ID0280 | E | PUTATIVE INNER MEMBRANE PROTEIN. |
| ID0281 | E | HYDANTOIN UTILIZATTON PROTEIN A (ORF2). |
| ID0282 | E | HYPOTHETICAL 38.3 KDA PROTEIN IN PEPT-KATB INTERGENIC REGION |
| ID0283 | E | HYPOTHETICAL 58.2 KDA PROTEIN IN KDGT-XPT INTERGENIC REGION. |
| ID0284 | E | HYPOTHETICAL 43.4 KDA PROTEIN IN SODA-COMGA INTERGENIC REGIO |
| ID0285 | E | GLYCINE BETAINE TRANSPORT SYSTEM PERMEASE PROTEIN OPUAB. |
| ID0286 | E | TIORF195 PROTEIN. |
| ID0287 | E | HOMOSERINE KINASE (EC 2.7.1.39) (HK). |
| ID0288 | E | YRVO PROTEIN. |
| ID0289 | E | PZ-PEPTIDASE. |

-continued

| | | |
|---|---|---|
| ID0290 | E | TARTRATE DEHYDROGENASE. |
| ID0291 | E | CYSTATHIONINE GAMMA-LYASE. |
| ID0292 | E | ASPARTATE AMINOTRANSFERASE (EC 2.6.1.1) (TRANSAMINASE A) (AS |
| ID0293 | E | DIPEPTIDE TRANSPORT PROTEIN DPPA. |
| ID0294 | E | D-3-PHOSPHOGLYCERATE DEHYDROGENASE (EC 1.1.1.95) (PGDH). |
| ID0295 | E | PROBABLE AMINO-ACID ABC TRANSPORTER ATP-BINDING PROTEIN YCKI |
| ID0296 | E | YNGG PROTEIN. |
| ID0297 | E | PUTATIVE HYDANTOIN UTILIZATION PROTEIN. |
| ID0298 | E | HISTIDINOL-PHOSPHATE AMINOTRANSFERASE/TYROSINE AND PHENYLALA |
| ID0299 | E | BUSAA. |
| ID0300 | E | L-2,4-DIAMINOBUTYRATE DECARBOXYLASE (EC 4.1.1.). |
| ID0301 | E | ANTHRANILATE PHOSPHORIBOSYLTRANSFERASE (EC 2.4.2.18). |
| ID0302 | E | HISF PROTEIN (CYCLASE). |
| ID0303 | E | N-ACETYLORNITHINE AMINOTRANSFERASE (EC 2.6.1.11). |
| ID0304 | E | YURW PROTEIN. |
| ID0305 | E | 2-ISOPROPYLMALATE SYNTHASE (EC 4.1.3.12). |
| ID0306 | E | PROBABLE AMINO-ACID ABC TRANSPORTER EXTRACELLULAR BINDING PR |
| ID0307 | E | L-SERINE DEHYDRATASE ALPHA SUBUNIT. |
| ID0308 | E | *Bacillus subtilis* metalloprotease YurH. |
| ID0309 | E | PROBABLE ABC TRANSPORTER EXTRACELLULAR BINDING PROTEIN YCKB |
| ID0310 | E | YNBB. |
| ID0311 | E | HYPOTHETICAL 57.1 KDA PROTEIN. |
| ID0312 | E | LYSiNE DECARBOXYLASE (EC 4.1.1.18) (LDC). |
| ID0313 | E | HYPOTHETICAL 53.2 KDA PROTEIN IN XPAC-ABRB INTERGENIC REGION |
| ID0314 | E | OLIGOENDOPEPTIDASE F HOMOLOG (EC 3.4.24.-). |
| ID0315 | E | SERINE HYDROXYMETHYLTRANSFERASE (EC 2.1.2.1) (SERINE METHYLA |
| ID0316 | E | PUTATIVE AMINOTRANSFERASE A (EC 2.6.1.-). |
| ID0317 | E | ORF starting with ATG of length 2001 |
| ID0318 | E | GLYCINE BETAINE/CARNITINE/CHOLINE TRANSPORT SYSTEM PERMEASE |
| ID0319 | E | TRANSCARBAMYLASE |
| ID0320 | E | SHIKIMATE 5-DEHYDROGENASE (EC 1.1.1.25). |
| ID0321 | E | COME OPERON PROTEIN 4. |
| ID0322 | E | ORF starting with ATG of length 1971 |
| ID0323 | E | *Bacillus subtilis* Class II EPSPS. |
| ID0324 | E | PHOSPHORIBOSYLFORMIMINO-S-AMINOIMIDAZOLE CARBOXAMIDE RIBOTID |
| ID0325 | E | SERINE ACETYLTRANSFERASE (EC 2.3.1.30) (SAT). |
| ID0326 | E | GLYCINE BETAINE/CARNITINE/CHOLINE TRANSPORT SYSTEM PERMEASE |
| ID0327 | E | GLUTAMYL ENDOPEPTIDASE PRECURSOR (EC 3.4.21.19) (GLUTAMATE S |
| ID0328 | E | ASPARTOKINASE 1 (EC 2.7.2.4) (ASPARTOKINASE I) (ASPARTATE KI |
| ID0329 | E | BH0994 PROTEIN. |
| ID0330 | E | HYPOTHETICAL 40.8 KDA PROTEIN IN PCP-LMRB INTERGENIC REGION |
| ID0331 | E | HYPOTHETICAL 39.4 KDA OXIDOREDUCTASE IN HOM-MRGA INTERGENIC |
| ID0332 | E | CYSTEINE SYNTHASE. |
| ID0333 | E | 3-ISOPROPYLMALATE DEHYDRATASE SMALL SUBUNIT (EC 4.2.1.33) (IS |
| ID0334 | E | IMIDAZOLEGLYCEROL-PHOSPHATE DEHYDRATASE (EC 4.2.1.19) (IGPD) |
| ID0335 | E | ASPARTATE-SEMIALDEHYDE DEHYDROGENASE (EC 1.2.1.11) (ASA DEHY |
| ID0336 | E | YBEC PROTEIN (ORF3). |
| ID0337 | E | GLYCINE BETAINE-BINDING PROTEIN PRECURSOR. |
| ID0338 | E | ORF starting with ATG of length 1797 |
| ID0339 | E | 3-ISOPROPYLMALATE DEHYDROGENASE (EC 1.1.1.B5) (BETA-IPM DEHY |
| ID0340 | E | PROBABLE AMINO-ACID ABC TRANSPORTER PERMEASE PROTEIN YCKA. |
| ID0341 | E | ORF starting with ATG of length 1740 |
| ID0342 | E | GLUTAMATE SYNTHASE [NADPH] LARGE CHAIN (EC 1.4.1.13) (NADPH- |
| ID0343 | E | PYRROLINE-5-CARBOXYLATE REDUCTASE HOMOLOG 1. |
| ID0344 | E | ALANINE DEHYDROGENASE (EC 1.4.1.1) (STAGE V SPORULATION PROT |
| ID0345 | E | HISTIDINE BIOSYNTHESIS BIFUNCTIONAL PROTEIN HISIE [INCLUDES: |
| ID0346 | E | NIFS2. |
| ID0347 | E | ACETYLGLUTAMATE KINASE (EC 2.7.2.8) (NAG KINASE) (AGK) (N-AC |
| ID0348 | E | BH1629 PROTEIN. |
| ID0349 | E | HYPOTHETICAL 27.6 KDA LIPOPROTEIN IN NUCB-AROD INTERGENIC RE |
| ID0350 | E | HYPOTHETICAL TRANSPORT PROTEIN IN NDHF-CSGA INTERGENIC REGIO |
| ID0351 | E | BH0591 PROTEIN. |
| ID0352 | E | ALANINE DEHYDROGENASE (STAGE V SPORULATION PROTEIN N) (EC 1. |
| ID0353 | E | 5-METHYLTETRAHYDROFOLATE S-HOMOCYSTEINE METHYLTRANSFERASE (EC |
| ID0354 | E | BRANCH-CHAIN AMINO ACID TRANSPORTER. |
| ID0355 | E | HYPOTHETICAL 63.8 KDA PROTEIN IN SIPU-PBPC INTERGENIC REGION |
| ID0356 | E | *B. subtilis* hydrolase protein YTMA. |
| ID0357 | E | ATP PHOSPHORIBOSYLTRANSFERASE (EC 2.4.2.17). |
| ID0358 | E | AMINO ACID TRANSPORTER. |
| ID0359 | E | Alanine dehydrogenase amino acid sequence. |
| ID0360 | E | YEST PROTEIN. |
| ID0361 | E | HYPOTHETICAL 69.3 KDA PROTEIN. |
| ID0362 | E | 314AA LONG HYPOTHETICAL CARBAMATE KINASE (FUCOXANTHIN CHLORO |
| ID0363 | E | YEBA. |
| ID0364 | E | AMIDOTRANSFERASE HISH (EC 2.4.2.-). |
| ID0365 | E | PYRROLINE-5-CARBOXYLATE REDUCTASE HOMOLOG 2. |
| ID0366 | E | YCGF PROTEIN. |
| ID0367 | E | HYPOTHETICAL 28.9 KDA PROTEIN IN ILVA 3' REGION. |
| ID0368 | E | ORF starting with ATG of length 1512 |

-continued

| | | |
|---|---|---|
| ID0369 | E | GAMMA-GLUTAMYL PHOSPHATE REDUCTASE. |
| ID0370 | E | SPERMIDINE SYNTHASE (EC 2.5.1.16) (PUTRESCINE AMINOPROPYLTRA |
| ID0371 | E | AMINO ACID CARRIER PROTEIN. |
| ID0372 | E | AMINO ACID TRANSPORTER. |
| ID0373 | E | ORF starting with ATG of length 1404 |
| ID0374 | E | ORF starting with ATG of length 1404 |
| ID0375 | E | NADP-SPECIFIC GLUTAMATE DEHYDROGENASE (EC 1.4.1.4) (GLUTAMAT |
| ID0376 | E | PROBABLE AMINO-ACID ABC TRANSPORTER EXTRACELLULAR BINDING PR |
| ID0377 | E | HYPOTHETICAL 30.2 KDA PROTEIN IN HTRA-DPPA INTERGENIC REGION |
| ID0378 | E | YJCI PROTEIN. |
| ID0379 | E | DIAMINOBUTYRATE--PYRUVATE AMINOTRANSFERASE (EC 2.6.1.76) (L- |
| ID0380 | E | VALINE-PYRUVATE AMINOTRANSFERASE. |
| ID0381 | E | N-ACETYL-GAMMA-GLUTAMYL-PHOSPHATE REDUCTASE (EC 1.2.1.38) (A |
| ID0382 | E | BH3963 PROTEIN. |
| ID0383 | E | HYPOTHETICAL 23.6 KDA PROTEIN IN KIPR-PBPC INTERGENIC REGION |
| ID0384 | E | Region of tryptophan synthase A. |
| ID0385 | E | ARGININE DEIMINASE (EC 3.5.3.6) (ARGININE DIHYDROLASE). |
| ID0386 | E | PROBABLE L-SERINE DEHYDRATASE, BETA CHAIN (EC 4.2.1.13) (L-S |
| ID0387 | E | DIHYDRODIPICOLINATE REDUCTASE (EC 1.3.1.26) (DHPR). |
| ID0388 | E | RHBA DIAMINOBUTYRATE-PYRUVATE AMINOTRANSFERASE (EC2.6.1.46). |
| ID0389 | E | SHIKIMATE KINASE (EC 2.7.1.71) (SK). |
| ID0390 | E | *Neisseria gonorrheae* ORF 705 protein sequence SEQ ID NO: 2358 |
| ID0391 | E | YFLA PROTEIN. |
| ID0392 | E | HOMOSERINE O-SUCCINYLTRANSFERASE (EC 2.3.1.46) (HOMOSERINE O |
| ID0393 | E | SODIUM/ALANINE SYMPORTER. |
| ID0394 | E | 376AA LONG HYPOTHETICAL DEHYDROGENASE. |
| ID0395 | E | 3-ISOPROPYLMALATE DEHYDRATASE LARGE SUBUNIT (EC 4.2.1.33) (IS |
| ID0396 | E | HYPOTHETICAL 32.4 KDA PROTEIN. |
| ID0397 | E | ORF starting with ATG of length 1104 |
| ID0398 | E | THERMOSTABLE DIPEPTIDASE BDP. |
| ID0399 | E | 3-DEHYDROQUINATE DEHYDRATASE (EC 4.2.1.10) (3-DEHYDROQUINASE |
| ID0400 | E | ORF starting with ATG of length 1020 |
| ID0401 | E | UGPC. |
| ID0402 | E | HYPOTHETICAL 14.8 KDA PROTEIN IN TDK-PRFA INTERGENIC REGION. |
| ID0403 | E | HYPOTHETICAL 23.4 KDA PROTEIN IN AAPA-SIGV INTERGENIC REGION |
| ID0404 | E | *Arabidopsis thaliana* protein fragment SEQ ID NO: 18888. |
| ID0405 | E | ASPARAGINE SYNTHETASE [GLUTAMINE-HYDROLYZING] 1 (EC 6.3.5.4) |
| ID0406 | E | N-(5'-PHOSPHORIBOSYL) ANTHRANILATE ISOMERASE (EC 5.3.1.24) (P |
| ID0407 | E | INDOLE-3-GLYCEROL PHOSPHATE SYNTHASE. |
| ID0408 | E | AROA(G) PROTEIN [INCLUDES: PHOSPHO-2-DEHYDRO-3-DEOXTHEPTONAT |
| ID0409 | E | BH1818 PROTEIN. |
| ID0410 | E | D-ALANINE GLYCINE PERMEASE. |
| ID0411 | E | ORF starting with ATG of length 906 |
| ID0412 | E | YNDN PROTEIN. |
| ID0413 | E | PUTATIVE ASPARTATE AMINOTRANSFERASE (EC 2.6.1.1). |
| ID0414 | E | HYPOTHETICAL 53.2 KDA PROTEIN IN XPAC-ABRB INTERGENIC REGION |
| ID0415 | E | ORF starting with ATG of length 870 |
| ID0416 | E | HOMOSERINE KINASE (EC 2.7.1.39) (HK). |
| ID0417 | E | PROBABLE 3-DEHYDROQUINATE DEHYDRATASE (EC 4.2.1.10) (3-DEHYD |
| ID0418 | E | ASPARTOKINASE II ALPHA AND BETA SUBUNITS (EC 2.7.2.4). |
| ID0419 | E | 5-ENOLPYRUVYLSHIKMATE 3-P SYNTHASE (FRAGMENT). |
| ID0420 | E | HYPOTHETICAL 61.8 KDA PROTEIN IN GLNQ-ANSR INTERGENIC REGION |
| ID0421 | E | YKCA PROTEIN. |
| ID0422 | E | ORF starting with ATG of length 801 |
| ID0423 | E | GLUTAMINE SYNTHETASE (EC 6.3.1.2) (GLUTAMATE--AMMONIA LIGASE |
| ID0424 | E | HYPOTHETICAL 14.4 KDA PROTEIN IN TETB-EXOA INTERGENIC REGION |
| ID0425 | E | *Arabidopsis thaliana* protein fragment SEQ ID NO: 12719. |
| ID0426 | E | ORF starting with ATG of length 1431 |
| ID0427 | E | HYPOTHETICAL 14.4 KDA PROTEIN IN EPR-GALK INTERGENIC REGION. |
| ID0428 | E | HYPOTHETICAL 15.2 KDA PROTEIN IN GLNQ-ANSR INTERGENIC REGION |
| ID0429 | E | 3-DEHYDROQUINATE SYNTHASE (EC 4.6.1.3). |
| ID0430 | E | YDAO PROTEIN. |
| ID0431 | E | ORF starting with ATG of length 654 |
| ID0432 | E | ORF starting with ATG of length 617 |
| ID0433 | E | YUSH PROTEIN. |
| ID0434 | E | ORF starting with ATG of length 573 |
| ID0435 | E | DIAMINOPIMELATE DECARBOXYLASE (EC 4.1.1.20) (DAP DECARBOXYLA |
| ID0436 | E | YKRV PROTEIN. |
| ID0437 | E | ORF starting with ATG of length 536 |
| ID0438 | E | MALTOSE PERMEASE (MALA). |
| ID0439 | E | ORF starting with TTG or GTG of length 1038 |
| ID0440 | E | METAL-ACTIVATED PYRIDOXAL ENZYME. |
| ID0441 | E | *Staphylococcus aureus* mutant P7C18 virulence gene product. |
| ID0442 | E | CYSTEINE SYNTHASE A (EC 4.2.99.8). |
| ID0443 | E | BRANCHED-CHAIN AMINO ACID TRANSPORTER. |
| ID0444 | E | ORF starting with ATG of length 465 |
| ID0445 | E | YDAO PROTEIN. |
| ID0446 | E | 3-PHOSPHOGLYCERATE DEHYDROGENASE (EC 1.1.1.95). |
| ID0447 | E | NITROGEN REGULATORY PROTEIN P-II (GLNB-2). |

| | | -continued |
|---|---|---|
| ID0448 | E | GLYCINE CLEAVAGE SYSTEM PROTEIN H (AMINOMETHYL CARRIER). |
| ID0449 | E | Human ORFX ORF544 polypeptide sequence SEQ ID NO: 1088. |
| ID0450 | E | 307AA LONG HYPOTHETICAL PHOSPHOGLYCERATE DEHYDROGENASE. |
| ID0451 | E | ORF starting with ATG of length 387 |
| ID0452 | E | ORF starting with ATG of length 837 |
| ID0453 | E | ORF starting with ATG of length 360 |
| ID0454 | E | YEBA. |
| ID0455 | E | PROBABLE 3-DEHYDROQUINATE DEHYDRATASE (EC 4.2.1.10) (3-DEHYD |
| ID0456 | E | BH3810 PROTEIN. |
| ID0457 | E | ORF starting with ATG of length 321 |
| ID0458 | E | AMINO ACID CARRIER PROTEIN. |
| ID0459 | E | Human ORFX ORF618 polypeptide sequence SEQ ID NO: 1236. |
| ID0460 | E | HYPOTHETICAL PROTEIN XF2305. |
| ID0461 | E | AGAE. |
| ID0462 | E | ORF starting with ATG of length 237 |
| ID0463 | E | ORF starting with ATG of length 237 |
| ID0464 | E | ORF starting with ATG of length 231 |
| ID0465 | E | HOMOCITRATE SYNTHASE (EC 4.1.3.21). |
| ID0466 | E | ORF starting with ATG of length 225 |
| ID0467 | E | ORF starting with ATG of length 225 |
| ID0468 | E | YNDN PROTEIN. |
| ID0469 | E | YEST PROTEIN. |
| ID0470 | E | BH1818 PROTEIN. |
| ID0471 | E | HISF PROTEIN (CYCLASE). |
| ID0472 | EF | CARBAMOYL-PHOSPHATE SYNTHETASE (CATALYTIC SUBUNIT). |
| ID0473 | EF | CARBAMOYL-PHOSPHATE SYNTHASE, ARGININE-SPECIFIC, LARGE CHAIN |
| ID0474 | EF | CARBAMOYL-PHOSPHATE SYNTHASE, PYRIMIDINE-SPECIFIC, SMALL CHA |
| ID0475 | EF | ORF starting with ATG of length 3213 |
| ID0476 | EF | CARBAMOYLPHOSPHATE SYNTHETASE HEAVY SUBUNIT. |
| ID0477 | EF | CARBAMOYL-PHOSPHATE SYNTHASE, ARGININE-SPECIFIC, SMALL CHAIN |
| ID0478 | EF | GLUTAMINE-DEPENDENT CARBAMOYL PHOSPHATE SYNTHASE (EC 6.3.5.5 |
| ID0479 | EH | PROBABLE MALONIC SEMIALDEHYDE OXIDATIVE DECARBOXYLASE (EC 1. |
| ID0480 | EH | YDAP PROTEIN. |
| ID0481 | EH | *B. subtilis* acetohydroxyacid synthetase subunit, IlvB. |
| ID0482 | EH | PARA-AMINOBENZOATE SYNTHASE COMPONENT I (EC 4.1.3.-) (ADC SY |
| ID0483 | EH | KETOL-ACID REDUCTOISOMERASE (EC 1.1.1.86) (ACETOHYDROXY-ACID |
| ID0484 | EH | ALPHA-ACETOLACTATE SYNTHASE PROTEIN, ALSS. |
| ID0485 | EH | PHOSPHOADENOSINE PHOSPHOSULFATE REDUCTASE (EC 1.8.99.4) (PAP |
| ID0486 | EH | ANTHRANILATE SYNTHASE COMPONENT I (EC 4.1.3.27). |
| ID0487 | EH | PROBABLE PHOSPHOADENOSINE PHOSPHOSULFATE REDUCTASE (EC 1.8.9 |
| ID0488 | EH | 4-AMINO-4-DEOXYCHORISMATE LYASE (EC 4.-.-.-) (ADC LYASE) (AD |
| ID0489 | EH | PARA-AMINOBENZOATE/ANTHRANILATE SYNTHASE GLUTAMINE AMIDOTRAN |
| ID0490 | EH | ORF starting with ATG of length 1746 |
| ID0491 | EH | ANTHRANILATE SYNTHASE. |
| ID0492 | EH | PUTATIVE BRANCHED-CHAIN AMINO ACID AMINOTRANSFERASE (EC 2.6. |
| ID0493 | EH | ORF starting with ATG of length 1539 |
| ID0494 | EH | D-ALANINE AMINOTRANSFERASE. |
| ID0495 | EH | *B. subtilis* IlvE homologue #1. |
| ID0496 | EHR | HYPOTHETICAL 55.0 KDA PROTEIN IN EPR-GALK INTERGENIC REGION. |
| ID0497 | EHR | NA+/MYO-INOSITOL COTRANSPORTER. |
| ID0498 | EHR | HYPOTHETICAL 40.1 KDA PROTEIN IN SIPU-KIPI INTERGENIC REGION |
| ID0499 | EHR | YOLC. |
| ID0500 | EHR | OSMOREGULATED PROLINE TRANSPORTER (SODIUM/PROLINE SYMPORTER) |
| ID0501 | EHR | Mouse high affinity choline transporter protein. |
| ID0502 | EHR | HOMOLOGUE OF PROLINE PERMEASE OF *E. COLI*. |
| ID0503 | EHR | HOMOLOGUE OF PROLINE PERMEASE OF *E. COLI*. |
| ID0504 | EHR | HOMOLOGUE OF PROLINE PERMEASE OF *E. COLI*. |
| ID0505 | EJ | L-ASPARAGINASE (EC 3.5.1.1) (L-ASPARAGINE AMIDOHYDROLASE). |
| ID0506 | EJ | L-ASPARAGINASE. |
| ID0507 | EM | PROBABLE 5-DEHYDRO-4-DEOXYGLUCARATE DEHYDRATASE (EC 4.2.1.41 |
| ID0508 | EM | DIHYDRODIPICOLINATE SYNTHASE (EC 4.2.1.52) (DHDPS) (VEGETATI |
| ID0509 | EM | DIHYDRODIPICOLINATE SYNTHASE. |
| ID0510 | EM | DIHYDRODIPICOLINATE SYNTHASE (EC 4.2.1.52) (DHDPS) (VEGETATI |
| ID0511 | EM | ORF starting with ATG of length 606 |
| ID0512 | EP | OLIGOPEPTIDE-BINDING PROTEIN APPA PRECURSOR. |
| ID0513 | EP | *B. subtilis* oppD ATPase. |
| ID0514 | EP | DIPEPTIDE-BINDING PROTEIN DPPE PRECURSOR. |
| ID0515 | EP | OLIGOPEPTIDE TRANSPORT ATP-BINDING PROTEIN APPF. |
| ID0516 | EP | DIPEPTIDE TRANSPORTER PROTEIN DPPA (FRAGMENT). |
| ID0517 | EP | OLIGOPEPTIDE TRANSPORT ATP-BINDING PROTEIN APPD. |
| ID0518 | EP | OLIGOPEPTIDE TRANSPORT SYSTEM PERMEASE PROTEIN APPB. |
| ID0519 | EP | OLIGOPEPTIDE TRANSPORT SYSTEM PERMEASE PROTEIN APPC. |
| ID0520 | EP | YKFD. |
| ID0521 | EP | OLIGOPEPTIDE TRANSPORT SYSTEM PERMEASE PROTEIN OPPC. |
| ID0522 | EP | DIPEPTIDE TRANSPORT SYSTEM PERMEASE PROTEIN DPPC. |
| ID0523 | EP | DIPEPTIDE ABC TRANSPORTER (PERMEASE). |
| ID0524 | EP | *B. subtilis* oppA ligand binding protein. |
| ID0525 | EP | NICKEL TRANSPORT SYSTEM (PERMEASE). |
| ID0526 | EP | NICKEL TRANSPORT SYSTEM (PERMEASE). |

| | | -continued |
|---|---|---|
| ID0527 | EP | NICKEL ABC TRANSPORTER (PERMEASE). |
| ID0528 | EP | DIPEPTIDE TRANSPORT SYSTEM PERMEASE PROTEIN DPPC. |
| ID0529 | EP | DIPEPTIDE TRANSPORT ATP-BTNDING PROTEIN DPPD. |
| ID0530 | EP | OLIGOPEPTIDE ABC TRANSPORTER (ATP-BINDING PROTEIN). |
| ID0531 | EP | OLIGOPEPTIDE ABC TRANSPORTER (ATP-BINDING PROTEIN). |
| ID0532 | EP | OLIGOPEPTIDE TRANSPORT ATP-BINDING PROTEIN AMIF. |
| ID0533 | EP | NICKEL ABC TRANSPORTER (PERMEASE). |
| ID0534 | EP | NICKEL ABC TRANSPORTER (NICKEL-BINDING PROTEIN). |
| ID0535 | EP | OLIGOPEPTIDE TRANSPORT SYSTEM PERMEASE PROTEIN OPPB. |
| ID0536 | EP | OLIGOPEPTIDE ABC TRANSPORTER (ATP-BINDING PROTEIN). |
| ID0537 | EP | OLIGOPEPTIDE ABC TRANSPORTER (ATP-BINDING PROTEIN). |
| ID0538 | EP | DIPEPTIDE TRANSPORTER DPPD HOMOLOG. |
| ID0539 | EP | *B. subtilis* oppB membrane protein. |
| ID0540 | EP | 420AA LONG HYPOTHETICAL OLIGOPEPTIDE TRANSPORT ATP-BINDING P |
| ID0541 | EP | *B. subtilis* oppA ligand binding protein. |
| ID0542 | EP | ATPASE OPPD. |
| ID0543 | EP | ORF starting with ATG of length 240 |
| ID0544 | EP | ORF starting with ATG of length 213 |
| ID0545 | EP | ORF starting with ATG of length 210 |
| ID0546 | ER | HYPOTHETICAL 64.1 KDA PROTEIN. |
| ID0547 | ER | GLUTAMATE SYNThASE (EC 1.4.1.13) (GLUTAMATE SYNTHASE (NADPH) |
| ID0548 | ER | YTVP. |
| ID0549 | ER | NAD ALCOHOL DEHYDROGENASE. |
| ID0550 | ER | *Pyrococcus horikoshii* thermophilic dehydrogenase. |
| ID0551 | ER | L-IDITOL 2-DEHYDROGENASE (EC 1.1.1.14). |
| ID0552 | ER | ZINC-CONTAINING ALCOHOL DEHYDROGENASE. |
| ID0553 | ER | ORF starting with ATG of length 1140 |
| ID0554 | ER | ORF starting with ATG of length 321 |
| ID0555 | F | YFKN PROTEIN. |
| ID0556 | F | PHOSPHORIBOSYLFORMYLGLYCINAMIDINE SYNTHASE II (EC 6.3.5.3) ( |
| ID0557 | F | HYPOTHETICAL 132.7 KDA PROTEIN IN CSPB-GLPP INTERGENIC REGIO |
| ID0558 | F | RIBONUCLEOSIDE-DIPHOSPHATE REDUCTASE ALPHA CHAIN (EC 1.17.4. |
| ID0559 | F | GMP SYNTHASE [GLUTAMINE-HYDROLYZING] (EC 6.3.5.2) (GLUTAMINE |
| ID0560 | F | BIFUNCTIONAL PURINE BIOSYNTHESIS PROTEIN PURH [INCLUDES:PHOS |
| ID0561 | F | TRANSFERASE (GLUTAMTNE AMIDOTRANSFERASE) |
| ID0562 | F | ADENYLOSUCCINATE LYASE (EC 4.3.2.2) (ADENYLOSUCCINASE) (ASL) |
| ID0563 | F | ADENINE DEAMINASE (EC 3.5.4.2) (ADENASE) (ADENINE AMINASE). |
| ID0564 | F | HYPOTHETICAL 66.6 KDA PROTEIN IN PURD-PCRB INTERGENIC REGION |
| ID0565 | F | PHOSPHORIBOSYLAMINE--GLYCINE LIGASE (EC 6.3.4.13) (GARS) (GL |
| ID0566 | F | DIHYDROOROTASE (EC 3.5.2.3) (DHOASE). |
| ID0567 | F | PYRIMIDINE NUCLEOSIDE TRANSPORT PROTEIN. |
| ID0568 | F | URACIL PERMEASE (URACIL TRANSPORTER). |
| ID0569 | F | PHOSPHORIBOSYLAMINOIMIDAZOLE CARBOXYLASE ATPASE SUBUNIT (EC |
| ID0570 | F | ORF starting with ATG of length 2985 |
| ID0571 | F | HYPOTHETICAL 43.7 KDA PROTEIN IN PEPT-KATB INTERGENIC REGION |
| ID0572 | F | DIHYDROOROTATE DEHYDROGENASE, CATALYTIC SUBUNIT (EC 1.3.3.1) |
| ID0573 | F | PUTATIVE PURINE PERMEASE YWDJ. |
| ID0574 | F | ALLANTOTNASE (EC 3.5.2.5). |
| ID0575 | F | A formate transport associated protein, PurU. |
| ID0576 | F | CTP SYNTHASE (EC 6.3.4.2) (UTP--AMMONIA LIGASE) (CTP SYNTHET |
| ID0577 | F | IMPDH. |
| ID0578 | F | PYRIMIDINE NUCLEOSIDE PHOSPHORYLASE. |
| ID0579 | F | YJBT PROTEIN. |
| ID0580 | F | YJBT PROTEIN. |
| ID0581 | F | PURINE NUCLEOSIDE PHOSPHORYLASE I (EC 2.4.2.1) (PNP I) (PU-N |
| ID0582 | F | XANTHINE PERMEASE. |
| ID0583 | P | PHOSPHORIBOSYLAMINOIMIDAZOLE-SUCCINOCARBOXAMIDE SYNTHASE (EC |
| ID0584 | F | SA2078 PROTEIN. |
| ID0585 | F | RIBONUCLEOSIDE-DIPHOSPHATE REDUCTASE BETA CHAIN (EC 1.17.4.1 |
| ID0586 | F | MTA/SAH NUCLEOSIDASE [INCLUDES: 5'-METHYLTHIOADENOSINE NUCLE |
| ID0587 | F | DEOXYRIBOSE-PHOSPHATE ALDOLASE (EC 4.1.2.4) (PHOSPHODEOXYRIB |
| ID0588 | F | ORF starting with ATG of length 1776 |
| ID0589 | F | ADENYLATE KINASE (EC 2.7.4.3) (ATP-AMP TRANSPHOSPHORYLASE) (S |
| ID0590 | F | CYTIDYLATE KINASE (EC 2.7.4.14) (CK) (CYTIDINE MONOPHOSPHATE |
| ID0591 | F | PHOSPHORIBOSYLFORMYLGLYCINAMIDINE CYCLO-LIGASE (EC 6.3.3.1) |
| ID0592 | F | COME OPERON PROTEIN 2. |
| ID0593 | F | FORMYLTETRAHYDROFOLATE SYNTHETASE. |
| ID0594 | F | OROTATE PHOSPHORIBOSYLTRANSFERASE (EC 2.4.2.10) (OPRT) (OPRT |
| ID0595 | F | YUND PROTEIN. |
| ID0596 | F | ADENINE PHOSPHORIBOSYLTRANSFERASE (EC 2.4.2.7) (APRT). |
| ID0597 | F | ASPARTATE TRANSCARBAMOYLASE. |
| ID0598 | F | HYPOTHETTCAL 24.1 KDA PROTEIN IN SERS-DNAZ INTERGENIC REGION |
| ID0599 | F | PHOSPHORIBOSYLFORMYLGLYCINAMIDINE SYNTHETASE I. |
| ID0600 | F | XANTHINE PHOSPHORIBOSYLTRANSFERASE (EC 2.4.2.-). |
| ID0601 | F | PHOSPHORIBOSYLAMINOIMIDAZOLE CARBOXYLASE CATALYTIC SUBUNIT (E |
| ID0602 | F | HYPOTHETICAL 25.4 KDA PROTEIN IN SERS-DNAZ INTERGENIC REGION |
| ID0603 | F | THYMIDINE KINASE (EC 2.7.1.21). |
| ID0604 | F | Thymidylate kinase-2. |
| ID0605 | F | URIDYLATE KINASE (EC 2.7.4.-) (UK) (URIDINE MONOPHOSPHATE KI |

| | | -continued |
|---|---|---|
| ID0606 | F | ORF starting with ATG of length 1146 |
| ID0607 | F | C-1-TETRAHYDROFOLATE SYNTHASE, MITOCHONDRIAL PRECURSOR (C1-T |
| ID0608 | F | PurR protein sequence. |
| ID0609 | F | URIDINE KINASE (EC 2.7.1.48) (URIDINE MONOPHOSPHOKINASE). |
| ID0610 | F | XANTHINE PERMEASE. |
| ID0611 | F | Nucleoside phosphorylase. |
| ID0612 | F | DEOXYRIBOSE-PHOSPHATE ALDOLASE. |
| ID0613 | F | THYMIDYLATE SYNTHASE A (EC 2.1.1.45) (TS A) (TSASE A). |
| ID0614 | F | ORF starting with ATG of length 870 |
| ID0615 | F | YUND PROTEIN. |
| ID0616 | F | *Corynebacterium glutamicum* MP protein sequence SEQ ID NO: 948 |
| ID0617 | F | PYRIMIDINE OPERON REGULATORY PROTEIN PYRR. |
| ID0618 | F | NUCLEOSIDE DIPHOSPHATE KINASE (EC 2.7.4.6) (NDK) (NDP KINASE |
| ID0619 | F | PHOSPHORIBOSYLGLYCINAMIDE FORMYLTRANSFERASE (EC 2.1.2.2) (GA |
| ID0620 | F | CYTIDINE DEAMINASE (EC 3.5.4.5). |
| ID0621 | F | ORF starting with ATG of length 591 |
| ID0622 | F | THYMIDYLATE SYNTHASE A (EC 2.1.1.45) (TS A) (TSASE A). |
| ID0623 | F | HYPOTHETICAL 9.7 KDA PROTEIN IN PURC-PURL INTERGENIC REGION. |
| ID0624 | F | PUTATIVE ADENYLOSUCCINATE SYNTHETASE (EC 6.3.4.4). |
| ID0625 | F | GUANYLATE KINASE (EC 2.7.4.8) (GMP KINASE) |
| ID0626 | F | *Zea mays* protein fragment SEQ ID NO: 40074. |
| ID0627 | F | *Corynebacterium glutamicum* MP protein sequence SEQ ID NO: 998 |
| ID0628 | F | GARS-AIRS-GART (FRAGMENT). |
| ID0629 | F | PURINE NUCLEOSIDE PHOSPHORYLASE II (EC 2.4.2.1) (PNP II) (PU |
| ID0630 | F | PHOSPHORIBOSYLGLYCINAMIDE FORMYLTRANSFERASE (EC 2.1.2.2) (GA |
| ID0631 | F | ORF starting with ATG of length 261 |
| ID0632 | F | DIHYDROOROTASE (EC 3.5.2.3) (DHOASE). |
| ID0633 | FE | RIBOSE-PHOSPHATE PYROPHOSPHOKINASE (EC 2.7.6.1) (PHOSPHORIBO |
| ID0634 | FE | PRPP SYNTHETASE (EC 2.7.6.1). |
| ID0635 | FGR | HIT PROTEIN. |
| ID0636 | FGR | HYPOTHETICAL HIT-LIKE PROTEIN MJ0866. |
| ID0637 | FH | HYPOTHETICAL 54.0 KDA PROTEIN IN NRGA-USD INTERGENIC REGION. |
| ID0638 | FH | HYPOTHETICAL 54.0 KDA PROTEIN IN NRGA-USD INTERGENIC REGION. |
| ID0639 | FJ | HYPOTHETICAL 17.8 KDA PROTEIN IN SERS-DNAH INTERGENIC REGION |
| ID0640 | FJ | YKOA. |
| ID0641 | FR | BH0185 PROTEIN. |
| ID0642 | G | PEP SYNTHASE. |
| ID0643 | G | GLYCOGEN PHOSPHORYLASE (EC 2.4.1.1). |
| ID0644 | G | *Bacillus* species alpha-glucosidase. |
| ID0645 | G | LEVANASE PRECURSOR (EC 3.2.1.65) (2,6-BETA-D-FRUCTANFRUCTANO |
| ID0646 | G | CHITINASE. |
| ID0647 | G | PEP SYNTHASE. |
| ID0648 | G | PHOSPHOENOLPYRUVATE-PROTEIN PHOSPHOTRANSFERASE (EC 2.7.3.9) ( |
| ID0649 | G | GLUCOSIDASE. |
| ID0650 | G | Arabinose isomerase from *Bacillus licheniformis*, deduced amo |
| ID0651 | G | YESZ PROTEIN. |
| ID0652 | G | HYPOTHETICAL 88.3 KDA PROTEIN IN CLPP-CRH INTERGENIC REGION. |
| ID0653 | G | 1,4-ALPHA-GLUCAN BRANCHING ENZYME (EC 2.4.1.18) (GLYCOGEN BR |
| ID0654 | G | HYPOTHETICAL 68.9 KDA PROTEIN. |
| ID0655 | G | *Bacillus* sp. exo-alpha-1,4-glucosidase, AMY1084 |
| ID0656 | G | HYPOTHETICAL 79.2 KDA PROTEIN. |
| ID0657 | G | TREHALOSE-6-PHOSPHATE HYDROLASE (EC 3.2.1.93) (ALPHA, ALPHA-P |
| ID0658 | G | 6-PHOSPHOGLUCONATE DEHYDROGENASE, DECARBOXYLATING II (EC 1.1 |
| ID0659 | G | HYPOTHETICAL 70.6 KDA LIPOPROTEIN IN FEUA-SIGW INTERGENIC RE |
| ID0660 | G | BETA-D-GALACTOSIDASE. |
| ID0661 | G | CHITINASE PRECURSOR (EC 3.2.1.14). |
| ID0662 | G | GLUCOSE-6-PHOSPHATE ISOMERASE (GPI) (EC 5.3.1.9) (PHOSPHOGLU |
| ID0663 | G | LIPOPROTEIN LPLA PRECURSOR. |
| ID0664 | G | ENOLASE (EC 4.2.1.11) (2-PHOSPHOGLYCERATE DEHYDRATASE) (2-PH |
| ID0665 | G | Amino acid sequence of a *Staphylococcus aureus* tktA polypept |
| ID0666 | G | GLUCOSE-6-PHOSPHATE 1-DEHYDROGENASE (EC 1.1.1.49) (G6PD) (VE |
| ID0667 | G | XYLOSE ISOMERASE (EC 5.3.1.5). |
| ID0668 | G | PROBABLE BETA-GLUCOSIDASE (EC 3.2.1.21) (GENTIOBIASE) (CELLO |
| ID0669 | G | PROBABLE PHOSPHOMANNOMUTASE (EC 5.4.2.8) (PMM). |
| ID0670 | G | HYPOTHETICAL 48.5 KDA PROTEIN. |
| ID0671 | G | GLUCAN-GLUCOHYDROLASE (EC 3.2.1.74) (GLUCAN 1,4-BETA-GLUCOSI |
| ID0672 | G | YDHP PROTEIN. |
| ID0673 | G | HYPOTEETICAL 47.3 KDA PROTEIN. |
| ID0674 | G | ALPHA-GALACTOSIDASE (EC 3.2.1.22) (MELIBIASE) |
| ID0675 | G | XYLULOKINASE. |
| ID0676 | G | 6-PHOSPHO-GLUCOSIDASE MALH. |
| ID0677 | G | PUTATIVE PTS SYSTEM IIBC COMPONENT YWBA (EC 2.7.1.69). |
| ID0678 | G | HYPOTHETICAL SYMPORTER IN COTT-RAPA INTERGENIC REGION. |
| ID0679 | G | YTCQ. |
| ID0680 | G | *Bacillus subtilis* araN gene product. |
| ID0681 | G | ALTRONATE HYDROLASE (EC 4.2.1.7) (ALTRONIC ACID HYDRATASE). |
| ID0682 | G | YBBT PROTEIN. |
| ID0683 | G | YKRW PROTEIN. |
| ID0684 | G | CELLULASE. |

| | | -continued |
|---|---|---|
| ID0685 | G | PTS SYSTEM, SUCROSE-SPECIFIC IIBC COMPONENT (EIIBC-SCR) (SUC |
| ID0686 | G | YESO PROTEIN. |
| ID0687 | G | Amino acid sequence of tac promoter and *Bacillus subtilis* BR |
| ID0688 | G | RIBOSE TRANSPORT ATP-BINDING PROTEIN RBSA. |
| ID0689 | G | PUTATIVE FAMILY 31 GLUCOSIDASE YICI. |
| ID0690 | G | PTS SYSTEM, N-ACETYLGLUCOSAMINE-SPECIFIC ENZYME II, ABC COMP |
| ID0691 | G | GLUCONOKINASE (EC 2.7.1.12) (GLUCONATE KINASE). |
| ID0692 | G | HYPOTHETICAL 34.0 KDA PROTEIN IN RHO-MURA INTERGENIC REGION |
| ID0693 | G | YTOP. |
| ID0694 | G | YTBD. |
| ID0695 | G | IOLH PROTEIN. |
| ID0696 | G | 2,3-BISPHOSPHOGLYCERATE-INDEPENDENT PHOSPHOGLYCERATE MUTASE. |
| ID0697 | G | 6-PHOSPHOGLUCONATE DEHYDROGENASE, DECARBOXYLATING (EC 1.1.1. |
| ID0698 | G | D-MANNONATE HYDROLASE. |
| ID0699 | G | L-ARABINOSE MEMBRANE PERMEASE. |
| ID0700 | G | HYPOTHETICAL 39.2 KDA PROTEIN. |
| ID0701 | G | LPLB PROTEIN. |
| ID0702 | G | SA2434 PROTEIN. |
| ID0703 | G | GLYCEROL-3-PHOSPHATE TRANSPORTER. |
| ID0704 | G | MEMBRANE TRANSPORT PROTEIN. |
| ID0705 | G | LIPOPROTEIN. |
| ID0706 | G | GLUCOSE-1-PHOSPHATE ADENYLYLTRANSFERASE (EC 2.7.7.27) (ADP-G |
| ID0707 | G | YJDE PROTEIN. |
| ID0708 | G | PROBABLE ABC TRANSPORTER PERMEASE PROTEIN YESP. |
| ID0709 | G | SUGAR-BINDING PROTEIN. |
| ID0710 | G | HYPOTHETICAL 35.0 KDA PROTEIN. |
| ID0711 | G | IOLE PROTEIN. |
| ID0712 | G | YBBF. |
| ID0713 | G | PHOSPHOPENTOMUTASE (EC 5.4.2.7) (PHOSPHODEOXYRIBOMUTASE). |
| ID0714 | G | LPLC PROTEIN. |
| ID0715 | G | SUGAR ABC TRANSPORTOR (ATP-BINDING PROTEIN). |
| ID0716 | G | BIFUNCTIONAL PGK/TIM [INCLUDES: PHOSPHOGLYCERATE KINASE (EC |
| ID0717 | G | PROBABLE 6-PHOSPHO-BETA-GLUCOSIDASE (EC 3.2.1.86). |
| ID0718 | G | HYPOTHETICAL ALTRONATE OXIDOREDUCTASE. |
| ID0719 | G | HYPOTHETICAL 30.9 KDA PROTEIN. |
| ID0720 | G | IOLI PROTEIN. |
| ID0721 | G | TEICHOIC ACID TRANSLOCATION ATP-BINDING PROTEIN TAGH. |
| ID0722 | G | D-MANNONATE DEHYDROLASE. |
| ID0723 | G | HYPOTHETICAL 45.5 KDA PROTEIN. |
| ID0724 | G | ORF starting with ATG of length 2513 |
| ID0725 | G | endo 1,5 alpha-L-arabinase |
| ID0726 | G | HYPOTHETICAL 31.3 KDA PROTEIN. |
| ID0727 | G | ABC TRANSPORTER (PERMIASE). |
| ID0728 | G | YKRP PROTEIN. |
| ID0729 | G | 6-PHOSPHO-BETA-GLUCOSIDASE BGLB (EC 3.2.1.86). |
| ID0730 | G | PROBABLE FRUCTOSE-BISPHOSPHATE ALDOLASE 2 (EC 4.1.2.13). |
| ID0731 | G | PROBABLE FRUCTOSE-BISPHOSPHATE ALDOLASE 1 (EC 4.1.2.13). |
| ID0732 | G | SUGAR TRANSPORTER. |
| ID0733 | G | PUTATIVE INTEGRAL PROTEIN. |
| ID0734 | G | SAC OPERON RELATED REGULATION PROTEIN (FRAGMENT). |
| ID0735 | G | HYPOTHETICAL 59.0 KDA PROTEIN. |
| ID0736 | G | D-RIBOSE-BINDING PROTEIN PRECURSOR. |
| ID0737 | G | ALPHA-L-ARABINOFURANOSIDASE 1 (EC 3.2.1.55) (ARABINOSIDASE). |
| ID0738 | G | YFHI. |
| ID0739 | G | PYRUVATE KINASE (EC 2.7.1.40) (PK). |
| ID0740 | G | GLYCOGEN BIOSYNTHESIS PROTEIN GLGD. |
| ID0741 | G | YUTF PROTEIN. |
| ID0742 | G | 2-DEHYDRO-3-DEOXYGLUCONOKINASE (EC 2.7.1.45) (2-KETO-3-DEOXY |
| ID0743 | G | PUTATIVE CARBOXYVINYL-CARBOXYPHOSPHONATE PHOSPHORYLMUTASE (EC |
| ID0744 | G | PTS SYSTEM, GLUCOSE-SPECIFIC ENZYME II, A COMPONENT. |
| ID0745 | G | YFJS PROTEIN. |
| ID0746 | G | PROBABLE D-GALACTARATE DEHYDRATASE (EC 4.2.1.42) (GALCD). |
| ID0747 | G | RIBOKINASE (EC 2.7.1.15). |
| ID0748 | G | HYPOTHETICAL 42.1 KDA PROTEIN. |
| ID0749 | G | MANNITOL-1-PHOSPHATE 5-DEHYDROGENASE (EC 1.1.1.17). |
| ID0750 | G | HYPOTHETICAL 29.9 KDA PROTEIN IN SIGY-CYDD INTERGENIC REGION |
| ID0751 | G | HYPOTHETICAL 48.4 KDA PROTEIN. |
| ID0752 | G | FRUCTOSE SPECIFIC PERMEASE. |
| ID0753 | G | SUGAR TRANSPORTER. |
| ID0754 | G | HYPOTHETICAL 28.3 KDA PROTEIN IN KBAA-FEUC INTERGENIC REGION |
| ID0755 | G | PHOSPHO-BETA-GLUCOSIDASE. |
| ID0756 | G | PROBABLE ABC TRANSPORTER PERMEASE PROTEIN YESQ. |
| ID0757 | G | GLYCOGEN SYNTHASE. |
| ID0758 | G | 6-PHOSPHO-BETA-GLUCOSIDASE A. |
| ID0759 | G | *B. licheniformis* acid stable and thermostable alpha-amylase. |
| ID0760 | G | PTS SYSTEM, N-ACETYLGLUCOSAMINE-SPECIFIC ENZYME II, ABC COMP |
| ID0761 | G | MULTIPLE SUGAR TRANSPORT SYSTEM (MULTIPLE SUGAR-BINDING PROT |
| ID0762 | G | SUCROSE-6-PHOSPHATE HYDROLASE E1 (EC 3.2.1.26) (SUCRASE E1) ( |
| ID0763 | G | *Bacillus* sp. OC187 4(R)-hydroxy-2-ketoglutaric acid aldolase |

| | | -continued |
|---|---|---|
| ID0764 | G | GALACTOKINASE (EC 2.7.1.6) (GALACTOSE KINASE). |
| ID0765 | G | SUCRASE (EC 3.2.1.26). |
| ID0766 | G | XYLAN BETA-1,4-XYLOSIDASE (EC 3.2.1.37). |
| ID0767 | G | N-ACETYLGLUCOSAMINE-6-PHOSPHATE DEACETYLASE (EC 3.5.1.25) (G |
| ID0768 | G | GLUCONOKINASE (EC 2.7.1.12) (GLUCONATE KINASE). |
| ID0769 | G | RIBULOSE-PHOSPHATE 3-EPIMERASE (EC 5.1.3.1) (PENTOSE-5-PHOSP |
| ID0770 | G | SUGAR KINASE. |
| ID0771 | G | HOMOLOGOUS TO SWISSPROT:YADE_ECOLI. |
| ID0772 | G | PTS SYSTEM, ARBUTIN-LIKE IIBC COMPONENT (PHOSPHOTRANSFERASE |
| ID0773 | G | SUGAR ABC TRANSPORTER (SUGAR-BINDING PROTEIN). |
| ID0774 | G | GLYCERALDEHYDE 3-PHOSPHATE DEHYDROGENASE 2 (EC 1.2.1.12) (GA |
| ID0775 | G | PUTATIVE SUGAR-TRANSPORT ATP BINDING PROTEIN. |
| ID0776 | G | URONATE ISOMERASE (EC 5.3.1.12) (GLUCURONATE ISOMERASE) (URO |
| ID0777 | G | PUTATIVE PTS SYSTEM IIBC COMPONENT YWBA (EC 2.7.1.69). |
| ID0778 | G | URONATE ISOMERASE (EC 5.3.1.12) (GLUCURONATE ISOMERASE) (URO |
| ID0779 | G | 6-PHOSPHOGLUCONATE DEHYDROGENASE, DECARBOXYLATING (EC 1.1.1. |
| ID0780 | G | ORF starting with ATG of length 1998 |
| ID0781 | G | HYPOTHETICAL 52.5 KDA PROTEIN IN HUTP-BGLP INTERGENIC REGION |
| ID0782 | G | PROBABLE HEXULOSE-6-PHOSPHATE SYNTHASE (EC 4.1.2.-) (HUMPS) |
| ID0783 | G | PROBABLE GALACTARATE TRANSPORTER (D-GALACTARATE PERMEASE). |
| ID0784 | G | TRANSALDOLASE (PENTOSE PHOSPHATE) |
| ID0785 | G | 6-PHOSPHO-BETA-GLUCOSIDASE BGLA (EC 3.2.1.86). |
| ID0786 | G | L-RIBULOSE-5-PHOSPHATE 4-EPIMERASE. |
| ID0787 | G | KBAY. |
| ID0788 | G | FRUCTOSE 1-PHOSPHATE KINASE. |
| ID0789 | G | YTEQ PROTEIN. |
| ID0790 | G | BH0592 PROTEIN. |
| ID0791 | G | HYPOTHETICAL 54.3 FDA PROTEIN. |
| ID0792 | G | L-RIBULOSE-5-PHOSPHATE 4-EPIMERASE. |
| ID0793 | G | endo 1,5 alpha-L-arabinase |
| ID0794 | G | CONSERVED HYPOTHETICAL PROTEIN, POSSIBLE OXIDOREDUCTASE. |
| ID0795 | G | HYPOTHETICAL 21.3 KDA PROTEIN IN BLTR-SPOIIIC INTERGENIC REG |
| ID0796 | G | 358AA LONG HYPOTHETICAL TRANSPORTER ATP-BINDING PROTEIN. |
| ID0797 | G | IOLC PROTEIN. |
| ID0798 | G | PHOSPHOTRANSFERASE ENZYME II (EC 2.7.1.69) (PROTEIN-N(PI)-PHO |
| ID0799 | G | PTS SYSTEM ENZYME II ABC (ASC), CRYPTIC, TRANSPORTS SPECIFIC |
| ID0800 | G | PTS SYSTEM, FRUCTOSE-SPECIFIC IIB COMPONENT (EIIB-FRU) (FRUC |
| ID0801 | G | HYPOTHETICAL 22.0 KDA PROTEIN. |
| ID0802 | G | N-ACETYLGLUCOSAMINE-6-PHOSPHATE ISOMERASE (EC 5.3.1.10). |
| ID0803 | G | PUTATIVE XYLANASE (FRAGMENT). |
| ID0804 | G | PUTATIVE ATP/GTP-BINDING PROTEIN. |
| ID0805 | G | HYPOTHETICAL 37.2 KDA PROTEIN IN PBP-GGT INTERGENIC REGION. |
| ID0806 | G | D-XYLOSE-BINDING PERIPLASMIC PROTEIN PRECURSOR. |
| ID0807 | G | PEP-DEPENDENT PHOSPHOTRANSFERASE ENZYME II FOR CELLOBIOSE. |
| ID0808 | G | ORF starting with ATG of length 1332 |
| ID0809 | G | B. subtilis cysteine protease CP3 protein sequence. |
| ID0810 | G | HYPOTHETICAL LACA/RPIB FAMILY PROTEIN IN SPOIIR-GLYC INTERGE |
| ID0811 | G | MALTOSE/MALTODEXTRIN-BINDING PROTEIN. |
| ID0812 | G | ORF starting with ATG of length 1284 |
| ID0813 | G | PUTATIVE PTS SYSTEM IIA COMPONENT YPQE (EC 2.7.1.69). |
| ID0814 | G | N-ACETYLGLUCOSAMINE-6-PHOSPHATE ISOMERASE (EC 5.3.1.10). |
| ID0815 | G | HYPOTHETICAL 48.4 KDA PROTEIN. |
| ID0816 | G | KHG/KDPG ALDOLASE [INCLUDES: 4-HYDROXY-2-OXOGLUTARATE ALDOLA |
| ID0817 | G | PTS SYSTEM, FRUCTOSE-SPECIFIC IIA COMPONENT (EIIA-FRU) (FRUC |
| ID0818 | G | ABC TRANSPORTER SUGAR PERMEASE. |
| ID0819 | G | NODB-LIKE PROTEIN. |
| ID0820 | G | ORF starting with ATG of length 1098 |
| ID0821 | G | 2-KETO-3-DEOXY-GLUCONATE KINASE. |
| ID0822 | G | ENZYME II SUCROSE PROTEIN (EC 2.7.1.69). |
| ID0823 | G | AMYX PROTEIN. |
| ID0824 | G | HYPOTHETICAL 79.2 KDA PROTEIN. |
| ID0825 | G | HYPOTHETICAL 44.9 KDA PROTEIN. |
| ID0826 | G | ABC TRANSPORTER SUGAR PERMEASE. |
| ID0827 | G | HYPOTHETICAL 31.7 KDA PROTEIN. |
| ID0828 | G | ORF starting with ATG of length 993 |
| ID0829 | G | ORF starting with ATG of length 975 |
| ID0830 | G | HYPOTHETICAL ABC TRANSPORTER PERMEASE PROTEIN YURM. |
| ID0831 | G | TRANSKETOLASE. |
| ID0832 | G | PUTATIVE ABC TRANSPORTER, SUGAR PERMEASE PROTEIN. |
| ID0833 | G | ORF starting with ATG of length 960 |
| ID0834 | G | ENDO-1,4-BETA-XYLANASE. |
| ID0835 | G | ORF starting with ATG of length 957 |
| ID0836 | G | ORF starting with ATG of length 936 |
| ID0837 | G | ORF starting with ATG of length 1050 |
| ID0838 | G | PTS SYSTEM ENZYME II ABC (ASC), CRYPTIC, TRANSPORTS SPECIFIC |
| ID0839 | G | ORF starting with ATG of length 888 |
| ID0840 | G | MALP. |
| ID0841 | G | SA1198 PROTEIN. |
| ID0842 | G | AMYX PROTEIN. |

|         |      | -continued                                                                  |
|---------|------|-----------------------------------------------------------------------------|
| ID0843  | G    | ORF starting with ATG of length 843                                         |
| ID0844  | G    | TRANSKETOLASE C-TERMINAL SECTION.                                           |
| ID0845  | G    | Arabinose isomerase from *Bacillus licheniformis*, deduced amo              |
| ID0846  | G    | ORF starting with ATG of length 822                                         |
| ID0847  | G    | ORF starting with ATG of length 1231                                        |
| ID0848  | G    | ORF starting with ATG of length 816                                         |
| ID0849  | G    | BETA-GLUCOSIDE PERMEASE IIABC COMPONENT.                                    |
| ID0850  | G    | *Bacillus subtilis* L-arabinose isomerase.                                  |
| ID0851  | G    | PUTATIVE TRANSALDOLASE.                                                     |
| ID0852  | G    | RHAMNOSE TRANSPORTER (FRAGMENT).                                            |
| ID0853  | G    | PTS SYSTEM, CELLOBIOSE-SPECTFIC IIA COMPONENT (EIIA-CEL) (CE                |
| ID0854  | G    | MALTOSE/MALTODEXTRIN TRANSPORT SYSTEM (MALTOSE/MALTODEXTRIN-                |
| ID0855  | G    | ORF starting with ATG of length 1239                                        |
| ID0856  | G    | HPR PROTEIN.                                                                |
| ID0857  | G    | PTS SYSTEM, GLUCOSE-SPECIFIC ENZYME II, A COMPONENT.                        |
| ID0858  | G    | ORF starting with ATG of length 705                                         |
| ID0859  | G    | PHOSPHOPENTOMUTASE (EC 5.4.2.7) (PHOSPHODEOXYRIBOMUTASE).                   |
| ID0860  | G    | ORF starting with ATG of length 687                                         |
| ID0861  | G    | FRUCTOSE 1-PHOSPHATE KINASE.                                                |
| ID0862  | G    | GLYCEROL-3-PHOSPHATE TRANSPORTER.                                           |
| ID0863  | G    | PROBABLE PTS SYSTEM, TREHALOSE-SPECIFIC IIBC COMPONENT (EIIB                |
| ID0864  | G    | PHOSPHOCARRIER PROTEIN HPR (CATABOLITE REPRESSION).                         |
| ID0865  | G    | ORF starting with ATG of length 576                                         |
| ID0866  | G    | PUTATIVE MALTOSE PHOSPHORYLASE (EC 2.4.1.8) (FRAGMENT).                     |
| ID0867  | G    | HYPOTHETICAL 87.9 KDA PROTEIN.                                              |
| ID0868  | G    | HYPOTHETICAL 38.4 KDA PROTEIN IN DPPE-HMP INTERGENIC REGION.                |
| ID0869  | G    | C4-DICARBOXYLATE TRANSPORT SYSTEM (C4-DICARBOXYLATE-BINDING                 |
| ID0870  | G    | PTS SYSTEM, CELLOBIOSE-SPECIFIC IIA CCMPONENT (EIIA-CEL) (CE                |
| ID0871  | G    | METHYLGLYOXAL SYNTHASE (EC 4.2.99.11) (MGS).                                |
| ID0872  | G    | *S. pneumoniae* derived protein #352.                                       |
| ID0873  | G    | ORF starting with ATG of length 516                                         |
| ID0874  | G    | C4-DICARBOXYLATE TRANSPORT SYSTEM (C4-DICARBOXYLATE-BINDING                 |
| ID0875  | G    | SUCRASE-6-PHOSPHATE HYDROLASE.                                              |
| ID0876  | G    | *Enterococcus faecalis* protein EF092.                                      |
| ID0877  | G    | SA0255 PROTEIN.                                                             |
| ID0878  | G    | *Enterococcus faecalis* protein EF092.                                      |
| ID0879  | G    | *S. pneumoniae* cellobiose phosphotransferase system celA.                  |
| ID0880  | G    | YTEP.                                                                       |
| ID0881  | G    | GLYCEROL UPTAKE FACILITATOR PROTEIN.                                        |
| ID0882  | G    | ORF starting with ATG of length 2513                                        |
| ID0883  | G    | ORF starting with ATG of length 429                                         |
| ID0884  | G    | ORF starting with ATG of length 402                                         |
| ID0885  | G    | 6-PHOSPHOFRUCTOKINASE, MUSCLE TYPE (EC 2.7.1.11) (PHOSPHOFRU                |
| ID0886  | G    | ORF starting with ATG of length 351                                         |
| ID0887  | G    | MYO-INOSITOL CATABOLISM, IOLC.                                              |
| ID0888  | G    | HYPOTHETICAL 35.3 KDA PROTEIN.                                              |
| ID0889  | G    | ORF starting with ATG of length 321                                         |
| ID0890  | G    | ORF starting with ATG of length 315                                         |
| ID0891  | G    | ORF starting with ATG of length 303                                         |
| ID0892  | G    | ORF starting with TTG or GTG of length 561                                  |
| ID0893  | G    | ORF starting with ATG of length 1368                                        |
| ID0894  | G    | ORF starting with ATG of length 264                                         |
| ID0895  | G    | PHOSPHOTRANSFERASE EII (GLUCOSE) (FRAGMENT).                                |
| ID0896  | G    | PROBABLE D-GALACTARATE DEHYDRATASE (EC 4.2.1.42) (GALCD).                   |
| ID0897  | GC   | HYPOTHETICAL 43.0 KDA PROTEIN.                                              |
| ID0898  | GC   | HYPOTHETICAL GLYCOSYL TRANSFERASE.                                          |
| ID0899  | GC   | HYPOTHETICAL 43.0 KDA PROTEIN.                                              |
| ID0900  | GC   | HYPOTHETICAL GLYCOSYL TRANSFERASE.                                          |
| ID0901  | GE   | GLUCONATE PERMEASE.                                                         |
| ID0902  | GE   | HYPOTHETICAL PROTEIN HI0092.                                                |
| ID0903  | GEPR | HYPOTHETICAL 58.3 KDA PROTEIN IN GLPD-CSPB INTERGENIC REGION                |
| ID0904  | GEPR | MYO-INOSITOL TRANSPORT PROTEIN.                                             |
| ID0905  | GEPR | BICYCLOMYCIN RESISTANCE PROTEIN.                                            |
| ID0906  | GEPR | HYPOTHETICAL 48.7 KDA PROTEIN.                                              |
| ID0907  | GEPR | HYPOTHETICAL METABOLITE TRANSPORT PROTEIN IN GLVBC 3' REGION.               |
| ID0908  | GEPR | YBFB PROTEIN.                                                               |
| ID0909  | GEPR | BH2528 PROTEIN.                                                             |
| ID0910  | GEPR | YFMO.                                                                       |
| ID0911  | GEPR | HOMOLOGUE OF MULTIDRUG RESISTANCE PROTEIN B, EMRB, OF *E. COL*              |
| ID0912  | GEPR | MULTIDRUG TRANSPORTER.                                                      |
| ID0913  | GEPR | HYPOTHETICAL 48.2 KDA PROTEIN IN COTF-TETB INTERGENIC REGION                |
| ID0914  | GEPR | HYPOTHETICAL.                                                               |
| ID0915  | GEPR | LMRB.                                                                       |
| ID0916  | GEPR | HYPOTHETICAL 52.7 KDA PROTEIN.                                              |
| ID0917  | GEPR | PROBABLE GALACTARATE TRANSPORTER (D-GALACTARATE PERMEASE).                  |
| ID0918  | GEPR | MYO-INOSITOL TRANSPORT PROTEIN.                                             |
| ID0919  | GEPR | MELY.                                                                       |
| ID0920  | GEPR | BENZOATE TRANSPORT PROTEIN.                                                 |
| ID0921  | GEPR | YVMA.                                                                       |

| | | -continued |
|---|---|---|
| ID0922 | GEPR | HEXURONATE TRANSPORTER. |
| ID0923 | GEPR | HYPOTHETICAL 39.1 KDA PROTEIN IN KAPD-PBPD INTERGENIC REGION |
| ID0924 | GEPR | ORF starting with ATG of length 1452 |
| ID0925 | GEPR | YITG PROTEIN. |
| ID0926 | GEPR | ORF starting with ATG of length 1434 |
| ID0927 | GEPR | HYPOTHETICAL 43.1 KDA PROTEIN. |
| ID0928 | GEPR | HYPOTHETICAL 44.7 KDA PROTEIN IN GLNQ-ANSR INTERGENIC REGION |
| ID0929 | GEPR | ORF starting with ATG of length 1368 |
| ID0930 | GEPR | MULTIDRUG RESISTANCE PROTEIN 2 (MULTIDRUG-EFFLUX TRANSPORTER |
| ID0931 | GEPR | HYPOTHETICAL 44.7 KDA PROTEIN IN GLNQ-ANSR INTERGENIC REGION |
| ID0932 | GEPR | ORF starting with ATG of length 1266 |
| ID0933 | GEPR | ORF starting with ATG of length 1257 |
| ID0934 | GEPR | LMRB. |
| ID0935 | GEPR | HEXURONATE TRANSPORTER. |
| ID0936 | GEPR | ORF starting with ATG of length 1098 |
| ID0937 | GEPR | ORF starting with ATG of length 1047 |
| ID0938 | GEPR | ORF starting with ATG of length 993 |
| ID0939 | GEPR | ORF starting with ATG of length 918 |
| ID0940 | GEPR | HYPOTHETICAL 44.2 KDA PROTEIN IN COTF-TETB INTERGENIC REGION |
| ID0941 | GEPR | ORF starting with ATG of length 843 |
| ID0942 | GEPR | YFKF PROTEIN. |
| ID0943 | GEPR | ORF starting with ATG of length 747 |
| ID0944 | GEPR | PARTIAL PUTATIVE MEMBRANE TRANSPORT PROTEIN. |
| ID0945 | GEPR | GLUCOSE TRANSPORTER 3. |
| ID0946 | GEPR | SA2300 PROTEIN. |
| ID0947 | GEPR | ORF starting with ATG of length 456 |
| ID0948 | GEPR | SIMILAR TO METABOLITE TRANSPORT PROTEINS. |
| ID0949 | GEPR | BH0884 PROTEIN. |
| ID0950 | GER | HYPOTHETICAL 37.8 KDA PROTEIN. |
| ID0951 | GER | HYPOTHETICAL 33.8 KDA PROTEIN IN GLPT-PURT INTERGENIC REGION |
| ID0952 | GER | HYPOTHETICAL 34.0 KDA PROTEIN IN GLTP-PCP INTERGENIC REGION |
| ID0953 | GER | BH1931 PROTEIN. |
| ID0954 | GER | HYPOTHETICAL 30.5 KDA PROTEIN IN GDHI 5' REGION (ORF 2). |
| ID0955 | GER | HYPOTHETICAL 33.0 KDA PROTEIN IN PELB-PENP INTERGENIC REGION |
| ID0956 | GER | BH2747 PROTEIN. |
| ID0957 | GER | ORF starting with ATG of length 939 |
| ID0958 | GER | ORF starting with ATG of length 912 |
| ID0959 | GER | ORF starting with ATG of length 369 |
| ID0960 | GER | ORF starting with ATG of length 345 |
| ID0961 | GR | YVRK PROTEIN. |
| ID0962 | GR | YOAN. |
| ID0963 | GT | YJDC PROTEIN. |
| ID0964 | GT | PUTATIVE CEL OPERoN REGULATOR. |
| ID0965 | GT | FRUCTOSE SPECIFIC PERMEASE (FRAGMENT). |
| ID0966 | GT | BH0220 PROTEIN. |
| ID0967 | GT | ORF starting with ATG of length 459 |
| ID0968 | H | HYPOTHETICAL 53.0 KDA PROTEIN IN SFP-GERKA INTERGENIC REGION |
| ID0969 | H | YUEK PROTEIN. |
| ID0970 | H | MENAQUINONE BIOSYNTHESIS PROTEIN MEND [INCLUDES: 2-SUCCINYL- |
| ID0971 | H | THIAMINE BIOSYNTHESIS PROTEIN THIC. |
| ID0972 | H | S-ADENOSYLMETHIONINE SYNTHETASE (EC 2.5.1.6) (METHIONINEADEN |
| ID0973 | H | PROBABLE GLUCARATE DEHYDRATASE (EC 4.2.1.40) (GDH) (GLUCD). |
| ID0974 | H | GLUTAMYL-TRNA REDUCTASE (EC 1.2.1.-) (GLUTR). |
| ID0975 | H | GLUTAMATE-1-SEMIALDEHYDE 2,1-AMINOMUTASE (EC 5.4.3.8) (GSA) ( |
| ID0976 | H | B. subtilis rib operon protein translated from reading frame |
| ID0977 | H | MOLYBDOPTERIN BIOSYNTHESIS PROTEIN. |
| ID0978 | H | PROTOPORPHYRINOGEN OXIDASE (EC 1.3.3.4) (PPO). |
| ID0979 | H | PROBABLE AMINOTRANSFERASE YODT (EC 2.6.-.-). |
| ID0980 | H | BIOTIN SYNTHASE (EC 2.8.1.6) (BIOTIN SYNTHETASE) |
| ID0981 | H | 2-AMINO-3-KETOBUTYRATE COENZYME A LIGASE (EC 2.3.1.29) (AKB |
| ID0982 | H | BH1152 PROTEIN. |
| ID0983 | H | GLUTAMATE-1-SEMIALDEHYDE 2,1-AMINOMUTASE 2 (EC 5.4.3.8) (GSA |
| ID0984 | H | YLOI PROTEIN. |
| ID0985 | H | UROPORPHYRINOGEN DECARBOXYLASE (EC 4.1.1.37) (URO-D) (UPD). |
| ID0986 | H | YTFD. |
| ID0987 | H | PROBABLE OXYGEN-INDEPENDENT COPROPORPHYRINOGEN III OXIDASE (E |
| ID0988 | H | HYPOTHETICAL 38.0 KDA PROTEIN. |
| ID0989 | H | QUINOLINATE SYNTHETASE. |
| ID0990 | H | FOLYLPOLYGLUTAMATE SYNTHASE (EC 6.3.2.17) (FOLYLPOLY-GAMMA-G |
| ID0991 | H | MOLYBDENUM COFACTOR BIOSYNTHESIS PROTEIN A (NARA PROTEIN). |
| ID0992 | H | DIHYDROXYNAPHTHOATE SYNTHASE. |
| ID0993 | H | 8-AMINO-7-OXONONANOATE SYNTHASE (EC 2.3.1.47) (AONS) (8-AMIN |
| ID0994 | H | MOLYBDOPTERIN BIOSYNTHESIS PROTEIN. |
| ID0995 | H | YKFB. |
| ID0996 | H | DENOSYLMETHIONINE-8-AMINO-7-OXONONANOATE AMINOTRANSFERASE. |
| ID0997 | H | YJBU PROTEIN. |
| ID0998 | H | FOLD BIFUNCTIONAL PROTEIN [INCLUDES: METHYLENETETRAHYDROFOLA |
| ID0999 | H | HEPTAPRENYL DIPHOSPHATE SYNTHASE COMPONENT II (EC 2.5.1.30) |
| ID1000 | H | PORPHOBILINOGEN DEAMINASE (EC 4.3.1.8) (PBG) (HYDROXYMETHYLB |

-continued

| | | |
|---|---|---|
| ID1001 | H | *B. subtilis* pantothenate kinase, CoaA#1. |
| ID1002 | H | DGOA PROTEIN [INCLUDES: 2-DEHYDRO-3-DEOXYPHOSPHOGALACTONATE |
| ID1003 | H | YITF PROTEIN. |
| ID1004 | H | DELTA-AMINOLEVULINIC ACID DEHYDRATASE (EC 4.2.1.24) (PORPHOB |
| ID1005 | H | NH(3)-DEPENDENT NAD(+) SYNTHETASE (EC 6.3.5.1) (SPORE OUTGRO |
| ID1006 | H | 3-METHYL-2-OXOBUTANOATE HYDROXYMETHYLTRANSFERASE (EC 2.1.2.1 |
| ID1007 | H | DIHYDROPTEROATE SYNTHASE (EC 2.5.1.15) (DHPS) (DIHYDROPTEROA |
| ID1008 | H | PROBABLE THIAMINE BIOSYNTHESIS PROTEIN THII. |
| ID1009 | H | SUPEROXIDE-INDUCIBLE PROTEIN. |
| ID1010 | H | LYASE (NITROGEN-HYDROGEN) |
| ID1011 | H | PUTATIVE S-ADENOSYL L-METHIONINE: UROPORPHYRINOGEN IIIMETHYL |
| ID1012 | H | MENAQUINONE BIOSYNTHESIS METHYLTRANSFERASE (EC 2.1.1.-) (SPO |
| ID1013 | H | THIAMINE-MONOPHOSPHATE KINASE (EC 2.7.4.16) (THIAMINE-PHOSPH |
| ID1014 | H | FERROCHELATASE. |
| ID1015 | H | GERANYLTRANSTRANSFERASE (EC 2.5.1.10) (FARNESYL-DIPHOSPHATE |
| ID1016 | H | RIBOFLAVIN BIOSYNTHESIS PROTEIN RIBC [INCLUDES: RIBOFLAVIN K |
| ID1017 | H | METHYLTRANSFERASE/UROPORPHYRINOGEN-III SYNTHASE. |
| ID1018 | H | YJBV PROTEIN. |
| ID1019 | H | HYDROXYETHYLTHIAZOLE KINASE (EC 2.7.1.50) (4-METHYL-5-BETA-H |
| ID1020 | H | TRANSCRIPTIONAL REPRESSOR OF THE BIOTIN OPERON. |
| ID1021 | H | HYPOTHETICAL 21.4 KDA PROTEIN IN DACA-SERS INTERGENIC REGION |
| ID1022 | H | DIPICOLINATE SYNTHASE, B CHAIN. |
| ID1023 | H | HYPOTHETICAL 31.4 KDA PROTEIN IN PTA 3' REGION. |
| ID1024 | H | PROBABLE NICOTINATE-NUCLECTIDE PYROPHOSPHORYLASE [CARBOXYLAT |
| ID1025 | H | Polypeptide encoded by rib operon of *Bacillus subtilis*. |
| ID1026 | H | HOMOLOGUE OF PHENYLACRYLIC ACID DECARBOXYLASE PAD1 OF YEAST. |
| ID1027 | H | RIBOFLAVIN SYNTHASE ALPHA CHAIN (EC 2.5.1.9). |
| ID1028 | H | DETHIOBIOTIN SYNTHETASE (EC 6.3.3.3) (DETHIOBIOTIN SYNTHASE) |
| ID1029 | H | COMQ. |
| ID1030 | H | UROPORPHYRINOGEN-III SYNTHASE (EC 4.2.1.75) (UROS) (UROPORPH |
| ID1031 | H | YLOS PROTEIN. |
| ID1032 | H | THIAMIN BIOSYNTHESIS |
| ID1033 | H | BH2162 PROTEIN. |
| ID1034 | H | PROBABLE NICOTINATE-NUCLEOTIDE ADENYLYLTRANSFERASE (EC 2.7.7 |
| ID1035 | H | PANTOATE--BETA-ALANINE LIGASE (EC 6.3.2.1) (PANTOTHENATE SYN |
| ID1036 | H | MOLYBDOPTERIN-GUANINE DINUCLEOTIDE BIOSYNTHESIS PROTEIN B. |
| ID1037 | H | DEPHOSPHO-COA KINASE (EC 2.7.1.24) (DEPHOSPHOCOENZYME A KINA |
| ID1038 | H | MOLYBDOPTERIN CONVERTING FACTOR (SUBUNIT 2). |
| ID1039 | H | 6,7-DIMETHYL-8-RIBITYLLUMAZINE SYNTHASE (EC 2.5.1.9) (DMRL S |
| ID1040 | H | Bradykinin gene product from plasmid pBLAK1. |
| ID1041 | H | UNKNOWN (PYRIDOXAL PHOSPHATE BIOSYNTHETIC PROTEIN). |
| ID1042 | H | ASPARTATE 1-DECARBOXYLASE PRECURSOR (EC 4.1.1.11) (ASPARTATE |
| ID1043 | H | PROBABLE 1,4-DIHYDROXY-2-NAPHTHOATE OCTAPRENYLTRANSFERASE (E |
| ID1044 | H | ORF starting with ATG of length 984 |
| ID1045 | H | 6-PYRUVOYL TETRAHYDROBIOPTERIN SYNTHASE HOMOLOGUE. |
| ID1046 | H | ASPARTATE OXIDASE (NADB) (EC 1.4.3.16). |
| ID1047 | H | PROBABLE LIPOIC ACID SYNTHETASE (LIP-SYN) (LIPOATE SYNTHASE) |
| ID1048 | H | DIHYDRONEOPTERIN ALDOLASE (EC 4.1.2.25). |
| ID1049 | H | LIPOIC ACID SYNTHASE. |
| ID1050 | H | ORF starting with ATG of length 675 |
| ID1051 | H | 6-CARBOXYHEXANOATE--COA LIGASE (EC 6.2.1.14) (PIMELOYL-COASY |
| ID1052 | H | 2-AMINO-4-HYDROXY-6-HYDROXYMETHYLDIHYDROPTERIDINE PYROPHOSPH |
| ID1053 | H | Protein product of *Lactococcus lactis* DNA fragment. |
| ID1054 | H | MOLYBDOPTERIN-GUANINE DINUCLEOTIDE BIOSYNTHESIS PROTEIN A. |
| ID1055 | H | PYRIDOXAL PHOSPHATE BIOSYNTHETIC PROTEIN, PDXA. |
| ID1056 | H | ORF starting with ATG of length 513 |
| ID1057 | H | YJBS PROTEIN. |
| ID1058 | H | HYPOTHETICAL 21.4 KDA PROTEIN IN SODA-COMGA INTERGENIC REGIO |
| ID1059 | H | *B. subtilis* pantothenate synthetase. |
| ID1060 | H | ORF starting with ATG of Length 354 |
| ID1061 | H | Sirohem synthase protein. |
| ID1062 | H | ORF starting with ATG of length 303 |
| ID1063 | H | ORF starting with ATG of length 406 |
| ID1064 | H | THIAMINE-MONOPHOSPHATE KINASE (EC 2.7.4.16) (THIAMINE-PHOSPH |
| ID1065 | HC | HYPOTHETICAL 54.4 KDA PROTEIN. |
| ID1066 | HC | 4-HYDROXYBENZOATE 3-MONOOXYGENASE (EC 1.14.13.2) (P-HYDROXYB |
| ID1067 | HE | PHOSPHOSERINE AMINOTRANSFERASE (EC 2.6.1.52) (PSAT) (VEGETAT |
| ID1068 | HI | *Synechocystis* sp. 6803 DXP synthase protein sequence. |
| ID1069 | HI | ORF starting with ATG of length 1536 |
| ID1070 | HI | *Bacillus subtilis* DXP synthase protein sequence. |
| ID1071 | HI | *Synechocystis* sp. 6803 DXP synthase protein sequence. |
| ID1072 | HQ | ISOCHORISMATE SYNTHASE DHBC (EC 5.4.99.6). |
| ID1073 | HQ | MENAQUINONE-SPECIFIC ISOCHORISMATE SYNTHASE (EC 5.4.99.6). |
| ID1074 | I | YUSL PROTEIN. |
| ID1075 | I | YNGE PROTEIN. |
| ID1076 | I | HYPOTHETICAL 72.2 KDA PROTEIN. |
| ID1077 | I | YTCI. |
| ID1078 | I | PROBABLE CARDIOLIPIN SYNTHETASE 2 (EC 2.7.8.-) (CARDIOLIPIN |
| ID1079 | I | SQUALENE-HOPENE CYCLASE. |

| | | -continued |
|---|---|---|
| ID1080 | I | YUSK PROTEIN. |
| ID1081 | I | YNGH. |
| ID1082 | I | BUTYRYL-COA DEHYDROGENASE. |
| ID1083 | I | 1-DEOXY-D-XYLULOSE 5-PHOSPHATE REDUCTOISOMERASE (EC 1.1.1.-) |
| ID1084 | I | METHYLMALONYL-COA DECARBOXYLASE ALPHA SUBUNIT (EC 6.4.1.3). |
| ID1085 | I | ACETYL-COENZYME A CARBOXYLASE CARBOXYL TRANSFERASE SUBUNIT A |
| ID1086 | I | MALONYL COA-ACYL CARRIER PROTEIN TRANSACYLASE (EC 2.3.1.39) |
| ID1087 | I | ACSA (FRAGMENT). |
| ID1088 | I | 4-DIPHOSPHOCYTIDYL-2-C-METHYL-D-ERYTHRITOL KINASE (EC 2.7.1. |
| ID1089 | I | FATTY ACID/PHOSPHOLIPID SYNTHESIS PROTEIN PLSX. |
| ID1090 | I | ACYL-COA DEHYDROGENASE (EC 1.3.99.). |
| ID1091 | I | ACETYL-COA ACETYLTRANSFERASE (EC 2.3.1.9). |
| ID1092 | I | ORF starting with ATG of length 1977 |
| ID1093 | I | HYPOTHETICAL 45.8 KDA PROTEIN IN ACDA-NARI INTERGENIC REGION |
| ID1094 | I | YVAB PROTEIN. |
| ID1095 | I | YDBM PROTEIN. |
| ID1096 | I | 3-HYDROXYBUTYRYL-COA DEHYDROGENASE (EC 1.1.1.157). |
| ID1097 | I | PHOSPHATIDATE CYTIDYLYLTRANSFERASE (EC 2.7.7.41) (CDP-DIGLYC |
| ID1098 | I | FATTY ACID DESATURASE. |
| ID1099 | I | UNDECAPRENYL PYROPHOSPHATE SYNTHETASE (EC 2.5.1.31) (UPP SYN |
| ID1100 | I | BUTYRATE ACETOACETATE-COA TRANSFERASE. |
| ID1101 | I | ORF starting with ATG of length 1716 |
| ID1102 | I | YUSJ PROTEIN. |
| ID1103 | I | 4-DIPHOSPHOCYTIDYL-2C-METHYL-D-ERYTHRITOL SYNTHASE (EC 2.7.7 |
| ID1104 | I | FATTY ACID DESATURASE. |
| ID1105 | I | PHAGE SHOCK PROTEIN A HOMOLOG. |
| ID1106 | I | ACETYL-COA CARBOXYLASE BIOTIN CARBOXYLASE SUBUNIT (EC 6.4.1. |
| ID1107 | I | TYPE B CARBOXYLESTERASE (EC 3.1.1.1). |
| ID1108 | I | PYRUVATE CARBOXYLASE (FRAGMENT). |
| ID1109 | I | HYPOTHETICAL 30.7 KDA PROTEIN IN MCPC-KINA INTERGENIC REGION |
| ID1110 | I | HYPOTHETICAL 19.9 KDA PROTEIN IN ILVD-THYB INTERGENIC REGION |
| ID1111 | I | HYPOTHETICAL 25.7 KDA PROTEIN IN GERAC-FHUC INTERGENIC REGIO |
| ID1112 | I | BUTYRYL-COA DEHYDROGENASE (EC 1.1.1.35) (3-HYDROXYACYL-COADE |
| ID1113 | I | B. subtilis hydrolase protein YTPA. |
| ID1114 | I | HYPOTHETICAL 18.7 KDA PROTEIN IN HOM-MRGA INTERGENIC REGION. |
| ID1115 | I | CG5044 PROTEIN. |
| ID1116 | I | SIMILAR TO HYDROXYMYRISTOYL- (ACYL CARRIER PROTEIN) DEHYDRATA |
| ID1117 | I | PHOSPHATIDYLSERINE DECARBOXYLASE PROENZYME (EC 4.1.1.65). |
| ID1118 | I | YHAR PROTEIN. |
| ID1119 | I | HYPOTHETICAL 35.4 KDA PROTEIN. |
| ID1120 | I | ORF starting with ATG of length 1089 |
| ID1121 | I | 3-HYDROXYBUTYRYL-COA DEHYDRATASE. |
| ID1122 | I | BUTYRATE-ACETOACETATE COA-TRANSFERASE SUBUNIT B (EC 2.8.3.9) |
| ID1123 | I | 3-HYDROXYACYL-COA DEHYDROGENASE/ENOYL COA HYDRATASE (EC 1.1. |
| ID1124 | I | 2C-METHYL-D-ERYTHRITOL 2,4-CYCLODIPHOSPHATE SYNTHASE (MECPS) |
| ID1125 | I | ACETYL-COA SYNTHETASE (ACS-3). |
| ID1126 | I | TYPE B CARBOXYLESTERASE (EC 3.1.1.1). |
| ID1127 | I | CDP-DIACYLGLYCEROL--GLYCEROL-3-PHOSPHATE-3-PHOSPHATIDYLTRANS |
| ID1128 | I | ORF starting with ATG of length 897 |
| ID1129 | I | ORF starting with ATG of length 888 |
| ID1130 | I | ACETYL-COA CARBOXYLASE TRANSFERASE BETA SUBUNIT (EC 6.4.1.2) |
| ID1131 | I | ORF starting with ATG of length 855 |
| ID1132 | I | BH2687 PROTEIN. |
| ID1133 | I | PUTATIVE ACYL-COA THIOESTER HYDROLASE YKHA (EC 3.1.2.-). |
| ID1134 | I | CFR-ASSOCIATED PROTEIN P70. |
| ID1135 | I | ORF starting with ATG of length 630 |
| ID1136 | I | ORF starting with ATG of length 627 |
| ID1137 | I | BH1133 PROTEIN. |
| ID1138 | I | YDBM PROTEIN. |
| ID1139 | I | HYPOTHETICAL 19.6 KDA PROTEIN IN SIPU-PBPC INTERGENIC REGION |
| ID1140 | I | ORF starting with ATG of length 342 |
| ID1141 | I | CG4784 PROTEIN. |
| ID1142 | I | ACYL-COA DEHYDROGENASE (FRAGMENT) |
| ID1143 | I | MALONYL COA-ACYL CARRIER PROTEIN TRANSACYLASE (EC 2.3.1.39) |
| ID1144 | I | ACSA (FRAGMENT). |
| ID1145 | IM | LYTB PROTEIN HOMOLOG. |
| ID1146 | IQ | YJAY PROTEIN. |
| ID1147 | IQ | OSB-COA SYNTHASE. |
| ID1148 | IQ | LONG-CHAIN-FATTY-ACID-COA LIGASE. |
| ID1149 | IQ | LONG-CHAIN-FATTY-ACID--COA LIGASE (FADD-7). |
| ID1150 | IQ | DNA encoding human synthetase #8. |
| ID1151 | IQ | ORF starting with ATG of length 1386 |
| ID1152 | IQ | LONG-CHAIN-FATTY-ACID--COA LIGASE (FADD-7). |
| ID1153 | IQ | D-ALANYL CARRIER PROTEIN (DCP). |
| ID1154 | J | VALYL-TRNA SYNTHETASE (EC 6.1.1.9). |
| ID1155 | J | THREONYL-TRNA SYNTHETASE 1 (EC 6.1.1.3) (THREONINE--TRNA LIG |
| ID1156 | J | ISOLEUCYL-TRNA SYNTHETASE (EC 6.1.1.5) (ISOLEUCINE--TRNA LIG |
| ID1157 | J | TRANSLATIONAL ELONGATION FACTOR G. |
| ID1158 | J | ARGINYL-TRNA SYNTHETASE (EC 6.1.1.19) (ARGININE--TRNA LIGASE |

-continued

| ID1159 | J | PHENYLALANYL-TRNA SYNTHETASE BETA SUBUNIT (EC 6.1.1.20). |
| ID1160 | J | TRANSLATION INITIATION FACTOR IF-2. |
| ID1161 | J | HYPOTHETICAL 58.2 EDA PROTEIN IN KLB-COTE INTERGENIC REGION. |
| ID1162 | J | PROLYL-TRNA SYNTHETASE. |
| ID1163 | J | CYSTEINYL-TRNA SYNTHETASE (EC 6.1.1.16) (CYSTEINE--TRNA LIGA |
| ID1164 | J | GLUTAMYL-TRNA (GLN) AMIDOTRANSFERASE SUBUNIT A. |
| ID1165 | J | ASPARAGINYL-TRNA SYNTHETASE (EC 6.1.1.22) (ASPARAGINE--TRNA |
| ID1166 | J | THREONYL-TRNA SYNTHETASE 2 (EC 6.1.1.3) (THREONINE--TRNA LIG |
| ID1167 | J | HYPOTHETICAL 51.7 KDA PROTEIN IN DNAJ-RPSU INTEREGENIC REGIO |
| ID1168 | J | SERYL-TRNA SYNTHETASE (EC 6.1.1.11) (SERINE--TRNA LIGASE) (S |
| ID1169 | J | YFJO PROTEIN. |
| ID1170 | J | GLYCYL-TRNA SYNTHETASE BETA CHAIN (EC 6.1.1.14) (GLYCINE--TR |
| ID1171 | J | TYROSYL-TRNA SYNTHETASE 1 (EC 6.1.1.1) (TYROSINE--TRNA LIGAS |
| ID1172 | J | HISTIDYL-TRNA SYNTHETASE (EC 6.1.1.21) (HISTIDINE--TRNA LIGA |
| ID1173 | J | ALANYL-TRNA SYNTHETASE (EC 6.1.1.7) (ALANINE--TRNA LIGASE) ( |
| ID1174 | J | TYROSYL-TRNA SYNTHETASE 2 (EC 6.1.1.1) (TYROSINE--TRNA LIGAS |
| ID1175 | J | PROBABLE TRNA (S-METHYLAMINOMETHYL-2-THIOURIDYLATE)-METHYLTR |
| ID1176 | J | PEPTIDE CHAIN RELEASE FACTOR 1 (RF-1). |
| ID1177 | J | GLUTAMYL-TRNA (GLN) AMIDOTRANSFERASE SUBUNIT B (EC 6.3.5.-) ( |
| ID1178 | J | GLUTAMYL-TRNA SYNTHETASE (EC 6.1.1.17) (GLUTAMATE--TRNA LIGA |
| ID1179 | J | LEUCYL-TRNA SYNTHETASE (EC 6.1.1.4). |
| ID1180 | J | PUTATIVE TRANSLATION INITIATION FACTOR EIF-2B (EIF-2B GDP-GT |
| ID1181 | J | LYSYL-TRNA SYNTHETASE (EC 6.1.1.6) (LYSINE--TRNA LIGASE) (LY |
| ID1182 | J | PROBABLE METHYLTRANSFERASE (EC 2.1.1.-). |
| ID1183 | J | LEUCYL-TRNA SYNTHETASE (EC 6.1.1.4) (LEUCINE--TRNA LIGASE) ( |
| ID1184 | J | ATP PHOSPHORIBOSYLTRANSFERASE REGULATORY SUBUNIT. |
| ID1185 | J | ELONGATION FACTOR TS (EF-TS). |
| ID1186 | J | TRYPTOPHANYL-TRNA SYNTHETASE (EC 6.1.1.2) (TRYPTOPHAN--TRNA |
| ID1187 | J | POLYRIBONUCLEOTIDE NUCLEOTIDYLTRANSFERASE (EC 2.7.7.8) (POLY |
| ID1188 | J | POLY(A) POLYMERASE (EC 2.7.7.19) (PAP). |
| ID1189 | J | DIMETHYLADENOSINE TRANSFERASE (EC 2.1.1.-) (S-ADENOSYLMETHIO |
| ID1190 | J | QUEUINE TRNA-RIBOSYLTRANSFERASE (EC 2.4.2.29) (TRNA-GUANINET |
| ID1191 | J | 30S RIBOSOMAL PROTEIN S2 (BS1) (VEGETATIVE PROTEIN 209) (VEG |
| ID1192 | J | *Streptococcus pneumoniae* glycyl tRNA synthetase alpha. |
| ID1193 | J | HYPOTHETICAL TRNA/RRNA METYYLTRANSFERASE YACO (EC 2.1.1.-). |
| ID1194 | J | YFLG PROTEIN. |
| ID1195 | J | METHIONINE AMINOPEPTIDASE (EC 3.4.11.18) (MAP). |
| ID1196 | J | 30S RIBOSOMAL PROTEIN S3 (BS3) (BS2). |
| ID1197 | J | RIBONUCLEASE PH (FRAGMENT). |
| ID1198 | J | TRNA PSEUDOURIDINE SYNTHASE A (EC 4.2.1.70) (PSEUDOURIDYLATE |
| ID1199 | J | Aspartyl-tRNA synthetase from *Staph. aureus*. |
| ID1200 | J | HYPOTHETICAL 29.7 KDA PROTEIN IN FOLD-AHRC INTERGENIC REGION |
| ID1201 | J | HEMK PROTEIN HOMOLOG. |
| ID1202 | J | HYPOTHETICAL 33.7 KDA PROTEIN IN CSPB-GLPP INTERGENIC REGION |
| ID1203 | J | HYPOTHETICAL P20 PROTEIN. |
| ID1204 | J | TRNA PSEUDOURIDINE SYNTHASE B (EC 4.2.1.70) (TRNA PSEUDOURID |
| ID1205 | J | HYPOTHETICAL 31.5 KDA PROTEIN IN MECA-TENA INTERGENIC REGION |
| ID1206 | J | PEPTIDYL-TRNA HYDROLASE (EC 3.1.1.29) (PTH) (STAGE V SPORULA |
| ID1207 | J | METHIONYL-TRNA FORMYLTRANSFERASE (EC 2.1.2.9). |
| ID1208 | J | POLYRIBONUCLEOTIDE NUCLEOTIDYLTRANSFERASE (EC 2.7.7.8) (POLY |
| ID1209 | J | HYPOTHETICAL 37.0 KDA PROTEIN IN SPOIIR-GLYC INTERGENIC REGI |
| ID1210 | J | Methionyl-tRNA synthetase from *Staph. aureus*. |
| ID1211 | J | POLYPEPTIDE DEFORMYLASE 2 (EC 3.5.1.31) (PDF 2) (FORMYLMETHI |
| ID1212 | J | HYPOTHETICAL 22.0 KDA PROTEIN IN FLIT-SECA INTERGENIC REGION |
| ID1213 | J | 30S RIBOSOMAL PROTEIN S7 (BS7). |
| ID1214 | J | HYPOTHETICAL 22.5 KDA PROTEIN IN RPLL-RPOB INTERGENIC REGION |
| ID1215 | J | PHENYLALANYL-TRNA SYNTHETASE ALPHA CHAIN (EC 6.1.1.20) (PHEN |
| ID1216 | J | 50S RIBOSOMAL PROTEIN L10 (BL5) (COLD ACCLIMATIZATION PROTEI |
| ID1217 | J | ORF starting with ATG of length 1479 |
| ID1218 | J | 50S RIBOSOMAL PROTEIN L3 (BL3). |
| ID1219 | J | 50S RIBOSOMAL PROTEIN L13. |
| ID1220 | J | 50S RIBOSOMAL PROTEIN L16. |
| ID1221 | J | 50S RIBOSOMAL PROTEIN L15. |
| ID1222 | J | S-ADENOSYLMETHIONINE:TRNA RIBOSYLTRANSFERASE-ISOMERASE (EC 5 |
| ID1223 | J | YJCG PROTEIN. |
| ID1224 | J | ERM2 PROTEIN. |
| ID1225 | J | 16S PSEUDOURIDYLATE SYNTHASE. |
| ID1226 | J | 30S RIBOSOMAL PROTEIN S11 (BS11). |
| ID1227 | J | 30S RIBOSOMAL PROTEIN S9 (BS10). |
| ID1228 | J | GLYCYL-TRNA SYNTHETASE BETA CHAIN (EC 6.1.1.14) (GLYCINE--TR |
| ID1229 | J | PUTATIVE REGULATOR OF PURINE BIOSYNTHESIS. |
| ID1230 | J | S-ADENOSYLMETHIONINE TRNA RIBOSYLTRANSFERASE. |
| ID1231 | J | RRNA METHYLASE HOMOLOG. |
| ID1232 | J | AT1G08980/F7G19_15. |
| ID1233 | J | 30S RIBOSOMAL PROTEIN S13. |
| ID1234 | J | 50S RIBOSOMAL PROTEIN L14. |
| ID1235 | J | GENERAL STRESS PROTEIN CTC. |
| ID1236 | J | RIBOSOME-BINDING FACTOR A (P158 PROTEIN). |
| ID1237 | J | 50S RIBOSOMAL PROTEIN L17. |

-continued

| ID1238 | J | ELONGATION FACTOR P (EF-P). |
|---|---|---|
| ID1239 | J | 50S RIBOSOMAL PROTEIN L6 (BL10). |
| ID1240 | J | 6-AMINOHEXANOATE-CYCLIC-DIMER HYDROLASE. |
| ID1241 | J | 50S RIBOSOMAL PROTEIN L24 (BL23) (12 KDA DNA-BINDING PROTEIN |
| ID1242 | J | ORF starting with ATG of length 989 |
| ID1243 | J | ORF starting with ATG of length 964 |
| ID1244 | J | SA0330 PROTEIN. |
| ID1245 | J | BH1243 PROTEIN. |
| ID1246 | J | 30S RIBOSOMAL PROTEIN S19 (BS19). |
| ID1247 | J | HYPOTHETICAL 37.0 KDA PROTEIN IN SPOIIR-GLYC INTERGENIC REGI |
| ID1248 | J | 30S RIBOSOMAL PROTEIN S1 HOMOLOG. |
| ID1249 | J | ORF starting with ATG of length 873 |
| ID1250 | J | HYPOTHETICAL 18.7 KDA PROTEIN. |
| ID1251 | J | Glutamyl-tRNA (GLn) amidotransferase subunit ratC subunit. |
| ID1252 | J | 30S RIBOSOMAL PROTEIN S17 (BS16). |
| ID1253 | J | 50S RIBOSOMAL PROTEIN L27 (BL30) (BL24). |
| ID1254 | J | 30S RIBOSOMAL PROTEIN S8 (BS8). |
| ID1255 | J | 50S RIBOSOMAL PROTEIN L20. |
| ID1256 | J | RHIZOBACTIN SIDEROPHORE BIOSYNTHESIS PROTEIN RHSD. |
| ID1257 | J | ALANYL-TRNA SYNTHETASE (ALAS). |
| ID1258 | J | 30S RIBOSOMAL PROTEIN S18 (BS21). |
| ID1259 | J | A formate transport associated protein, FMD. |
| ID1260 | J | HYPOTHETICAL 9.7 KDA PROTEIN IN MFD-DIVIC INTERGENIC REGION. |
| ID1261 | J | HYPOTHETICAL 21.1 KDA PROTEIN IN AMYX-OPUD INTERGENIC REGION |
| ID1262 | J | TRANSLATION INITIATION FACTOR IF-1. |
| ID1263 | J | 30S RIBOSOMAL PROTEIN S20 (BS20). |
| ID1264 | J | YJCK PROTEIN. |
| ID1265 | J | ORF starting with ATG of length 705 |
| ID1266 | J | BH1498 PROTEIN. |
| ID1267 | J | PHE-TRNA SYNTHETASE ALPHA CHAIN. |
| ID1268 | J | SPERMIDINE N1-ACETYLTRANSFERASE (EC 2.3.1.57) (DIAMINEACETYL |
| ID1269 | J | CG8684 PROTEIN. |
| ID1270 | J | 30S RIBOSOMAL PROTEIN S6 (BS9). |
| ID1271 | J | TRNA-GUANINE TRANSGLYCOSYLASE. |
| ID1272 | J | ORF starting with ATG of length 600 |
| ID1273 | J | 6-AMINOHEXANOATE-CYCLIC-DIMER HYRDOLASE. |
| ID1274 | J | HYPOTHETICAL 12.3 KDA PROTEIN IN RPLU-RPMA INTERGENIC REGION |
| ID1275 | J | 50S RIBOSOMAL PROTEIN L5 (BL6). |
| ID1276 | J | YFKH PROTEIN. |
| ID1277 | J | 50S RIBOSOMAL PROTEIN L30 (BL27). |
| ID1278 | J | SA1699 PROTEIN. |
| ID1279 | J | ORF starting with ATG of length 537 |
| ID1280 | J | ORF starting with ATG of length 510 |
| ID1281 | J | ORF starting with ATG of length 507 |
| ID1282 | J | TRANSLATION INITIATION FACTOR IF-3. |
| ID1283 | J | 50S RIBOSOMAL PROTEIN L7/L12 (BL9) ('A' TYPE) (VEGETATIVE PR |
| ID1284 | J | RIBOSOMAL PROTEIN S15 (BS18). |
| ID1285 | J | 50S RIBOSOMAL PROTEIN L2 (BL2). |
| ID1286 | J | SPERMIDINE N1-ACETYLTRANSFERASE (EC 2.3.1.57) (DIAMINEACETYL |
| ID1287 | J | ORF starting with ATG of length 477 |
| ID1288 | J | TRANSLATION INITIATION INHIBITOR, PUTATIVE. |
| ID1289 | J | 50S RIBOSOMAL PROTEIN L22. |
| ID1290 | J | PROTEIN SYNTHESIS INHIBITOR, PUTATIVE. |
| ID1291 | J | ASPARTYL-TRNA SYNTHETASE (EC 6.1.1.12) (ASPARTATE--TRNA LIGA |
| ID1292 | J | BH0940 PROTEIN. |
| ID1293 | J | 50S RIBOSOMAL PROTEIN L28. |
| ID1294 | J | 50S RIBOSOMAL PROTEIN L22. |
| ID1295 | J | ELONGATION FACTCR-P HOMOLOG (FRAGMENT). |
| ID1296 | J | THREONYL-TRNA SYNTHETASE 1 (EC 6.1.1.3) (THREONINE--TRNA LIG |
| ID1297 | J | HYPOTHETICAL 29.7 KDA PROTEIN IN FOLD-AHRC INTERGENIC REGION |
| ID1298 | J | PEPTIDE CHAIN RELEASE FACTOR 2 (RF-2) (FRAGMENT). |
| ID1299 | J | GLUTAMYL-TRNA SYNTHETASE (EC 6.1.1.17). |
| ID1300 | J | ORF starting with ATG of length 318 |
| ID1301 | J | GLUTAMINYL-TRNA SYNTHETASE (EC 6.1.1.18) (GLUTAMINE--TRNA LI |
| ID1302 | J | ORF starting with ATG of length 270 |
| ID1303 | J | ORF starting with TTG or GTG of length 497 |
| ID1304 | J | ORF starting with ATG of length 228 |
| ID1305 | J | ORF starting with ATG of length 225 |
| ID1306 | J | ORF starting with TTG or GTG of length 438 |
| ID1307 | J | HYPOTHETICAL 18.7 KDA PROTEIN. |
| ID1308 | J | RIBONUCLEASE PH (FRAGMENT). |
| ID1309 | JE | ELONGATION FACTOR TU (EF-TU) (P-40). |
| ID1310 | K | DNA-DIRECTED RNA POLYMERASE BETA CHAIN (EC 2.7.7.6) (TRANSCR |
| ID1311 | K | DNA-DIRECTED RNA POLYMERASE BETA' CHAIN (EC 2.7.7.6) (TRANSC |
| ID1312 | K | YTDP PROTEIN. |
| ID1313 | K | RNA POLYMERASE SIGMA FACTOR RPOD (SIGMA-A) (SIGMA-43). |
| ID1314 | K | N UTILIZATION SUBSTANCE PROTEIN A HOMOLOG. |
| ID1315 | K | DNA-DIRECTED RNA POLYMERASE ALPHA CHAIN (EC 2.7.7.6) (TRANSC |
| ID1316 | K | TRANSCRIPTION TERMINATION FACTOR RHO. |

-continued

| | | |
|---|---|---|
| ID1317 | K | CENTRAL GLYCOLYTIC GENES RECULATOR. |
| ID1318 | K | HEAT-INDUCIBLE TRANSCRIPTION REPRESSOR HRCA. |
| ID1319 | K | DEOXYRIBONUCLEOSIDE REGULATOR. |
| ID1320 | K | VIRULENCE-ASSOCIATED PROTEIN. |
| ID1321 | K | HYPOTHETICAL TRANSCRIPTIONAL REGULATOR IN CLPP-CRH INTERGENI |
| ID1322 | K | SIGMA-B GENERAL STRESS TRANSCRIPTION FACTOR. |
| ID1323 | K | HYPOTHETICAL TRANSCRIPTIONAL REGULATOR YKUM. |
| ID1324 | K | TRANSCRIPTIONAL REGULATORY PROTEIN GLTC. |
| ID1325 | K | RNA POLYMERASE SIGMA-54 FACTOR. |
| ID1326 | K | *B. subtilis* novel pantothenate kinase encoded by the gene co |
| ID1327 | K | STAGE 0 SPORULATION PROTEIN J. |
| ID1328 | K | PROBABLE HTH_ARAC_FAMILY OF TRANSCRIPTIONAL REGULATOR. |
| ID1329 | K | RNA POLYMERASE SIGMA-E FACTOR PRECURSOR (SIGMA-29) (P31) (ST |
| ID1330 | K | YKVZ PROTEIN. |
| ID1331 | K | PUTATIVE FIBRONECTIN-BINDING PROTEIN (YLCA PROTEIN). |
| ID1332 | K | YKOZ PROTEIN. |
| ID1333 | K | XYL REPRESSOR. |
| ID1334 | K | LACI REPRESSOR-LIKE PROTEIN (YJMH PROTEIN). |
| ID1335 | K | RNA POLYMERASE SIGMA-28 FACTOR PRECURSOR. |
| ID1336 | K | PUTATIVE FIBRONECTIN-BINDING PROTEIN (YLOA PROTEIN). |
| ID1337 | K | HOMOLOGUE OF ALS OPERON REGULATORY PROTEIN ALSR OF *B. SUBTIL* |
| ID1338 | K | ALS OPERON REGULATORY PROTEIN. |
| ID1339 | K | RNA POLYMERASE SIGMA-G FACTOR (STAGE III SPORULATION PROTEIN |
| ID1340 | K | HYPOTHETICAL 37.7 KDA PROTEIN. |
| ID1341 | K | KDG OPERON REPRESSOR. |
| ID1342 | K | TRANSCRIPTIONAL ACTIVATOR TENA. |
| ID1343 | K | HYPOTHETICAL TRANSCRIPTIONAL REGULATOR IN GLTP-CWLJ INTERGEN |
| ID1344 | K | HYPOTHETICAL TRANSCRIPTIONAL REGULATOR IN SPOIIIE-PGSA INTER |
| ID1345 | K | LACI-FAMILY TRANSCRIPTION REGULATOR. |
| ID1346 | K | RNA POLYMERASE SIGMA-H FACTOR (SIGMA-30). |
| ID1347 | K | CATABOLITE CONTROL PROTEIN A (GLUCOSE-RESISTANCE AMYLASE REG |
| ID1348 | K | HYPOTHETICAL 33.3 KDA PROTEIN IN FEUA-SIGW INTERGENIC REGION |
| ID1349 | K | PUTATIVE FRUCTOKINASE (EC 2.7.1.4). |
| ID1350 | K | RNA POLYMERASE SIGMA-D FACTOR (SIGMA-28). |
| ID1351 | K | TREHALOSE OPERON TRANSCRIPTIONAL REPRESSOR. |
| ID1352 | K | HYPOTHETICAL TRANSCRIPTIONAL REGULATOR IN SIPU-PBPC INTERGEN |
| ID1353 | K | HYPOTHETICAL 29.3 KDA PROTEIN IN GLVA-GLVC INTERGENIC REGION |
| ID1354 | K | RNA POLYMERASE SIGMA FACTOR SIGW. |
| ID1355 | K | HYPOTHETICAL TRANSCRIPTIONAL REGULATOR YWFK. |
| ID1356 | K | TRANSCRIPTIONAL ACTIVATOR OF MULTIDRUG-EFFLUX TRANSPORTER GE |
| ID1357 | K | HYPOTHETICAL TRANSCRIPTIONAL REGULATOR YWBI. |
| ID1358 | K | HYPOTHETICAL TRANSCRIPTIONAL REGULATOR IN MRGA-CITG INTERGEN |
| ID1359 | K | PROTEASE PRODUCTION REGULATORY PROTEIN HPR. |
| ID1360 | K | TRANSCRIPTIONAL REPRESSOR OF THE XYLOSE OPERON. |
| ID1361 | K | STAGE V SPORULATION PROTEIN T. |
| ID1362 | K | HYPOTHETICAL 24.3 KDA PROTEIN (YVFI PROTEIN). |
| ID1363 | K | YDHQ PROTEIN. |
| ID1364 | K | Gene product which inhibits production of coenzymes and intr |
| ID1365 | K | RNA POLYMERASE SIGMA FACTOR SIGX. |
| ID1366 | K | YUGG PROTEIN. |
| ID1367 | K | HYPOTHETICAL TRANSCRIPTICNAL REGULATOR IN HEMY-GLTT INTERGEN |
| ID1368 | K | YEEK PROTEIN. |
| ID1369 | K | BH0411 PROTEIN. |
| ID1370 | K | HYPOTHETICAL PROTEIN YWRC. |
| ID1371 | K | TRANSCRIPTION ELONGATION FACTOR GREA (TRANSCRIPT CLEAVAGE FA |
| ID1372 | K | MEMBRANE-BOUND PROTEIN LYTR. |
| ID1373 | K | HYPOTHETICAL 21.1 KDA PROTEIN IN GBSA-TLPB INTERGENIC REGION |
| ID1374 | K | TRANSCRIPTIONAL REGULATOR (MARR FAMILY). |
| ID1375 | K | PEPTIDE METHIONINE SULFOXIDE REDUCTASE REGULATOR. |
| ID1376 | K | BH0391 PROTEIN. |
| ID1377 | K | HYPOTHETICAL 21.3 KDA PROTEIN (ORF-1). |
| ID1378 | K | Modified penicillinase repressor penI gene product. |
| ID1379 | K | HYPOTHETICAL TRANSCRTPTIONAL REGULATOR IN WPRA-DEGA INTERGEN |
| ID1380 | K | RNA POLYMERASE SIGMA FACTOR SIGY. |
| ID1381 | K | TRANSCRIPTIONAL REGULATCR LRPC. |
| ID1382 | K | ATTENUATOR FOR LYTABC AND LYTR EXPRESSION. |
| ID1383 | K | SIMILAR TO *B. SUBTILIS* YWGB GENE (BH0656 PROTEIN). |
| ID1384 | K | YKVE PROTEIN. |
| ID1385 | K | YWQ [A, B, C, D, E, F, G, H, I, J, K, L, M, N, O] GENES. |
| ID1386 | K | PUTATIVE RNA POLYMERASE SIGMA FACTOR YLAC. |
| ID1387 | K | YFMP. |
| ID1388 | K | GLUCONATE OPERON TRANSCRIPTIONAL REPRESSOR. |
| ID1389 | K | HYPOTHETICAL 16.6 KDA PROTEIN IN GLPD-SPOVR INTERGENIC REGIO |
| ID1390 | K | HYPOTHETICAL 20.7 KDA PROTEIN IN BLTR-SPOIIIC INTERGENIC REG |
| ID1391 | K | SINR PROTEIN. |
| ID1392 | K | HYPOTHETICAL 14.5 KDA PROTEIN IN GAPB-MUTM INTERGENIC REGION |
| ID1393 | K | REGULATORY PROTEIN. |
| ID1394 | K | RNA POLYMERASE ECF-TYPE SIGMA FACTOR. |
| ID1395 | K | RIBONUCLEASE R (EC 3.1.-.-) (RNASE R) (VACB PROTEIN HOMOLOG) |

| | | -continued |
|---|---|---|
| ID1396 | K | ORF starting with ATG of length 1056 |
| ID1397 | K | RIBOSE OPERON REPRESSOR. |
| ID1398 | K | N UTILIZATION SUBSTANCE PROTEIN B HOMOLOG (NUSB PROTEIN). |
| ID1399 | K | ORF starting with ATG of length 1047 |
| ID1400 | K | HYPOTHETICAL 17.6 KDA PROTEIN. |
| ID1401 | K | YRHO. |
| ID1402 | K | SCGR GENE. |
| ID1403 | K | BH3951 PROTEIN. |
| ID1404 | K | RIBONUCLEASE III (EC 3.1.26.3) (RNASE III). |
| ID1405 | K | TRANSCRIPTIONAL REGULATOR LRPA. |
| ID1406 | K | HYPOTHETICAL 14.7 KDA PROTEIN. |
| ID1407 | K | HYPOTHETICAL TRANSCRIPTIONAL REGULATOR YTLI. |
| ID1408 | K | HYPOTEETICAL 32.8 KDA PROTEIN IN SPO0J-GIDB INTERGENIC REGIO |
| ID1409 | K | HYPOTHETICAL 15.9 KDA PROTEIN. |
| ID1410 | K | YKOM. |
| ID1411 | K | YKMA. |
| ID1412 | K | 30S RIB0SOMAL PROTEIN S21. |
| ID1413 | K | DNA-DIRECTED RNA POLYMERASE DELTA SUBUNIT (RNAP DELTA FACTOR |
| ID1414 | K | BH1561 PROTEIN. |
| ID1415 | K | BH0575 PROTEIN. |
| ID1416 | K | BH1889 PROTEIN. |
| ID1417 | K | TRANSCRIPTIONAL REGULATOR (ICLR FAMILY). |
| ID1418 | K | ORF starting with ATG of length 882 |
| ID1419 | K | YOZA PROTEIN. |
| ID1420 | K | ORF starting with ATG of length 879 |
| ID1421 | K | HYPOTHETICAL 12.8 KDA PROTEIN IN ODHA-CTPA INTERGENIC REGION |
| ID1422 | K | ORF starting with ATG of length 858 |
| ID1423 | K | HYPOTHETICAL TRANSCRIPTIONAL REGULATOR IN GNTR-HTPG INTERGEN |
| ID1424 | K | ORF starting with ATG of length 855 |
| ID1425 | K | PUTATIVE TRANSITION STATE REGULATOR ABH. |
| ID1426 | K | ORF starting with ATG of length 837 |
| ID1427 | K | TRANSCRIPTIONAL REPRESSOR (BETA-GALACTOSIDASE GENE). |
| ID1428 | K | ORF starting with ATG of length 813 |
| ID1429 | K | ORF starting with ATG of length 804 |
| ID1430 | K | BH0353 PROTEIN. |
| ID1431 | K | VIRULENCE-ASSOCIATED PROTEIN. |
| ID1432 | K | YVNA. |
| ID1433 | K | BH2909 PROTEIN. |
| ID1434 | K | ORF starting with ATG of length 741 |
| ID1435 | K | RNA POLYMERASE SPORULATION FORESPORE-SPECIFIC (LATE) SIGMA-G |
| ID1436 | K | HYPOTHETICAL 21.1 KDA PROTEIN IN TDK-PRFA INTERGENIC REGION. |
| ID1437 | K | ORF starting with ATG of length 729 |
| ID1438 | K | PUTATIVE GNTR-FAMILY REGULATORY PROTEIN. |
| ID1439 | K | SORBITOL OPERON REGULATOR (SOR OPERON ACTIVATOR). |
| ID1440 | K | HYPOTHETICAL TRANSCRIPTIONAL REGULATOR IN DINB-PHOB INTERGEN |
| ID1441 | K | TRANSCRIPTIONAL REGULATOR (GNTR FAMILY). |
| ID1442 | K | TRANSCRIPTIONAL REPRESSOR (BETA-GALACTOSIDASE GENE). |
| ID1443 | K | TRANSCRIPTIONAL REPRESSOR OF THE RIBOSE OPERON. |
| ID1444 | K | HYPOTHETICAL 14.1 KDA PROTEIN IN TLPC-SRFAA INTERGENIC REGIO |
| ID1445 | K | HYPOTHETICAL 8.2 KDA PROTEIN IN BLTR-SPOIIIC INTERGENIC REGI |
| ID1446 | K | ARAR. |
| ID1447 | K | ORF starting with ATG of length 624 |
| ID1448 | K | HYPOTHETICAL TRANSCRIPTIONAL REGULATOR IN SPOIIIC-CWLA INTER |
| ID1449 | K | ORF starting with ATG of length 615 |
| ID1450 | K | HYPOTHETICAL TRANSCRIPTIONAL REGULATOR IN UVRX-ILVA INTERGEN |
| ID1451 | K | ORF starting with ATG of length 606 |
| ID1452 | K | HYPOTHETICAL 14.5 KDA PROTEIN. |
| ID1453 | K | ORF starting with ATG of length 600 |
| ID1454 | K | ORF starting with ATG of length 597 |
| ID1455 | K | ORF starting with ATG of length 585 |
| ID1456 | K | YDET PROTEIN. |
| ID1457 | K | YVBA PROTEIN. |
| ID1458 | K | ORF starting with ATG of length 573 |
| ID1459 | K | TRANSCRIPTIONAL REGULATOR OF EXTRACELLULAR ENZYME GENES. |
| ID1460 | K | PUTATIVE TETR FAMILY TRANSCRIPTIONAL REGULATOR. |
| ID1461 | K | YLOH PROTEIN. |
| ID1462 | K | BH0406 PROTEIN. |
| ID1463 | K | Barstar protein sequence. |
| ID1464 | K | BH0521 PROTEIN. |
| ID1465 | K | ORF starting with ATG of length 519 |
| ID1466 | K | RNA POLYMERASE SIGMA-G FACTOR (STAGE III SPORULATION PROTEIN |
| ID1467 | K | RNA POLYMERASE SIGMA FACTOR SIGV. |
| ID1468 | K | HYPOTHETICAL 14.5 KDA PROTEIN. |
| ID1469 | K | MERCURIC RESISTANCE OPERON REGULATORY PROTEIN. |
| ID1470 | K | RPOC PROTEIN (DNA-DIRECTED RNA POLYMERASE BETA' SUBUNIT) (EC |
| ID1471 | K | ACTIVATOR PROTEIN. |
| ID1472 | K | ORF starting with ATG of length 477 |
| ID1473 | K | AUTOLYSIN ATLE AND PUTATIVE TRANSCRIPTIONAL REGULATOR ATLR G |
| ID1474 | K | HYPOTHETICAL TRANSCRIPTIONAL REGULATOR IN LYSP-NFO INTERGENI |

| | | -continued |
|---|---|---|
| ID1475 | K | ORF starting with ATG of length 783 |
| ID1476 | K | TRANSCRIPTIONAL REGULATOR (ARAC/XYLS FAMILY). |
| ID1477 | K | ORF starting with ATG of length 396 |
| ID1478 | K | ORF starting with ATG of length 387 |
| ID1479 | K | BH3535 PROTEIN. |
| ID1480 | K | HYPOTHETICAL PROTEIN MTH1285. |
| ID1481 | K | HYPOTHETICAL 14.5 KDA PROTEIN. |
| ID1482 | K | RRF2 PROTEIN. |
| ID1483 | K | MLR8761 PROTEIN. |
| ID1484 | K | HYPOTHETICAL 46.4 KDA PROTEIN. |
| ID1485 | K | YOZG PROTEIN. |
| ID1486 | K | YORF [A, B, C, D, E], FTSL, PBPX AND REGR GENES. |
| ID1487 | K | HYPOTHETICAL TRANSCRIPTIONAL REGULATOR MJ0272. |
| ID1488 | K | ORF starting with ATG of length 342 |
| ID1489 | K | PUTATIVE TRANSCRIPTIONAL REGULATOR OF SORBOSE UPTAKE AND UTI |
| ID1490 | K | ORF starting with ATG of length 315 |
| ID1491 | K | SINR PROTEIN. |
| ID1492 | K | PROBABLE GNTR-FAMTLY REGULATOR. |
| ID1493 | K | YTCG (DNAB). |
| ID1494 | K | RNA POLYMERASE SIGMA FACTOR SIGK. |
| ID1495 | K | ORF starting with ATG of length 255 |
| ID1496 | K | ORF starting with ATG of length 225 |
| ID1497 | K | SIGMA-B GENERAL STRESS TRANSCRIPTION FACTOR. |
| ID1498 | KE | HYPOTHETICAL 50.8 KDA PROTEIN IN SRFA4-SFP INTERGENIC REGION |
| ID1499 | KE | YDEL PROTEIN. |
| ID1500 | KE | HOMOLOGUE OF REGULATORY PROTEIN MOCR OF R. MELILOTI. |
| ID1501 | KE | YDEL PROTEIN. |
| ID1502 | KE | HYPOTHETICAL 48.9 KDA PROTEIN PH0207. |
| ID1503 | KG | DNA-BINDING PROTEIN IOLR. |
| ID1504 | KG | SIMILAR TO PHOSPHOTRANSFERASE SYSTEM REGULATOR. |
| ID1505 | KG | DNA FOR 25-36 DEGREE REGION CONTAINING THE AMYE-SRFA REGION, |
| ID1506 | KG | YTZE PROTEIN. |
| ID1507 | KG | TRANSCRIPTTONAL REGULATOR (DEOR FAMILY). |
| ID1508 | KL | YWQA PROTEIN (MEMBER OF THE SNF2 HELICASE FAMILY). |
| ID1509 | KL | HYPOTHETICAL HELICASE IN SINI-GCVT INTERGENIC REGION. |
| ID1510 | KL | YWQA PROTEIN (MEMBER OF THE SNF2 HELICASE FAMILY). |
| ID1511 | KN | NEGATIVE REGULATOR OF FLAGELLIN SYNTHESIS (ANTI-SIGMA-D FACT |
| ID1512 | KR | YBFA PROTEIN. |
| ID1513 | KR | PROTEASE SYNTHASE AND SPORULATION NEGATIVE REGULATORY PROTEI |
| ID1514 | KR | CGEE PROTEIN. |
| ID1515 | KR | YJCF PROTEIN. |
| ID1516 | KR | BH2157 PROTEIN. |
| ID1517 | KR | BH1453 PROTEIN. |
| ID1518 | KR | BA1582 PROTEIN. |
| ID1519 | KR | ORF starting with ATG of length 552 |
| ID1520 | KT | LEXA REPRESSOR (EC 3.4.21.88) (SOS REGULATORY PROTEIN DINR). |
| ID1521 | KT | YVLC. |
| ID1522 | L | DNA POLYMERASE III POLC-TYPE (EC 2.7.7.7) (POLIII). |
| ID1523 | L | EXCINUCLEASE ABC SUBUNIT A. |
| ID1524 | L | DNA POLYMERASE I (EC 2.7.7.7) (POL I). |
| ID1525 | L | ATP-DEPENDENT DNA HELICASE PCRA (EC 3.6.1.-). |
| ID1526 | L | MUTS2 PROTEIN. |
| ID1527 | L | EXCINUCLEASE ABC SUBUNIT B (DINA PROTEIN). |
| ID1528 | L | DNA GYRASE SUBUNIT B (EC 5.99.1.3). |
| ID1529 | L | ATP-DEPENDENT NUCLEASE SUBUNIT A. |
| ID1530 | L | Amino acid sequence of a DnaE polypeptide. |
| ID1531 | L | DNA TOPOISOMERASE IV SUBUNIT A. |
| ID1532 | L | PROBABLE DNA TOPOISOMERASE III (EC 5.99.1.2) (RELAXING ENZYM |
| ID1533 | L | YIRY PROTEIN (PUTATIVE - HOMOLOGY WITH SBCC FROM C. PERFRING |
| ID1534 | L | DNA GYRASE SUBUNIT A (EC 5.99.1.3). |
| ID1535 | L | PRIMOSOMAL REPLICATION FACTOR Y. |
| ID1536 | L | DNA MISMATCH REPAIR PROTEIN MUTL. |
| ID1537 | L | YJCD PROTEIN. |
| ID1538 | L | DNA REPAIR PROTEIN RECN (RECOMBINATION PROTEIN N). |
| ID1539 | L | YRRC PROTEIN. |
| ID1540 | L | YVGS PROTEIN. |
| ID1541 | L | PROBABLE ATP-DEPENDENT HELICASE DING HOMOLOG. |
| ID1542 | L | DNA PRIMASE (EC 2.7.7.-). |
| ID1543 | L | REPLICATIVE DNA HELICASE (EC 3.6.1.-). |
| ID1544 | L | DNA MISMATCH REPAIR PROTEIN (MISMATCH RECOGNITION STEP). |
| ID1545 | L | YKOU PROTEIN. |
| ID1546 | L | DNA TOPOISOMERASE IV SUBUNIT B. |
| ID1547 | L | SPORE PHOTOPRODUCT LYASE. |
| ID1548 | L | PROBABLE EXODEOXYRIBONUCLEASE VII LARGE SUBUNIT (EC 3.1.11.6 |
| ID1549 | L | DNA POLYMERASE III SUBUNIT GAMMA/TAU (EC 2.7.7.7). |
| ID1550 | L | REPLICATION INITIATION AND MEMBRANE ATTACHMENT PROTEIN. |
| ID1551 | L | *L. lactis* HsdM subunit #2. |
| ID1552 | L | EXCINUCLEASE ABC SUBUNIT C. |
| ID1553 | L | HYPOTHETICAL 47.0 KDA PROTEIN IN GLNQ-ANSR INTERGENIC REGION |

-continued

| | | |
|---|---|---|
| ID1554 | L | DNA POLYMERASE III, BETA CHAIN (EC 2.7.7.7). |
| ID1555 | L | RECQ HOMOLOG. |
| ID1556 | L | PROBABLE ENDONUCLEASE IV (EC 3.1.21.2) (ENDODEOXYRIBONUCLEAS |
| ID1557 | L | PROBABLE ATP-DEPENDENT HELICASE IN COTD-KDUD INTERGENIC REGI |
| ID1558 | L | HYPOTHETICAL 40.5 KDA PROTEIN IN COMEC-RPST INTERGENIC REGIO |
| ID1559 | L | EXONUCLEASE SBCD HOMOLOG (FRAGMENT). |
| ID1560 | L | CHROMOSOMAL REPLICATION INITIATOR PROTEIN DNAA. |
| ID1561 | L | PRIMOSOMAL PROTEIN DNAI. |
| ID1562 | L | PROBABLE INTEGRASE/RECOMBINASE CODV. |
| ID1563 | L | PUTATIVE DEOXYRIBONUCLEASE YABD (EC 3.1.21.-). |
| ID1564 | L | PUTATIVE 5'-3' EXONUCLEASE (EC 3.1.11.-). |
| ID1565 | L | YFJP PROTEIN. |
| ID1566 | L | HYPOTHETICAL 46.8 KDA PROTEIN. |
| ID1567 | L | ORF starting with ATG of length 2277 |
| ID1568 | L | FORMAMIDOPYRIMIDINE-DNA GLYCOSYLASE (EC 3.2.2.23) (FAPY-DNAG |
| ID1569 | L | PROBABLE ENDONUCLEASE III (EC 4.2.99.18) (DNA-(APURINIC ORAP |
| ID1570 | L | HYPOTHETICAL 37.4 KDA PROTEIN IN ACKA-SSPA INTERGENIC REGION |
| ID1571 | L | ATP-DEPENDENT DNA HELICASE RECQ (EC 3.6.1.-) (RECOMBINATION |
| ID1572 | L | HOLLIDAY JUNCTION DNA HELICASE RUVB. |
| ID1573 | L | DNA REPAIR PROTEIN RADC HOMOLOG. |
| ID1574 | L | SA1093 PROTEIN. |
| ID1575 | L | HYPOTHETICAL 36.1 KDA PROTEIN IN SPOIIIC-CWLA INTERGENIC REG |
| ID1576 | L | DNA REPAIR PROTEIN RECO (RECOMBINATION PROTEIN O). |
| ID1577 | L | PHAGE-LIKE ELEMENT PBSX PROTEIN XKDC. |
| ID1578 | L | YOQV PROTEIN. |
| ID1579 | L | SIMILAR TO *B. ANTHRACIS* WEYAR ELEMENT ORFB. |
| ID1580 | L | PROBABLE ATP-DEPENDENT HELICASE IN COTO-KDUD INTERGENIC REGI |
| ID1581 | L | YRVE PROTEIN. |
| ID1582 | L | *Staphylococcus aureus* CcrB1 protein sequence SEQ ID NO: 8. |
| ID1583 | L | YFHQ PROTEIN. |
| ID1584 | L | ORF starting with ATG of length 1809 |
| ID1585 | L | DNA GYRASE A (FRAGMENT). |
| ID1586 | L | UV-DAMAGE REPAIR PROTEIN. |
| ID1587 | L | DNA REPLICATION AND REPAIR PROTEIN RECF. |
| ID1588 | L | HYPOTHETICAL 48.0 KDA PROTEIN IN PONA-COTD INTERGENIC REGION |
| ID1589 | L | ORF starting with ATG of length 1320 |
| ID1590 | L | TYPE IC RESTRICTION SUBUNIT. |
| ID1591 | L | PROBABLE INTEGRASE/RECOMBINASE RIPX. |
| ID1592 | L | SINGLE-STRAND DNA-SPECIFIC EXONUCLEASE. |
| ID1593 | L | *L. lactis* HsdM subunit #1. |
| ID1594 | L | PUTATIVE TYPE I RESTRICTION ENZYME R PROTEIN (EC 3.1.21.3). |
| ID1595 | L | YRVN PROTEIN. |
| ID1596 | L | SIMILAR TO *B. ANTHRACIS* WEYAR ELEMENT ORFB. |
| ID1597 | L | ORF starting with ATG of length 1146 |
| ID1598 | L | ORF starting with ATG of length 1143 |
| ID1599 | L | SA0828 PROTEIN. |
| ID1600 | L | HYPOTHETICAL 48.0 KDA PROTEIN IN PONA-COTD INTERGENIC REGION |
| ID1601 | L | BH0056 PROTEIN. |
| ID1602 | L | METALLOREGULATION DNA-BINDING STRESS PROTEIN. |
| ID1603 | L | RECOMBINATION PROTEIN RECR. |
| ID1604 | L | YLBH PROTEIN. |
| ID1605 | L | COME OPERON PROTEIN 1. |
| ID1606 | L | METHYLATED-DNA--PROTEIN-CYSTEINE METHYLTRANSFERASE (EC 2.1.1 |
| ID1607 | L | YADA PROTEIN. |
| ID1608 | L | RIBONUCLEASE HII. |
| ID1609 | L | DNA REPLICATION AND REPAIR PROTEIN RECF. |
| ID1610 | L | SIMILAR TO *E. COLI* YJAF PROTEIN. |
| ID1611 | L | 14.7 KDA RIBONUCLEASE H-LIKE PROTEIN. |
| ID1612 | L | EXTRACELLULAR RIBONUCLEASE PRECURSOR (EC 3.1.-.-). |
| ID1613 | L | Amino acid sequence of a DnaE polypeptide. |
| ID1614 | L | YUSF PROTEIN. |
| ID1615 | L | ORF starting with ATG of length 1197 |
| ID1616 | L | HOLLIDAY JUNCTION DNA HELICASE RUVA. |
| ID1617 | L | MISMATCH BINDING PROTEIN (FRAGMENT). |
| ID1618 | L | ORF starting with ATG of length 774 |
| ID1619 | L | SINGLE-STRAND BINDING PROTEIN (SSB) (HELIX-DESTABILIZING PRO |
| ID1620 | L | HYPOTHETICAL 15.2 KDA PROTEIN IN UDK-ALAS INTERGENIC REGION. |
| ID1621 | L | ORF starting with ATG of length 738 |
| ID1622 | L | RECQ HOMOLOG. |
| ID1623 | L | ATP-DEPENDENT DNA HELICASE RECQ (EC 3.6.1.-) (RECOMBINATION |
| ID1624 | L | SIMILAR TO *B. ANTHRACIS* WEYAR ELEMENT ORFB. |
| ID1625 | L | YAZA PROTEIN. |
| ID1626 | L | SIMILAR TO STNGLE STRAND BINDING PROTEIN. |
| ID1627 | L | HYPOTHETICAL 43.5 KDA PROTEIN IN COTD-KDUD INTERGENIC REGION |
| ID162B | L | ORF starting with ATG of length 648 |
| ID1629 | L | ORF starting with ATG of length 645 |
| ID1630 | L | HYPOTHETICAL 43.8 KDA PROTEIN. |
| ID1631 | L | O6-METHYLGUANINE DNA ALKYLTRANSFERASE. |
| ID1632 | L | ORF starting with ATG of length 606 |

-continued

| ID | | Description |
|---|---|---|
| ID1633 | L | DNA POLYMERASE III DELTA' SUBUNIT (EC 2.7.7.7). |
| ID1634 | L | YIRY PROTEIN (PUTATIVE - HOMOLOGY WITH SBCC FROM *C. PERFRING* |
| ID1635 | L | DNA-BINDING PROTEIN HU 1 (DNA-BINDING PROTEIN II) (HB). |
| ID1636 | L | EXODEOXYRIBONUCLEASE VII (SMALL SUBUNIT). |
| ID1637 | L | CHROMOSOMAL REPLICATION INITIATOR PROTEIN DNAA. |
| ID1638 | L | Amino acid sequence of a DnaE polypeptide. |
| ID1639 | L | SINGLE-STRAND BINDING PROTEIN (SSB) (HELIX-DESTABILIZING PRO |
| ID1640 | L | YNEB. |
| ID1641 | L | ORF starting with ATG of length 417 |
| ID1642 | L | HYPOTHETICAL 17.0 KDA PROTEIN. |
| ID1643 | L | EXCINUCLEASE ABC (C) (FRAGMENT). |
| ID1644 | L | INT PROTEIN. |
| ID1645 | L | RIBONUCLEASE HIII (EC 3.1.26.-) (RNASE HIII). |
| ID1646 | L | ORF starting with ATG of length 315 |
| ID1647 | L | ORF starting with ATG of length 258 |
| ID1648 | L | DNA HELICASE HOMOLOG (FRAGMENT). |
| ID1649 | L | ORF starting with ATG of length 678 |
| ID1650 | L | ORF starting with ATG of length 201 |
| ID1651 | L | ORF starting with ATG of length 1143 |
| ID1652 | LK | TRANSCRIPTION-REPAIR COUPLING FACTOR (TRCF). |
| ID1653 | LK | ATP-DEPENDENT DNA HELICASE RECG (EC 3.6.1.-). |
| ID1654 | LK | TRANSCRIPTION-REPAIR COUPLING FACTOR (FRAGMENT). |
| ID1655 | LK | ORF starting with ATG of length 657 |
| ID1656 | LKJ | PROBABLE RNA HELICASE IN CCCA-SODA INTERGENIC REGION. |
| ID1657 | LKJ | COMF OPERON PROTEIN 1. |
| ID1658 | LKJ | YFML PROTEIN. |
| ID1659 | LKJ | COLD-SHOCK DEAD-BOX PROTEIN A HOMOLOG (ATP-DEPENDENT RNA HEL |
| ID1660 | LKJ | HYPOTHETICAL 56.9 KDA PROTEIN. |
| ID1661 | LN | SMF PROTEIN. |
| ID1662 | LR | Amino acid sequence of activator YgkG of methanol dehydrogen |
| ID1663 | LR | MUTATOR MUTT PROTEIN. |
| ID1664 | LR | MUTATOR MUTT PROTEIN. |
| ID1665 | LR | YTKD. |
| ID1666 | M | STAGE V SPORULATION PROTEIN D (SPORULATION SPECIFIC PENICILL |
| ID1667 | M | REGULATORY PROTEIN BLAR1. |
| ID1668 | M | PENICILLIN-BINDING PROTEIN 1F (PBP-1F). |
| ID1669 | M | GLUCOSAMINE--FRUCTOSE-6-PHOSPHATE AMINOTRANSFERASE [ISOMERIZ |
| ID1670 | M | PENICILLIN-BINDING PROTEIN 2B (PBP-2B). |
| ID1671 | M | PENICILLIN-BINDING PROTEIN 1A/1B (PBP1) [INCLUDES: PENICILLI |
| ID1672 | M | HYPOTHETICAL 71.8 KDA PROTEIN. |
| ID1673 | M | PENICILLIN-BINDING PROTEIN 4 PRECURSOR (PBF 4). |
| ID1674 | M | PENICILLIN-BINDING PROTEIN 3 (PBP 3) (PSPB20). |
| ID1675 | M | YFLE PROTEIN. |
| ID1676 | M | YRRR PROTEIN. |
| ID1677 | M | UDP-N-ACETYLGLUCOSAMINE 1-CARBOXYVINYLTRANSFERASE 1 (EC 2.5. |
| ID1678 | M | TEICHOIC ACID BIOSYNTHESIS PROTEIN F. |
| ID1679 | M | UDP-N-ACETYLGLUCOSAMINE 1-CARBOXYVINYLTRANSFERASE 2 (EC 2.5. |
| ID1680 | M | HYPOTHETICAL 73.6 KDA PROTEIN IN DNAC-RPLI INTERGENIC REGION |
| ID1681 | M | YVGJ PROTEIN. |
| ID1682 | M | D-ALANYL-D-ALANINE CARBOXYPEPTIDASE PRECURSOR (EC 3.4.16.4) |
| ID1683 | M | PROBABLE N-ACETYLMURAMOYL-L-ALANINE AMIDASE PRECURSOR (EC 3. |
| ID1684 | M | *B. subtiLis* yaeL poLypeptide. |
| ID1685 | M | UDP-N-ACETYLMURAMOYLALANINE--D-GLUTAMATE LIGASE (EC 6.3.2.9) |
| ID1686 | M | HYPOTHETICAL 73.2 KDA PROTEIN IN SODA-COMGA INTERGENIC REGIO |
| ID1687 | M | CARBOXY-TERMINAL PROCESSING PROTEASE. |
| ID1688 | M | SPOIVB. |
| ID1689 | M | *B. subtilis* glycosyl transferase catalytic domain. |
| ID1690 | M | DLTB PROTEIN. |
| ID1691 | M | PENICILLIN-BINDING PROTEIN 4* (PBP 4*) (PBP 4A). |
| ID1692 | M | GCPE PROTEIN HOMOLOG. |
| ID1693 | M | PENICILLIN-BINDING PROTEIN DACF PRECURSOR (D-ALANYL-D-ALANIN |
| ID1694 | M | UDP-N-ACETYLGLUCOSAMINE--N-ACETYLMURAMYL-(PENTAPEPTIDE) PYROP |
| ID1695 | M | HYPOTHETICAL 42.0 KDA PROTEIN IN DAPB-PAPS INTERGENIC REGION |
| ID1696 | M | PUTATIVE UNDECAPRENYL-PHOSPHATE N-ACETYLGLUCOSAMINYLTRANSFER |
| ID1697 | M | UDP-N-ACETYLGLUCOSAMINE PYROPHOSPHORYLASE (EC 2.7.7.23) (N-A |
| ID1698 | M | YBBE PROTEIN (YBZA). |
| ID1699 | M | UDP-N-ACETYLMURAMOYLALANYL-D-GLUTAMYL-2, 6-DIAMINOPIMELATE L |
| ID1700 | M | YKUA PROTEIN. |
| ID1701 | M | UTP--GLUCOSE-1-PHOSPHATE URIDYLYLTRANSFERASE (EC 2.7.7.9) (U |
| ID1702 | M | HYPOTHETICAL 43.6 KDA PROTEIN. |
| ID1703 | M | GLYCINE BETAINE/CARNITINE/CHOLINE-BINDING PROTEIN PRECURSOR ( |
| ID1704 | M | CSBB PROTEIN. |
| ID1705 | M | TUAH PROTEIN. |
| ID1706 | M | SIMILAR TO *E. COLI* NLPC PROTEIN AND TO LISTERIA SPECIES P60-R |
| ID1707 | M | TUAC PROTEIN. |
| ID1708 | M | YFNI. |
| ID1709 | M | BETA-LACTAMASE (EC 3.5.2.6) (PENICILLINASE) (CEPHALOSPORINAS |
| ID1710 | M | HYPOTHETICAL 37.4 KDA PROTEIN IN SPOIISA-HTRA INTERGENIC REG |
| ID1711 | M | HYPOTHETICAL 50.1 KDA PROTEIN. |

-continued

| | | |
|---|---|---|
| ID1712 | M | YKON. |
| ID1713 | M | N-ACETYLMURAMOYL-L-ALANINE AMIDASE CWLM (EC 3.5.1.28) (CELL |
| ID1714 | M | PUTATIVE ALANINE RACEMASE (EC 5.1.1.1). |
| ID1715 | M | HYPOTHETICAL 42.6 KDA PROTEIN. |
| ID1716 | M | UDP-GLUCOSE 4-EPIMERASE (EC 5.1.3.2). |
| ID1717 | M | GALE. |
| ID1718 | M | HYPOTHETICAL 38.5 KDA PROTEIN IN TNRA-SSPD INTERGENIC REGION |
| ID1719 | M | HYPOTHETICAL 37.2 KDA PROTEIN IN IDH-DEOR INTERGENIC REGION. |
| ID1720 | M | YKCB PROTEIN. |
| ID1721 | M | GLUTAMATE RACEMASE (EC 5.1.1.3). |
| ID1722 | M | GENERAL STRESS PPOTEIN A. |
| ID1723 | M | HYPOTHETICAL 40.6 KDA PROTEIN IN SPOVID 3' REGION (ORF2). |
| ID1724 | M | ORF starting with ATG of length 2235 |
| ID1725 | M | PROLIPOPROTEIN DIACYLGLYCERYL TRANSFERASE (EC 2.4.99.-) (SPO |
| ID1726 | M | SPORE-CORTEX-LYTIC ENZYME PRECURSOR. |
| ID1727 | M | HYPOTHETICAL 80.1 KDA PROTEIN IN SODA-COMGA INTERGENIC REGIO |
| ID1728 | M | HYPOTHETICAL 32.7 KDA PROTEIN. |
| ID1729 | M | ROD SHAPE-DETERMINING PROTEIN MREC. |
| ID1730 | M | ALPHA-D-MANNOSE-ALPHA (1-6) PHOSPHATIDYL MYO-INOSITOL MONOMANN |
| ID1731 | M | TEICHOIC ACID BIOSYNTHESIS PROTEIN B PRECURSOR. |
| ID1732 | M | YUSA PROTEIN. |
| ID1733 | M | GERMINATION-SPECIFIC N-ACETYLMURAMOYL-L-ALANINE AMIDASE (EC |
| ID1734 | M | TUAG PROTEIN. |
| ID1735 | M | DIVIB PROTEIN. |
| ID1736 | M | HYPOTHETICAL 24.4 KDA PROTEIN. |
| ID1737 | N | HYPOTHETICAL 42.5 KDA PROTEIN IN CITA-SSPB INTERGENIC REGION |
| ID1738 | N | HYPOTHETICAL 39.8 KDA PROTEIN |
| ID1739 | M | ORF starting with ATG of length 1982 |
| ID1740 | M | CARBOXYPEPTIDASE. |
| ID1741 | M | PHOSPHO-N-ACETYLMURAMOYL-PENTAPEPTIDE-TRANSFERASE (EC 2.7.8. |
| ID1742 | M | YKFC. |
| ID1743 | M | GALE. |
| ID1744 | M | 455AA LONG HYPOTHETICAL VI POLYSACCHARIDE BIOSYNTHESIS PROTE |
| ID1745 | M | *Bacillus subtilis* IFO 3336 PGA synthesising enzyme. |
| ID1746 | M | YRVJ PROTEIN. |
| ID1747 | M | D-alanine racemase from *Bacillus licheniformis*. |
| ID1748 | M | UDP-N-ACETYLENOLPYRUVOYLGLUCOSAMINE REDUCTASE (EC 1.1.1.158) |
| ID1749 | M | PLEIOTROPIC REGULATORY PROTEIN. |
| ID1750 | M | PENICILLIN-BINDING PROTEIN 5* PRECURSOR (D-ALANYL-D-ALANINEC |
| ID1751 | M | CARBOXY-TERMINAL PROCESSING PROTEASE. |
| ID1752 | M | STAGE IV SPORULATION PROTEIN FA. |
| ID1753 | M | PUTATIVE PENICILLIN BINDING PROTEIN PRECURSOR. |
| ID1754 | M | ENDOPEPTIDASE LYTF PRECURSOR (CELL WALL-ASSOCIATED POLYPEPTI |
| ID1755 | M | ORF starting with ATG of length 1527 |
| ID1756 | M | HYPOTHETICAL 23.1 KDA PROTEIN. |
| ID1757 | M | ORF starting with ATG of length 1497 |
| ID1758 | M | D-ALANINE--D-ALANINE LIGASE (EC 6.3.2.4) (D-ALANYLALANINE SY |
| ID1759 | M | YUNA PROTEIN. |
| ID1760 | M | PUTATIVE ENDOPEPTIDASE LYTE PRECURSOR (PHOSPHATASE-ASSOCIATE |
| ID1761 | M | HYPOTHETTCAL 35.3 KDA PROTEIN IN FTSL 5' REGION (ORFB). |
| ID1762 | M | GALE. |
| ID1763 | M | ORF46. |
| ID1764 | M | D-ALANINE--D-ALANINE LIGASE (EC 6.3.2.4) (D-ALANYLALANINE SY |
| ID1765 | M | SIMILAR TO PSEUDOMONAS AERUGINOSA GDP-MANNOSE 6-DEHYDROGENAS |
| ID1766 | M | HYPOTHETICAL 22.2 KDA PROTEIN IN SPO0A-MMGA INTERGENIC REGIO |
| ID1767 | M | YUNA PROTEIN. |
| ID1768 | M | HYPOTHETICAL 80.1 KDA PROTEIN IN SODA-COMGA INTERGENIC REGIO |
| ID1769 | M | UDP-N-ACETYLMURAMOYLALANYL-D-GLUTAMYL-2,6-DIAMINOPIMELATE-D- |
| ID1770 | M | ORF starting with ATG of length 1236 |
| ID1771 | M | ORF starting with ATG of length 1227 |
| ID1772 | M | N-ACETYLMURAMOYL-L-ALANINE AMIDASE CWLL PRECURSOR (EC 3.5.1. |
| ID1773 | M | MINIMAL CHANGE NEPHRITIS TRANSMEMBRANE GLYCOPROTEIN (FRAGMEN |
| ID1774 | M | ORF starting with ATG of length 1170 |
| ID1775 | M | GLUCOSE INHIBITED DIVISION PROTEIN B. |
| ID1776 | M | ROD SHAPE-DETERMINING PROTEIN MRED. |
| ID1777 | M | SIMILAR TO *BACILLUS ANTHRACIS* CAPA PROTEIN. |
| ID1778 | M | TEICHOIC ACID BIOSYNTHESIS PROTEIN A. |
| ID1779 | M | N-ACETYLMURAMOYL-L-ALANINE AMIDASE CWLM (EC 3.5.1.28) (CELL |
| ID1780 | M | YTMP. |
| ID1781 | M | HYPOTHETICAL 25.8 KDA PROTEIN IN EPR-GALK INTERGENIC REGION. |
| ID1782 | M | ORF starting with ATG of length 1062 |
| ID1783 | M | GLYCINE BETAINE TRANSPORTER OPUD. |
| ID1784 | M | ORF starting with ATG of length 1035 |
| ID1785 | M | YNGB PROTEIN. |
| ID1786 | M | PLEIOTROPIC REGULATORY PROTEIN DEGT. |
| ID1787 | M | STAGE V SPORULATION PROTEIN G. |
| ID1788 | M | UDP-N-ACETYLGLUCOSAMINE PYROPHOSPHORYLASE (EC 2.7.7.23). |
| ID1789 | M | LARGE-CONDUCTANCE MECHANOSENSITIVE CHANNEL. |
| ID1790 | M | STAGE II SPORULATION PROTEIN. |

-continued

| | | |
|---|---|---|
| ID1791 | M | *B. subtilis* hexulose phosphate isomerase. |
| ID1792 | M | UDP-D-GLUCOSE-DEHYDROGENASE GDHGA. |
| ID1793 | M | YNGB PROTEIN. |
| ID1794 | M | Amino acid sequence of epsH of *L. delbrueckii* bulgaricus Lfi |
| ID1795 | M | PUTATIVE UDP-N-ACETYLGLUCOSAMINE 2-EPIMERASE (EC 5.1.3.14) ( |
| ID1796 | M | N-ACETYLMURAMOYL-L-ALANINE AMIDASE CWLL PRECURSOR (EC 3.5.1. |
| ID1797 | M | ORF starting with ATG of length 810 |
| ID1798 | M | BH1600 PROTEIN. |
| ID1799 | M | PUTATIVE UDP-N-ACETYLGLUCOSAMINE 2-EPIMERASE (EC 5.1.3.14) ( |
| ID1800 | M | ORF starting with ATG of length 753 |
| ID1801 | M | PENICILLIN-BINDING PROTEIN 1A/1B (PBP1) (INCLUDES: PENICILLI |
| ID1802 | M | *Staphylococcus aureus* ica A protein. |
| ID1803 | M | TEICHOIC ACID TRANSLOCATION PERMEASE PROTEIN TAGG. |
| ID1804 | M | PUTATIVE ALANINE RACEMASE (EC 5.1.1.1). |
| ID1805 | M | ORF starting with ATG of length 654 |
| ID1806 | M | PHOSPHO-N-ACETYLMURAMOYL-PENTAPEPTIDE-TRANSFERASE (EC 2.7.8. |
| ID1807 | M | HYPOTHETICAL 73.2 KDA PROTEIN IN SODA-COMGA INTERGENIC REGIO |
| ID1808 | M | TUAA PROTEIN. |
| ID1809 | M | HYPOTHETICAL 18.4 KDA PROTEIN. |
| ID1810 | M | AMIDASE ENHANCER PRECURSOR (MODIFIER PROTEIN OF MAJOR AUTOLY |
| ID1811 | M | PENICILLIN-BINDING PROTEIN 2B (INTERNAL REGION OF THE PENICIL |
| ID1812 | M | CWLV. |
| ID1813 | M | UDP-N-AACERYLMURAMATE-ALANINE LIGASE. |
| ID1814 | M | ORF starting with ATG of length 498 |
| ID1815 | M | PHOSPHINOTHRICIN N-ACETYLTRANSFERASE. |
| ID1816 | N | ORF starting with ATG of length 495 |
| ID1817 | M | ORF starting with ATG of length 483 |
| ID1818 | M | TEICHOIC ACID TRANSLOCATION PERMEASE PROTEIN TAGG. |
| ID1819 | M | AMIDASE ENHANCER PRECURSOR (MODIFIER PROTEIN OF MAJOR AUTOLY |
| IDT820 | M | MurF protein. |
| ID1821 | M | HYPOTHETICAL 40.8 KDA PROTEIN IN SODA-COMGA INTERGENIC REGIO |
| ID1822 | M | GLYCINE BETAINE TRANSPORTER OPUD. |
| ID1823 | M | ORF starting with ATG of length 372 |
| ID1824 | M | ORF starting with TTG or GTG of length 705 |
| ID1825 | M | ORF starting with ATG of length 327 |
| ID1826 | N | HYPOTHETICAL 30.5 KDA PROTEIN. |
| ID1827 | M | ORF starting with ATG of length 276 |
| ID1828 | MG | HYPOTHETICAL 66.3 KDA PROTEIN. |
| ID1829 | MG | HYPOTHETICAL 28.2 KDA PROTEIN IN BIOI 3' REGION (CRF2). |
| ID1830 | MG | PUTATIVE UDP-GLUCOSE 4-EPIMERASE (EC 5.1.3.2) (GALACTOWALDEN |
| ID1831 | MG | HYPOTHETICAL 66.3 KDA PROTEIN. |
| ID1832 | MG | ORF starting with ATG of length 975 |
| ID1833 | MG | CONSERVED HYPOTHETICAL PROTEIN. |
| ID1834 | MG | PUTATIVE SUGAR NUCLEOTIDE BIOSYNTHESIS PROTEIN. |
| ID1835 | MG | YESF PROTEIN. |
| ID1836 | N | GTP-BINDING PROTEIN LEPA. |
| ID1837 | N | GTP-BINDING PROTEIN TYPA/BIPA HOMOLOG. |
| ID1838 | N | PREPROTEIN TRANSLOCASE SECA SUBUNIT. |
| ID1839 | N | CHEMOTAXIS PROTEIN CHEA (EC 2.7.3.-). |
| ID1840 | N | *B. subtilis* secretion factor SecDF. |
| ID1841 | N | METHYL-ACCEPTING CHEMOTAXIS PROTEIN MCPA (H1). |
| ID1842 | N | YOAH. |
| ID1843 | N | METHYL-ACCEPTING CHEMOTAXIS PROTEIN MCPB (H3). |
| ID1844 | N | PREPROTEIN TRANSLOCASE SECY SUBUNIT. |
| ID1845 | N | FLAGELLUM-SPECIFIC ATP SYNTHASE (EC 3.6.1.34). |
| ID1846 | N | FLAGELLAR HOOK-ASSOCIATED PROTEIN 1 (HAP1). |
| ID1847 | N | SIGNAL RECOGNITION PARTICLE PROTEIN (FIFTY-FOUR HOMOLOG). |
| ID1848 | N | FLAGELLAR HOOK-ASSOCIATED PROTEIN 2 (HAP2) (FILAMENT CAP PRO |
| ID1849 | N | FLAGELLAR MOTOR SWITCH PROTEIN FLIG. |
| ID1850 | N | HYPOTHETICAL 48.8 KDA PROTEIN. |
| ID1851 | N | FLAGELLAR BIOSYNTHETIC PROTEIN FLHB. |
| ID1852 | N | *Bacillus subtilis* protein secretion chaperone FtsY. |
| ID1853 | N | FLAGELLAR BIOSYNTHESIS PROTEIN FLHA. |
| ID1854 | N | COMG OPERON PROTEIN 1. |
| ID1855 | N | FLAGELLIN. |
| ID1856 | N | METHYL-ACCEPTING CHEMOTAXIS PROTEIN MCPB (H3). |
| ID1857 | N | FLAGELLAR M-RING PROTEIN. |
| ID1858 | N | CHEMOTAXIS CHEV PROTEIN (EC 2.7.3.-). |
| ID1859 | N | FLAGELLAR HOOK-ASSOCIATED PROTEIN 3 (HAP3). |
| ID1860 | N | YFMS. |
| ID1861 | N | FLAGELLA-ASSOCIATED PROTEIN. |
| ID1862 | N | FLAGELLAR MOTOR SWITCH PROTEIN. |
| ID1863 | N | HYPOTHETICAL 30.1 KDA PROTEIN IN ACUC 5' REGION (ORFA). |
| ID1864 | N | FLAGELLAR BIOSYNTHESIS PROTEIN FLHF (FLAGELLA ASSOCTATED GTP |
| ID1865 | N | CHEMOTAXIS MOTA PROTEIN (MOTILITY PROTEIN A). |
| ID1866 | N | METHYL-ACCEPTING CHEMOTAXIS PROTEIN TLPC. |
| ID1867 | N | FLAGELLAR BIOSYNTHETIC PROTEIN FLIR. |
| ID1868 | N | FLAGELLAR BIOSYNTHETIC PROTEIN FLIP. |
| ID1869 | N | ORF starting with ATG of length 1983 |

-continued

| ID | | Description |
|---|---|---|
| ID1870 | N | FLAGELLAR HOOK-BASAL BODY COMPLEX PROTEIN FLHO. |
| ID1871 | N | COMG OPERON PROTEIN 2. |
| ID1872 | N | METHYL-ACCEPTING CHEMOTAXIS PROTEIN MCPC. |
| ID1873 | N | ORF starting with ATG of length 1785 |
| ID1874 | N | ORF starting with ATG of length 1734 |
| ID1875 | N | ORF starting with ATG of length 1725 |
| ID1876 | N | HYPOTHETICAL 28.1 KDA PROTEIN IN PHOD-PCP INTERGENIC REGION |
| ID1877 | N | FLAGELLAR HOOK-BASAL BODY COMPLEX PROTEIN FLHP. |
| ID1878 | N | SECDF PROTEIN (PROTEIN-EXPORT MEMBRNNE PROTEIN). |
| ID1879 | N | STAGE III SPORULATION PROTEIN J PRECURSOR. |
| ID1880 | N | ORF starting with ATG of length 1566 |
| ID1881 | N | HYPOTHETICAL 30.7 KDA LIPOPROTEIN IN GLNQ-ANSR INTERGENIC RE |
| ID1882 | N | ORF39. |
| ID1883 | N | PROBABLE FLAGELLAR HOOK-LENGTH CONTROL PROTEIN. |
| ID1884 | N | Amino acid sequence of a SipW protein of *Bacillus subtilus*. |
| ID1885 | N | TYPE 4 PREPILIN-LIKE PROTEINS LEADER PEPTIDE PROCESSING ENZY |
| ID1886 | N | FLAGELLAR FLIJ PROTEIN (CHEMOTAXIS CHEF PROTEIN). |
| ID1887 | N | SIGNAL PEPTIDASE TYPE I. |
| ID1888 | N | FLAGELLAR BASAL-BODY ROD PROTEIN FLGG (DISTAL ROD PROTEIN). |
| ID1889 | N | HYPOTHETICAL 24.6 KDA PROTEIN IN CCPA 3' REGION (ORF2). |
| ID1890 | N | CHEMOTAXIS PROTEIN CHEW. |
| ID1891 | N | FLAGELLAR PROTEIN FLIS. |
| ID1892 | N | HYPOTHETICAL 29.1 FDA PROTEIN IN PHOB-GROES INTERGENIC REGIO |
| ID1893 | N | YOCH. |
| ID1894 | N | ORF starting with ATG of length 964 |
| ID1895 | N | ORF starting with ATG of length 954 |
| ID1896 | N | FLAGELLAR FLIL PROTEIN. |
| ID1897 | N | PREPROTEIN TRANSLOCASE SECA SUBUNIT (FRAGMENT). |
| ID1898 | N | SIGNAL PEPTIDASE I (EC 3.4.21.89) (SPASE I) (LEADER PEPTIDAS |
| ID1899 | N | FLAGELLAR BIOSYNTHETIC PROTEIN FLIQ. |
| ID1900 | N | FLAGELLAR ASSEMBLY PROTEIN. |
| ID1901 | N | HYPOTHETICAL 9.9 KDA PROTEIN IN SPOVB-TGT INTERGENIC REGION. |
| ID1902 | N | MOTILITY PROTEIN. |
| ID1903 | N | COMG OPERON PROTEIN 3 PRECURSOR. |
| ID1904 | N | ORF starting with ATG of length 620 |
| ID1905 | N | FLAGELLAR BASAL-BODY ROD PROTEIN FLGB. |
| ID1906 | N | HYPOTHETICAL 13.0 KDA PROTEIN IN HAG-FLID INTERGENIC REGION |
| ID1907 | N | FLAGELLAR BASAL-BODY ROD PROTEIN FLGC. |
| ID1908 | N | YRBA PROTEIN. |
| ID1909 | N | PREPROTEIN TRANSLOCASE SECA SUBUNIT. |
| ID1910 | N | ORF starting with ATG of length 399 |
| ID1911 | N | ORF starting with ATG of length 336 |
| ID1912 | N | ORF starting with ATG of length 314 |
| ID1913 | N | THA4 PROTEIN PRECURSOR. |
| ID1914 | NO | HYPOTHETICAL 46.5 KDA PROTEIN IN RPSU-PHOH INTEREGENIC REGIO |
| ID1915 | NO | PROTEINASE IV. |
| ID1916 | NO | BH2397 PROTEIN. |
| ID1917 | NO | PUTATIVE PROTEASE/SCAFFOLD PROTEIN. |
| ID1918 | NT | FLAGELLAR MOTOR SWITCH PROTEIN FLIY. |
| ID1919 | NT | PROTEIN-GLUTAMATE METHYLESTERASE (EC 3.1.1.61). |
| ID1920 | NT | CHEMOTAXIS PROTEIN METHYLTRANSFERASE (EC 2.1.1.80). |
| ID1921 | NT | CHEMOTAXIS PROTEIN CHEC. |
| ID1922 | NT | CHEMOTAXIS PROTEIN CHED. |
| ID1923 | NT | CHEMOTAXIS PROTEIN CHEC. |
| ID1924 | NT | ORF starting with ATG of length 321 |
| ID1925 | O | BACILLOPEPTIDASE F PRECURSOR (EC 3.4.21.-) (ESTERASE) (RP-I |
| ID1926 | O | NEGATIVE REGULATOR OF GENETIC COMPETENCE CLPC/MECB. |
| ID1927 | O | TRANSCRIPTIONAL REGULATORY PROTEIN LEVR. |
| ID1928 | O | *B. subtilis* FtsH protein. |
| ID1929 | O | ATP-DEPENDENT CLP PROTEASE-LIKE. |
| ID1930 | O | ATF-DEPENDENT PROTEASE LA HOMOLOG (EC 3.4.21.-). |
| ID1931 | O | RESB PROTEIN. |
| ID1932 | O | ATP-DEPENDENT PROTEASE LA 1 (EC 3.4.21.53). |
| ID1933 | O | MINOR EXTRACELLULAR PROTEASE VPR PRECURSOR (EC 3.4.21.-). |
| ID1934 | O | ALKALINE SERINE PROTEASE. |
| ID1935 | O | CELL WALL-ASSOCIATED PROTEASE PRECURSOR (EC 3.4.21.-) [CONTA |
| ID1936 | O | DNA REPAIR PROTEIN RADA HOMOLOG (DNA REPAIR PROTEIN SMS HOMO |
| ID1937 | O | THIOREDOXIN REDUCTASE. |
| ID1938 | O | BACILLOPEPTIDASE F PRECURSOR (EC 3.4.21.-) (ESTERASE) (RP-I |
| ID1939 | O | ARGININE UTILIZATION REGULATORY PROTEIN ROCR. |
| ID1940 | O | STAGE V SPORULATION PROTEIN K. |
| ID1941 | O | RESC PROTEIN. |
| ID1942 | O | HTRA-LIKE SERINE PROTEASE. |
| ID1943 | O | YRRO PROTEIN. |
| ID1944 | O | HYPOTHETICAL PROTEASE IN ROCR-PURA INTERGENIC REGION (EC 3.4 |
| ID1945 | O | HYPOTHETICAL 36.3 KDA PROTEIN IN RECQ-CMK INTERGENIC REGION. |
| ID1946 | O | ATP-DEPENDENT CLP PROTEASE ATP-BINDING SUBUNIT (CLASS III HE |
| ID1947 | O | 60 KDA CHAPERONIN (PROTEIN CPN60) (GROEL PROTEIN) (STRESS PR |
| ID1948 | O | HEMX PROTEIN. |

-continued

| ID | | Description |
|---|---|---|
| ID1949 | O | MINOR EXTRACELLULAR PROTEASE EPR PRECURSOR (EC 3.4.21.-). |
| ID1950 | O | AIP-DEPENDENT CLP PROTEASE (HEAT-SHOCK PROTEIN). |
| ID1951 | O | CELL DIVISION CYCLE PROTEIN. |
| ID1952 | O | HEAT SHOCK PROTEIN HTPG. |
| ID1953 | O | TRIGGER FACTOR (TF) (VEGETATIVE PROTEIN 2) (VEG2). |
| ID1954 | O | CHAPERONE PROTEIN DNAJ. |
| ID1955 | O | YKVL PROTEIN. |
| ID1956 | O | PUTATIVE METALLOPROTEASE YHFN (EC 3.4.24.-) (P5P23). |
| ID1957 | O | *Bacillus megaterium* HSP (Bmehsp70). |
| ID1958 | O | ALKYL HYDROPEROXIDE REDUCTASE C22 PROTEIN (EC 1.6.4.-) (GENE |
| ID1959 | O | ORF starting with ATG of length 1665 |
| ID1960 | O | *Bacillus megaterium* HSP (Bmehsp70). |
| ID1961 | O | ATP-DEPENDENT PROTEASE HSLV PRECURSOR (EC 3.4.99.-). |
| ID1962 | O | ALKYL HYDROPEROXIDE REDUCTASE LARGE SUBUNIT (EC 1.6.99.3) (P |
| ID1963 | O | CYTOCHROME C-TYPE BIOGENESIS PROTEIN CCDA. |
| ID1964 | O | PUTATIVE SIGMA L-DEPENDENT TRANSCRIPTIONAL REGULATDR IN DFRA |
| ID1965 | O | YKDA. |
| ID1966 | O | 33 KDA CHAPERONIN (HEAT SHOCK PROTEIN 33 HOMOLOG) (HSP33). |
| ID1967 | O | PEPTIDE METHIONINE SULFOXIDE REDUCTASE (EC 1.8.4.6) (PROTEIN |
| ID1968 | O | YVGV PROTEIN. |
| ID1969 | O | YVJD. |
| ID1970 | O | SA2162 PROTEIN. |
| ID1971 | O | YVGU PROTEIN. |
| ID1972 | O | HYPOTHETICAL 16.6 KDA PROTEIN IN MSRA 3' REGION. |
| ID1973 | O | *Bacillus carlsberg* alkaline elastase. |
| ID1974 | O | PROTEIN EXPORT PROTEIN PRSA PRECURSOR. |
| ID1975 | O | HYPOTHETICAL 25.2 KDA PROTEIN. |
| ID1976 | O | GLUTATHIONE PEROXIDASE HOMOLOG BSAA. |
| ID1977 | O | *Arabidopsis thaliana* protein fragment SEQ ID NO: 56671. |
| ID1978 | O | CYTOCHROME C-TYPE BIOGENESIS PROTEIN CCDA. |
| ID1979 | O | GENERAL STRESS PROTEIN 170 (GSP170). |
| ID1980 | O | YMAD PROTEIN. |
| ID1981 | O | YVJD. |
| ID1982 | O | GRPE PROTEIN (HSP-70 COFACTOR). |
| ID1983 | O | SUBTILISIN CARLSBERG PRECURSOR (EC 3.4.21.62). |
| ID1984 | O | THIOL PROTEASE |
| ID1985 | O | PLASMID PAD1 (FROM *ENTEROCOCCUS FAECALIS*) CYLLL, CYLLS, CYLM |
| ID1986 | O | *Staphylococcus aureus* glycoprotease (gcp) protein. |
| ID1987 | O | Amino acid sequence of a heat shock protein. |
| ID1988 | O | FORMATE ACETYLTRANSFERASE ACTIVATING ENZYME. |
| ID1989 | O | YUTI PROTEIN. |
| ID1990 | O | ATP-DEPENDENT HSL PROTEASE ATP-BTNDING SUBUNIT HSLU. |
| ID1991 | O | ORF starting with ATG of length 750 |
| ID1992 | O | SPORE COAT PROTEIN M. |
| ID1993 | O | ATP-DEPENDENT CLP PROTEASE ATP-BINDING SUBUNIT (CLASS III HE |
| ID1994 | O | 10 KDA CHAPERONIN (PROTEIN CPN10) (PROTEIN GROES). |
| ID1995 | O | ANAEROBIC RIBONUCLEOSIDE-TRIPHOSPHATE REDUCTASE ACTIVATING P |
| ID1996 | O | PUTATIVE METALLOPROTEASE YHFN (EC 3.4.24.-) (PSP23). |
| ID1997 | O | BACTERIOFERRITIN COMIGRATORY PROTEIN HOMOLOG. |
| ID1998 | O | PYRROLIDONE-CARBOXYLATE PEPTIDASE (EC 3.4.19.3) (5-OXOPROLYL |
| ID1999 | O | *Bacillus megaterium* HSP (Bmehsp70). |
| ID2000 | O | CHAPERONE HSLU. |
| ID2001 | O | ORF starting with ATG of length 498 |
| ID2002 | O | HYPOTHETICAL 16.3 KDA PROTEIN IN PONA-COTD INTERGENIC REGION |
| ID2003 | O | SMALL PROTEIN B HOMOLOGUE. |
| ID2004 | O | ALKYL HYDROPEROXIDE REDUCTASE LARGE SUBUNIT (EC 1.6.99.3) (P |
| ID2005 | O | PYRUVATE FORMATE-LYASE ACTIVATING ENZYME (EC 1.97.1.4) (PFL- |
| ID2006 | O | ORF starting with ATG of length 276 |
| ID2007 | O | ATP-DEPENDENT PROTEASE LA 1 (EC 3.4.21.53). |
| ID2008 | OC | RESA PROTEIN. |
| ID2009 | OC | YKVV PROTEIN. |
| ID2010 | OC | PUTATIVE THIOREDOXIN. |
| ID2011 | OC | YDFQ PROTEIN. |
| ID2012 | OC | YNEN PROTEIN. |
| ID2013 | OC | YUSE PROTEIN. |
| ID2014 | OC | Thioredoxin-Treponema pallidum 15 kDa antigen fusion protein |
| ID2015 | OC | ORF starting with ATG of length 219 |
| ID2016 | P | YLOB PROTEIN. |
| ID2017 | P | POTENTIAL COPPER-TRANSPORTING ATPASE (EC 3.6.3.4). |
| ID2018 | P | SULFITE REDUCTASE (NADPH). |
| ID2019 | P | ALKALINE PHOSPHATASE D PRECURSCR (EC 3.1.3.1) (APASED) (RAN1 |
| ID2020 | P | YKVW PROTEIN. |
| ID2021 | P | HYPOTHETICAL 57.4 KDA PROTEIN. |
| ID2022 | P | CATALASE HPII. |
| ID2023 | P | Amino acid sequence of a *Bacillus* P450 monooxygenase protein |
| ID2024 | P | SULFATE PERMEASE. |
| ID2025 | P | Alkaline phosphatase. |
| ID2026 | P | NA+-TRANSPORTING ATP SYNTHASE. |
| ID2027 | P | NA+/H+ ANTIPORTER. |

-continued

| | | |
|---|---|---|
| ID2028 | P | CHROMATE TRANSPORTER. |
| ID2029 | P | PUTATIVE NITRATE REDUCTASE BETA CHAIN. |
| ID2030 | P | YJBQ PROTEIN. |
| ID2031 | P | YFKE PROTEIN. |
| ID2032 | P | FEOB PROTEIN. |
| ID2033 | P | CATALASE X (EC 1.11.1.6). |
| ID2034 | P | NA+-TRANSPORTING ATP SYNTHASE. |
| ID2035 | P | HOMOLOGUE OF COPPER EXPORT PROTEIN PCOD OF E. COLI. |
| ID2036 | P | YLNA PROTEIN. |
| ID2037 | P | SULFITE REDUCTASE (NADPH). |
| ID2038 | P | PROBABLE LOW-AFFINITY INORGANIC PHOSPHATE TRANSPORTER. |
| ID2039 | P | NITRITE EXTRUSION PROTEIN (NITRITE FACILITATOR). |
| ID2040 | P | FERRICHROME-BINDING PROTEIN PRECURSOR. |
| ID2041 | P | YKOK. |
| ID2042 | P | BH1407 PROTEIN. |
| ID2043 | P | PROBABLE AMMONIUM TRANSPORTER (MEMBRANE PROTEIN NRGA). |
| ID2044 | P | IRON-UPTAKE SYSTEM BINDING PROTEIN PRECURSOR. |
| ID2045 | P | YFJQ PROTEIN. |
| ID2046 | P | YVGW PROTEIN. |
| ID2047 | P | MANGANESE-CONTAINING CATALASE. |
| ID2048 | P | NITRATE TRANSPORTER. |
| ID2049 | P | HYPOTHETICAL ABC TRANSPORTER ATP-BINDING PROTEIN YQGK. |
| ID2050 | P | YKOY PROTEIN. |
| ID2051 | P | YBAF PROTEIN. |
| ID2052 | P | PROBABLE SUPEROXIDE DISMUTASE [FE] (EC 1.15.1.1). |
| ID2053 | P | HYPOTHETICAL 57.2 KDA PROTEIN. |
| ID2054 | P | YTLD. |
| ID2055 | P | SULFATE ADENYLYLTRANSFERASE (EC 2.7.7.4) (SULFATE ADENYLATET |
| ID2056 | P | HYPOTHETICAL 33.4 KDA PROTEIN IN DNAJ-RPSU INTEREGENIC REGIO |
| ID2057 | P | YLMA PROTEIN. |
| ID2058 | P | HYPOTHETICAL 23.8 KDA PROTEIN IN SPCIISA-HTRA INTERGENIC REG |
| ID2059 | P | HYPOTHETICAL 31.8 KDA PROTEIN IN GABP-GUAA INTERGENIC REGION |
| ID2060 | P | HYPOTHETICAL 29.2 KDA PROTEIN IN RAPJ-OPUAA INTERGENIC REGIO |
| ID2061 | P | FERRIC ANGUIBACTIN-BINDING PROTEIN PRECUSOR FATB OF V. ANGUI |
| ID2062 | P | HYPOTHETICAL ABC TRANSPORTER ATP-BINDING PROTEIN YBXA. |
| ID2063 | P | YKRM PROTEIN. |
| ID2064 | P | HYPOTHETICAL 24.3 KDA PROTEIN IN KINC-ADEC INTERGENIC REGION |
| ID2065 | P | PROBABLE ABC TRANSPORTER BINDING PROTEIN YQGG PRECURSOR. |
| ID2066 | P | HYPOTHETICAL 38.6 KDA PROTEIN. |
| ID2067 | P | HYPOTHETICAL TRANSCRIPTIONAL REGULATOR IN FEUA-SIGW INTERGEN |
| ID2068 | P | YFIY PROTEIN. |
| ID2069 | P | COTJC PROTEIN. |
| ID2070 | P | SA0587 PROTEIN. |
| ID2071 | P | YLNA PROTEIN. |
| ID2072 | P | HYPOTHETICAL 37.7 KDA PROTEIN IN SODA-COMGA INTERGENIC REGIO |
| ID2073 | P | PROBABLE MANGANESE TRANSPORT PROTEIN MNTH. |
| ID2074 | P | PROBABLE ADENYLYLSULFATE KINASE (EC 2.7.1.25) (APS KINASE) ( |
| ID2075 | P | PROBABLE ABC TRANSPORTER PERMEASE PROTEIN YQGI. |
| ID2076 | P | CYTOCHROME B SUBUNIT OF NITRIC OXIDE REDUCTASE. |
| ID2077 | P | SUPEROXIDE DISMUTASE (EC 1.15.1.1). |
| ID2078 | P | YVGL PROTEIN. |
| ID2079 | P | SULFITE REDUCTASE (NADPH) FLAVOPROTEIN (EC 1.8.1.2). |
| ID2080 | P | HYPOTHETICAL 21.7 KDA PROTEIN. |
| ID2081 | P | HYPOTHETICAL PROTEIN YWRB. |
| ID2082 | P | ORF starting with ATG of length 1458 |
| ID2083 | P | HYPOTHETICAL 49.9 KDA PROTEIN. |
| ID2084 | P | HYPOTHETICAL 43.2 KDA PROTEIN IN DNAC-RPLI INTERGENIC REGION |
| ID2085 | P | PEROXIDE OPERON REGULATOR. |
| ID2086 | P | HYPOTHETICAL 57.2 KDA PROTEIN. |
| ID2087 | P | YFIY PROTEIN. |
| ID2088 | P | PUTATIVE ALKALINE PHOSPHATASE. |
| ID2089 | P | HYPOTHETICAL PROTEIN YWRA. |
| ID2090 | P | YVGW PROTEIN. |
| ID2091 | P | PROBABLE ABC TRANSPORTER PERMEASE PROTEIN YQGH. |
| ID2092 | P | ARSENIC EFFLUX PUMP. |
| ID2093 | P | YVGQ (FRAGMENT). |
| ID2094 | P | YJBD PROTEIN. |
| ID2095 | P | POTASSIUM CHANNEL PROTEIN. |
| ID2096 | P | A formate transport associated protein, FTAP2. |
| ID2097 | P | BH0467 PROTEIN. |
| ID2098 | P | HYPOTHETICAL 14.6 KDA PROTEIN IN GCVT-SPOIIIAA INTERGENIC RE |
| ID2099 | P | Vancomycin resistant Enterococcus faecium expression product |
| ID2100 | P | PROBABLE ABC TRANSPORTER BINDING PROTEIN YXEB PRECURSOR. |
| ID2101 | P | YOJM PROTEIN. |
| ID2102 | P | YUSI PROTEIN. |
| ID2103 | P | HYDROPHOBIC MEMBRANE PROTEIN ZURM. |
| ID2104 | P | GENERAL STRESS PROTEIN 80 (GSP80). |
| ID2105 | P | ORF starting with ATG of length 957 |
| ID2106 | P | ORF starting with ATG of length 954 |

| | | -continued |
|---|---|---|
| ID2107 | P | YVGQ (FRAGMENT). |
| ID2108 | P | MODB PROTEIN. |
| ID2109 | P | ORF starting with ATG of length 933 |
| ID2110 | P | S. pneumoniae phosphate transport ATP-binding protein. |
| ID2111 | P | B. subtilis hydrolase protein YJCH. |
| ID2112 | P | GENERAL STRESS PROTEIN 80 (GSP80). |
| ID2113 | P | NA+/H+ ANTIPORTER SUBUNIT. |
| ID2114 | P | HYPOTHETICAL 12.1 KDA PROTEIN IN SACB-CLPP INTERGENIC REGION |
| ID2115 | P | HYPOTHETICAL 11.4 KDA PROTEIN IN SACB-CLPP INTERGENIC REGION |
| ID2116 | P | SA0928 PROTEIN. |
| ID2117 | P | RPOH (FRAGMENT). |
| ID2118 | P | ORF starting with ATG of length 799 |
| ID2119 | P | YJBE PROTEIN. |
| ID2120 | P | HYPOTHETICAL 11.3 KDA PROTEIN IN HMP-PROB INTERGENIC REGION. |
| ID2121 | P | FEOB PROTEIN. |
| ID2122 | P | ORF starting with ATG of length 771 |
| ID2123 | P | TRANSPORTER (PHO87 FAMILY). |
| ID2124 | P | PEROXIDE OPERON REGULATOR. |
| ID2125 | P | PUTATIVE ALKALINE PHOSPHATASE. |
| ID2126 | P | HYPOTHETICAL 11.9 KDA PROTEIN IN HMP-PROB INTERGENIC REGION. |
| ID2127 | P | MULTIDRUG RESISTANCE PROTEIN EBRB. |
| ID2128 | P | PEROXIDE OPERON REGULATOR. |
| ID2129 | P | ORF starting with ATG of length 1005 |
| ID2130 | P | NA+/H+ ANTIPORTER SUBUNIT. |
| ID2131 | P | NA+/H+ ANTIPORTER SUBUMIT. |
| ID2132 | P | YBCF PROTEIN. |
| ID2133 | P | NITRATE EXTRUSION PROTEIN (FRAGMENT). |
| ID2134 | P | ORF starting with ATG of length 624 |
| ID2135 | P | ORF starting with ATG of length 594 |
| ID2136 | P | YDFA PROTEIN. |
| ID2137 | P | YTWF PROTEIN. |
| ID2138 | P | NA+/H+ ANTIPORTER SUBUNIT. |
| ID2139 | P | CATION-EFFLUX SYSTEM MEMBRANE PROTEIN HOMOLOG. |
| ID2140 | P | YFLS PROTEIN. |
| ID2141 | P | B. subtilis hydrolase protein YJCH. |
| ID2142 | P | HYPOTHETICAL 7.2 KDA PROTEIN. |
| ID2143 | P | IRON UPTAKE REGULATORY PROTEIN. |
| ID2144 | P | ABC-TYPE TRANSPORTER, PUTATIVE ATP-BINDING COMPONENT. |
| ID2145 | P | ORF starting with ATG of length 244 |
| ID2146 | P | PROBABLE MANGANESE TRANSPORT PROTEIN MNTH. |
| ID2147 | P | HYPOTHETICAL PROTEIN YWRB. |
| ID2148 | PH | IRON-UPTAKE SYSTEM PERMEASE PROTEIN FEUB. |
| ID2149 | PH | HOMOLOGUE OF FERRIC ANGUIBACTIN TRANSPORT SYSTEM PERMERASE P |
| ID2150 | PH | YUSV PROTEIN. |
| ID2151 | PH | YFHA PROTEIN. |
| ID2152 | PH | IRON-UPTAKE SYSTEM PERMEASE PROTEIN FEUC. |
| ID2153 | PH | FERRICHROME TRANSPORT SYSTEM PERMEASE PROTEIN FHUG. |
| ID2154 | PH | FERRICHROME TRANSPORT ATP-BINDING PROTEIN FHUC. |
| ID2155 | PH | YVRA PROTEIN. |
| ID2156 | PH | YFMD PROTEIN. |
| ID2157 | PH | ENTEROCHELIN UPTAKE PERMEASE. |
| ID2158 | PH | YFME PROTEIN. |
| ID2159 | PH | PERMEASE PROTEIN OF ABC TRANSPORTER. |
| ID2160 | PH | FERRICHROME TRANSPORT PERMEASE. |
| ID2161 | PH | BIRII, ATR, FBID & FBIC GENES (FRAGMENT). |
| ID2162 | PH | HOMOLOGUE OF IRON DICITRATE TRANSPORT ATP-BINDING PROTEIN FE |
| ID2163 | PH | HMUV. |
| ID2164 | PH | FERRICHROME TRANSPORT SYSTEM PERMEASE PROTEIN FHUB. |
| ID2165 | PR | ASSIMILATORY NITRITE REDUCTASE [NAD(P)H] SMALL SUBUNIT (EC 1 |
| iD2166 | Q | LCHAB PROTEIN. |
| ID2167 | Q | LICHENYSIN SYNTHETASE A. |
| ID2168 | Q | LICHENYSIN SYNTHETASE A. |
| ID2169 | Q | ORF starting with ATG of length 8268 |
| ID2170 | Q | YERP PROTEIN. |
| ID2171 | Q | ORF starting with ATG of length 7158 |
| ID2172 | Q | YKNV PROTEIN. |
| ID2173 | Q | 2,3-DIHYDROXYBENZOATE-AMP LIGASE (EC 6.3.2.-) (DIHYDROXYBENZ |
| ID2174 | Q | TRANSPORT ATP-BINDING PROTEIN CYDC. |
| ID2175 | Q | ORF starting with ATG of length 3798 |
| ID2176 | Q | UNIDENTIFIED TRANSPORTER-ATP BINDING. |
| ID2177 | Q | HYPOTHETICAL 65.1 KDA PROTEIN. |
| ID2178 | Q | REGULATORY PROTEIN (FRAGMENT). |
| ID2179 | Q | HYPOTHETICAL 48.5 KDA PROTEIN IN ILVA 3' REGION. |
| ID2180 | Q | HYPOTHETICAL ABC TRANSPORTER ATP-BINDING PROTEIN IN ACDA 5' R |
| ID2181 | Q | PUTATIVE CYTOCHROME P450 CYPX (EC 1.14.-.-). |
| ID2182 | Q | CYTOCHROME P450 109 (EC 1.14.-.-) (ORF405). |
| ID2183 | Q | ATP-BINDING CASSETTE TRANSPORTER A. |
| ID2184 | Q | NYSH. |
| ID2185 | Q | "BIOTIN BIOSYNTHESIS; CYTOCHROME P450-LIKE ENZYME (EC 1.14.- |

-continued

| | | |
|---|---|---|
| ID2186 | Q | BH2620 PROTEIN. |
| ID2187 | Q | LANTIBIOTIC MERSACIDIN TRANSPORTER SYSTEM. |
| ID2188 | Q | YKNX PROTEIN. |
| ID2189 | Q | HYPOTHETICAL 76.3 KDA PROTEIN. |
| ID2190 | Q | PUTATIVE CYTOCHROME P450 YJIB (EC 1.14.-.-). |
| ID2191 | Q | LANTIBIOTIC MERSACIDIN TRANSPORTER SYSTEM. |
| ID2192 | Q | HYPOTHETICAL 33.7 KDA PROTEIN. |
| ID2193 | Q | ORF starting with ATG of length 3798 |
| ID2194 | Q | ORF starting with ATG of length 1950 |
| ID2195 | Q | TRANSPORT ATP-BINDING PROTEIN CYDD. |
| ID2196 | Q | PUTATIVE CHALCONE SYNTHASE (EC 2.3.1.74) (NARINGENIN-CHALCON |
| ID2197 | Q | ALPHA-ACETOLACTATE DECARBOXYLASE (EC 4.1.1.5). |
| ID2198 | Q | ORF starting with ATG of length 1824 |
| ID2199 | Q | *S. xylosus* DltA protein. |
| ID2200 | Q | DNA-DAMAGE-INDUCIBLE PROTEIN. |
| ID2201 | Q | ORF starting with ATG of length 1677 |
| ID2202 | Q | YLPC PROTEIN. |
| ID2203 | Q | YUEJ PROTEIN. |
| ID2204 | Q | ORF starting with ATG of length 1470 |
| ID2205 | Q | ISOCHORISMATASE (EC 3.3.2.1) (2,3 DIHYDRO-2,3 DIMYDROXYBENZO |
| ID2206 | Q | 4'-PHOSPHOPANTETHEINYL TRANSFERASE (EC 2.-.-.-) (SURFACTIN S |
| ID2207 | Q | HYPOTHETICAL 20.8 KDA PROTEIN IN SERS-DNAZ INTERGENIC REGION |
| ID2208 | Q | BACITRACIN SYNTHETASE 3 (BA3) (FRAGMENT). |
| ID2209 | Q | SURFACTIN SYNTHETASE (FRAGMENT). |
| ID2210 | Q | TRANSPORT ATP-BINDING PROTEIN CYDD. |
| ID2211 | Q | ABC TRANSPORTER ECSA HOMOLOG. |
| ID2212 | Q | PUTATIVE ABC TRANSPORTER SUBUNIT EPIF. |
| ID2213 | Q | 4-OXALOCROTONATE DECARBOXYLASE-LIKE PROTEIN. |
| ID2214 | Q | HYPOTHETICAL ABC TRANSPORTER ATP-BINDING PROTEIN 2 IN GLPD-C |
| ID2215 | Q | YHAQ. |
| ID2216 | Q | ORF starting with ATG of length 927 |
| ID2217 | Q | ORF starting with ATG of length 927 |
| ID2218 | Q | HYPOTHETICAL 50.0 KDA PROTEIN. |
| ID2219 | Q | ORF starting with ATG of length 885 |
| ID2220 | Q | LCHA-TE PROTEIN. |
| ID2221 | Q | YHBJ PROTEIN. |
| ID2222 | Q | 308AA LONG HYPOTHETICAL ATP-BINDING TRANSPORT PROTEIN. |
| ID2223 | Q | ORF starting with ATG of length 852 |
| ID2224 | Q | ORF starting with ATG of length 885 |
| ID2225 | Q | ORF starting with ATG of length 834 |
| ID2226 | Q | HYPOTHETICAL 76.3 KDA PROTEIN. |
| ID2227 | Q | ATP BINDING PROTEIN BVIA. |
| ID2228 | Q | YOJI PROTEIN. |
| ID2229 | Q | ORF starting with ATG of length 780 |
| ID2230 | Q | ORF starting with ATG of length 759 |
| ID2231 | Q | ORF starting with ATG of length 690 |
| ID2232 | Q | CYTOCHROME P450 97B3 (EC 1.14.-.-). |
| ID2233 | Q | ISOCHORISMATASE (EC 3.3.2.1) (2,3 DIHYDRO-2,3 DIHYDROXYBENZO |
| ID2234 | Q | ORF starting with ATG of length 636 |
| ID2235 | Q | HYPOTHETICAL 34.4 KDA PROTEIN. |
| ID2236 | Q | SA1655 PROTEIN. |
| ID2237 | Q | HYPOTHETICAL 14.8 KDA PROTEIN. |
| ID2238 | Q | ISOCHORISMATASE (EC 3.3.2.1) (2,3 DIHYDRO-2,3 DIHYDROXYBENZO |
| ID2239 | Q | ORF starting with ATG of length 489 |
| ID2240 | Q | DNA-DAMAGE-INDUCIBLE PROTEIN. |
| ID2241 | Q | YHBJ PROTEIN. |
| ID2242 | Q | PUTATIVE CYTOCHROME P450 YJIB (EC 1.14.-.-). |
| ID2243 | Q | HYPOTHETICAL 30.2 KDA PROTEIN. |
| ID2244 | Q | ACETYL XYLAN ESTERASE. |
| ID2245 | Q | ORF starting with ATG of length 354 |
| ID2246 | Q | ORF starting with ATG of length 353 |
| ID2247 | Q | BH2936 PROTEIN. |
| ID2248 | Q | Synthetic ferulic acid decarboxylase clone pGS97b1. |
| ID2249 | Q | ORF starting with ATG of length 204 |
| ID2250 | QR | HYPOTHETICAL OXIDOREDUCTASE IN APRE-COMK INTERGENIC REGION (E |
| ID2251 | QR | YVAG PROTEIN. |
| ID2252 | QR | HYPOTHETICAL OXIDOREDUCTASE IN RTP-PELB INTERGENIC REGION (E |
| ID2253 | QR | D-MANNONATE OXIDOREDUCTASE. |
| ID2254 | QR | *H. ghilianii/B. megaterium* fusion protein Tridegin/GlcDH. |
| ID2255 | QR | 3-KETOACYL-ACP REDUCTASE. |
| ID2256 | QR | 2,3-DIHYDRO-2,3-DIHYDROXYBENZOATE DEHYDROGENASE (EC 1.3.1.28 |
| ID2257 | QR | YUED PROTEIN. |
| ID2258 | QR | HYPOTHETICAL 28.3 KDA PROTEIN IN AROD-COMER INTERGENIC REGIO |
| ID2259 | QR | SORBITOL-6-PHOSPHATE DEHYDROGENASE. |
| ID2260 | QR | ACETOIN (DIACETYL) REDUCTASE. |
| ID2261 | QR | AT1G54870/F14C21__16. |
| ID2262 | QR | YTQB. |
| ID2263 | QR | YRRT PROTEIN. |
| ID2264 | QR | UNIDENTFIED DEHYDROGENASE. |

-continued

| | | |
|---|---|---|
| ID2265 | QR | GLUCOSE AND RIBITOL DEHYDROGENASE HOMOLOG (FRAGMENT). |
| ID2266 | QR | *B. subtilis* hydroLase protein YODH. |
| ID2267 | QR | YVAG PROTEIN. |
| ID2268 | QR | YRRM PROTEIN. |
| ID2269 | QR | PUTATIVE OXIDOREDUCTASE TM0019 (EC 1.-.-.-). |
| ID2270 | QR | HYPOTHETICAL 31.5 KDA PROTEIN IN KATB 3' REGION. |
| ID2271 | QR | Amino acid sequence of a beta-ketoacyl-ACP reductase protein |
| ID2272 | QR | HYPOTEETICAL OXIDOREDUCTASE F53C11.3 (EC 1.-.-.-). |
| ID2273 | QR | YVAG PROTEIN. |
| ID2274 | QR | SHORT-CHAIN ALCOHOL DEHYDROGENASE. |
| ID2275 | QR | 282AA LONG HYPOTHETICAL DEHYDROGENASE. |
| ID2276 | QR | HYPOTHETICAL 28.3 KDA PROTEIN IN XPAC-ABRB INTERGENIC REGION |
| ID2277 | QR | YMFI PROTEIN. |
| ID2278 | QR | MLL3372 PROTEIN. |
| ID2279 | QR | ORF starting with ATG of length 765 |
| ID2280 | QR | 3-OXOACYL-[ACYL-CARRIER-PROTEIN] REDUCTASE. |
| ID2281 | QR | PUTATIVE OXIDOREDUCTASE HI0048 (EC 1.-.-.-). |
| ID2282 | QR | ORF starting with ATG of length 597 |
| ID2283 | QR | GRA-ORF6 PROTEIN. |
| ID2284 | QR | GRF starting with ATG of length 534 |
| ID2285 | QR | HYPOTHETICAL 19.0 KDA PROTEIN IN ILVD-THYB INTERGENIC REGION |
| ID2286 | QR | ORF starting with ATG of length 432 |
| ID2287 | QR | ORF starting with TTG or GTG of length 468 |
| ID2288 | R | PUTATIVE FORMATE DEHYDROGENASE, ALPHA SUBUNIT (EC 1.2.1.2) ( |
| ID2289 | R | HYPOTHETICAL 74.3 KDA PROTEIN IN RPLI-COTF INTERGENIC REGION |
| ID2290 | R | HYPOTHETICAL 79.2 KDA PROTEIN IN PHOH-DGKA INTERGENIC REGION |
| ID2291 | R | HYPOTHETICAL 61.5 KDA PROTEIN IN ADEC-PDHA INTERGENIC REGION |
| ID2292 | R | YTSD. |
| ID2293 | R | YFMR. |
| ID2294 | R | HYPOTHETICAL 78.8 KDA PROTEIN IN TETB-EXOA INTERGENIC REGION |
| ID2295 | R | HYPOTHETICAL 60.2 KDA PROTEIN IN CSPB-GLPP INTERGENIC REGION |
| ID2296 | R | YFMM PROTEIN. |
| ID2297 | R | FORMATE DEHYDROGENASE ALPHA SUBUNIT HOMOLOG. |
| ID2298 | R | YURU PROTEIN. |
| ID2299 | R | PROBABLE GTP-BINDING PROTEIN ENGA. |
| ID2300 | R | HYPOTHETICAL 70.5 KDA PROTEIN IN IDH 3' REGION. |
| ID2301 | R | SPO0B-ASSOCIATED GTP-BINDING PROTEIN. |
| ID2302 | R | YURX PROTEIN. |
| ID2303 | R | BH0531 PROTEIN. |
| ID2304 | R | HYPOTHETICAL 56.1 KDA PROTEIN IN MFD-DIVIC INTERGENIC REGION |
| ID2305 | R | ORF11. |
| ID2306 | R | COME OPERON PROTEIN 3. |
| ID2307 | R | HYPOTHETICAL HELICASE IN PONA-COTD INTERGENIC REGION. |
| ID2308 | R | PBSX PHAGE TERMINASE LARGE SUBUNIT. |
| ID2309 | R | YKPA PROTEIN. |
| ID2310 | R | HYPOTHETICAL 51.2 KDA PROTEIN IN RECQ-CMK INTERGENIC REGION |
| ID2311 | R | YKVU PROTEIN. |
| ID2312 | R | HYPOTHETICAL 48.9 KDA PROTEIN. |
| ID2313 | R | MMGE PROTEIN. |
| ID2314 | R | HYPOTHETICAL 40.1 KDA GTP-BINDING PROTEIN IN RPSF-SPO0J INTE |
| ID2315 | R | ORF11. |
| ID2316 | R | HYPOTHETICAL 50.9 KDA PROTEIN IN SPOIIIC-CWLA INTERGENIC REG |
| ID2317 | R | POSSIBLE THIOPHENE AND FURAN OXIDATION PROTEIN. |
| ID2318 | R | *Bacillus subtilis* inositol dehydrogenase. |
| ID2319 | R | ORNITHINE ACETYLTRANSFERASE. |
| ID2320 | R | HYPOTHETICAL 40.9 KDA PROTEIN IN MECB-GLTX INTERGENIC REGION |
| ID2321 | R | HYPOTHETICAL 43.6 KDA PROTEIN IN GBSA-TLPB INTERGENIC REGION |
| ID2322 | R | HYPOTHETICAL 50.0 KDA PROTEIN IN SODA-COMGA INTERGENIC REGIO |
| ID2323 | R | HYPOTHETICAL 40.7 KDA PROTEIN IN MECB-GLTX INTERGENIC REGION |
| ID2324 | R | HYPOTHETICAL 48.3 KDA PROTEIN IN QCRA-AROE INTERGENIC REGION |
| ID2325 | R | YTQA. |
| ID2326 | R | YESM PROTEIN. |
| ID2327 | R | HYPOTHETICAL SYMPORTER YHCL. |
| ID2328 | R | HYPOTHETICAL 41.0 KDA PROTEIN IN NUCB-AROD INTERGENIC REGION |
| ID2329 | R | YMFA PROTEIN. |
| ID2330 | R | HYPOTHETICAL 42.1 KDA PROTEIN IN MOAD-FRUR INTERGENIC REGION |
| ID2331 | R | ORF starting with ATG of length 2879 |
| ID2332 | R | HYPOTHETICAL 51.5 KDA PROTEIN IN CITA-SSPB INTERGENIC REGION |
| ID2333 | R | HYPOTHETICAL 57.4 KDA PROTEIN IN MFD-DIVIC INTERGENIC REGION |
| ID2334 | R | BH0889 PROTEIN. |
| ID2335 | R | GTP-BINDING PROTEIN ERA HOMOLOG (BEX PROTEIN). |
| ID2336 | R | YTRF. |
| ID2337 | R | AMINOPEPTIDASE. |
| ID2338 | R | HYPOTHETICAL 51.0 KDA PROTEIN IN PTA 3' REGION. |
| ID2339 | R | HYPOTHETICAL 37.1 KDA PROTEIN IN FOLK-LYSS INTERGENIC REGION |
| ID2340 | R | HYPOTHETICAL OXIDOREDUCTASE IN FHUD-OPUBD INTERGENIC REGION. |
| ID2341 | R | HYPOTHETICAL 33.6 KDA PROTEIN IN TDK-PRFA INTERGENIC REGION. |
| ID2342 | R | YDFJ PROTEIN. |
| ID2343 | R | HYPOTHETICAL 37.5 KDA PROTEIN IN DEGA-NPRB INTERGENIC REGION |

| | | -continued |
|---|---|---|
| ID2344 | R | YHAA PROTEIN. |
| ID2345 | R | YBFQ PROTEIN. |
| ID2346 | R | YLOQ PROTEIN. |
| ID2347 | R | PUTATIVE SODIUM-DEPENDENT INNER MEMBRANE TPANSPORT PROTEIN. |
| ID2348 | R | HOMOLOGUE OF HYPOTHETICAL PROTEIN IN A RAPAMYCIN SYNTHESIS G |
| ID2349 | R | BH2362 PROTEIN. |
| ID2350 | R | HYPOTHETICAL 32.9 KDA PROTEIN IN GCVT-SPOIIIAA INTERGENIC RE |
| ID2351 | R | HYPOTHETICAL 29.5 KDA PROTEIN. |
| ID2352 | R | YEBB PROTEIN. |
| ID2353 | R | 2-NITROPROPANE DIOXYGENASE. |
| ID2354 | R | ORF starting with ATG of length 2250 |
| ID2355 | R | YKOQ. |
| ID2356 | R | YTQI. |
| ID2357 | R | HYPOTHETICAL 30.2 KDA PROTEIN IN IDH-DEOR INTERGENIC REGION. |
| ID2358 | R | YTNP. |
| ID2359 | R | SIMILAR TO *BACILLUS SUBTILIS* YXEH AND YCSE PROTEINS AND TO E |
| ID2360 | R | PUTATIVE MORPHINE DEHYDROGENASE. |
| ID2361 | R | HYPOTHETICAL 20.0 KDA PROTEIN IN RRNG-FEUC INTERGENIC REGION |
| ID2362 | R | ORF starting with ATG of length 2055 |
| ID2363 | R | YHAA PROTEIN. |
| ID2364 | R | HYPOTHETICAL 34.5 KDA PROTEIN IN GLTP-CWLJ INTERGENIC REGION |
| ID2365 | R | YTIP. |
| ID2366 | R | YRRL PROTEIN. |
| ID2367 | R | BH2393 PROTEIN. |
| ID2368 | R | NUCLEOTIDE BINDING PROTEIN EXPZ. |
| ID2369 | R | YTFP (YTFP PROTEIN). |
| ID2370 | R | HYPOTHETICAL 33.9 KDA PROTEIN IN LIPB-SSPK INTERGENIC REGION |
| ID2371 | R | HYPOTHETICAL 24.7 KDA PROTEIN. |
| ID2372 | R | YQZB PROTEIN. |
| ID2373 | R | HOMOLOGUES TO NITRILE HYDRATASE REGION 3'-HYPOTHETICAL PROTE |
| ID2374 | R | HOMOLOGUE OF HYPOTHETICAL PROTEIN IN A RAPAMYCIN SYNTHESIS G |
| ID2375 | R | YVGN PROTEIN. |
| ID2376 | R | HYPOTHETICAL 39.3 KDA PROTEIN. |
| ID2377 | R | HYPOTHETICAL 32.7 KDA PROTEIN IN FEUA-SIGW INTERGENIC REGION |
| ID2378 | R | HYPOTHETICAL 24.1 KDA PROTEIN YDIH. |
| ID2379 | R | PUTATIVE TRANSPORTER. |
| ID2380 | R | PCRB PROTEIN HOMOLOG. |
| ID2381 | R | YOJE PROTEIN. |
| ID2382 | R | HYPOTHETICAL 24.7 KDA PROTEIN IN CSPB-GLPP INTERGENIC REGION |
| ID2383 | R | YUSB PROTEIN. |
| ID2384 | R | HYPOTHETICAL ZINC PROTEASE YMXG (EC 3.4.99.-) (ORFP). |
| ID2385 | R | YCCF PROTEIN. |
| ID2386 | R | YMFH PROTEIN. |
| ID2387 | R | YTMQ. |
| ID2388 | R | HEMOLYSIN III HOMOLOG. |
| ID2389 | R | TUAB PROTEIN. |
| ID2390 | R | HYPOTHETICAL 31.5 KDA PROTEIN IN GLVBC 3' REGION. |
| ID2391 | R | YFNB. |
| ID2392 | R | YFHG PROTEIN. |
| ID2393 | R | BH1896 PROTEIN. |
| ID2394 | R | *Bacillus subtilis* yihA famiiy member polypeptide sequence. |
| ID2395 | R | DNA FOR 25-36 DEGREE REGION CONTAINING THE AMYE-SRFA REGION, |
| ID2396 | R | YKVM PROTEIN. |
| ID2397 | R | HPR (SER-P) PHOSPHATASE (YVOE PROTEIN). |
| ID2398 | R | YFLN PROTEIN. |
| ID2399 | R | YUNE PROTEIN. |
| ID2400 | R | HYPOTHETICAL OXIDOREDUCTASE IN ANSR-BMRU INTERGENIC REGION (E |
| ID2401 | R | HYPOTHETICAL 28.9 KDA PROTEIN. |
| ID2402 | R | HYPOTHETICAL ABC TRANSPORTER ATP-BINDING PROTEIN IN IDH 3' RE |
| ID2403 | R | ORF starting with ATG of length 1722 |
| ID2404 | R | ABC TRANSPORTER ATP-BINDING PROTEIN HOMOLOGUE. |
| ID2405 | R | YKVJ PROTEIN. |
| ID2406 | R | YOAZ. |
| ID2407 | R | YCZE PROTEIN. |
| ID2408 | R | HYPOTHETICAL 23.7 KDA PROTEIN IN CCCA-SODA INTERGENIC REGION |
| ID2409 | R | *Bacillus subtilis* serine protease SP3 (YITV). |
| ID2410 | R | HYPOTHETICAL 19.0 KDA PROTEIN IN GLPD-CSPB INTERGENIC REGION |
| ID2411 | R | UNKNOWN (BH2089 PROTEIN). |
| ID2412 | R | HYPOTHETICAL 35.9 KDA PROTEIN. |
| ID2413 | R | YRRB PROTEIN. |
| ID2414 | R | HYPOTHETICAL 37.5 KDA PROTEIN YDHJ. |
| ID2415 | R | HYPOTHETICAL 30.6 KDA PROTEIN. |
| ID2416 | R | ORF starting with ATG of length 1584 |
| ID2417 | R | RECOMBINATION PROTEIN U (PENICILLIN-BINDING PROTEIN-RELATED |
| ID2418 | R | PUTATIVE ACETYLTRANSFERASE. |
| ID2419 | R | HYPOTHETICAL 27.6 KDA PROTEIN IN BLTR-SPOIIIC INTERGENIC REG |
| ID2420 | R | PUTATIVE BETA-PHOSPHOGLUCOMUTASE (EC 5.4.2.6) (BETA-PGM). |
| ID2421 | R | YTSC PROTEIN. |
| ID2422 | R | HOMOLOGUE OF UNIDENTIFIED PROTEIN OF *E. COLI.* |

-continued

| | | |
|---|---|---|
| ID2423 | R | HYPOTHETICAL 32.9 KDA PROTEIN IN BLTR-SPOIIIC INTERGENIC REG |
| ID2424 | R | FUNCTION UNKNOWN. |
| ID2425 | R | BH1010 PROTEIN. |
| ID2426 | R | HYPOTHETICAL 33.2 KDA PROTEIN. |
| ID2427 | R | HYPOTHETICAL 19.7 KDA PROTEIN IN CYSS 3' REGION. |
| ID2428 | R | HYPOTHETICAL 137.4 KDA PROTEIN IN BCSA-DEGR INTERGENIC REGIO |
| ID2429 | R | YNGD PROTEIN. |
| ID2430 | R | HYPOTHETICAL 35.8 KDA PROTEIN IN GLNQ-ANSR INTERGENIC REGION |
| ID2431 | R | YTDI. |
| ID2432 | R | YTET. |
| ID2433 | R | HYPOTHETICAL 24.5 KDA PROTEIN IN NARQ-SPOIID INTERGENIC REGI |
| ID2434 | R | YKUE PROTEIN. |
| ID2435 | R | HYPOTHETICAL ABC TRANSPORTER ATP-BINDING PROTEIN YDIF. |
| ID2436 | R | YDCA PROTEIN. |
| ID2437 | R | BH1564 PROTEIN. |
| ID2438 | R | HYPOTHETICAL 20.1 KDA PROTEIN IN NUCB-AROD INTERGENIC REGION |
| ID2439 | R | YTET. |
| ID2440 | R | YTQA. |
| ID2441 | R | HYPOTHETICAL 27.9 KDA PROTEIN. |
| ID2442 | R | ORF starting with ATG of length 1419 |
| ID2443 | R | HYPOTHETICAL 41.6 KDA PROTEIN IN FMT-SPOVM INTERGENIC REGION |
| ID2444 | R | ORF starting with ATG of length 1413 |
| ID2445 | R | GENERAL STRESS PROTEIN 18 (GSP18). |
| ID2446 | R | CINA-LIKE PROTEIN. |
| ID2447 | R | HYPOTHETICAL 49.5 KDA PROTEIN LN TGL-PGI INTERGENIC REGION. |
| ID2448 | R | *B. subtilis* hydrolase protein YUII. |
| ID2449 | R | SA0421 PROTEIN. |
| ID2450 | R | YLOV PROTEIN. |
| ID2451 | R | YTNM. |
| ID2452 | R | HYPOTHETICAL 40.6 KDA PROTEIN IN CITZ-PYKA INTERGENIC REGION |
| ID2453 | R | MLL7248 PROTEIN. |
| ID2454 | R | BH3078 PROTEIN. |
| ID2455 | R | YTPR. |
| ID2456 | R | YKUL PROTEIN. |
| ID2457 | R | ACETOIN UTILIZATION ACUB PROTEIN. |
| ID2458 | R | MALTOSE TRANSACETYLASE (MALTOSE O-ACETYLTRANSFERASE) (EC 2.3 |
| ID2459 | R | JAG PROTEIN (SPOIIIJ ASSOCIATED PROTEIN). |
| ID2460 | R | HYPOTHETICAL 22.0 KDA PROTEIN IN RECQ-CMK INTERGENIC REGION. |
| ID2461 | R | HYPOTHETICAL 41.6 KDA PROTEIN IN FMT-SPOVM INTERGENIC REGION |
| ID2462 | R | BH1956 PROTEIN. |
| ID2463 | R | BH0846 PROTEIN. |
| ID2464 | R | COMF OPERON PROTEIN 3. |
| ID2465 | R | HYPOTHETICAL 56.4 KDA PROTEIN IN SODA-COMGA INTERGENIC REGIO |
| ID2466 | R | LIPOPOLYSACCHARIDE BIOSYNTHESIS PROTEIN BPLA. |
| ID2467 | R | YUIG PROTEIN. |
| ID2468 | R | YKNY PROTEIN. |
| ID2469 | R | BH3002 PROTEIN. |
| ID2470 | R | HYPOTHETICAL 23.2 KDA PROTEIN. |
| ID2471 | R | HYPOTHETICAL 22.5 KDA PROTEIN. |
| ID2472 | R | ORF starting with ATG of length 1233 |
| ID2473 | R | YFHB PROTEIN. |
| ID2474 | R | BH2921 PROTEIN. |
| ID2475 | R | UNKNOWN (BH2089 PROTEIN) |
| ID2476 | R | HYPOTHETICAL 41.0 KDA PROTEIN. |
| ID2477 | R | *B. subtilis* hydrolase protein YCGS. |
| ID2478 | R | SPORE MATURATION PROTEIN A. |
| ID2479 | R | YOLF. |
| ID2480 | R | PUTATIVE - PROBABLE ESTERASE. |
| ID2481 | R | HYPOTHETICAL 39.6 KDA PROTEIN IN ALAS-GLNQ INTERGENIC REGION |
| ID2482 | R | HYPOTHETICAL 34.9 KDA PROTEIN IN GLPD-CSPB INTERGENIC REGION |
| ID2483 | R | Human secreted protein sequence encodod by gene 4 SEQ ID NO: |
| ID2484 | R | GALACTOSYLTRANSFERASE-RELATED PROTEIN. |
| ID2485 | R | HYPOTHETICAL 18.8 KDA PROTEIN IN ECSC-PBPF INTERGENIC REGION |
| ID2486 | R | HYPOTHETICAL 24.0 KDA PROTEIN IN NARQ-SPOIID INTERGENIC REGI |
| ID2487 | R | ORF starting with ATG of length 1146 |
| ID2488 | R | HYPOTHETICAL 41.0 KDA PROTEIN. |
| ID2489 | R | ORF starting with ATG of length 1134 |
| ID2490 | R | HYPOTHETICAL ABC TRANSPORTER ATP-BINDING PROTEIN YDIF. |
| ID2491 | R | YDCJ PROTEIN. |
| ID2492 | R | HYPOTHETICAL 17.4 KDA PROTEIN. |
| ID2493 | R | YJBI PROTEIN. |
| ID2494 | R | HYPOTHETICAL 21.1 KDA PROTEIN. |
| ID2495 | R | HYPOTHETICAL. |
| ID2496 | R | HYPOTHETICAL 137.4 FDA PROTEIN IN BCSA-DEGR INTERGENIC REGIO |
| ID2497 | R | COENZYME PQQ SYNTHESIS PROTEIN (PQQE). |
| ID2498 | R | HYPOTHETICAL 28.6 KDA PROTEIN IN RECQ-CMK INTERGENIC REGION |
| ID2499 | R | ORF starting with ATG of length 1056 |
| ID2500 | R | HYPOTHETICAL 22.8 KDA PROTEIN. |
| ID2501 | R | HYPOTHETICAL 19.5 KDA PROTEIN. |

| | | -continued |
|---|---|---|
| ID2502 | R | ORF starting with ATG of length 1053 |
| ID2503 | R | HYPOTHETICAL 14.9 KDA PROTEIN IN CSPB-GLPP INTERGENIC REGION |
| ID2504 | R | ORF starting with ATG of length 1044 |
| ID2505 | R | BH2278 PROTEIN. |
| ID2506 | R | HYPOTHETICAL 49.5 KDA PROTEIN IN TGL-PGI INTERGENIC REGION. |
| ID2507 | R | ORF starting with ATG of length 1020 |
| ID2508 | R | PHOSPHOTRIESTERASE HOMOLOGY PROTEIN. |
| ID2509 | R | ACYLTRANSFERASE, PUTATIVE. |
| ID2510 | R | INTRACELLULAR PROTEINASE. |
| ID2511 | R | ABC TRANSPORTER (ATP-BINDING PROTEIN). |
| ID2512 | R | YLOV PROTEIN. |
| ID2513 | R | HYPOTHETICAL ABC TRANSPORTER ATP-BINDTNG PROTEIN YDTF. |
| ID2514 | R | VEGETATIVE PROTEIN 296 (VEG296). |
| ID2515 | R | BH2279 PROTEIN. |
| ID2516 | R | HYPOTHETICAL 49.0 KDA PROTEIN IN BLTD-TRKA INTERGENIC REGION |
| ID2517 | R | HYPOTHETICAL 23.1 KDA PROTEIN IN BSAA-ILVD INTERGENIC REGION |
| ID2518 | R | SA0084 PROTEIN. |
| ID2519 | R | HYPOTHETICAL 11.3 KDA PROTEIN. |
| ID2520 | R | HYPOTHETICAL 20.5 KDA PROTEIN. |
| ID2521 | R | BH1964 PROTEIN. |
| ID2522 | R | HYPOTHETICAL 21.6 KDA PROTEIN IN ILVA 3' REGION. |
| ID2523 | R | HYPOTHETICAL PROTEIN NMB0739. |
| ID2524 | R | HOMOLOGUES TO NITRILE HYDRATASE REGION 3'-HYPOTHETICAL PROTE |
| ID2525 | R | BH2398 PROTEIN. |
| ID2526 | R | LYASE (OXO-ACID) |
| ID2527 | R | PROBABLE MEMBRANE SPANNING PROTEIN. |
| ID2528 | R | HOMOLOGUE OF HYPOTHETICAL PROTEIN IN A RAPAMYCIN SYNTHESIS G |
| ID2529 | R | ORF starting with ATG of length 879 |
| ID2530 | R | MDAB PROTEIN HOMOLOG. |
| ID2531 | R | HYPOTHETICAL 27.7 KDA PROTEIN. |
| ID2532 | R | HOMOLOGUE OF UNIDENTIFIED PROTEIN OF *E. COLI*. |
| ID2533 | R | YOBT. |
| ID2534 | R | HYPOTHETICAL 36.5 KDA PROTEIN IN GBSA-TLPB INTERGENIC REGION |
| ID2535 | R | HYPOTHETICAL 19.2 KDA PROTEIN TN RPH-TLVB INTERGENIC REGION. |
| ID2536 | R | BH1151 PROTEIN. |
| ID2537 | R | CHAPERONIN INVOLVED IN PROTEIN SECRETION. |
| ID2538 | R | YTDI. |
| ID2539 | R | FORMATE HYDROGENASE. |
| ID2540 | R | HYPOTHETICAL 30.7 KDA PROTEIN. |
| ID2541 | R | LACTAM UTILIZATION PROTEIN. |
| ID2542 | R | ORF starting with ATG of length 783 |
| ID2543 | R | ORF starting with ATG of length 774 |
| ID2544 | R | ABC TRANSPORTER, ATP BINDING PROTEIN. |
| ID2545 | R | YTGP. |
| ID2546 | R | *B. subtilis* nitroreductaSe Bs YrwO. |
| ID2547 | R | HYPOTHETICAL 13.0 KDA PROTEIN IN GLNQ-ANSR INTERGENIC REGION |
| ID2548 | R | YDFJ PROTEIN. |
| ID2549 | R | ORF starting with ATG of length 756 |
| ID2550 | R | YDFE PROTEIN. |
| ID2551 | R | BH0392 PROTEIN. |
| ID2552 | R | HYPOTHETICAL 32.6 KDA PROTEIN. |
| ID2553 | R | SA2112 PROTEIN. |
| ID2554 | R | HYPOTHETICAL 28.6 KDA PROTEIN IN RECQ-CMK INTERGENIC REGION |
| ID2555 | R | DLTE PROTEIN. |
| ID2556 | R | INTRACELLULAR PROTEINASE (EC 3.2.). |
| ID2557 | R | *Bacillus subtilis* metalloprotease YhaA. |
| ID2558 | R | HYPOTHETICAL 39.6 KDA PROTEIN IN ALAS-GLNQ INTERGENIC REGION |
| ID2559 | R | BH2605 PROTEIN. |
| ID2560 | R | ORF starting with ATG of length 667 |
| ID2561 | R | YBBA PROTEIN. |
| ID2562 | R | HYPOTHETICAL 13.6 KDA PROTEIN. |
| ID2563 | R | YDDR PROTEIN. |
| ID2564 | R | YTKL. |
| ID2565 | R | ORF starting with ATG of length 648 |
| ID2566 | R | BH2138 PROTEIN. |
| ID2567 | R | CG1349 PROTEIN. |
| ID2566 | R | MLL5156 PROTEIN. |
| ID2569 | R | ORF starting with ATG of length 609 |
| ID2570 | R | ORF starting with ATG of length 735 |
| ID2571 | R | COMPETENCE-DAMAGE INDUCIBLE PROTEIN. |
| ID2572 | R | YFHB PROTEIN. |
| ID2573 | R | YVAK PROTEIN. |
| ID2574 | R | YKVM PROTEIN. |
| ID2575 | R | HYPOTHETICAL 78.8 XDA PROTEIN IN TETB-EXOA INTERGENIC REGION |
| ID2576 | R | HYPOTHETICAL 9.1 KDA PROTEIN IN TETB-EXOA INTERGENIC REGION. |
| ID2577 | R | ORF starting with ATG of length 546 |
| ID2578 | R | YTNM. |
| ID2579 | R | HYPOTHETICAL HELICASE IN PONA-COTD INTERGENIC REGION. |
| ID2580 | R | FORMATE HYDROGENASE. |

-continued

| | | |
|---|---|---|
| ID2581 | R | HYPOTHETICAL 7.1 KDA PROTEIN. |
| ID2582 | R | NAD(P)H OXIDOREDUCTASE. |
| ID2583 | R | ORF starting with ATG of length 2879 |
| ID2584 | R | BH2906 PROTEIN. |
| ID2585 | R | ORF starting with ATG of length 480 |
| ID2586 | R | ORF starting with ATG of length 447 |
| ID2587 | R | BH2982 PROTEIN. |
| ID2588 | R | HYPOTHETICAL 23.6 KDA PROTEIN. |
| ID2589 | R | HYPOTHETICAL PROTEIN VC2101. |
| ID2590 | R | YFMR. |
| ID2591 | R | HYPOTHETICAL 27.6 KDA PROTEIN. |
| ID2592 | R | ORF starting with ATG of length 408 |
| ID2593 | R | ORF starting with ATG of length 409 |
| ID2594 | R | Amino acid sequence of *N. meningitidis* protein ORF77. |
| ID2595 | R | CMP-BINDING PROTEIN. |
| ID2596 | R | BH3997 PROTEIN. |
| ID2597 | R | PUTATIVE MEMBRANE PROTEIN YDGH. |
| ID2598 | R | COENZYME PQQ SYNTHESIS PROTEIN (PQQE). |
| ID2599 | R | BH2605 PROTEIN. |
| ID2600 | R | ORF starting with TTG or GTG of length 726 |
| ID2601 | R | ORF starting with ATG of length 354 |
| ID2602 | R | PUTATIVE BIFUNCTIONAL ENZYME WXCM. |
| ID2603 | R | ORF starting with ATG of length 348 |
| ID2604 | R | GENERAL STRESS PROTEIN 14 (GSP14) (EC 1.6.99.-). |
| ID2605 | R | ORF starting with ATG of length 324 |
| ID2606 | R | ORF starting with ATG of length 321 |
| ID2607 | R | HYPOTHETICAL 33.0 KDA PROTEIN IN XPAC-ABRB INTERGENIC REGION |
| ID2608 | R | PUTATIVE METHIONYL-TRNA SYNTHETASE. |
| ID2609 | R | F44E7.4 PROTEIN. |
| ID2610 | R | PUTATIVE TERMINASE LARGE SUBUNIT. |
| ID2611 | R | ORF starting with ATG of length 270 |
| ID2612 | R | HYPOTHETICAL 30.8 KDA PROTEIN. |
| ID2613 | R | BH0590 PROTEIN. |
| ID2614 | R | YTPR. |
| ID2615 | R | ORF starting with ATG of length 225 |
| ID2616 | R | HYPOTHETICAL 32.8 KDA PROTEIN IN BIO3-HXT17 INTERGENIC REGIO |
| ID2617 | R | ORF starting with ATG of length 210 |
| ID2618 | R | BIOTIN SULFOXIDE REDUCTASE. |
| ID2619 | R | ORF starting with ATG of length 870 |
| ID2620 | R | HYPOTHETICAL 79.2 KDA PROTEIN IN PHOH-DGKA INTERGENIC REGION |
| ID2621 | R | HYPOTHETICAL 74.3 KDA PROTEIN IN RPLI-COTF INTERGENIC REGION |
| ID2622 | S | ATP-DEPENDENT NUCLEASE SUBUNIT B. |
| ID2623 | S | YVNB. |
| ID2624 | S | Enzyme exhibiting activity on arabinan and galactan. Possibl |
| ID2625 | S | *Bacillus licheniformis* Pectin lyase III. |
| ID2626 | S | YFHO PROTEIN. |
| ID2627 | S | YESX PROTEIN. |
| ID2628 | S | YETA PROTEIN. |
| ID2629 | S | HYPOTHETICAL 171.0 KDA PROTEIN IN SPOIIIC-CWLA INTERGENIC RE |
| ID2630 | S | YDAL PROTEIN. |
| ID2631 | S | YDAN PROTEIN. |
| ID2632 | S | ORF starting with ATG of length 4557 |
| ID2633 | S | STAGE V SPORULATION PROTEIN R. |
| ID2634 | S | XFIX. |
| ID2635 | S | BETA-N-ACETYLGLUCOSAMINIDASE PRECURSOR (EC 3.2.1.-). |
| ID2636 | S | BH1550 PROTEIN. |
| ID2637 | S | Patent NN No. 5481Arabinogalactan endo-1,4-beta-galactosidas |
| ID2638 | S | *Bacillus licheniformis* endo-beta-1,4-glucanase. |
| ID2639 | S | HYPOTHETICAL 46.0 KDA PROTEIN (TRANSPOSASE OF TN10). |
| ID2640 | S | Phytase gene from *Bacillus licheniformis*, Homologous to unkn |
| ID2641 | S | STAGE IV SPORULATION PROTEIN A. |
| ID2642 | S | ORF starting with ATG of length 3927 |
| ID2643 | S | SEPTATION RING FORMATION REGULATOR. |
| ID2644 | S | LEVANSUCRASE PRECURSOR (EC 2.4.1.10) (BETA-D-FRUCTOFURANOSYL |
| ID2645 | S | PHAGE-LIKE ELEMENT PBSX PROTEIN XKDE. |
| ID2646 | S | ORF starting with ATG of length 3519 |
| ID2647 | S | YKOR. |
| ID2648 | S | DNA FOR 25-36 DEGREE REGION CONTAINING THE AMYE-SRFA REGION, |
| ID2649 | S | STAGE V SPORULATION PROTEIN AF. |
| ID2650 | S | A Bacillus pectate lyase and JP170 alpha-amylase fusion prot |
| ID2651 | S | HYPOTHETICAL 58.0 KDA PROTEIN IN COTC-LEXA INTERGENIC REGION |
| ID2652 | S | HYPOTHETICAL ATP:GUANIDO PHOSPHOTRANSFERASE YACI (EC 2.7.3.- |
| ID2653 | S | YTPB. |
| ID2654 | S | ORF starting with ATG of length 3222 |
| ID2655 | S | FamiLy 1 Pectate lyase. 29% identical to BioPrep (SP958), 50% |
| ID2656 | S | YBBR PROTEIN. |
| ID2657 | S | HYPOTHETICAL 48.8 KDA PROTEIN. |
| ID2658 | S | HYPOTHETICAL 46.0 KDA PROTEIN IN FEUA-SIGW INTERGENIC REGION |
| ID2659 | S | YESS PROTEIN. |

-continued

| | | |
|---|---|---|
| ID2660 | S | ORF starting with ATG of length 3057 |
| ID2661 | S | YDJI PROTEIN. |
| ID2662 | S | HYPOTHETICAL 35.6 KDA PROTEIN IN RPSU-PHOH INTEREGENIC REGIO |
| ID2663 | S | 2-KETO-3-DEOXYGLUCONATE PERMEASE (KDG PERMEASE). |
| ID2654 | S | HYPOTHETICAL 42.6 KDA PROTEIN. |
| ID2665 | S | C4-DICARBOXYLATE TRANSPORT SYSTEM (PERMEASE LARGE PROTEIN). |
| ID2666 | S | HYPOTHETICAL 36.3 KDA PROTEIN. |
| ID2667 | S | STAGE III SPORULATIDN PROTEIN AE. |
| ID2668 | S | Xyloglucanase |
| ID2669 | S | ORF starting with ATG of length 3519. |
| ID2670 | S | YESR PROTEIN. |
| ID2671 | S | HYPOTHETICAL 48.6 KDA PROTEIN IN SERS-DNAZ INTERGENIC REGION |
| ID2672 | S | HYPOTHETICAL 47.4 KDA PROTEIN. |
| ID2673 | S | PROBABLE HTH_LYSR_FAMILY TRANSCRIPTIONAL REGULATOR. |
| ID2674 | S | YFHP PROTEIN. |
| ID2675 | S | YDJG PROTEIN. |
| ID2676 | S | YNDJ PROTEIN. |
| ID2677 | S | HYPOTHETICAL 45.3 KDA PROTEIN IN PRKA-CSPB INTERGENIC REGION |
| ID2678 | S | YDAJ PROTEIN. |
| ID2679 | S | PHAGE-LIKE ELEMENT PBSX PROTEIN XKDG. |
| ID2680 | S | YLBC PROTEIN. |
| ID2681 | S | SPORE GERMINATION PROTEIN KA. |
| ID2682 | S | YTER. |
| ID2683 | S | BH2622 PROTEIN. |
| ID2684 | S | YKRT PROTEIN. |
| ID2685 | S | DNA, COMPLETE SEQUENCE. |
| ID2686 | S | HYPOTHETICAL 43.8 KDA PROTEIN IN XPAC-ABRB INTERGENIC REGION |
| ID2687 | S | HYPOTHETICAL 37.7 KDA PROTEIN IN RPSF-SPO0J INTERGENIC REGIO |
| ID2688 | S | HYPOTHETICAL 34.7 KDA PROTEIN IN CRH-TRXB INTERGENIC REGION. |
| ID2689 | S | PTS SYSTEM, FRUCTOSE-SPECIFIC IID COMPONENT (EIID-FRU) (FRUC |
| ID2690 | S | PROTEIN ECSB. |
| ID2691 | S | LANTIBIOTIC MERSACIDIN MODIFYING ENZYME. |
| ID2692 | S | HYPOTHETICAL 45.0 KDA PROTEIN IN FDRA-ARCC INTERGENIC REGION |
| ID2693 | S | HYPOTHETICAL 37.0 KDA PROTEIN IN SPOIIIC-CWLA INTERGENIC REG |
| ID2694 | S | YWSC PROTEIN. |
| ID2695 | S | HYPOTHETICAL PROTEIN VC1332. |
| ID2696 | S | YCEH. |
| ID2697 | S | YLQG PROTEIN. |
| ID2698 | S | IOLB PROTEIN. |
| ID2699 | S | HYPOTHETICAL 43.0 KDA PROTEIN (YVFB PROTEIN). |
| ID2700 | S | YNDE PROTEIN (PUTATIVE SPORE GERMINATION PROTEIN). |
| ID2701 | S | HYPOTHETICAL 30.3 KDA PROTEIN IN GLYS-DNAG/DNAE INTERGENIC R |
| ID2702 | S | HYPOTHETICAL 38.5 KDA PROTEIN IN PONA-COTD INTERGENIC REGION |
| ID2703 | S | HYPOTHETICAL 41.5 KDA PROTEIN. |
| ID2704 | S | YJBA PROTEIN. |
| ID2705 | S | PROTEIN DLTD PPECURSOR. |
| ID2706 | S | PTS SYSTEM, FRUCTOSE-SPECIFIC IIC COMPONENT (EIIC-FRU) (FRUC |
| ID2707 | S | HYPOTHETICAL 35.0 KDA PROTEIN IN SPOIIIC-CWLA INTERGENIC REG |
| ID2708 | S | GALACTOSE-1-PHOSPHATE URIDYLTRANSFERASE. |
| ID2709 | S | HYPOTHETICAL 34.4 KDA PROTEIN IN RRND 5' REGION. |
| ID2710 | S | YBCD PROTEIN. |
| ID2711 | S | HYPOTHETICAL 51.4 KDA PROTEIN. |
| ID2712 | S | HYPOTHETICAL 32.5 KDA PROTEIN IN CCCA-SODA INTERGENIC REGION |
| ID2713 | S | YVLB. |
| ID2714 | S | YLAA PROTEIN. |
| ID2715 | S | HYPOTHETICAL 41.9 KDA PROTEIN. |
| ID2716 | S | EXO-POLY-ALPHA-D-GALACTURONOSIDASE, PUTATIVE. |
| ID2717 | S | SPORULATION SIGMA-E FACTOR PROCESSING PEPTIDASE (EC 3.4.23.- |
| ID2718 | S | YUBB PROTEIN. |
| ID2719 | S | SPORE GERMINATION PROTEIN A2. |
| ID2720 | S | PUTATIVE SUGAR ISOMERASE. |
| ID2721 | S | TUAE PROTEIN. |
| ID2722 | S | HYPOTHETICAL 40.6 KDA PROTEIN. |
| ID2723 | S | LEVANSUCRASE AND SUCRASE SYNTHESIS OPERON ANTITERMINATOR. |
| ID2724 | S | DIPICOLINATE SYNTHASE, A CHAIN. |
| ID2725 | S | YKOV PROTEIN. |
| ID2726 | S | HYPOTHETICAL 36.0 KDA PROTEIN IN GCVT-SPOIIIAA INTERGENIC RE |
| ID2727 | S | YOAT. |
| ID2728 | S | HYPOTHETICAL 42.9 KDA PROTEIN. |
| ID2729 | S | BH2618 PROTEIN. |
| ID2730 | S | SACPA OPERON ANTITERMINATOR. |
| ID2731 | S | YFLP PROTEIN. |
| ID2732 | S | SPORE GERMINATION PROTEIN KB. |
| ID2733 | S | YFNK. |
| ID2734 | S | YDCC PROTEIN. |
| ID2735 | S | YJCL PROTEIN. |
| ID2736 | S | YVJA. |
| ID2737 | S | SPORE GERMINATION PROTEIN A1. |
| ID2738 | S | HYPOTHETICAL 32.2 KDA PROTEIN IN BMRU-ANSR INTERGENIC REGION |

-continued

| | | |
|---|---|---|
| ID2739 | S | PUTATIVE SPORE GERMINATION PROTEIN. |
| ID2740 | S | HYPOTHETICAL 29.6 KDA PROTEIN IN RIBT-DACB INTERGENIC REGION |
| ID2741 | S | YFKD PROTEIN. |
| ID2742 | S | HYPOTHETICAL 45.7 KDA PROTEIN IN RPSU-PHOH INTEREGENIC REGIO |
| ID2743 | S | DEGV PROTEIN. |
| ID2744 | S | PHAGE-LIKE ELEMENT PBSX PROTEIN XKDK. |
| ID2745 | S | YVOD. |
| ID2746 | S | YDAH PROTEIN. |
| ID2747 | S | HYPOTHETICAL 48.2 KDA PROTEIN IN SODA-COMGA INTERGENIC REGIO |
| ID2748 | S | YTAP. |
| ID2749 | S | RESPONSE REGULATOR ASPARTATE PHOSPHATASE. |
| ID2750 | S | HYPOTHETICAL 37.3 KDA PROTEIN. |
| ID2751 | S | YJBH PROTEIN. |
| ID2752 | S | LANTIBIOTIC MERSACIDIN MODIFYING ENZYME. |
| ID2753 | S | PTS SYSTEM, GLUCITOL/SORBITOL-SPECIFIC IIBC COMPONENT (EIIBC |
| ID2754 | S | ORF starting with ATG of length 2089 |
| ID2755 | S | YOAJ. |
| ID2756 | S | YITL PROTEIN. |
| ID2757 | S | EXOGLUCANASE B PRECURSOR (EC 3.2.1.91) (EXOCELLOBIOHYDROLASE |
| ID2758 | S | HYPOTHETICAL 28.1 KDA PROTEIN IN SIPU-KIPI INTERGENIC REGION |
| ID2759 | S | YDEG PROTEIN. |
| ID2760 | S | YERB PROTEIN. |
| ID2761 | S | ORF25. |
| ID2762 | S | HYPOTHETICAL 51.5 KDA PROTEIN. |
| ID2763 | S | YCEG. |
| ID2764 | S | HYPOTHETICAL 38.0 KDA PROTEIN IN GIRA-GUAB INTERGENIC REGION |
| ID2765 | S | ORF starting with ATG of length 1974 |
| ID2766 | S | SAPB PROTEIN. |
| ID2767 | S | PUTATIVE SIGMA-B REGULATOR. |
| ID2768 | S | YQFO PROTE1N. |
| ID2769 | S | ORF40. |
| ID2770 | S | YLNE PROTEIN. |
| ID2771 | S | HYPOTHETICAL 31.2 KDA PROTEIN IN XPAC-ABRB INTERGENIC REGION |
| ID2772 | S | ORF22. |
| ID2773 | S | ORF starting with ATG of length 1935 |
| ID2774 | S | Amino acid sequence of a mature TasA antibiotic protein. |
| ID2775 | S | PBSX PHAGE TERMINASE SMALL SUBUNIT. |
| ID2776 | S | BH3947 PROTEIN. |
| ID2777 | S | HYPOTHETICAL 38.6 KDA PROTEIN IN CYSG-TRPS INTERGENIC REGION |
| ID2778 | S | YVBY PROTEIN. |
| ID2779 | S | ORF starting with ATG of length 1896 |
| ID2780 | S | ORF starting with ATG of length 1860 |
| ID2781 | S | YFLM PROTEIN. |
| ID2782 | S | ORF starting with ATG of length 1854 |
| ID2783 | S | YBCD PROTEIN. |
| ID2784 | S | *Bacillus licheniformis* endo-beta-1,4-glucanase. |
| ID2785 | S | YUTH PROTEIN. |
| ID2786 | S | DNA FOR 25-36 DEGREE REGION CONTAINING THE AMYE-SRFA REGION, |
| ID2787 | S | HYPOTHETICAL 33.3 KDA PROTEIN IN DNAI-THRS INTERGENIC REGION |
| ID2788 | S | INTRACELLULAR ALKALINE PROTEASE. |
| ID2789 | S | SPAE. |
| ID2790 | S | YOJO PROTEIN. |
| ID2791 | S | HYPOTHETICAL 22.2 KDA PROTEIN IN RECQ-CMK INTERGENIC REGION. |
| ID2792 | S | YUNF PROTEIN. |
| ID2793 | S | ACETOIN UTILIZATION PROTEIN ACUA (EC 2.3.1.-). |
| ID2794 | S | SPORE GERMINATION PROTEIN A3 PRECURSOR. |
| ID2795 | S | HYPOTHETICAL 47.7 KDA PROTEIN IN METS-KSGA INTERGENIC REGION |
| ID2796 | S | YLBM PROTEIN. |
| ID2797 | S | HYPOTHETICAL 21.3 KDA PROTEIN. |
| ID2798 | S | HYPOTHETICAL 25.4 KDA PROTEIN IN DPPE-HMP INTERGENIC REGION. |
| ID2799 | S | HYPOTHETICAL 28.7 KDA PROTEIN IN GLXK-ALLC INTERGENIC REGION |
| ID2800 | S | BH2265 PROTEIN. |
| ID2801 | S | ORF starting with ATG of length 1782 |
| ID2802 | S | SPOIISA PROTEIN. |
| ID2803 | S | NECROSIS AND ETHYLENE INDUCING PROTEIN. |
| ID2804 | S | YLOP PROTEIN. |
| ID2805 | S | YLOC PROTEIN. |
| ID2806 | S | HYPOTHETICAL 40.7 KDA PROTEIN IN FER-RECQ INTERGENIC REGION. |
| ID2807 | S | HYPOTHETICAL 23.8 KDA PROTEIN. |
| ID2808 | S | HYPOTHETICAL 25.7 KDA PROTEIN IN BCSA-DEGR INTERGENIC REGION |
| ID2809 | S | YDEI (BH2088 PROTEIN). |
| ID2810 | S | ORF38. |
| ID2811 | S | YJBC PROTEIN. |
| ID2812 | S | YITD PROTEIN. |
| ID2813 | S | ORF starting with ATG of length 1725 |
| ID2814 | S | INNER SPORE COAT PROTEIN H. |
| ID2815 | S | PHAGE-LIKE ELEMENT PBSX PROTEIN XKDF. |
| ID2816 | S | ORF13. |
| ID2817 | S | BH1298 PROTEIN. |

-continued

| ID2818 | S | PROTEIN ECSC. |
| ID2819 | S | YBDO PROTEIN. |
| ID2820 | S | PROBABLE PROTEIN ASP-PHOSPHATASE. |
| ID2821 | S | N-ACETYMURAMOYL-L-ALANINE AMIDASE CWLL PRECURSOR (EC 3.5.1. |
| ID2822 | S | YDJN PROTEIN. |
| ID2823 | S | YJBM PROTEIN. |
| ID2824 | S | HYPOTHETICAL 62.6 KDA PROTEIN IN RPMF-FTSL INTERGENIC REGION |
| ID2825 | S | YOJO PROTEIN. |
| ID2826 | S | *Bacillus licheniformis* Pectate lyase I. |
| ID2827 | S | HYPOTHETICAL 27.7 KDA PROTEIN IN GPSA-SPOIVA INTERGENIC REGI |
| ID2828 | S | YKRI PROTEIN. |
| ID2829 | S | STREPTOGRAMIN B LACTONASE. |
| ID2830 | S | YDBA PROTEIN. |
| ID2831 | S | YVQF PROTEIN. |
| ID2832 | S | BH2292 PROTEIN. |
| ID2833 | S | YKRX PROTEIN. |
| ID2834 | S | HYPOTHETICAL 19.5 KDA PROTEIN. |
| ID2835 | S | HYPOTHETICAL 23.3 KDA PROTEIN. |
| ID2836 | S | HYPOTHETICAL 51.0 KDA PROTEIN IN TRXB-HISI INTERGENIC REGION |
| ID2837 | S | TRANSCRIPTION ANTITERMINATOR LICT. |
| ID2838 | S | SIMILAR TO *BACILLUS SUBTILIS* YXID PROTEIN. |
| ID2839 | S | HYPOTHETICAL 27.6 KDA PROTEIN IN FNR-NARG INTERGENIC REGION. |
| ID2840 | S | STAGE III SPORULATION PROTEIN AA. |
| ID2841 | S | YJAZ PROTEIN. |
| ID2842 | S | *Bacillus* sp. transglutaminase. |
| ID2843 | S | BH0974 PROTEIN. |
| ID2844 | S | HYPOTHETICAL 33.3 KDA PROTEIN IN KSGA-VEG INTERGENIC REGION. |
| ID2845 | S | HYPOTHETICAL 23.4 KDA PROTEIN IN NRDF-CWLC INTERGENIC REGION |
| ID2846 | S | YVQJ PROTEIN. |
| ID2847 | S | HYPOTHETICAL 24.8 KDA PROTEIN IN DAPB-PAPS INTERGENIC REGION |
| ID2848 | S | KINB SIGNALING PATHWAY ACTIVATION PROTEIN. |
| ID2849 | S | STAGE III SPORULATION PROTEIN AG. |
| ID2850 | S | YESU PROTEIN. |
| ID2851 | S | HYPOTHETICAL 22.5 KDA PROTEIN IN RPSF-SPO0J INTERGENIC REGIO |
| ID2852 | S | YJAU PROTEIN. |
| ID2853 | S | YUIC PROTEIN. |
| ID2854 | S | YDFS PROTEIN. |
| ID2855 | S | *S. pneumoniae* derived protein #146. |
| ID2856 | S | ORF27. |
| ID2857 | S | YVBJ PROTEIN. |
| ID2858 | S | HYPOTHETICAL 23.3 KDA PROTEIN. |
| ID2859 | S | YCDA. |
| ID2860 | S | YVGT PROTEIN. |
| ID2861 | S | BH3996 PROTEIN. |
| ID2862 | S | YOBG. |
| ID2863 | S | YTRC. |
| ID2864 | S | MINOR SPIKE PROTEIN (H PROTEIN) (PILOT PROTEIN). |
| ID2865 | S | YTEU. |
| ID2866 | S | HYPOTHETICAL 21.3 KDA PROTEIN IN QCRC-DAPB INTERGENIC REGION |
| ID2867 | S | RAP60. |
| ID2868 | S | PHAGE-LIKE ELEMENT PBSX PROTEIN XKDO. |
| ID2869 | S | YLXX PROTEIN. |
| ID2870 | S | ORF starting with ATG of length 1491 |
| ID2871 | S | YKWB PROTEIN. |
| ID2872 | S | PUTATIVE TRANSCRIPTION REGULATOR. |
| ID2873 | S | YRVE PROTEIN. |
| ID2874 | S | SIMILAR TO *STAPHYLOCOCCUS AUREUS* CAPC PROTEIN. |
| ID2875 | S | HYPOTHETICAL 30.1 KDA PROTEIN. |
| ID2876 | S | YUAD PROTEIN. |
| ID2877 | S | HYPOTHETICAL 21.0 KDA PROTEIN IN LYSS-MECB INTERGENIC REGION |
| ID2878 | S | ORF starting with ATG of length 1458 |
| ID2879 | S | YTLR. |
| ID2880 | S | HYPOTHETICAL 26.5 KDA PROTEIN IN RAPH-COTJA INTERGENIC REGIO |
| ID2881 | S | YWMB PROTEIN. |
| ID2882 | S | YRRS PROTEIN. |
| ID2883 | S | ORF starting with ATG of length 1443 |
| ID2884 | S | PROTEIN BMRU. |
| ID2885 | S | ORF starting with ATG of length 1438 |
| ID2886 | S | YDAE PROTEIN. |
| ID2887 | S | SPORE GERMINATION PROTEIN GERD PRECURSOR. |
| ID2888 | S | ORF starting with ATG of length 1434 |
| ID2889 | S | PHAGE-LIKE ELEMENT PBSX PROTEIN XKDM. |
| ID2890 | S | SPORE GERMINATION PROTEIN A2. |
| ID2891 | S | ORF starting with ATG of length 1431 |
| ID2892 | S | HYPOTHETICAL 19.4 KDA PROTEIN IN SPOIIR-GLYC INTERGENIC REGI |
| ID2893 | S | HYPOTHETICAL 21.9 KDA PROTEIN IN XYND-PPSE INTERGENIC REGION |
| ID2894 | S | HYPOTHETICAL 30.8 KDA PROTEIN IN SINI-GCVT INTERGENIC REGION |
| ID2895 | S | YNDL PROTEIN. |
| ID2896 | S | HYPOTHETICAL 19.7 KDA PROTEIN. |

-continued

| ID | | Description |
|---|---|---|
| ID2897 | S | HYPOTHETICAL 34.5 KDA PROTEIN IN RPLI-COTF INTERGENIC REGION |
| ID2898 | S | SPORE PROTEASE (EC 3.4.99.-). |
| ID2899 | S | Family 1 Pectate lyase. 29% identical to BioPrep (SP958). 50% |
| ID2900 | S | STAGE II SPORULATION PROTEIN P. |
| ID2901 | S | YFLK PROTEIN. |
| ID2902 | S | HYPOTHETICAL 16.2 KDA PROTEIN IN BMRU-ANSR INTERGENIC REGION |
| ID2903 | S | GERMINATION PROTEIN GERM. |
| ID2904 | S | ORF starting with ATG of length 1392 |
| ID2905 | S | YJBF PROTEIN. |
| ID2906 | S | HYPOTHETICAL 19.7 KDA PROTEIN IN SPOIIR-GLYC INTERGENIC REGI |
| ID2907 | S | PUTATIVE TRANSCRIPTIONAL REGULATOR (YVHJ). |
| ID2908 | S | YYCI PROTEIN. |
| ID2909 | S | ORF starting with ATG of length 1379 |
| ID2910 | S | YTOQ. |
| ID2911 | S | ORF starting with ATG of length 1374 |
| ID2912 | S | YTRI. |
| ID2913 | S | HYPOTHETICAL 17.1 KDA PROTEIN IN SPOIIIC-CWLA INTERGENIC REG |
| ID2914 | S | YITE PROTEIN. |
| ID2915 | S | AMINOGLYCOSIDE ADENYLTRANSFERASE. |
| ID2916 | S | COMPETENCE TRANSCRIPTION FACTOR (CTF) (COMPETENCE PROTEIN K) |
| ID2917 | S | HYPOTHETICAL 27.3 KDA PROTEIN IN TYRZ-SACY INTERGENIC REGION |
| ID2918 | S | STAGE VI SPORULATION PROTEIN D. |
| ID2919 | S | HYPOTHETICAL 16.6 KDA PROTEIN IN RPMF-FTSL INTERGENIC REGION |
| ID2920 | S | YUID PROTEIN. |
| ID2921 | S | HYPOTHETICAL 24.8 KDA PROTEIN IN CSPB-GLPP INTERGENIC REGION |
| ID2922 | S | YKUB PROTEIN. |
| ID2923 | S | YKOX PROTEIN. |
| ID2924 | S | PEROXIDASE. |
| ID2925 | S | SIMILAR TO *BACILLUS ANTHRACIS* CAPC PROTEIN. |
| ID2926 | S | YKNT PROTEIN (CSE15 PROTEIN) (CSE15). |
| ID2927 | S | ORF starting with ATG of length 1344 |
| ID2928 | S | BH2938 PROTEIN. |
| ID2929 | S | HYPOTHETICAL 17.8 KDA PROTEIN IN BLTR-SPOIIIC INTERGENIC REG |
| ID2930 | S | ORF starting with ATG of length 1332 |
| ID2931 | S | TRANSCRIPTIONAL REGULATOR CTSR. |
| ID2932 | S | HYPOTHETICAL 17.6 KDA PROTEIN IN NUSA 5' REGION (P15A) (ORF1) |
| ID2933 | S | ORF starting with ATG of length 1323 |
| ID2934 | S | YOAS PROTEIN. |
| ID2935 | S | YISF PROTEIN. |
| ID2936 | S | STAGE II SPORULATION PROTEIN B. |
| ID2937 | S | YTWI. |
| ID2938 | S | HYPOTHETICAL 37.0 KDA PROTEIN IN SPOIIIC-CWLA INTERGENIC REG |
| ID2939 | S | YETF PROTEIN. |
| ID2940 | S | SPAG. |
| ID2941 | S | HYPOTHETICAL 64.3 KDA PROTEiN IN HUTP-BGLP INTERGENIC REGION |
| ID2942 | S | YDJH PROTEJN. |
| ID2943 | S | YODP |
| ID2944 | S | YKOP. |
| ID2945 | S | HYPOTHETICAL 26.7 KDA PROTEIN IN CSBX-COXA INTERGENIC REGION |
| ID2946 | S | YOCC. |
| ID2947 | S | PUTATIVE - SOME HOMOLOGY WITH HI1034. |
| ID2948 | S | HYPOTHETICAL TRANSCRIPTIONAL REGULATOR IN GSPA-TYRZ INTERGEN |
| ID2949 | S | HYPOTHETICAL 29.1 KDA PROTEIN. |
| ID2950 | S | HYPOTHETICAL 23.0 KDA PROTEIN IN CMK-GPSA INTERGENIC REGION. |
| ID2951 | S | SPORE PROTEASE (EC 3.4.99.-). |
| ID2952 | S | ORF starting with ATG of length 1237 |
| ID2953 | S | CCDC PROTEIN. |
| ID2954 | S | HYPOTHETICAL 18.4 KDA PROTEIN. |
| ID2955 | S | HYPOTHETICAL 25.1 KDA PROTEIN IN MFD-DIVIC INTERGENIC REGION |
| ID2956 | S | SPORULATION INITIATION PHOSPHOTRANSFERASE B (EC 2.7.-.-) (ST |
| ID2957 | S | *Bacillus subtilis* prenyl diphosphate synthetase subunit. |
| ID2958 | S | DNA FOR 25-36 DEGREE REGION CONTAINING THE AMYE-SRFA REGION |
| ID2959 | S | HYPOTHETICAL 24.7 KDA PROTEIN IN RECQ-CMK INTERGENIC REGION. |
| ID2960 | S | YMCA PROTEIN. |
| ID2961 | S | PROBABLE PROTEIN ASP-PHOSPHATASE. |
| ID2962 | S | ORF starting with ATG of length 1239 |
| ID2963 | S | *B. subtilis* hydrolase protein YQJL. |
| ID2964 | S | ORF starting with ATG of length 1238 |
| ID2965 | S | ORF starting with ATG of length 1233 |
| ID2966 | S | SIMILAR TO PHOSPHATASES. |
| ID2967 | S | BH2308 PROTEIN. |
| ID2968 | S | HYPOTHETICAL 16.0 KDA PROTEIN IN COTF-TETB INTERGENIC REGION |
| ID2969 | S | YKUO PROTEIN. |
| ID2970 | S | YTLQ. |
| ID2971 | S | YFLK PROTEIN. |
| ID2972 | S | HYPOTHETICAL 15.0 KDA PROTEIN. |
| ID2973 | S | ORF12. |
| ID2974 | S | YNDG PROTEIN. |
| ID2975 | S | REQUIRED FOR REPLICATION INITIATION. |

| | | -continued |
|---|---|---|
| ID2976 | S | DNA FOR 25-36 DEGREE REGION CONTAINING THE AMYE-SRFA REGION, |
| ID2977 | S | YRBG PROTEIN. |
| ID2978 | S | YMAC PROTEIN. |
| ID2979 | S | BH1973 PROTEIN. |
| ID2980 | S | YNDH PROTEIN. |
| ID2981 | S | YJBB PROTEIN. |
| ID2982 | S | GENERAL STRESS PROTEIN 26 (GSP26). |
| ID2983 | S | ORF starting with ATG of length 1200 |
| ID2984 | S | ORF starting with ATG of length 1200 |
| ID2985 | S | HYPOTHETICAL 16.3 KDA PROTEIN IN TGL-PGI INTERGENIC REGION. |
| ID2986 | S | HYPOTHETICAL 19.1 KDA PROTEIN IN SPO0F-PYRG INTERGENIC REGIO |
| ID2987 | S | HYPOTHETICAL 21.1 KDA PROTEIN IN ILVA 3' REGION. |
| ID2988 | S | HYPOTHETICAL 23.6 KDA PROTEIN IN QCRC-DAPB INTERGENIC REGION |
| ID2989 | S | STAGE III SPORULATION PROTEIN AD. |
| ID2990 | S | PHAGE-LIKE ELEMENT PBSX PROTEIN XKDA. |
| ID2991 | S | YJBK PROTEIN. |
| ID2992 | S | CODY PROTEIN (VEGETATIVE PROTEIN 286B) (VEG286B). |
| ID2993 | S | STAGE II SPORULATION PROTEIN M. |
| ID2994 | S | BH0621 PROTEIN. |
| ID2995 | S | HYPOTHETICAL 17.9 KDA PPOTEIN IN SPOIIIC-CWLA INTERGENIC REG |
| ID2996 | S | YMAC PROTEIN. |
| ID2997 | S | HYPOTHETICAL 17.0 KDA PROTEIN IN CCDC-CITB INTERGENIC REGION |
| ID2998 | S | HYPOTHETICAL 17.5 KDA PROTEIN IN SIGV-GREA INTERGENIC REGION |
| ID2999 | S | ORF starting with ATG of length 1155 |
| ID3000 | S | ORF starting with ATG of length 1155 |
| ID3001 | S | YOQW PROTEIN. |
| ID3002 | S | DNA, COMPLETE SEQUENCE. |
| ID3003 | S | YLAJ PROTEIN. |
| ID3004 | S | YBFI PROTEIN. |
| ID3005 | S | HYPOTHETICAL 18.1 KDA PROTEIN IN TTK-CCDA INTERGENIC REGION. |
| ID3006 | S | ORF starting with ATG of length 1137 |
| ID3007 | S | YESV PROTEIN. |
| ID3008 | S | YKUD PROTEIN. |
| ID3009 | S | STAGE III SPORULATIGN PROTEIN AH. |
| ID3010 | S | YKVT PROTEIN. |
| ID3011 | S | YTFJ. |
| ID3012 | S | ORF starting with ATG of length 1119 |
| ID3013 | S | BH3151 PROTEIN. |
| ID3014 | S | HYPOTHETICAL 20.3 KDA PROTEIN IN UNG-ROCA INTERGENIC REGION. |
| ID3015 | S | ORF starting with ATG of length 1116 |
| ID3016 | S | HYPOTHETICAL 17.9 KDA PROTEIN IN DING-ASPB INTERGENIC REGION |
| ID3017 | S | YVRI PROTEIN. |
| ID3018 | S | STAGE V SPORULATION PROTEIN AA. |
| ID3019 | S | TRANSMEMBRANE PROTEIN. |
| ID3020 | S | YBBK. |
| ID3021 | S | FTSL PROTEIN. |
| ID3022 | S | YLOU PROTEIN. |
| ID3023 | S | DNA REPLICATION PROTEIN DNAD. |
| ID3024 | S | YKVI PROTEIN. |
| ID3025 | S | 4-DEOXY-L-THREO-5-HEXOSULOSE-URONATE KETOL-ISOMERASE (EC 5.3 |
| ID3026 | S | HYPOTHETICAL 32.9 KDA PROTEIN IN CMK-GPSA INTERGENIC REGION. |
| ID3027 | S | HYPOTHETICAL 59.7 KDA PROTEIN IN CWLA-CISA INTERGENIC REGION |
| ID3028 | S | YUAE PROTEIN. |
| ID3029 | S | BH0186 PROTEIN. |
| ID3030 | S | YEEE. |
| ID3031 | S | ORF starting with ATG of length 1077 |
| ID3032 | S | TRANSCRIPTION ANTITERMINATOR (BIGG FAMILY). |
| ID3033 | S | HYPOTHETICAL 13.3 KDA PROTEIN IN AROD-COMER INTERGENIC REGIO |
| ID3034 | S | BH1562 PROTEIN. |
| ID3035 | S | HYPOTHETICAL 23.9 KDA PROTEIN IN GLNQ-ANSR INTERGENIC REGION |
| ID3036 | S | PHAGE-LIKE ELEMENT PBSX PROTEIN XKDI. |
| ID3037 | S | POSITIVE CONTROL FACTOR. |
| ID3038 | S | HYPOTHETICAL 16.4 KDA PROTEIN. |
| ID3039 | S | BH3995 PROTEIN. |
| ID3040 | S | YLBF PROTEIN. |
| ID3041 | S | ORF starting with ATG of length 1065 |
| ID3042 | S | ORF starting with ATG of length 1059 |
| ID3043 | S | YDAT PROTEIN. |
| ID3044 | S | STAGE V SPORULATION PROTEIN AB. |
| ID3045 | S | MLR3962 PROTEIN. |
| ID3046 | S | YOAQ. |
| ID3047 | S | HYPOTHETICAL 14.1 KDA PROTEIN IN XPAC-ABRB INTERGENIC REGION |
| ID3048 | S | SPORULATION-SPECIFIC EXTRACELLULAR NUCLEASE PRECURSOR (EC 3. |
| ID3049 | S | YHZB PROTEIN. |
| ID3050 | S | HYPOTHETICAL 28.8 KDA PROTEIN IN DNAJ-RPSU INTEREGENIC REGIO |
| ID3051 | S | HYPOTHETICAL 23.3 KDA PROTEIN IN DNAI-THRS INTERGENIC REGION |
| ID3052 | S | RIBT PROTEIN. |
| ID3053 | S | STAGE III SPORULATION PROTEIN AB. |
| ID3054 | S | YTFI. |

| | | -continued |
|---|---|---|
| ID3055 | S | ORF starting with ATG of length 1032 |
| ID3056 | S | METHYLASE HOMOLOG (CSPR). |
| ID3057 | S | HYPOTHETICAL 23.3 KDA PROTEIN IN DFRA-ILVA INTERGENIC REGION |
| ID3058 | S | SPORE COAT PROTEIN F. |
| ID3059 | S | YAZC PROTEIN. |
| ID3060 | S | GENERAL STRESS PROTEIN 17M (GSP17M). |
| ID3061 | S | YKUW PROTEIN. |
| ID3062 | S | YLBD PROTEIN. |
| ID3063 | S | ORF starting with ATG of length 1005 |
| ID3064 | S | ORF starting with ATG of length 1002 |
| ID3065 | S | HYPOTHETICAL 40.7 KDA PROTEIN. |
| ID3066 | S | CHORISMATE WJTASE (EC 5.4.99.5) (CM). |
| ID3067 | S | YUTE PROTEIN. |
| ID3068 | S | ORF16. |
| ID3069 | S | HYPOTHETICAL 25.1 KDA PROTEIN IN PRKA 5' REGION (ORF2). |
| ID3070 | S | HYPOTHETICAL 21.4 KDA PROTEIN IN QCRA-AROE INTERGENIC REGION |
| ID3071 | S | BH0817 PROTEIN. |
| ID3072 | S | CHITIN-BINDING PROTEIN. |
| ID3073 | S | HYPOTHETICAL 16.2 KDA PROTEIN IN COMF-FLGM INTERGENIC REGION |
| ID3074 | S | ORF starting with ATG of length 984 |
| ID3075 | S | HYPOTHETICAL 64.3 KDA PROTEIN IN HUTP-BGLP INTERGENIC REGION |
| ID3076 | S | HYPOTHETICAL 13.2 KDA PROTEIN IN GUTB-COTA INTERGENIC REGIO |
| ID3077 | S | BH1290 PROTEIN. |
| ID3078 | S | ORF starting with ATG of length 978 |
| ID3079 | S | HYPOTHETICAL 18.1 KDA PROTEIN IN NARK-NARG INTERGENIC REGION |
| ID3080 | S | PHAGE-LIKE ELEMENT PBSX PROTEIN XKDJ. |
| ID3081 | S | HYPOTHETICAL 14.0 KDA PROTEIN IN SIGV-GREA INTERGENIC REGION |
| ID3082 | S | YTTB. |
| ID3083 | S | YVQK PROTEIN. |
| ID3084 | S | YJCS PROTEIN. |
| ID3085 | S | HYPOTHETICAL 41.5 KDA PROTEIN IN AMHX-AMYE INTERGENIC REGION |
| ID3086 | S | PUTATIVE PHOSPHO-BETA-GLUCOSIDASE. |
| ID3087 | S | BH0923 PROTEIN. |
| ID3088 | S | YVBK PROTEIN. |
| ID3089 | S | YOAR. |
| ID3090 | S | BOFC PROTEIN PRECURSOR (BYPASS-OF-FORESPORE PROTEIN C). |
| ID3091 | S | HYPOTHETICAL 27.7 KDA PROTEIN IN HMP-PROB INTERGENIC REGION |
| ID3092 | S | HYPOTHETICAL 44.1 KDA PROTEIN. |
| ID3093 | S | BETA-MANNOSIDASE. |
| ID3094 | S | YOEB PROTEIN. |
| ID3095 | S | YDHG PROTEIN. |
| ID3096 | S | HYPOTHETICAL 20.4 KDA PROTEIN IN RIBT-DACB INTERGENIC REGION |
| ID3097 | S | HYPOTHETICAL 48.2 KDA PROTEIN IN COTF-TETB INTERGENIC REGION |
| ID3098 | S | HYPOTHETICAL 30.5 KDA PROTEIN IN GABP-GUAA INTERGENIC REGION |
| ID3099 | S | A AND A* PROTEINS (GPA). |
| ID3100 | S | SIMILAR TO *STAPHYLOCOCCUS AUREUS* CAPA PROTEIN. |
| ID3101 | S | HYPOTHETICAL 15.7 KDA PROTEIN. |
| ID3102 | S | YOJF PROTEIN. |
| ID3103 | S | YVZD PROTEIN. |
| ID3104 | S | Amino acid seguence of a spore-associated protein called Yqx |
| ID3105 | S | YNDF PROTEIN. |
| ID3106 | S | ORF starting with ATG of length 945 |
| ID3107 | S | HYPOTHETICAL 39.0 KDA PROTEIN IN GLNQ-ANSR INTERGENIC REGION |
| ID3108 | S | FENH. |
| ID3109 | S | SPORE COAT PROTEIN E. |
| ID3110 | S | YITI PROTEIN. |
| ID3111 | S | ORF starting with ATG of length 936 |
| ID3112 | S | ORF starting witb ATG of length 936 |
| ID3113 | S | YLMD PROTEIN. |
| ID3114 | S | YFJM PROTEIN. |
| ID3115 | S | BACITRACIN RESISTANCE PROTEIN (UNDECAPRENOL KINASE). |
| ID3116 | S | YMCC PROTEIN. |
| ID3117 | S | BH2340 PROTEIN. |
| ID3118 | S | RIBONUCLEASE PRECURSOR (EC 3.1.27.-) (BARNASE) (RNASE BA). |
| ID3119 | S | HYPOTHETICAL 31.3 KDA PROTEIN IN LYSA-PPIB INTERGENIC REGION |
| ID3120 | S | HYPOTHETICAL 19.3 KDA PROTEIN IN PONA-NTH INTERGENIC REGION |
| ID3121 | S | YVLD. |
| ID3122 | S | HYPOTHETICAL 15.6 KDA PROTEIN. |
| ID3123 | S | BH3953 PROTEIN. |
| ID3124 | S | HYPOTHETICAL 22.5 KDA PROTEIN IN GLYS-DNAG/DNAE INTERGENIC R |
| ID3125 | S | PUTATIVE SECRETED PECTINESTERASE. |
| ID3126 | S | KINASE-ASSOCIATED PROTEIN B. |
| ID3127 | S | YHBB PROTEIN. |
| ID3128 | S | ORF starting with ATG of length 906 |
| ID3129 | S | ORF starting with ATG of length 903 |
| ID3130 | S | ORF starting with ATG of length 903 |
| ID3131 | S | HYPOTHETICAL 24.1 KDA PROTEIN IN CSPB-GLPP INTERGENIC REGION |
| ID3132 | S | ORF22. |
| ID3133 | S | HYPOTHETICAL 12.0 KDA PROTEIN IN XPAC-ABRB INTERGENIC REGION |

-continued

| | | |
|---|---|---|
| ID3134 | S | FENI. |
| ID3135 | S | DNA REPLICATION PROTEIN DNAD. |
| ID3136 | S | ORF starting with ATG of length 899 |
| ID3137 | S | YHZA HOMOLOG. |
| ID3138 | S | ORF starting with ATG of length 897 |
| ID3139 | S | HYPOTHETICAL 25.9 KDA PROTEIN IN CCCA-SODA INTERGENIC REGION |
| ID3140 | S | HYPOTHETICAL 15.6 KDA PROTEIN IN PURA-DNAC INTERGENIC REGION |
| ID3141 | S | HYPOTHETICAL 15.7 KDA PROTEIN IN PBPD-COMA INTERGENIC REGION |
| ID3142 | S | YMDB PROTEIN. |
| ID3143 | S | HYPOTHETICAL 13.2 KDA PROTEIN IN FTSY-FFH INTERGENIC REGION. |
| ID3144 | S | GLUCOSE STARVATION-INDUCIBLE PROTEIN B (GENERAL STRESS PROTE |
| ID3145 | S | YUTD PROTEIN. |
| ID3146 | S | FLAA LOCUS 22.9 KDA PROTEIN (ORF 6). |
| ID3147 | S | HYPOTHETICAL 10.1 KDA PROTEIN IN ORF3 5' REGION. |
| ID3148 | S | BH3627 PROTEIN. |
| ID3149 | S | HYPOTHETICAL 18.2 KDA PROTEIN IN FLGM-FLGK INTERGENIC REGION |
| ID3150 | S | YUIB PROTEIN. |
| ID3151 | S | YCEG. |
| ID3152 | S | YDFB PROTEIN. |
| ID3153 | S | YUSN PROTEIN. |
| ID3154 | S | YDBL PROTEIN. |
| ID3155 | S | YNGA PROTEIN. |
| ID3156 | S | ORF starting with ATG of length 864 |
| ID3157 | S | YQZD PROTEIN. |
| ID3158 | S | YERQ PROTEIN. |
| ID3159 | S | SMALL BASIC PROTEIN. |
| ID3160 | S | BH2308 PROTEIN. |
| ID3161 | S | ORF starting with ATG of length 861 |
| ID3162 | S | HYPOTHETICAL 9.5 KDA PROTEIN IN ORF3 5' REGION. |
| ID3163 | S | ORF starting with ATG of length 852 |
| ID3164 | S | YDBS PROTEIN. |
| ID3165 | S | ALKALINE PHOSPHATASE. |
| ID3166 | S | HYPOTHETICAL 24.8 FDA PROTEIN IN DEGS-TAGO INTERGENIC REGION |
| ID3167 | S | *Bacillus subtilis* IFO 3336 PGA synthesising enzyme. |
| ID3168 | S | HYPOTHETICAL 14.1 KDA PROTEIN IN PCP 5' REGION (ORF15). |
| ID3169 | S | ORF starting with ATG of length 849 |
| ID3170 | S | HYPOTHETICAL 13.1 KDA PROTEIN. |
| ID3171 | S | ORF starting with ATG of length 843 |
| ID3172 | S | ORF starting with ATG of length 843 |
| ID3173 | S | HYPOTHETICAL PROTEIN TC0114. |
| ID3174 | S | HYPOTHETICAL PROTEIN VC1285. |
| ID3175 | S | HYPOTHETICAL 16.5 KDA PROTEIN IN SPOIIR-GLYC INTERGENIC REGI |
| ID3176 | S | YNER. |
| ID3177 | S | HYPOTHETICAL 10.8 KDA PROTEIN IN RPSU-PHOH INTEREGENIC REGIO |
| ID3178 | S | MBL, FLH [O, P], RAPD, YWP [B, C, D, E, F, G, H, I, J] AND YWQA GENES. |
| ID3179 | S | COMPLETE NUCLEOTIDE SEQUENCE. |
| ID3180 | S | HYPOTHETICAL 21.7 KDA PROTEIN IN LON-HEMA INTERGENIC REGION |
| ID3181 | S | YRRD PROTEIN. |
| ID3182 | S | YUTC PROTEIN. |
| ID3183 | S | COMPLETE NUCLEOTIDE SEQUENCE. |
| ID3184 | S | YKRK PROTEIN. |
| ID3185 | S | YJCA PROTEIN. |
| ID3186 | S | HYPOTHETICAL 20.2 KDA PROTEIN IN GCVT-SPOIIIAA INTERGENIC RE |
| ID3187 | S | ORF starting with ATG of length 822 |
| ID3188 | S | HYPOTHETICAL 27.7 KDA PROTEIN IN SPOIIIC-CWLA INTERGENIC REG |
| ID3189 | S | ORF starting with ATG of length 822 |
| ID3190 | S | BH3473 PROTEIN. |
| ID3191 | S | GP8 PROTEIN. |
| ID3192 | S | YUZD PROTEIN. |
| ID3193 | S | YRZB PROTEIN. |
| ID3194 | S | GP8 PROTEIN. |
| ID3195 | S | TUAF PROTEIN. |
| ID3196 | S | ORF starting with ATG of length 812 |
| ID3197 | S | FIBRONECTIN-BINDING PROTEIN, 25KDA. |
| ID3198 | S | YVGZ PROTEIN. |
| ID3199 | S | PROBABLE HTH_LYSR_FAMILY TRANSCRIPTIONAL REGULATOR. |
| ID3200 | S | YLBA PROTEIN. |
| ID3201 | S | HYPOTHETICAL 15.6 KDA PROTEIN (ORF2). |
| ID3202 | S | ORF starting with ATG of length 800 |
| ID3203 | S | YUEI PROTEIN. |
| ID3204 | S | YODL. |
| ID3205 | S | YKUK PROTEIN. |
| ID3206 | S | YLAH PROTEIN. |
| ID3207 | S | ORF starting with ATG of length 792 |
| ID3208 | S | YDGC PROTEIN. |
| ID3209 | S | HYPOTHETICAL 22.3 KDA PROTEIN IN WPRA-ASNQ INTERGENIC REGION |
| ID3210 | S | YNDE PROTEIN. |
| ID3211 | S | ORF starting with ATG of length 783 |
| ID3212 | S | HYPOTHETICAL 21.0 KDA LIPOPROTEIN IN CSPB-GLPP INTERGENIC RE |

| | | -continued |
|---|---|---|
| ID3213 | S | ORF starting with ATG of length 780 |
| ID3214 | S | HYPOTHETICAL 19.3 KDA PROTEIN IN BCSA-DEGR INTERGENIC REGION |
| ID3215 | S | HYPOTHETICAL 19.2 KDA PROTEIN. |
| ID3216 | S | HYPOTHETICAL 64.3 KDA PROTEIN IN HUTP-BGLP INTERGENIC REGION |
| ID3217 | S | SIMILAR TO *BACILLUS SUBTILIS* YXID PROTEIN. |
| ID3218 | S | MBL, FLH [O, P], RAPD, YWP [B, C, D, E, F, G, H, I, J] AND YWQA GENES. |
| ID3219 | S | YJQB PROTEIN. |
| ID3220 | S | YDZA PROTEIN. |
| ID3221 | S | HYPOTHETICAL 13.3 KDA PROTEIN. |
| ID3222 | S | YKUC PROTEIN. |
| ID3223 | S | MAJOR CAPSID PROTEIN. |
| ID3224 | S | YUBF PROTEIN. |
| ID3225 | S | PUTATIVE PBSX REPRESSOR. |
| ID3226 | S | YTES. |
| ID3227 | S | ORF starting with ATG of length 765 |
| ID3228 | S | ORF starting with ATG of length 762 |
| ID3229 | S | HYPOTHETICAL PROTEIN VC0429. |
| ID3230 | S | CHLORAMPHENICOL ACETYLTRANSFERASE (EC 2.3.1.28) (CAT). |
| ID3231 | S | HYPOTHETICAL 27.6 KDA PROTEIN IN NUCB-AROD INTERGENIC REGION |
| ID3232 | S | ORF starting with ATG of length 753 |
| ID3233 | S | YWZC PROTEIN. |
| ID3234 | S | BH0424 PROTEIN. |
| ID3235 | S | YKOE. |
| ID3236 | S | HYPOTHETICAL 19.8 KDA PROTEIN. |
| ID3237 | S | YJCC PROTEIN. |
| ID3238 | S | YFHH PROTEIN. |
| ID3239 | S | YUSQ PROTEIN. |
| ID3240 | S | HYPOTHETICAL 9.4 KDA PROTEIN IN SODA-COMGA INTERGENIC REGION |
| ID3241 | S | HYPOTHETICAL 9.9 KDA PROTEIN IN GCVT-SPOIIIAA INTERGENIC REG |
| ID3242 | S | YKZC PROTEIN. |
| ID3243 | S | HYPOTHETICAL 27.7 KDA PROTEIN IN SPGIIIC-CWLA INTERGENIC REG |
| ID3244 | S | BH3995 PROTEIN. |
| ID3245 | S | BH1312 PROTEIN. |
| ID3246 | S | ORF starting with ATG of length 735 |
| ID3247 | S | PHAGE-LIKE ELEMENT PBSX PROTEIN XKDH. |
| ID3248 | S | HYPOTHETICAL 31.8 KDA PROTEIN IN SODA-COMGA INTERGENIC REGIO |
| ID3249 | S | YFIT PROTEIN. |
| ID3250 | S | YKUJ PROTEIN. |
| ID3251 | S | PHAGE-LIKE ELEMENT PBSX PROTEIN XKDE. |
| ID3252 | S | ORF starting with ATG of length 731 |
| ID3253 | S | HYPOTHETICAL 10.0 KDA PROTEIN IN QOXD-VPR INTERGENIC REGION |
| ID3254 | S | ORF starting with ATG of length 729 |
| ID3255 | S | YDFG PROTEIN. |
| ID3256 | S | YDZE PROTEIN. |
| ID3257 | S | YMFJ PROTEIN. |
| ID3258 | S | HYPOTHETICAL 33.3 KDA PROTEIN IN KSGA-VEG INTERGENIC REGION. |
| ID3259 | S | ORF starting with ATG of length 720 |
| ID3260 | S | STAGE II SPORULATION PROTEIN R. |
| ID3261 | S | SIMILAR TO *B. ANTHRACIS* STERNER ELEMENT ORFA. |
| ID3262 | S | Pectate Lyase Family 3. Putative ORF with homology to this gr |
| ID3263 | S | SIMILAR TO *B. ANTHRACIS* STERNER ELEMENT ORFA. |
| ID3264 | S | SIMILAR TO *B. ANTHRACIS* STERNER ELEMENT ORFA. |
| ID3265 | S | DNA-ENTRY NUCLEASE INHIBITOR (COMPETENCE PROTEIN J). |
| ID3266 | S | BH1921 PROTEIN. |
| ID3267 | S | HYPOTHETICAL 14.8 KDA PROTEIN. |
| ID3268 | S | ORF starting with ATG of length 717 |
| ID3269 | S | YKUC PROTEIN. |
| ID3270 | S | HYPOTHETICAL 11.0 KDA PROTEIN IN CWLL 5' REGION. |
| ID3271 | S | HYPOTHETICAL 12.8 KDA PROTEIN IN PAIA-THRB INTERGENIC REGION |
| ID3272 | S | MEMBRANE PROTEIN CSK22. |
| ID3273 | S | ORF starting with ATG of length 714 |
| ID3274 | S | ORF starting with ATG of length 714 |
| ID3275 | S | HYPOTHETICAL 19.7 KDA PROTEIN IN PHEA-NIFS INTERGENIC REGION |
| ID3276 | S | YJCL PROTEIN. |
| ID3277 | S | YLMC PROTEIN. |
| ID3278 | S | ORF (FRAGMENT). |
| ID3279 | S | YNCE. |
| ID3280 | S | HYPOTHETICAL 9.7 KDA PROTEIN IN CWLL 5' REGION. |
| ID3281 | S | HYPOTHETICAL 13.0 KDA PROTEIN IN IDH-DEOR INTERGENIC REGION |
| ID3282 | S | YNDM PROTEIN. |
| ID3283 | S | SIMILAR TO *B. ANTHRACIS* STERNER ELEMENT ORFA. |
| ID3284 | S | ORF starting with ATG of length 708 |
| ID3285 | S | ORF starting with ATG of length 705 |
| ID3286 | S | HYPOTHETICAL 17.2 KDA PROTEIN. |
| ID3287 | S | HYPOTHETICAL 21.4 KDA PROTEIN IN IDH-DEOR INTERGENIC REGION. |
| ID3288 | S | BH0586 PROTEIN. |
| ID3289 | S | COMPLETE NUCLEOTIDE SEQUENCE. |
| ID3290 | S | ORF starting with ATG of length 699 |
| ID3291 | S | ORF starting with ATG of length 699 |

-continued

| | | |
|---|---|---|
| ID3292 | S | ORF starting with ATG of length 699 |
| ID3293 | S | ORF starting with ATG of length 696 |
| ID3294 | S | SPORE COAT PROTEIN X. |
| ID3295 | S | ORF starting with ATG of length 690 |
| ID3296 | S | PTS SYSTEM, GLUCITOL/SORBITOL-SPECIFIC IIC COMPONENT, ONE OF |
| ID3297 | S | HYPOTHETICAL 47.7 KDA PROTEIN IN METS-KSGA INTERGENIC REGION |
| ID3298 | S | ORF starting with ATG of length 687 |
| ID3299 | S | HYPOTHETICAL 14.6 KDA PROTEIN IN GCVT-SPOIIIAA INTERGENIC RE |
| ID3300 | S | HYPOTHETICAL 12.4 KDA PROTEIN IN MURC-AROA INTERGENIC REGION |
| ID3301 | S | HYPOTHETICAL 49.4 KDA PROTEIN. |
| ID3302 | S | TET.BSR. |
| ID3303 | S | HYPOTHETICAL 17.6 KDA PROTEIN IN CWLD 5' REGION (ORF1). |
| ID3304 | S | YLBE PROTEIN. |
| ID3305 | S | ORF starting with ATG of length 681 |
| ID3306 | S | YTZH PROTEIN. |
| ID3307 | S | SPORE COAT PROTEIN D. |
| ID3308 | S | ORF42. |
| ID3309 | S | YDGD PROTEIN. |
| ID3310 | S | ORF starting with ATG of length 678 |
| ID3311 | S | ORF starting with ATG of length 675 |
| ID3312 | S | NITRIC OXIDE SYNTHASE. |
| ID3313 | S | STAGE III SPORULATION PROTEIN AC. |
| ID3314 | S | YETA PROTEIN. |
| ID3315 | S | HYPOTHETICAL 21.3 KDA PROTEIN. |
| ID3316 | S | ORF starting with ATG of length 666 |
| ID3317 | S | BH1437 PROTEIN. |
| ID3318 | S | YTKC. |
| ID3319 | S | HYPOTHETICAL 11.7 KDA PROTEIN IN EPR-GALK INTERGENIC REGION. |
| ID3320 | S | YNDB PROTEIN. |
| ID3321 | S | YISC PROTEIN. |
| ID3322 | S | HYPOTHETICAL 12.7 KDA PROTEIN. |
| ID3323 | S | ORF starting with ATG of length 660 |
| ID3324 | S | YJBL PROTEIN. |
| ID3325 | S | HYPOTHETICAL 16.9 KDA PROTEIN. |
| ID3326 | S | ORF starting with ATG of length 651 |
| ID3327 | S | YISD PROTEIN. |
| ID3328 | S | ORF starting with ATG of length 652 |
| ID3329 | S | HYPOTHETICAL 8.6 KDA PROTEIN. |
| ID3330 | S | ORF starting with ATG of length 648 |
| ID3331 | S | YESL PROTEIN. |
| ID3332 | S | VEG PROTEIN. |
| ID3333 | S | ORF29. |
| ID3334 | S | ORF starting with ATG of length 645 |
| ID3335 | S | YUAJ PROTEIN. |
| ID3336 | S | ORF starting with ATG of length 642 |
| ID3337 | S | YUNC PROTEIN. |
| ID3338 | S | DNA-ENTRY NUCLEASE (EC 3.-.-.-) (COMPETENCE-SPECIFIC NUCLEAS |
| ID3339 | S | ORF starting with ATG of length 639 |
| ID3340 | S | YUZA PROTEIN. |
| ID3341 | S | SPORE COAT PROTEIN V. |
| ID3342 | S | YFHJ PROTEIN. |
| ID3343 | S | HYPOTHETICAL 8.5 KDA PROTEIN. |
| ID3344 | S | HYPOTHETICAL 9.8 KDA PROTEIN. |
| ID3345 | S | BH2016 PROTEIN. |
| ID3346 | S | YUSW PROTEIN. |
| ID3347 | S | YQZG PROTEIN. |
| ID3348 | S | HYPOTHETICAL 11.6 KDA PROTEIN IN UNG-ROCA INTERGENIC REGION. |
| ID3349 | S | YOJC. |
| ID3350 | S | ORF starting with ATG of length 630 |
| ID3351 | S | CSBA PROTEIN. |
| ID3352 | S | ORF starting with ATG of length 627 |
| ID3353 | S | YLMG PROTEIN. |
| ID3354 | S | COMPLETE NUCLEOTIDE SEQUENCE. |
| ID3355 | S | ORF starting with ATG of length 624 |
| ID3356 | S | ORF starting with ATG of length 624 |
| ID3357 | S | SPORE COAT PROTEIN D. |
| ID3358 | S | ORF starting with ATG of length 621 |
| ID3359 | S | ORF starting with ATG of length 618 |
| ID3360 | S | YNZC PROTEIN. |
| ID3361 | S | ORF starting with ATG of length 618 |
| ID3362 | S | YKUO PROTEIN. |
| ID3363 | S | ORF starting with ATG of length 617 |
| ID3364 | S | ORF starting with ATG of length 615 |
| ID3365 | S | YCZC PROTEIN. |
| ID3366 | S | SPORE COAT PROTEIN. |
| ID3367 | S | YRZD PROTEIN. |
| ID3368 | S | ORF starting with ATG of length 612 |
| ID3369 | S | HYPOTHETICAL 15.0 FDA PROTEIN IN ASNH-GNTR INTERGENIC REGION |
| ID3370 | S | HYPOTHETICAL 9.9 KDA PROTEIN IN BCSA-DEGR INTERGENIC REGION. |

| ID | | Description |
|---|---|---|
| ID3371 | S | YRVD PROTEIN. |
| ID3372 | S | YUEC PROTEIN. |
| ID3373 | S | ORF starting with ATG of length 606 |
| ID3374 | S | ORF starting with ATG of length 606 |
| ID3375 | S | HYPOTHETICAL 19.1 KDA PROTEIN IN SIGD-RPSB INTERGENIC REGION |
| ID3376 | S | ORF starting with ATG of length 606 |
| ID3377 | S | HYPOTHETICAL 9.3 KDA PROTEIN IN PCKA-DPS INTERGENIC REGION. |
| ID3378 | S | ORF starting with ATG of length 603 |
| ID3379 | S | YUEE PROTEIN. |
| ID3380 | S | ORF starting with ATG of length 603 |
| ID3381 | S | YOLA. |
| ID3382 | S | YISH PROTEIN. |
| ID3383 | S | HYPOTHETICAL 30.6 KDA PROTEIN IN QCRC-DAPB INTERGENIC REGION |
| ID3384 | S | ORF starting with ATG of length 597 |
| ID3385 | S | ORF starting with ATG of length 597 |
| ID3386 | S | BH3337 PROTEIN. |
| ID3387 | S | ORF starting with ATG of length 597 |
| ID3388 | S | BH0885 PROTEIN. |
| ID3389 | S | HYPOTHETICAL 17.8 KDA PROTEIN. |
| ID3390 | S | YKWD PROTEIN. |
| ID3391 | S | ORF starting with ATG of length 591 |
| ID3392 | S | HYPOTHETICAL 25.1 KDA PROTEIN IN RECQ-CMK INTERGENIC REGION. |
| ID3393 | S | HYPOTHETICAL 42.3 KDA PROTEIN (YVFT PROTEIN). |
| ID3394 | S | *Streptomyces galilaeus* putative cyclase encoded by sga10 gen |
| ID3395 | S | ORF starting with ATG of length 589 |
| ID3396 | S | LYSIS PROTEIN (E PROTEIN) (GPE). |
| ID3397 | S | HYPOTHETICAL 15.3 KDA PROTEIN IN CSPB-GLPP INTERGENIC REGION |
| ID3398 | S | ORF starting with ATG of length 588 |
| ID3399 | S | YBYB PROTEIN. |
| ID3400 | S | YVLA. |
| ID3401 | S | YUNG PROTEIN. |
| ID3402 | S | ORF starting with ATG of length 585 |
| ID3403 | S | BH0588 PROTEIN. |
| ID3404 | S | YJZC PROTEIN. |
| ID3405 | S | ORF starting with ATG of length 585 |
| ID3406 | S | ORF starting with ATG of length 582 |
| ID3407 | S | BH0589 PROTEIN. |
| ID3408 | S | STAGE V SPORULATION PROTEIN AC. |
| ID3409 | S | COMPLETE NUCLEOTIDE SEQUENCE. |
| ID3410 | S | ORF starting with ATG of length 582 |
| ID3411 | S | ORF starting with ATG of length 579 |
| ID3412 | S | YBFF PROTEIN. |
| ID3413 | S | ORF starting with ATG of length 579 |
| ID3414 | S | SMALL, ACID-SOLUBLE SPORE PROTEIN 1 (SASP). |
| ID3415 | S | HYPOTHETICAL 14.7 KDA PROTEIN IN SPOIIIC-CWLA INTERGENIC REG |
| ID3416 | S | ORF starting with ATG of length 576 |
| ID3417 | S | SIGMA-G-DEPENDENT SPORULATION SPECIFIC SASP PROTEIN. |
| ID3418 | S | HYPOTHETICAL OXIDOREDUCTASE IN RTP-PELB INTERGENIC REGION (E |
| ID3419 | S | ORF starting with ATG of length 573 |
| ID3420 | S | BH3170 PROTEIN. |
| ID3421 | S | ORF starting with ATG of length 570 |
| ID3422 | S | ORF starting with ATG of length 570 |
| ID3423 | S | PRODUCT REQUIRED FOR HEAD MORPHOGENESIS. |
| ID3424 | S | ORF starting with ATG of length 567 |
| ID3425 | S | HYPOTHETICAL 7.5 KDA PROTEIN IN CSGA 3' REGION (ORF3). |
| ID3426 | S | YFJT PROTEIN. |
| ID3427 | S | YUEH PROTEIN. |
| ID3428 | S | HYPOTHETICAL 14.5 KDA PROTEIN IN PONA-COTD INTERGENIC REGION |
| ID3429 | S | SPORULATION CORTEX PROTEIN COXA. |
| ID3430 | S | HYPOTHETICAL 28.3 KDA PROTEIN. |
| ID3431 | S | HYPOTHETICAL PROTEIN. |
| ID3432 | S | HYPOTHETICAL 9.8 KDA PROTEIN IN SPOVFA 5' REGION (ORFZ). |
| ID3433 | S | BH3870 PROTEIN. |
| ID3434 | S | YERC PROTEIN. |
| ID3435 | S | ORF starting with ATG of length 558 |
| ID3436 | S | HYPOTHETICAL 12.0 KDA PROTEIN IN UNG-ROCA INTERGENIC REGION. |
| ID3437 | S | HYPOTHETICAL TRANSCRIPTIONAL REGULATOR YOAU. |
| ID3438 | S | YNDF PROTEIN. |
| ID3439 | S | HYPOTHETICAL 21.1 KDA PROTEIN IN COTD-KDUD INTERGENIC REGION |
| ID3440 | S | MLL7394 PROTEIN. |
| ID3441 | S | ORF starting with ATG of length 555 |
| ID3442 | S | CTAG PROTEIN. |
| ID3443 | S | XPAC PROTEIN. |
| ID3444 | S | YFMB PROTEIN. |
| ID3445 | S | YTZC PROTEIN. |
| ID3446 | S | HYPOTHETICAL 16.7 KDA PROTEIN IN XPAC-ABRB INTERGENIC REGION |
| ID3447 | S | YDJO PROTEIN. |
| ID3448 | S | HYPOTHETICAL 64.3 KDA PROTEIN IN HUTP-BGLP INTERGENIC REGION |
| ID3449 | S | HYPOTHETICAL 9.2 KDA PROTEIN IN RECR-BOFA INTERGENIC REGION. |

-continued

| | | |
|---|---|---|
| ID3450 | S | ORF starting with TTG or GTG of length 1098 |
| ID3451 | S | ORF starting with ATG of length 549 |
| ID3452 | S | RAPA. |
| ID3453 | S | HYPOTHETICAL 7.3 KDA PROTEIN IN PONA-COTD INTERGENIC REGION. |
| ID3454 | S | ORF starting with ATG of length 543 |
| ID3455 | S | YUSG PROTEIN. |
| ID3456 | S | ORF starting with ATG of length 540 |
| ID3457 | S | BH4052 PROTEIN. |
| ID3458 | S | ORF starting with ATG of length 537 |
| ID3459 | S | SMALL, ACID-SOLUBLE SPORE PROTEIN A (SASP). |
| ID3460 | S | HYPOTHETICAL 10.8 KDA PROTEIN IN CCCA-SODA INTERGENIC REGION |
| ID3461 | S | ORF starting with ATG of length 531 |
| ID3462 | S | ORF starting with ATG of length 531 |
| ID3463 | S | HYPOTHETICAL 11.4 KDA PROTEIN IN MFD-DIVIC INTERGENIC REGION |
| ID3464 | S | STAGE V SPORULATION PROTEIN AC. |
| ID3465 | S | YOJB PROTEIN. |
| ID3466 | S | HYPOTHETICAL 8.2 KDA PROTEIN IN NPRE-PYCA INTERCENIC REGION. |
| ID3467 | S | FLAGELLAR PROTEIN REQUIRED FOR FLAGELLAR FORMATION. |
| ID3468 | S | YOED PROTEIN. |
| ID3469 | S | ORF starting with ATG of length 525 |
| ID3470 | S | SINI PROTEIN. |
| ID3471 | S | YLBG PROTEIN. |
| ID3472 | S | YEBG PROTEIN. |
| ID3473 | S | ORF starting with ATG of length 522 |
| ID3474 | S | SORBITOL OPERON ACTIVATOR. |
| ID3475 | S | SMALL ACID SOLUBLE SPORE PROTEIN SSPD. |
| ID3476 | S | ORF starting with ATG of length 519 |
| ID3477 | S | BH0695 PROTEIN. |
| ID3478 | S | CSE60. |
| ID3479 | S | ORF starting with ATG of length 521 |
| ID3480 | S | HYPOTHETICAL 23.2 KDA PROTEIN. |
| ID3481 | S | YRZE PROTEIN. |
| ID3482 | S | STAGE 0 SPORULATION PROTEIN A (SPO0A) (FRAGMENT). |
| ID3483 | S | HYPOTHETICAL 27.3 KDA PROTEIN IN RECQ-CMK INTERGENIC REGION. |
| ID3484 | S | YFMQ. |
| ID3485 | S | SSPF PROTEIN. |
| ID3486 | S | ORF starting with ATG of length 516 |
| ID3487 | S | HYPOTHETICAL 15.7 KDA PROTEIN IN RPSU-PHOH INTEREGENIC REGIO |
| ID3488 | S | COMPLETE NUCLEOTIDE SEQUENCE. |
| ID3489 | S | COMG OPERON PROTEIN 4 PRECURSOR. |
| ID3490 | S | E22 PROTEIN (GENE 43 PROTEIN). |
| ID3491 | S | HYPOTHETICAL 10.2 KDA PROTEIN IN ILVA 3' REGION. |
| ID3492 | S | ORF starting with ATG of length 511 |
| ID3493 | S | HYPOTHETICAL 11.1 KDA PROTEIN YITR. |
| ID3494 | S | ORF starting with ATG of length 513 |
| ID3495 | S | YOZB PROTEIN. |
| ID3496 | S | HYPOTHETICAL 8.3 KDA PROTEIN IN TTK-CCDA INTERGENIC REGION. |
| ID3497 | S | YRZG PROTEIN. |
| ID3498 | S | HYPOTHETICAL 20.3 KDA PROTEIN. |
| ID3499 | S | YVBJ PROTEIN. |
| ID3500 | S | BH2945 PROTEIN. |
| ID3501 | S | HYPOTHETICAL 10.3 KDA PROTEIN. |
| ID3502 | S | COMG OPERON PROTEIN 6. |
| ID3503 | S | ORF starting with ATG of length 504 |
| ID3504 | S | XPAC PROTEIN. |
| ID3505 | S | YRZA PROTEIN. |
| ID3506 | S | ORF starting with ATG of length 504 |
| ID3507 | S | HYPOTHETICAL 10.5 KDA PROTEIN IN ACDA 5' REGION. |
| ID3508 | S | ORF 36 (FRAGMENT). |
| ID3509 | S | HYPOTHETICAL 19.9 KDA PROTEIN (FRAGMENT). |
| ID3510 | S | ORF starting with ATG of length 501 |
| ID3511 | S | YKZF PROTEIN. |
| ID3512 | S | ORF N001. |
| ID3513 | S | ORF starting with ATG of length 498 |
| ID3514 | S | ORF starting with ATG of length 495 |
| ID3515 | S | HYPOTHETICAL 17.8 KDA PROTEIN. |
| ID3516 | S | HYPOTHETICAL 9.8 KDA PROTEIN IN HUTP-BGLP INTERGENIC REGION. |
| ID3517 | S | YISG PROTEIN. |
| ID3518 | S | ORF starting with ATG of length 495 |
| ID3519 | S | ORF starting with ATG of length 492 |
| ID3520 | S | YKZI PROTEIN. |
| ID3521 | S | HYPOTHETICAL 21.4 KDA PROTEIN. |
| ID3522 | S | SIMILAR TO *STAPHYLOCOCCUS AUREUS* CAPA PROTEIN. |
| ID3523 | S | BH2911 PROTEIN. |
| ID3524 | S | ORF starting with ATG of length 488 |
| ID3S25 | S | ORF starting with ATG of length 489 |
| ID3526 | S | CSFB PROTEIN. |
| ID3527 | S | BH2618 PROTEIN. |
| ID3528 | S | STAGE V SPORULATION PROTEIN AE. |

-continued

| | | |
|---|---|---|
| ID3529 | S | YOZD PROTEIN. |
| ID3530 | S | DNA, COMPLETE SEQUENCE. |
| ID3531 | S | YWIB PROTEIN. |
| ID3532 | S | YOQW PROTEIN. |
| ID3533 | S | YFNK. |
| ID3534 | S | YLAD PROTEIN. |
| ID3535 | S | HYPOTHETICAL 6.6 KDA PROTEIN IN DING-ASPB INTERGENIC REGION. |
| ID3536 | S | ORF starting with ATG of length 480 |
| ID3537 | S | HYPOTHETICAL 62.6 KDA PROTEIN IN RPMF-FTSL INTERGENIC REGION |
| ID3538 | S | ORF14. |
| ID3539 | S | BH2266 PROTEIN. |
| ID3540 | S | ORF14. |
| ID3541 | S | ORF starting with ATG of length 478 |
| ID3542 | S | SPORE COAT PROTEIN D. |
| ID3543 | S | ORF starting with ATG of length 477 |
| ID3544 | S | SIMILAR TO *BACILLUS SUBTILIS* YXIC PROTEIN. |
| ID3545 | S | ORF starting with ATG of length 474 |
| ID3546 | S | PLASMID PBS2 ORIGIN OF REPLICATION. |
| ID3547 | S | HYPOTHETICAL 20.1 KDA PROTEIN. |
| ID3548 | S | ORF starting with ATG of length 468 |
| ID3549 | S | ORF starting with ATG of length 468 |
| ID3550 | S | ORF starting with ATG of length 468 |
| ID3551 | S | GERMINATION PROTEIN. |
| ID3552 | S | OUTER MEMBRANE PORIN PROTEIN PRECURSOR. |
| ID3553 | S | PAL-RELATED LIPOPROTEIN PRECURSOR. |
| ID3554 | S | ORF starting with ATG of length 465 |
| ID3555 | S | ORF starting with ATG of length 462 |
| ID3556 | S | ORF starting with ATG of length 462 |
| ID3557 | S | ORF starting with ATG of length 462 |
| ID3558 | S | YFKK PROTEIN. |
| ID3559 | S | HYPOTHETICAL 38.5 KDA PROTEIN IN TNRA-SSPD INTERGENIC REGION |
| ID3560 | S | SPORE COAT PROTEIN L. |
| ID3561 | S | ORF starting with ATG of length 459 |
| ID3562 | S | DEGRADATION ENZYME REGULATION PROTEIN DEGQ (SACQ REGULATORY |
| ID3563 | S | BH1955 PROTEIN. |
| ID3564 | S | PHAGE-LIKE ELEMENT PBSX PROTEIN XKDD. |
| ID3565 | S | BH0893 PROTEIN. |
| ID3566 | S | ORF starting with ATG of length 456 |
| ID3567 | S | ORF starting with ATG of length 456 |
| ID3568 | S | ORF starting with ATG of length 456 |
| ID3569 | S | ORF starting with ATG of length 456 |
| ID3570 | S | ORF starting with ATG of length 456 |
| ID3571 | S | YUZC PROTEIN. |
| ID3572 | S | SPORE GERMINATION PROTEIN A1. |
| ID3573 | S | ORF starting with ATG of length 453 |
| ID3574 | S | ORF starting with ATG of length 452 |
| ID3575 | S | PHAGE-LIFE ELEMENT PBSX PROTEIN XTRA. |
| ID3576 | S | YOLD PROTEIN. |
| ID3577 | S | ORF starting with ATG of length 453 |
| ID3578 | S | ORF starting with ATG of length 453 |
| ID3579 | S | ORF starting with ATG of length 450 |
| ID3580 | S | ORF starting with ATG of length 981 |
| ID3581 | S | ORF starting with ATG of length 447 |
| ID3582 | S | HYPOTHETICAL 28.0 KDA PROTEIN. |
| ID3583 | S | ORF starting with ATG of length 447 |
| ID3584 | S | HYPOTHETICAL 28.2 KDA PROTEIN IN CCCA-SODA INTERGENIC REGION |
| ID3585 | S | ORF starting with ATG of length 447 |
| ID3586 | S | ORF starting with ATG of length 444 |
| ID3587 | S | YKZG PROTEIN. |
| ID3588 | S | ORF starting with ATG of length 444 |
| ID3589 | S | ORF starting with ATG of length 444 |
| ID3590 | S | HYPOTHETICAL 8.8 KDA PROTEIN IN SPOVC-MFD INTERGENIC REGION. |
| ID3591 | S | ORF starting with ATG of length 441 |
| ID3592 | S | ORF starting with ATG of length 441 |
| ID3593 | S | PROBABLE HTH_LYSR_FAMILY TRANSCRIPTIONAL REGULATOR. |
| ID3594 | S | ORF starting with ATG of length 438 |
| ID3595 | S | ORF starting with ATG of length 438 |
| ID3596 | S | PROBABLE PROTEIN ASP-PHOSPHATASE. |
| ID3597 | S | ORF starting with ATG of length 438 |
| ID3598 | S | ORF starting with ATG of length 438 |
| ID3599 | S | ORF starting with ATG of length 438 |
| ID3600 | S | ORF starting with ATG of length 435 |
| ID3601 | S | ORF starting with ATG of length 435 |
| ID3602 | S | HYPOTHETICAL 30.6 FDA PROTEIN IN QCRC-DAPB INTERGENIC REGION |
| ID3603 | S | *Thermotoga maritima* endoglucanase. |
| ID3604 | S | ORF starting with ATG of length 432 |
| ID3605 | S | ORF starting with ATG of length 432 |
| ID3606 | S | HYPOTHETICAL 9.8 KDA PROTEIN IN HUTP-BGLP INTERGENIC REGION. |
| ID3607 | S | SPORE COAT PROTEIN K. |

-continued

| | | |
|---|---|---|
| ID3608 | S | BH3113 PROTEIN. |
| ID3609 | S | *Sorangium cellulosum* protein Orf 4. |
| ID3610 | S | YUEG PROTEIN. |
| ID3611 | S | HYPOTHETICAL 9.1 KDA PROTEIN IN GLNQ-ANSR INTERGENIC REGION. |
| ID3612 | S | ORF starting with ATG of length 432 |
| ID3613 | S | ORF starting with ATG of length 432 |
| ID3614 | S | SIMILAR TO *BACILLUS SUBTILIS* YXIC PROTEIN. |
| ID3615 | S | CAPSID PROTEIN (F PROTEIN) (GPF). |
| ID3616 | S | ORF starting with ATG of length 426 |
| ID3617 | S | ORF starting with ATG of length 423 |
| ID3618 | S | ORF starting with ATG of length 423 |
| ID3619 | S | ORF starting with ATG of length 423 |
| ID3620 | S | ORF starting with ATG of length 423 |
| ID3621 | S | ORF starting with ATG of length 423 |
| ID3622 | S | HYPOTHETICAL 58.5 KDA PROTEIN IN SPOIIIC-CWLA INTERGENIC REG |
| ID3623 | S | ORF starting with TTG or GTG of length 843 |
| ID3624 | S | ORF starting with ATG of length 420 |
| ID3625 | S | ORF starting with ATG of length 421 |
| ID3626 | S | ORF starting with ATG of length 420 |
| ID3627 | S | YDAS PROTEIN. |
| ID3628 | S | HYPOTHETICAL 15.7 KDA PROTEIN IN MURC-AROA INTERGENIC REGION |
| ID3629 | S | HYPOTHETICAL 25.3 KDA PROTEIN PH0221. |
| ID3630 | S | ORF16. |
| ID3631 | S | ORF starting with ATG of length 417 |
| ID3632 | S | *Chlamydia pneumoniae* lipoprotein sequence. |
| ID3633 | S | ORF starting with ATG of length 417 |
| ID3634 | S | COMG OPERON PROTEIN 7. |
| ID3635 | S | ORF starting with ATG of length 414 |
| ID3636 | S | BH1265 PROTEIN. |
| ID3637 | S | ORF starting with ATG of length 414 |
| ID3638 | S | BH2053 PROTEIN. |
| ID3639 | S | ORF starting with ATG of length 411 |
| ID3640 | S | ORF starting with ATG of length 411 |
| ID3641 | S | HYPOTHETICAL 21.0 KDA PROTEIN IN RIBT-DACB INTERGENIC REGION |
| ID3642 | S | YUEE PROTEIN. |
| ID3643 | S | HYPOTHETICAL 30.8 KDA PROTEIN IN SINI-GCVT INTERGENIC REGION |
| ID3644 | S | DNA FOR 25-36 DEGREE REGION CONTAINING THE AMYE-SRFA REGION, |
| ID3645 | S | ORF starting with ATG of length 409 |
| ID3646 | S | ORF starting with ATG of length 409 |
| ID3647 | S | HYPOTHETICAL 7.6 KDA PROTEIN IN SPOIIIC-CWLA INTERGENIC REGI |
| ID3648 | S | ORF starting with ATG of length 405 |
| ID3649 | S | ORF starting with ATG of length 405 |
| ID3650 | S | ORF starting with ATG of length 405 |
| ID3651 | S | ORF starting with ATG of length 405 |
| ID3652 | S | *Porphoromonas gingivalis* protein PG22. |
| ID3653 | S | SMALL CORE PROTEIN (J PROTEIN). |
| ID3654 | S | ORF starting with ATG of length 402 |
| ID3655 | S | ORF starting with ATG of length 402 |
| ID3656 | S | ORF starting with ATG of length 399 |
| ID3657 | S | ORF starting with ATG of length 399 |
| ID3658 | S | ORF starting with ATG of length 399 |
| ID3659 | S | ORF starting with ATG of length 399 |
| ID3660 | S | YFHD PROTEIN. |
| ID3661 | S | ORF starting with ATG of length 395 |
| ID3662 | S | HYPOTHETICAL 7.3 KDA PROTEIN IN PONA-COTD INTERGENIC REGION. |
| ID3663 | S | HYPOTHETICAL 9.5 KDA PROTEIN IN ORF3 5' REGION. |
| ID3664 | S | MRSM PROTEIN. |
| ID3665 | S | HYPOTHETICAL 16.7 KDA PROTEIN. |
| ID3666 | S | ORF starting with ATG of length 393 |
| ID3667 | S | ORF starting with ATG of length 393 |
| ID3668 | S | ORF starting with ATG of length 393 |
| ID3669 | S | ORF starting with ATG of length 393 |
| ID3670 | S | HYPOTHETICAL 31.3 KDA PROTEIN. |
| ID3671 | S | HYPOTHETICAL PROTEIN HI1600. |
| ID3672 | S | ORF starting with ATG of length 393 |
| ID3673 | S | ORF starting with ATG of length 390 |
| ID3674 | S | ORF starting with ATG of length 389 |
| ID3675 | S | ORF starting with ATG of length 387 |
| ID3676 | S | ORF starting with ATG of length 389 |
| ID3677 | S | ORF starting with ATG of length 387 |
| ID3678 | S | BH2118 PROTEIN. |
| ID3679 | S | HYPOTHETICAL 9.2 KDA PROTEIN. |
| ID3680 | S | PXO1-135. |
| ID3681 | S | ORF starting with ATG of length 384 |
| ID3682 | S | HYPOTHETICAL 20.5 KDA PROTEIN IN HMP-PROB INTERGENIC REGION. |
| ID3683 | S | ORF starting with ATG of length 384 |
| ID3684 | S | PHI PVL ORF 63 HOMOLOGUE. |
| ID3685 | S | SIMILAR TO *B. ANTHRACIS* WEYAR ELEMENT ORFB. |
| ID3686 | S | ORF starting with ATG of length 381 |

-continued

| | | |
|---|---|---|
| ID3687 | S | ORF starting with ATG of length 381 |
| ID3668 | S | ORP starting with ATG of length 381 |
| ID3689 | S | ORF starting with ATG of length 381 |
| ID3690 | S | ORF starting with ATG of length 381 |
| ID3691 | S | ORF starting with ATG of length 381 |
| ID3692 | S | ORF starting with ATG of length 381 |
| ID3693 | S | ORF starting with ATG of length 381 |
| ID3694 | S | ORF starting with ATG of length 381 |
| ID3695 | S | ORF starting with ATG of length 380 |
| ID3696 | S | YVLB. |
| ID3697 | S | YODN. |
| ID3698 | S | YTEJ. |
| ID3699 | S | ORF starting with ATG of length 378 |
| ID3700 | S | ORF starting with ATG of length 378 |
| ID3701 | S | ORF starting with ATG of length 375 |
| ID3702 | S | ORF starting with ATG of length 375 |
| ID3703 | S | HYPOTHETICAL 7.5 KDA PROTEIN IN DNAC-RPLI INTERGENIC REGION. |
| ID3704 | S | ORF starting with ATG of length 377 |
| ID3705 | S | ORF starting with ATG of length 375 |
| ID3706 | S | ORF starting with ATG of length 375 |
| ID3707 | S | YQZE PROTEIN. |
| ID3708 | S | YFHS PROTEIN. |
| ID3709 | S | ORF starting with ATG of length 372 |
| ID3710 | S | HYPOTHETICAL 12.8 KDA PROTEIN IN COMJ 5' REGION PRECURSOR (OR |
| ID3711 | S | ORF starting with ATG of length 371 |
| ID3712 | S | ORF starting with ATG of length 372 |
| ID3713 | S | HYPOTHETICAL 24.6 KDA PROTEIN IN DAE-TYRZ INTERGENIC REGION. |
| ID3714 | S | HYPOTHETICAL 9.8 KDA PROTEIN. |
| ID3715 | S | ORF starting with ATG of length 369 |
| ID3716 | S | ORF starting with ATG of length 369 |
| ID3717 | S | YJCF PROTEIN. |
| ID3718 | S | BH0973 PROTEIN. |
| ID3719 | S | HYPOTHETICAL 14.9 KDA PROTEIN. |
| ID3720 | S | ORF starting with ATG of length 368 |
| ID3721 | S | ORF starting with ATG of length 369 |
| ID3722 | S | ORF starting with ATG of length 366 |
| ID3723 | S | ORF starting with ATG of length 366 |
| ID3724 | S | ORF starting with ATG of length 366 |
| ID3725 | S | ORF starting with ATG of length 366 |
| ID3726 | S | ORF starting with ATG of length 363 |
| ID3727 | S | ORF starting with ATG of length 363 |
| ID3728 | S | ORF starting with ATG of length 363 |
| ID3729 | S | ORF starting with ATG of length 363 |
| ID3730 | S | ORF starting with ATG of length 365 |
| ID3731 | S | ORF starting with ATG of length 364 |
| ID3732 | S | (CLONE LAMBDA-BS1) CELL DIVISION AND SPORULATION PROTEIN (DD |
| ID3733 | S | ORF starting with ATG of length 363 |
| ID3734 | S | ORF starting with ATG of length 363 |
| ID3735 | S | ORF starting with ATG of length 363 |
| ID3736 | S | ORF starting with ATG of length 363 |
| ID3737 | S | HYPOTHETICAL 7.1 KDA PROTEIN TN RECQ-CMK INTERGENIC REGION. |
| ID3738 | S | NADP-SPECIFIC GLUTAMATE DEHYDROGENASE (EC 1.4.1.4) (GLUTAMAT |
| ID3739 | S | POSITIVE TRANSCRIPTIONAL ACTIVATOR. |
| ID3740 | S | YOLD PROTEIN. |
| ID3741 | S | ORF starting with ATG of length 360 |
| ID3742 | S | ORF starting with ATG of length 360 |
| ID3743 | S | DIVISION INITIATION PROTEIN (DIVIB) (FRAGMENT). |
| ID3744 | S | POTENTIAL ABC TRANSPORTER. |
| ID3745 | S | ORF starting with TTG or GTG of length 711 |
| ID3746 | S | ORF starting with ATG of length 357 |
| ID3747 | S | ORF starting with ATG of length 357 |
| ID3748 | S | ORF starting with ATG of length 357 |
| ID3749 | S | GENOMIC DNA, CHROMOSOME 3, BAC CLONE:F1D9. |
| ID3750 | S | ORF starting with ATG of length 357 |
| ID3751 | S | ORF starting with ATG of length 357 |
| ID3752 | S | ORF starting with TTG or GTG of length 708 |
| ID3753 | S | ORF starting with ATG of length 354 |
| ID3754 | S | VCO28. |
| ID3755 | S | ORF starting with ATG of length 354 |
| ID3756 | S | ORF starting with ATG of length 351 |
| ID3757 | S | ORF starting with ATG of length 353 |
| ID3758 | S | ORF starting with ATG of length 351 |
| ID3759 | S | ORF starting with ATG of length 351 |
| ID3760 | S | ORF starting with ATG of length 351 |
| ID3761 | S | *Bacillus licheniformis* (BLC) RP-II protease. |
| ID3762 | S | HYPOTHETICAL 29.5 KDA PROTEIN IN ROCC-PTA INTERGENIC REGION. |
| ID3763 | S | ORF starting with ATG of length 348 |
| ID3764 | S | YOMP PROTEIN. |
| ID3765 | S | PROBABLE HTH_ARAC_FAMILY OF TRANSCRIPTIONAL REGULATOR. |

-continued

| | | |
|---|---|---|
| ID3766 | S | SPORE COAT PROTEIN. |
| ID3767 | S | ORP starting with ATG of length 345 |
| ID3768 | S | ORF starting with ATG of length 345 |
| ID3769 | S | HYPOTHETICAL 6.9 KDA PROTEIN TN SODA-COMGA INTERGENIC REGION |
| ID3770 | S | ORF starting with ATG of length 345 |
| ID3771 | S | PUTATTVE PERMEASE. |
| ID3772 | S | YKZB PROTEIN. |
| ID3773 | S | ORF starting with ATG of length 345 |
| ID3774 | S | YKZE PROTEIN. |
| ID3775 | S | ORF starting with ATG of length 342 |
| ID3776 | S | ORF starting with ATG of length 342 |
| ID3777 | S | ORF starting with ATG of length 342 |
| ID3778 | S | ORF starting with ATG of length 339 |
| ID3779 | S | ORF starting with ATG of length 339 |
| ID3780 | S | ORF starting with ATG of length 339 |
| ID3781 | S | ORF starting with ATG of length 339 |
| ID3782 | S | BH0644 PROTEIN. |
| ID3783 | S | ORF starting with ATG of length 339 |
| ID3784 | S | ORF starting with ATG of length 339 |
| ID3785 | S | YDCC PROTEIN. |
| ID3786 | S | ORF starting with ATG of length 339 |
| ID3787 | S | ORF starting with ATG of length 339 |
| ID3788 | S | ORF starting with ATG of length 339 |
| ID3789 | S | ORF starting with ATG of length 339 |
| ID3790 | S | ORF starting with ATG cf length 339 |
| ID3791 | S | ORF starting with ATG of length 34i |
| ID3792 | S | YFLB PROTEIN. |
| ID3793 | S | ORF starting with ATG of length 335 |
| ID3794 | S | BH0315 PROTEIN. |
| ID3795 | S | ORF starting with ATG of length 336 |
| ID3796 | S | YOAF PROTEIN. |
| ID3797 | S | SIMILAR TO B. ANTHRACIS WEYAR ELEMENT ORFB. |
| ID3798 | S | HYPOTHETICAL TRANSCRIPTIONAL REGULATOR YYBE. |
| ID3799 | S | ORF starting with ATG of length 333 |
| ID3800 | S | ORF starting with ATG of length 333 |
| ID3801 | S | HYPOTHETICAL 7.5 KDA PROTEIN IN GPSA-SPOIVA INTERGENIC REGIO |
| ID3802 | S | ORF starting with ATG of length 333 |
| ID3803 | S | HYPOTHETICAL 21.0 KDA PROTEIN IN RIBT-DACB INTERGENIC REGION |
| ID3804 | S | ORF starting with ATG of length 333 |
| ID3805 | S | ORF starting with ATG of length 333 |
| ID3806 | S | ORF starting with ATG of length 333 |
| ID3807 | S | ORF starting with ATG of length 333 |
| ID3808 | S | HYPOTHETICAL 18.8 KDA PROTEIN PH0220. |
| ID3809 | S | ORF starting with ATG of length 330 |
| ID3810 | S | ORF starting with TTG or GTG of length 660 |
| ID3811 | S | REPRESSOR. |
| ID3812 | S | ORF starting with ATG of length 327 |
| ID3813 | S | ORF starting with ATG of length 327 |
| ID3814 | S | ORF starting with TTG or GTG of length 651 |
| ID3815 | S | HYPOTHETICAL 4.5 KDA PROTEIN. |
| ID3816 | S | ORF starting with ATG of length 324 |
| ID3817 | S | YNZD PROTEIN. |
| ID3818 | S | EATRO 164 KINETOPLAST (CR4). |
| ID3819 | S | HYPOTHETICAL 18.8 KDA PROTEIN PH0220. |
| ID3820 | S | GAMMA-GLUTAMYL PHOSPHATE REDUCTASE (GPR) (EC 1.2.1.41) (GLUT |
| ID3821 | S | ORF starting with ATG of length 324 |
| ID3822 | S | ORF starting with ATG of length 324 |
| ID3823 | S | ORF starting with ATG of length 1059 |
| ID3824 | S | PHAGE-LIKE ELEMENT PBSX PROTEIN XKDW. |
| ID3825 | S | 403AA LONG HYPOTHETICAL COENZYME PQQ SYNTHESIS PROTEIN. |
| ID3826 | S | ORF starting with ATG of length 321 |
| ID3827 | S | ORF starting with ATG of length 319 |
| ID3828 | S | ORF starting with ATG of length 321 |
| ID3829 | S | ORF starting with ATG of length 321 |
| ID3830 | S | YKZH PROTEIN. |
| ID3831 | S | ORF starting with ATG of length 318 |
| ID3832 | S | ORF starting with ATG of length 318 |
| ID3833 | S | BH1226 PROTEIN. |
| ID3834 | S | ORF starting with ATG of length 318 |
| ID3835 | S | FLAGELLAR PROTEIN FLIT. |
| ID3836 | S | YFLJ PROTEIN. |
| ID3837 | S | ORF starting with ATG of length 318 |
| ID3838 | S | ORF starting with TTG or GTG of length 633 |
| ID3839 | S | ORF starting with ATG of length 315 |
| ID3840 | S | ORF starting with ATG of length 315 |
| ID3841 | S | ORF starting with ATG of length 315 |
| ID3842 | S | HYPOTHETICAL 6.3 KDA PROTEIN IN SODA-COMGA INTERGENIC REGION |
| ID3843 | S | ORF21. |
| ID3844 | S | LACA. |

-continued

| ID | | Description |
|---|---|---|
| ID3845 | S | ORF starting with ATG of length 315 |
| ID3846 | S | ORF starting with ATG of length 315 |
| ID3847 | S | CYTOCHROME AA3 CONTROLLING PROTEIN. |
| ID3848 | S | YVKN. |
| ID3849 | S | ORF starting with ATG of length 312 |
| ID3850 | S | ORF starting with ATG of length 313 |
| ID3851 | S | ORF starting with ATG of length 312 |
| ID3852 | S | HYPOTHETICAL 19.5 KDA PROTEIN IN DEGA-NPRB INTERGENIC REGION |
| ID3853 | S | ORF starting with ATG of length 311 |
| ID3854 | S | ORF starting with ATG of length 312 |
| ID3855 | S | QUINOLONE RESISTANCE PROTEIN. |
| ID3856 | S | YEEF PROTEIN. |
| ID3857 | S | HYPOTHETICAL 18.8 KDA PROTEIN PH0220. |
| ID3858 | S | ORF starting with ATG of length 313 |
| ID3859 | S | ORF starting with ATG of length 312 |
| ID3860 | S | ORF starting with ATG of length 312 |
| ID3861 | S | ORF starting with TTG or GTG of length 621 |
| ID3862 | S | ORF starting with ATG of length 309 |
| ID3863 | S | YUIA PROTEIN. |
| ID3664 | S | YRZK PROTEIN. |
| ID3865 | S | IOLB PROTEIN. |
| ID3866 | S | BH1709 PROTEIN. |
| ID3867 | S | BH0952 PROTEIN. |
| ID3868 | S | PHOSPRATIDYLSERINE SYNTHASE. |
| ID3869 | S | HYPOTHETICAL 17.9 KDA PROTEIN IN RECQ-CMK INTERGENIC REGION. |
| ID3870 | S | ORF starting with ATG of length 306 |
| ID3871 | S | REPRESSOR |
| ID3872 | S | ORF starting with ATG of length 353 |
| ID3873 | S | ORF starting with ATG of length 306 |
| ID3874 | S | ORF starting with ATG of length 306 |
| ID3875 | S | ORF starting with ATG of length 303 |
| ID3876 | S | ORF starting with ATG of length 303 |
| ID3877 | S | ORF starting with ATG of length 303 |
| ID3878 | S | ORF starting with ATG of length 303 |
| ID3879 | S | CYTOCHROME C-550. |
| ID3880 | S | YOSA PROTEIN. |
| ID3881 | S | Thymidylate kinase-2. |
| ID3882 | S | HYPOTHETICAL 13.7 KDA PROTEIN. |
| ID3883 | S | ORF starting with ATG of length 300 |
| ID3884 | S | ORF starting with ATG of length 301 |
| ID3885 | S | ORF starting with ATG of length 300 |
| ID3886 | S | ORF starting with ATG of length 300 |
| ID3887 | S | YUNB PROTEIN. |
| ID3888 | S | BH3172 PROTEIN. |
| ID3889 | S | ORF starting with ATG of length 300 |
| ID3890 | S | ORF starting with ATG of length 300 |
| ID3891 | S | HYPOTHETICAL 10.9 KDA PROTEIN. |
| ID3892 | S | ORF starting with ATG of length 333 |
| ID3893 | S | ORF starting with ATG of length 298 |
| ID3894 | S | YOMM PROTEIN. |
| ID3895 | S | ORF starting with ATG of length 297 |
| ID3896 | S | PLASMID PAM-BETA1 ADENINE METHYLASE GENE (FRAGMENT). |
| ID3897 | S | HYPOTHETICAL 42.0 KDA PROTEIN IN DAPB-PAPS INTERGENIC REGION |
| ID3898 | S | YVQI PROTEIN. |
| ID3899 | S | ORF starting with ATG of length 297 |
| ID3900 | S | ORF starting with ATG of length 297 |
| ID3901 | S | GLYCINE-RICH_PROTEIN PRECURSOR. |
| ID3902 | S | ORF starting with ATG of length 294 |
| ID3903 | S | ORF starting with ATG of length 294 |
| ID3904 | S | YOZM PROTEIN. |
| ID3905 | S | ORF starting with ATG of length 294 |
| ID3906 | S | ORF starting with ATG of length 291 |
| ID3907 | S | ORF starting with ATG of length 291 |
| ID3908 | S | ORF starting with ATG of length 291 |
| ID3909 | S | HYPOTHETICAL 23.2 KDA PROTEIN. |
| ID3910 | S | HYPOTHETICAL 16.5 KDA PROTEIN. |
| ID3911 | S | ORF starting with ATG of length 291 |
| ID3912 | S | ORF starting with ATG of length 288 |
| ID3913 | S | ORF starting with ATG of length 288 |
| ID3914 | S | ORF starting with ATG of length 288 |
| ID3915 | S | ORF starting with ATG of length 288 |
| ID3916 | S | CDP-DIACYLGLYCEROL--SERINE O-PHOSPHATIDYLTRANSFERASE (EC 2.7 |
| ID3917 | S | ORF starting with ATG of length 288 |
| ID3918 | S | HPR(SER) KINASE/PHOSPHATASE (EC 2.7.1.-) (EC 3.1.3.-). |
| ID3919 | S | MLR7758 PROTEIN. |
| ID3920 | S | L-ASPARTATE OXIDASE (EC 1.4.3.16) (QUINOLINATE SYNTHETASE B) |
| ID3921 | S | HYPOTHFTICAL 23.3 KDA PROTEIN IN ROCC-PTA INTERGENIC REGION. |
| ID3922 | S | BH0606 PROTEIN. |
| ID3923 | S | ORF starting with ATG of length 285 |

-continued

| | | |
|---|---|---|
| ID3924 | S | ORF starting with TTG or GTG of length 569 |
| ID3925 | S | LANTIBIOTIC MERSACIDIN PRECURSOR. |
| ID3926 | S | ORF starting with ATG of length 285 |
| ID3927 | S | ORF starting with ATG of length 285 |
| ID3928 | S | ORF starting with ATG of length 285 |
| ID3929 | S | ORF starting with ATG of length 285 |
| ID3930 | S | ORF starting with ATG of length 285 |
| ID3931 | S | ORF starting with ATG of length 282 |
| ID3932 | S | ORF starting with ATG of length 282 |
| ID3933 | S | ORF starting with ATG of length 282 |
| ID3934 | S | OPF starting with ATG of length 282 |
| ID3935 | S | PROLINE PERMEASE. |
| ID3936 | S | ORF starting with ATG of length 282 |
| ID3937 | S | STRESS RESPONSE HOMOLOG HSP. |
| ID3938 | S | ORF starting with ATG of length 279 |
| ID3939 | S | ORF starting with ATG of length 279 |
| ID3940 | S | ORF starting with ATG of length 279 |
| ID3941 | S | HYPOTHETICAL 4.0 KDA PROTEIN. |
| ID3942 | S | ORF starting with ATG of length 279 |
| ID3943 | S | YJBI PROTEIN. |
| ID3944 | S | ORF starting with ATG of length 276 |
| ID3945 | S | ORF42. |
| ID3946 | S | ORF starting with ATG of length 276 |
| ID3947 | S | TRNA PSEUDOURIDINE SYNTHASE B (EC 4.2.1.70) (TRNA PSEUDOURID |
| ID3948 | S | HYPOTHETICAL 73.6 KDA PROTEIN. |
| ID3949 | S | Human protein sequence SEQ ID NO: 11751. |
| ID3950 | S | ORF starting with ATG of length 273 |
| ID3951 | S | HYPOTHETICAL 22.4 KDA PROTEIN IN RPMF-FTSL INTERGENIC REGION |
| ID3952 | S | BH2341 PROTEIN. |
| ID3953 | S | Right origin-binding protein. |
| ID3954 | S | ORF starting with ATG of length 273 |
| ID3955 | S | ORF starting with ATG of length 273 |
| ID3956 | S | ORF starting with ATG of length 273 |
| ID3957 | S | ORF starting with ATG of length 270 |
| ID3958 | S | ORF starting with ATG of length 270 |
| ID3959 | S | ORF starting with ATG of length 270 |
| ID3960 | S | YDBN PROTEIN. |
| ID3961 | S | DAUNORUBICIN RESISTANCE ATP-BINDING PROTEIN (DRRA-1). |
| ID3962 | S | ORF starting with ATG of length 270 |
| ID3963 | S | ORF starting with ATG of length 267 |
| ID3964 | S | ORF starting with ATG of length 267 |
| ID3965 | S | ORF starting with ATG of length 267 |
| ID3966 | S | ORF starting with ATG of length 267 |
| ID3967 | S | BH2327 PROTEIN. |
| ID3968 | S | HYPOTHETICAL 30.7 KDA LIPOPROTEIN IN GLNQ-ANSR INTERGENIC RE |
| ID3969 | S | HYPOTHETICAL 17.1 KDA PROTEIN IN RAPH-COTJA INTERGENIC REGIO |
| ID3970 | S | YLBB PROTEIN. |
| ID3971 | S | ORF starting with TTG or GTG of length 530 |
| ID3972 | S | METHYLTRANSFERASE/UROPORPHYRINOGEN-III SYNTHASE. |
| ID3973 | S | HYPOTHETICAL OXIDOREDUCTASE IN ANSR-BMRU INTERGENIC REGION. |
| ID3974 | S | ORF starting with ATG of length 264 |
| ID3975 | S | ORF starting with ATG of length 264 |
| ID3976 | S | ORF starting with ATG of length 264 |
| ID3977 | S | ORF starting with ATG of length 264 |
| ID3978 | S | YOBG. |
| ID3979 | S | ORF starting with ATG of length 261 |
| ID3980 | S | ORF starting with ATG of length 261 |
| ID3981 | S | ORF starting with ATG of length 261 |
| ID3982 | S | ORF starting with ATG of length 261 |
| ID3983 | S | ORF starting with ATG of length 261 |
| ID3984 | S | ORF starting with TTG or GTG of length 522 |
| ID3985 | S | ORF starting with ATG of length 259 |
| ID3986 | S | BH1397 PROTEIN. |
| ID3987 | S | YFIQ PROTEIN. |
| ID3988 | S | ORF starting with ATG of length 259 |
| ID3989 | S | YYZB PROTEIN. |
| ID3990 | S | HYPOTHETICAL 6.0 KDA PROTEIN. |
| ID3991 | S | ORF starting with ATG of length 261 |
| ID3992 | S | 50S RIBOSOMAL PROTEIN L2 (BL2). |
| ID3993 | S | YQZH PROTEIN. |
| ID3994 | S | ORF starting with ATG of length 258 |
| ID3995 | S | HYPOTHETICAL 12.8 KDA PROTEIN. |
| ID3996 | S | IMMUNOGENIC PROTEIN. |
| ID3997 | S | ORF starting with ATG of length 258 |
| ID3998 | S | BH1336 PROTEIN. |
| ID3999 | S | BH2912 PROTEIN. |
| ID4000 | S | ORF starting with ATG of length 258 |
| ID4001 | S | ORF starting with ATG of length 258 |
| ID4002 | S | HYPOTHETICAL 8.7 KDA PROTEIN. |

-continued

| | | |
|---|---|---|
| ID4003 | S | YDBT PROTEIN. |
| ID4004 | S | ORF starting with ATG of length 255 |
| ID4005 | S | ORF starting with ATG of length 255 |
| ID4006 | S | BH0426 PROTEIN. |
| ID4007 | S | BH0636 PROTEIN. |
| ID4008 | S | HYPOTHETICAL 6.3 KDA PROTEIN. |
| ID4009 | S | ORF starting with ATG of length 255 |
| ID4010 | S | ORF starting with ATG of length 255 |
| ID4011 | S | YFLI PROTEIN. |
| ID4012 | S | EBV tethering protein EBNA1. |
| ID4013 | S | BH1502 PROTEIN. |
| ID4014 | S | HYPOTHETICAL 8.5 EDA PROTEIN (FRAGMENT). |
| ID4015 | S | OCTAPEPTIDE-REPEAT PROTEIN T2. |
| ID4016 | S | ORF starting with ATG of length 252 |
| ID4017 | S | SIGNAL PEPTIDASE I P (EC 3.4.21.89) (SPASE I) (LEADER PEPTID |
| ID4018 | S | ORF starting with ATG of length 252 |
| ID4019 | S | ORF starting with ATG of length 252 |
| ID4020 | S | PUTATIVE - SOME HOMOLOGY WITH METH2. |
| ID4021 | S | SITE-SPECIFIC RECOMBINASE XERC. |
| ID4022 | S | *Arabidopsis thaliana* protein fragment SEQ ID NO: 48115. |
| ID4023 | S | ORF starting with ATG of length 252 |
| ID4024 | S | ORF starting with ATG of length 252 |
| ID4025 | S | ORF starting with ATG of length 252 |
| ID4026 | S | HYPOTHETICAL 42.6 KDA PROTEIN IN BSAA-ILVD INTERGENIC REGION |
| ID4027 | S | SA1216 PROTEIN. |
| ID4028 | S | REGULATORY PROTEIN GLNR. |
| ID4029 | S | ORF starting with ATG of length 249 |
| ID4030 | S | ORF starting with ATG of length 248 |
| ID4031 | S | ORF starting with ATG of length 249 |
| ID4032 | S | ORF starting with ATG of length 249 |
| ID4033 | S | ORF starting with ATG of length 249 |
| ID4034 | S | ORF starting with ATG of length 249 |
| ID4035 | S | 30S RIBOSOMAL PROTEIN S21. |
| ID4036 | S | YFMJ PROTEIN. |
| ID4037 | S | STAGE V SPORULATION PROTEIN M. |
| ID4038 | S | ORF starting with ATG of length 249 |
| ID4039 | S | ORF starting with ATG of length 249 |
| ID4040 | S | ORF starting with ATG of length 249 |
| ID4041 | S | ORF starting with ATG of length 249 |
| ID4042 | S | ORF starting with ATG of length 249 |
| ID4043 | S | ORF starting with ATG of length 246 |
| ID4044 | S | VMP3 PROTEIN. |
| ID4045 | S | ORF starting with ATG of length 246 |
| ID4046 | S | ORF starting with ATG of length 246 |
| ID4047 | S | ORF starting with ATG of length 246 |
| ID4048 | S | ORF starting with ATG of length 246 |
| ID4049 | S | ORF starting with ATG of length 243 |
| ID4050 | S | PUTATIVE TRANSPOSASE. |
| ID4051 | S | Human protein sequence SEQ ID NO: 17122. |
| ID4052 | S | ORF starting with ATG of length 243 |
| ID4053 | S | ORF starting with ATG of length 243 |
| ID4054 | S | HYDROXYPROLINE-RICH PROTEIN. |
| ID4055 | S | HYPOTHETICAL 34.8 KDA PROTEIN. |
| ID4056 | S | T08D2.8 PROTEIN. |
| ID4057 | S | PBSX PHAGE TERMINASE LARGE SUBUNIT. |
| ID4058 | S | ORF starting with ATG of length 240 |
| ID4059 | S | ORF starting with ATG of length 240 |
| ID4060 | S | ORF starting with ATG of length 240 |
| ID4061 | S | HYPOTHETICAL 40.9 KDA PROTEIN IN MECB-GLTX INTERGENIC REGION |
| ID4062 | S | YWIB PROTEIN. |
| ID4063 | S | PROLINE-RICH PROTEIN. |
| ID4064 | S | CG2839 PROTEIN (FRAGMENT) |
| ID4065 | S | NADH DEHYDROGENASE (EC 1.6.99.3) (ALKYL HYDROPEROXIDE REDUCT |
| ID4066 | S | HSDS. |
| ID4067 | S | SP62_HUMAN. |
| ID4068 | S | HYPOTHETICAL 7.7 KDA PROTEIN IN ILVA 3' REGION. |
| ID4069 | S | ORF starting with ATG of length 237 |
| ID4070 | S | YCZF PROTEIN. |
| ID4071 | S | ALANYL-TRNA SYNTHETASE (EC 6.1.1.7) (ALANINE--TRNA LIGASE) ( |
| ID4072 | S | TRANSPOSON TN10 TETD PROTEIN (ORFR). |
| ID4073 | S | ORF starting with ATG of length 237 |
| ID4074 | S | ORF starting with ATG of length 234 |
| ID4075 | S | ORF starting with ATG of length 234 |
| ID4076 | S | ORF starting with ATG of length 234 |
| ID4077 | S | HYPOTHETICAL 18.5 KDA PROTEIN IN SODA-COMGA INTERGENIC REGIO |
| ID4078 | S | ORF starting with ATG of length 234 |
| ID4079 | S | DNA BINDING PROTEIN. |
| ID4080 | S | ORF starting with ATG of length 234 |
| ID4081 | S | ORF starting with ATG of length 234 |

-continued

| | | |
|---|---|---|
| ID4082 | S | ORF starting with ATG of length 234 |
| ID4083 | S | ORF starting with ATG of length 234 |
| ID4084 | S | ORF starting with ATG of length 234 |
| ID4085 | S | ORF starting with ATG of length 234 |
| ID4086 | S | ORF starting with ATG of length 234 |
| ID4087 | S | ORF starting with ATG of length 231 |
| ID4088 | S | ORF starting with ATG of length 231 |
| ID4089 | S | ORF starting with ATG of length 231 |
| ID4090 | S | TRNA LIGASE (EC 6.5.1.3). |
| ID4091 | S | ORF starting with ATG of length 375 |
| ID4092 | S | HYPOTHETICAL 48.6 KDA PPOTEIN IN SERS-DNAZ INTERGENIC REGION |
| ID4093 | S | ORF starting with ATG of length 231 |
| ID4094 | S | ORF starting with ATG of length 231 |
| ID4095 | S | ORF starting with ATG of length 231 |
| ID4096 | S | ORF starting with ATG of length 231 |
| ID4097 | S | CELL DEATH REGULATOR AVEN. |
| ID4098 | S | ORF starting with TTG or GTG of length 460 |
| ID4099 | S | BH0850 PROTEIN. |
| ID4100 | S | HYPOTHETICAL 21.0 KDA PROTEIN IN TLP-GRLB INTERGENIC REGION. |
| ID4101 | S | BH1321 PROTEIN. |
| ID4102 | S | ORF starting with ATG of length 228 |
| ID4103 | S | ORF starting with ATG of length 228 |
| ID4104 | S | ORF starting with ATG of length 228 |
| ID4105 | S | KIAA1297 PROTEIN (FRAGMENT). |
| ID4106 | S | HYPOTHETICAL 15.9 KDA PROTEIN. |
| ID4107 | S | HYPOTHETICAL 24.5 KDA PROTEIN. |
| ID4108 | S | ACETYL-COA ACETYLTRANSFERASE (EC 2.3.1.9). |
| ID4109 | S | ORF starting with ATG of length 228 |
| ID4110 | S | ORF starting with ATG of length 228 |
| ID4111 | S | PTS SYSTEM, GLUCITOL/SORBITOL-SPECIFIC ENZYME IIA COMPONENT. |
| ID4112 | S | ORF33. |
| ID4113 | S | YNZH PROTEIN. |
| ID4114 | S | ODHA (EC 1.2.4.2) (OXOGLUTARATE DEHYDROGENASE (LIPOAMIDE)) (O |
| ID4115 | S | YOST PROTEIN. |
| ID4116 | S | ORF starting with ATG of length 225 |
| ID4117 | S | ORF starting with ATG of length 225 |
| ID4118 | S | ORF starting with ATG of length 225 |
| ID4119 | S | ORF starting with ATG of length 225 |
| ID4120 | S | ORF starting with ATG of length 225 |
| ID4121 | S | ORF starting with ATG of length 225 |
| ID4122 | S | BH1397 PROTEIN. |
| ID4123 | S | P-HYDROXYBENZOATE HYDROXYLASE (EC 1.14.13.2) (4-HYDROXYBENZO |
| ID4124 | S | ORF starting with ATG of length 225 |
| ID4125 | S | ORF starting with ATG of length 225 |
| ID4126 | S | ORF starting with TTG or GTG of length 447 |
| ID4127 | S | ORF starting with ATG of length 225 |
| ID4128 | S | ORF starting with ATG of length 225 |
| ID4129 | S | ORF starting with ATG of length 222 |
| ID4130 | S | ORF starting with ATG of length 222 |
| ID4131 | S | YFKG. |
| ID4132 | S | ORF starting with ATG of length 222 |
| ID4133 | S | ORF starting with ATG of length 222 |
| ID4134 | S | UNIDENTIFIED TRANSPORTER-ATP BINDING. |
| ID4135 | S | HYPOTHETICAL 11.5 KDA PROTEIN PH0217. |
| ID4136 | S | HYPOTHETICAL 7.3 KDA PROTEIN. |
| ID4137 | S | ORF starting with ATG of length 222 |
| ID4138 | S | YUTJ PROTEIN. |
| ID4139 | S | ORF starting with ATG of length 222 |
| ID4140 | S | ORF starting with ATG of length 222 |
| ID4141 | S | ORF starting with ATG of length 219 |
| ID4142 | S | ORF starting with ATG of length 219 |
| ID4143 | S | ORF starting with ATG of length 219 |
| ID4144 | S | ORF starting with ATG of length 219 |
| ID4145 | S | ORF starting with ATG of length 219 |
| ID4146 | S | ORF starting with ATG of length 219 |
| ID4147 | S | ORF starting with ATG of length 220 |
| ID4148 | S | ORF starting with ATG of length 219 |
| ID4149 | S | ORF starting with ATG of length 219 |
| ID4150 | S | ORF starting with ATG of length 219 |
| ID4151 | S | ORF starting with ATG of length 218 |
| ID4152 | S | COMX. |
| ID4153 | S | ORF starting with ATG of length 216 |
| ID4154 | S | ORF starting with ATG of length 215 |
| ID4155 | S | ORF starting with ATG of length 216 |
| ID4156 | S | ORF starting with ATG of length 216 |
| ID4157 | S | ORF starting with ATG of length 216 |
| ID4158 | S | ORF starting with ATG of length 216 |
| ID4159 | S | ORF starting with ATG of length 216 |
| ID4160 | S | Deduced protein sequence of p170-2 comprising T4. |

-continued

| | | |
|---|---|---|
| ID4161 | S | REGULATOR OF THE ACTIVITY OF PHOSPHATASE RAPK. |
| ID4162 | S | *M. tuberculosis* SYNEC protein. |
| ID4163 | S | ORF starting with ATG of length 216 |
| ID4164 | S | ORF starting with ATG of length 216 |
| ID4165 | S | ORF starting with ATG of length 216 |
| ID4166 | S | ORF starting with ATG of length 216 |
| ID4167 | S | ORF starting with ATG of length 216 |
| ID4168 | S | *Streptococcus pneumoniae* encoded polypeptide. |
| ID4169 | S | ORF starting with ATG of length 216 |
| ID4170 | S | ORF starting with ATG of length 214 |
| ID4171 | S | Nucleic acid transporter system peptide ligand SEQ ID NO 60. |
| ID4172 | S | ORF starting with ATG of length 213 |
| ID4173 | S | ORF starting with TTG or GTG of length 426 |
| ID4174 | S | ORF starting with ATG of length 212 |
| ID4175 | S | ORF starting with ATG of length 213 |
| ID4176 | S | ORF starting with ATG of length 213 |
| ID4177 | S | ORF starting with ATG of length 213 |
| ID4178 | S | ORF starting with ATG of length 213 |
| ID4179 | S | ORF starting with ATG of length 213 |
| ID4180 | S | ORF starting with ATG of length 213 |
| ID4181 | S | 90K-PROTEASE (BACILLOPEPTIDASE F) PRECURSOR (BACILLOPEPTIDAS |
| ID4182 | S | HYPOTHETICAL PROTEIN H11600. |
| ID4183 | S | ORF starting with ATG of length 213 |
| ID4184 | S | ORF starting with ATG of length 213 |
| ID4185 | S | ORF starting with ATG of length 213 |
| ID4186 | S | ORF starting with ATG of length 210 |
| ID4187 | S | ORF starting with ATG of length 210 |
| ID4188 | S | ORF starting with ATG of length 210 |
| ID4189 | S | ORF starting with ATG of length 210 |
| ID4190 | S | ORF starting with ATG of length 210 |
| ID4191 | S | ORF starting with ATG of length 210 |
| ID4192 | S | ORF starting with ATG of length 210 |
| ID4193 | S | BH3511 PROTEIN. |
| ID4194 | S | YISL PROTEIN. |
| ID4195 | S | PROTEIN-TYROSINE PHOSPHATASE, RECEPTOR-TYPE, F POLYPEPTIDE P |
| ID4196 | S | ORF starting with ATG of length 207 |
| ID4197 | S | ORF starting with ATG of length 207 |
| ID4198 | S | ORF starting with ATG of length 207 |
| ID4199 | S | ORF starting with ATG of length 207 |
| ID4200 | S | ORF starting with TTG or GTG of length 414 |
| ID4201 | S | ORF starting with ATG of length 207 |
| ID4202 | S | ORP starting with ATG of length 207 |
| ID4203 | S | HYPOTHETICAL TRANSCRIPTIONAL REGULATOR IN GNTR-HTPG INTERGEN |
| ID4204 | S | PROBABLE AMINO-ACID ABC TRANSPORTER PERMEASE PROTEIN YQIY. |
| ID4205 | S | PHOSPHOTRANSACETYLASE. |
| ID4206 | S | D-ISOMER SPECIFIC 2-HYDROXYACID DEHYDROGENASE FAMILY. |
| ID4207 | S | ORF starting with ATG of length 204 |
| ID4208 | S | ORF starting with ATG of length 204 |
| ID4209 | S | ORF starting with ATG of length 204 |
| ID4210 | S | BH3131 PROTEIN. |
| ID4211 | S | *Arabidopsis thaliana* protein fragment SEQ ID NO: 22242. |
| ID4212 | S | ORF starting with ATG of length 203 |
| ID4213 | S | ORF starting with ATG of length 204 |
| ID4214 | S | ORF starting with ATG of length 204 |
| ID4215 | S | ORF starting with ATG of length 204 |
| ID4216 | S | ORF starting with ATG of length 204 |
| ID4217 | S | ORF starting with ATG of length 205 |
| ID4218 | S | RESPONSE REGULATOR PROTEIN (FRAGMENT). |
| ID4219 | S | ORF starting with ATG of length 201 |
| ID4220 | S | ORF starting with ATG of length 201 |
| ID4221 | S | ORF starting with ATG of length 201 |
| ID4222 | S | ORF starting with ATG of length 201 |
| ID4223 | S | ORF starting with ATG of length 201 |
| ID4224 | S | ORF starting with ATG of length 201 |
| ID4225 | S | ORF starting with ATG of length 201 |
| ID4226 | S | ORF starting with ATG of length 201 |
| ID4227 | S | ORF starting with ATG of length 201 |
| ID4228 | S | ORF starting with TTG or GTG of length 402 |
| ID4229 | S | ORF starting with ATG of length 201 |
| ID4230 | S | ORF starting with ATG of length 201 |
| ID4231 | S | SPOIISA PROTEIN. |
| ID4232 | S | YFIX. |
| ID4233 | S | INTRACELLUILAR ALKALINE PROTEASE. |
| ID4234 | S | STAGE V SPORULATION PROTEIN AA. |
| ID4235 | S | YJZC PROTEIN. |
| ID4236 | S | YFHO PROTEIN. |
| ID4237 | T | PRKA PROTEIN. |
| ID4238 | T | PUTATIVE SIGMA L-DEPENDENT TRANSCRIPTIONAL REGULATOR IN MMGE |
| ID4239 | T | HOMOLOGOUS TO SP:PHOR_BACSU. |

-continued

| | | |
|---|---|---|
| ID4240 | T | CARBON STARVATION PROTEIN A HOMOLOG. |
| ID4241 | T | SPORULATION KINASE A (EC 2.7.3.-) (STAGE II SPORULATION PROT |
| ID4242 | T | YKRQ PROTEIN. |
| ID4243 | T | POBABLE SENSORY TRANSDUCTION HISTIDINE KINASE. |
| ID4244 | T | YVRG PROTEIN. |
| ID4245 | T | YLAK PROTEIN. |
| ID4246 | T | YKUI PROTEIN. |
| ID4247 | T | ALKALINE PHOSPHATASE SYNTHESIS SENSOR PROTEIN PHOR (EC 2.7.3 |
| ID4248 | T | SENSOR PROTEIN RESE (EC 2.7.3.-). |
| ID4249 | T | YVQB PROTEIN. |
| ID4250 | T | HOMOLOGUE OF ALKALINE PHOSPHATASE SYNTHESIS SENSOR PROTEIN P |
| ID4251 | T | YKVD PROTEIN. |
| ID4252 | T | AUTOLYSIN SENSOR KINASE. |
| ID4253 | T | SUBTILIN BIOSYNTHESIS SENSOR PROTEIN SPAK (EC 2.7.3.-). |
| ID4254 | T | HYPOTHETICAL 47.9 KDA PROTEIN IN DEGQ 5' REGION. |
| ID4255 | T | HYPOTHETICAL 58.9 KDA PROTEIN. |
| ID4256 | T | YTRP. |
| ID4257 | T | YVQE PROTEIN. |
| ID4258 | T | PUTATIVE SIGMA-B REGULATOR. |
| ID4259 | T | YLOP PROTEIN. |
| ID4260 | T | SIGNAL TRANSDUCTION PROTEIN KINASE. |
| ID4261 | T | FNR PROTEIN. |
| ID4262 | T | HYPOTHETICAL SENSOR-LIKE HISTIDINE KINASE (EC 2.7.3. -) (ORFH |
| ID4263 | T | CRP/FNR FAMILY PROTEIN. |
| ID4264 | T | CITS (TWO-COMPDNENT SENSOR HISTIDINE KINASE). |
| ID4265 | T | YLBL PROTEIN. |
| ID4266 | T | PROBABLE SERINE/THREONINE-PROTEIN KINASE IN SPOIIE-HPT INTER |
| ID4267 | T | HYPOTHETICAL 35.7 KDA SENSORY TRANSDUCTION PROTEIN (ORFJ) (O |
| ID4268 | T | HYPOTHETICAL 42.3 KDA PROTEIN (YVFT PROTEIN). |
| ID4269 | T | HYPOTHETICAL SENSOR-LIKE HISTIDINE KINASE IN IDH 3' REGION (EC |
| ID4270 | T | SENSOR PROTEIN DEGS (EC 2.7.3.-). |
| ID4271 | T | ORF4 PROTEIN. |
| ID4272 | T | GENERAL STRESS PROTEIN 16U (GSP16U). |
| ID4273 | T | STRESS RESPONSE PROTEIN SCP2. |
| ID4274 | T | HYPOTHETICAL 27.7 KDA PROTEIN (ORFQ). |
| ID4275 | T | CITS (TWO-COMPONENT SENSOR HISTIDINE KINASE). |
| ID4276 | T | ORF starting with ATG of length 1569 |
| ID4277 | T | ORF starting with ATG of length 1545 |
| ID4278 | T | SIGNAL SENSOR PROTEIN HISTIDINE KINASE. |
| ID4279 | T | BH2505 PROTEIN. |
| ID4280 | T | PUTATIVE SIGMA-B REGULATOR. |
| ID4281 | T | HYPOTHETICAL SENSOR-LIKE HISTIDINE KINASE IN IDH 3' REGION (EC |
| ID4282 | T | SENSOR PROTEIN. |
| ID4283 | T | ORF starting with ATG of length 1233 |
| ID4284 | T | ORF starting with ATG of length 1182 |
| ID4285 | T | ORF starting with ATG of length 1170 |
| ID4286 | T | SPORULATION INITIATION PHOSPHOTRANSFERASE F (EC 2.7.-.-) (ST |
| ID4287 | T | ORF starting with ATG of length 1164 |
| ID4288 | T | ANTI-SIGMA F FACTOR ANTAGONIST (STAGE II SPORULATION PROTEIN |
| ID4289 | T | SPORULATION KINASE C (EC 2.7.3.-). |
| ID4290 | T | ORF starting with ATG of length 1119 |
| ID4291 | T | CHEMOTAXIS PROTEIN CHEY HOMOLOG. |
| ID4292 | T | ORF starting with ATG of length 1083 |
| ID4293 | T | ANTI-SIGMA B FACTOR ANTAGONIST. |
| ID4294 | T | YDCE PROTEIN. |
| ID4295 | T | ANTI-SIGMA B FACTOR ANTAGONIST. |
| ID4296 | T | TWO-COMPONENT SENSOR HISTIDINE KINASE HOMOLOG. |
| ID4297 | T | ARSENATE REDUCTASE (ARSENICAL PUMP MODIFIER). |
| ID4298 | T | YTAB PROTEIN. |
| ID4299 | T | PUTATIVE LOW MOLECULAR WEIGHT PROTEIN-TYROSINE-PHOSPHATASE Y |
| ID4300 | T | SPORULATION KINASE C (EC 2.7.3.-). |
| ID4301 | T | ORF starting with ATG of length 936 |
| ID4302 | T | YJBP PROTEIN. |
| ID4303 | T | HYPOTHETICAL 20.1 KDA PROTEIN. |
| ID4304 | T | YBDM PROTEIN. |
| ID4305 | T | YKOW PROTEIN. |
| ID4306 | T | HYPOTHETICAL 20.3 KDA PROTEIN. |
| ID4307 | T | BH0415 PROTEIN. |
| ID4308 | T | ORF starting with ATG of length 699 |
| ID4309 | T | HYPOTHETICAL 40.7 KDA PROTEIN IN CSPB-GLPP INTERGENIC REGION |
| ID4310 | T | ORF starting with ATG of length 1389 |
| ID4311 | T | YFKJ PROTEIN. |
| ID4312 | T | ANTI-SIGMA F FACTOR (STAGE II SPORULATION PROTEIN AB). |
| ID4313 | T | HYPOTHETICAL 31.8 KDA PROTEIN IN SODA-COMGA INTERGENIC REGIO |
| ID4314 | T | RECEPTOR-LIKE HISTIDINE KINASE BPDS. |
| ID4315 | T | AUTOLYSIN SENSOR KINASE. |
| ID4316 | T | YKOW PROTEIN. |
| ID4317 | T | LYTS AND LYTR GENES, COMPLETE CDS. |
| ID4318 | T | BH2016 PROTEIN. |

-continued

| | | |
|---|---|---|
| ID4319 | T | ANTI-SIGMA F FACTOR (STAGE II SPORULATION PROTEIN AB). |
| ID4320 | T | RESPONSE REGULATOR ACTA. |
| ID4321 | T | ORF starting with ATG of length 1170 |
| ID4322 | T | ORF starting with ATG of length 780 |
| ID4323 | T | ORF starting with ATG of length 255 |
| ID4324 | T | ORF starting with ATG of length 249 |
| ID4325 | T | ORF starting with ATG of length 239 |
| ID4326 | T | CITS (TWO-COMPONENT SENSOR HISTIDINE KINASE). |
| ID4327 | T | YLAK PROTEIN. |
| ID4328 | TK | STAGE II SPORULATION PROTEIN E (EC 3.1.3.16). |
| ID4329 | TK | GTP PYROPHOSPHOKINASE (EC 2.7.6.5) (ATP:GTP 3'-PYROPHOSPHOTR |
| ID4330 | TK | PUTATIVE SIGMA-B REGULATOR. |
| ID4331 | TK | Peptide which promotes formn. of *B. subtilis* extracellular p |
| ID4332 | TK | SIGNAL TRANSDUCTION REGULATOR. |
| ID4333 | TK | *Streptococcus pneumoniae* spo/rel protein sequence. |
| ID4334 | TK | YVQA PROTEIN. |
| ID4335 | TK | YVQC PROTEIN. |
| ID4336 | TK | YVRH PROTEIN (RECEIVER MODULE OF PUTATIVE RESPONSE REGULATOR |
| ID4337 | TK | *Staphylococcus aureus* response regulator protein. |
| ID4338 | TK | HYPOTHETICAL 27.5 KDA PROTEIN. |
| ID4339 | TX | HYPOTHETICAL 27.2 KDA SENSORY TRANSDUCTION PROTEIN IN ROCR-P |
| ID4340 | TK | MTRA PROTEIN. |
| ID4341 | TK | CITT (TWO-COMPONENT RESPONSE REGULATOR) |
| ID4342 | TK | HYPOTHETICAL 22.8 KDA PROTEIN. |
| ID4343 | TK | PHOSPHATE REGULATORY PROTEIN PHOB. |
| ID4344 | TK | HYPOTHETICAL 22.8 KDA PROTEIN. |
| ID4345 | TK | YVRH PROTEIN (RECEIVER MODULE OF PUTATIVE RESPONSE REGULATOR |
| ID4346 | TK | PUTATIVE TWO COMPONENT RESPONSE REGULATOR. |
| ID4347 | TK | SCNR PROTEIN. |
| ID4348 | TK | ORF starting with ATG of length 615 |
| ID4349 | TK | TWO-COMPONENT RESPONSE REGULATOR HOMOLOG. |
| ID4350 | TK | ORF starting with ATG of length 506 |
| ID4351 | TK | ORF starting with ATG of length 240 |
| ID4352 | TK | ORF starting with ATG of length 228 |
| ID4353 | TQ | YUNI PROTEIN. |
| ID4354 | TQ | HYPOTHETICAL 47.8 KDA PROTEIN IN CAH-NASF INTERGENIC REGION. |
| ID4355 | TQ | ACETOIN UTILIZATION ACUC PROTEIN. |
| ID4356 | TQ | ORF starting with ATG of length 1614 |
| ID4357 | TQ | ORF starting with ATG of length 1239 |
| ID4358 | TQ | HYPOTHETICAL 47.8 KDA PROTEIN IN CAH-NASF INTERGENIC REGION. |
| ID4359 | TQ | ORF starting with ATG of length 942 |
| ID4360 | TQ | ORF starting with ATG of length 864 |
| ID4361 | Z | transfer RNA-Ala |
| ID4362 | Z | transfer RNA-Ile |
| ID4363 | Z | transfer RNA-Ala |
| ID4364 | Z | transfer RNA-Arg |
| ID4365 | Z | transfer RNA-Asn |
| ID4366 | Z | transfer RNA-Asp |
| ID4367 | Z | transfer RNA-Glu |
| ID4368 | Z | transfer RNA-Gly |
| ID4369 | Z | transfer RNA-Gly |
| ID4370 | Z | transfer RNA-His |
| ID4371 | Z | transfer RNA-Ile |
| ID4372 | Z | transfer RNA-Leu |
| ID4373 | Z | transfer RNA-Leu |
| ID4374 | Z | transfer RNA-Lys |
| ID4375 | Z | transfer RNA-Met |
| ID4376 | Z | transfer RNA-Met |
| ID4377 | Z | transfer RNA-Met |
| ID4378 | Z | transfer RNA-Phe |
| ID4379 | Z | transfer RNA-Pro |
| ID4380 | Z | transfer RNA-Ser |
| ID4381 | Z | transfer RNA-Ser |
| ID4382 | Z | transfer RNA-Thr |
| ID4383 | Z | transfer RNA-Val |
| ID4384 | Z | transfer RNA-Asn |
| ID4385 | Z | transfer RNA-Asp |
| ID4386 | Z | transfer RNA-Gln |
| ID4387 | Z | transfer RNA-Glu |
| ID4388 | Z | transfer RNA-Gly |
| ID4389 | Z | transfer RNA-His |
| ID4390 | Z | transfer RNA-Leu |
| ID4391 | Z | transfer RNA-Leu |
| ID4392 | Z | transfer RNA-Met |
| ID4393 | Z | transfer RNA-Phe |
| ID4394 | Z | transfer RNA-Ser |
| ID4395 | Z | transfer RNA-Thr |
| ID4396 | Z | transfer RNA-Trp |
| ID4397 | Z | transfer RNA-Tyr |

| | | -continued |
|---|---|---|
| ID4398 | Z | transfer RNA-Val |
| ID4399 | Z | transfer RNA-Arg |
| ID4400 | Z | transfer RNA-Asp |
| ID4401 | Z | transfer RNA-Gly |
| ID4402 | Z | transfer RNA-Met |
| ID4403 | Z | transfer RNA-Ala |
| ID4404 | Z | transfer RNA-Arg |
| ID4405 | Z | transfer RNA-Asn |
| ID4406 | Z | transfer RNA-Gly |
| ID4407 | Z | transfer RNA-Pro |
| ID4408 | Z | transfer RNA-Thr |
| ID4409 | Z | transfer RNA-Ala |
| ID4410 | Z | transfer RNA-Arg |
| ID4411 | Z | transfer RNA-Gly |
| ID4412 | Z | transfer RNA-Leu |
| ID4413 | Z | transfer RNA-Leu |
| ID4414 | Z | transfer RNA-Lys |
| ID4415 | Z | transfer RNA-Pro |
| ID4416 | Z | transfer RNA-Thr |
| ID4417 | Z | transfer RNA-Val |
| ID4418 | Z | transfer RNA-Ala |
| ID4419 | Z | transfer RNA-Ile |
| ID4420 | Z | transfer RNA-Arg |
| ID4421 | Z | transfer RNA-Asn |
| ID4422 | Z | transfer RNA-Gln |
| ID4423 | Z | transfer RNA-Glu |
| ID4424 | Z | transfer RNA-Leu |
| ID4425 | Z | transfer RNA-Leu |
| ID4426 | Z | transfer RNA-Lys |
| ID4427 | Z | transfer RNA-Ser |
| ID4428 | Z | transfer RNA-Ala |
| ID4429 | Z | transfer RNA-Arg |
| ID4430 | Z | transfer RNA-Arg |
| ID4431 | Z | transfer RNA-Gln |
| ID4432 | Z | transfer RNA-Gln |
| ID4433 | Z | transfer RNA-Glu |
| ID4434 | Z | transfer RNA-Glu |
| ID4435 | Z | transfer RNA-Gly |
| ID4436 | Z | transfer RNA-Met |
| ID4437 | Z | transfer RNA-Ser |
| ID4438 | Z | transfer RNA-Thr |
| ID4439 | Z | transfer RNA-Tyr |
| ID4440 | Z | transfer RNA-Val |
| ID4441 | Z | transfer RNA-Val |
| ID4442 | Z | transfer RNA-Asp |
| ID4443 | Z | transfer RNA-Glu |
| ID4444 | Z | transfer RNA-Lys |
| ID4445 | Z | transfer RNA-Phe |
| ID4446 | Z | ribosomal RNA-16S |
| ID4447 | Z | ribosomal RNA-23S |
| ID4448 | Z | ribosomal RNA-5S |

| | | |
|---|---|---|
| ID0001 | C | NADH DEHYDROGENASE. |
| ID0002 | C | ACONITATE HYDRATASE (EC 4.2.1.3) (CITRATE HYDRO-LYASE) (ACON |
| ID0003 | C | L-LACTATE DEHYDROGENASE (EC 1.1.1.27). |
| ID0004 | C | CYTOCHROME AA3 QUINOL OXIDASE SUBUNIT III (EC 1.10.3.). |
| ID0005 | C | CYTOCHROME AA3 QUINOL OXIDASE SUBUNIT I (EC 1.10.3.). |
| ID0006 | C | QOXA (CYTOCHROME AA3 QUINOL OXIDASE SUBUNIT II) (EC 1.10.3.) |
| ID0007 | C | MALATE SYNTHASE. |
| ID0008 | C | ACETATE KINASE (EC 2.7.2.1) (ACETOKINASE). |
| ID0009 | C | ALCOHOL DEHYDROGENASE. |
| ID0010 | C | L-lactic acid dehydrogenase. |
| ID0011 | C | HYPOTHETICAL 35.0 KDA PROTEIN IN RAPJ-OPUAA INTERGENIC REGIO |
| ID0012 | C | HYPOTHETICAL 49.3 KDA PROTEIN IN IDH-DEOR INTERGENIC REGION. |
| ID0013 | C | PYRUVATE DEHYDROGENASE E2 (DIHYDROLIPOAMIDE ACETYLTRANSFERAS |
| ID0014 | C | HYPOTHETICAL OXIDOREDUCTASE IN ANSR-BMRU INTERGENIC REGION. |
| ID0015 | C | ACONITATE HYDRATASE (EC 4.2.1.3) (CITRATE HYDRO-LYASE) (ACON |
| ID0016 | C | HYPOTHETICAL 49.3 KDA PROTEIN IN IDH-DEOR INTERGENIC REGION. |
| ID0017 | C | ORF starting with ATG of length 558 |
| ID0018 | C | DIHYDROLIPOAMIDE DEHYDROGENASE (EC 1.8.1.4) (E3 COMPONENT OF |
| ID0019 | C | 68% IDENTITY PROTEIN TO 1-PYRROLINE-5-CARBOXYLATE DEHYDROGEN |
| ID0020 | C | GLYCEROL KINASE. |
| ID0021 | C | ELECTRON TRANSFER FLAVOPROTEIN (BETA SUBUNIT). |
| ID0022 | C | ALDEHYDE DEHYDROGENASE, THERMOSTABLE (EC 1.2.1.3). |

-continued

| ID | | Description |
|---|---|---|
| ID0023 | C | NADH DEHYDROGENASE. |
| ID0024 | C | NADH DEHYDROGENASE-LIKE PROTEIN. |
| ID0025 | C | Heat resistant aldehyde dehydrogenase. |
| ID0026 | C | GLYCOLATE OXIDASE SUBUNIT. |
| ID0027 | C | ORF starting with ATG of length 351 |
| ID0028 | C | MAGNESIUM CITRATE SECONDARY TRANSPORTER. |
| ID0029 | C | Heat resistant aldehyde dehydrogenase. |
| ID0030 | C | NITRITE REDUCTASE [NAD (P) H] (EC 1.6.6.4). |
| ID0031 | C | H(+)/SODIUM-GLUTAMATE SYMPORTER. |
| ID0032 | C | PHOSPHOTRANSACETYLASE (EC 2.3.1.8). |
| ID0033 | C | ORF starting with ATG of length 708 |
| ID0034 | C | CITRATE SYNTHASE (EC 4.1.3.7). |
| ID0035 | C | DIHYDROLIPOAMIDE DEHYDROGENASE (EC 1.8.1.4) (E3 COMPONENT OF |
| ID0036 | C | BRANCHED-CHAIN ALPHA-KETO ACID DEHYDROGENASE E1. |
| ID0037 | C | OXIDOREDUCTASE. |
| ID0038 | C | GLYCEROL KINASE (EC 2.7.1.30) (ATP:GLYCEROL 3-PHOSPHOTRANSFE |
| ID0039 | C | ATP SYNTHASE ALPHA SUBUNIT (EC 3.6.1.34). |
| ID0040 | C | ISOCITRATE LYASE. |
| ID0041 | C | Amino acid sequence of respiratory Nitrate Reductase 1 alpha |
| ID0042 | C | *Staphylococcus aureus* respiratory nitrate reductase alpha su |
| ID0043 | C | PTS SYSTEM, MANNITOL-SPECIFIC ENZYME II, BC COMPONENT. |
| ID0044 | C | *Staphylococcus carnosus* nitrate reductase biogenesis protein |
| ID0045 | C | PUTATIVE PROTON-TRANSLOCATING ATPASE, BETA SUBUNIT (EC 3.6.1 |
| ID0046 | C | PUTATIVE NITRATE REDUCTASE ALPHA CHAIN. |
| ID0047 | C | ATP SYNTHASE BETA SUBUNIT (EC 3.6.1.34). |
| ID0048 | C | ASSIMILATORY NITRATE REDUCTASE CATALYTIC SUBUNIT (EC 1.7.99. |
| ID0049 | C | ORF starting with ATG of length 918 |
| ID0050 | C | ASSIMILATORY NITRATE REDUCTASE CATALYTIC SUBUNIT (EC 1.7.99. |
| ID0051 | C | GLYCOLATE OXIDASE SUBUNIT. |
| ID0052 | C | L-lactic acid dehydrogenase. |
| ID0053 | C | GLYCOLATE OXIDASE SUBUNIT. |
| ID0054 | C | HYPOTHETICAL 49.2 KDA PROTEIN. |
| ID0055 | C | PROBABLE METHYLMALONATE-SEMIALDEHYDE DEHYDROGENASE [ACYLATIN |
| ID0056 | C | GLYCOLATE OXIDASE IRON-SULFUR SUBUNIT. |
| ID0057 | C | ALDO/KETO REDUCTASE. |
| ID0058 | C | NA(+)/H(+) ANITPORTER (SODIUM/PROTON ANITPORTER). |
| ID0059 | C | MALIC ENZYME (MALATE DEHYDROGENASE) (EC 1.1.1.38). |
| ID0060 | C | HYPOTHETICAL 48.5 KDA PROTEIN. |
| ID0061 | C | PROBABLE D-LACTATE DEHYDROGENASE. |
| ID0062 | C | PROBABLE METHYLMALONATE-SEMIALDEHYDE DEHYDROGENASE [ACYLATIN |
| ID0063 | C | GLYCEROL-3-PHOSPHATE DEHYDROGENASE (EC 1.1.99.5). |
| ID0064 | C | GLYCEROL-3-PHOSPHATE DEHYDROGENASE. |
| ID0065 | C | ALKANESULFONATE MONOOXYGENASE. |
| ID0066 | C | GLYCEROL-3-PHOSPHATE DEHYDROGENASE. |
| ID0067 | C | GLYCOLATE OXIDASE IRON-SULFUR SUBUNIT. |
| ID0068 | C | MALATE SYNTHASE. |
| ID0069 | C | CITRATE SYNTHASE III (EC 4.1.3.7). |
| ID0070 | C | BH1020 PROTEIN. |
| ID0071 | C | METHYLMALONATE-SEMIALDEHYDE DEHYDROGENASE. |
| ID0072 | C | METHYLMALONATE-SEMIALDEHYDE DEHYDROGENASE. |
| ID0073 | C | OMEGA-CRYSTALLIN. |
| ID0074 | C | L-LACTATE PERMEASE. |
| ID0075 | C | GLYCOLATE OXIDASE. |
| ID0076 | C | BH1833 PROTEIN. |
| ID0077 | C | HYPOTHETICAL 49.2 KDA PROTEIN. |
| ID0078 | C | GLYCEROL KINASE. |
| ID0079 | C | ATP SYNTHASE B SUBUNIT (EC 3.6.1.34). |
| ID0080 | C | SUCCINATE DEHYDROGENASE FLAVOPROTEIN SUBUNIT. |
| ID0081 | C | NADH DEHYDROGENASE. |
| ID0082 | C | HYPOTHETICAL 47.8 KDA PROTEIN. |
| ID0083 | C | PYRUVATE DEHYDROGENASE B2 (DIHYDROLIPOAMIDE ACETYLTRANSFERAS |
| ID0084 | C | DIHYDROLIPOAMIDE DEHYDROGENASE (EC 1.8.1.4) (E3 COMPONENT OF |
| ID0085 | C | PROBABLE ALDEHYDE DEHYDROGENASE YCBD (EC 1.2.1.3). |
| ID0086 | C | PROBABLE FLAVODOXIN 1. |
| ID0087 | C | HYPOTHETICAL 79.2 KDA PROTEIN IN ACDA 5'REGION. |
| ID0088 | C | ORF starting with ATG of length 969 |
| ID0089 | C | TPP-DEPENDENT ACETOIN DEHYDROGENASE, E1 ALPHA-SUBUNIT. |
| ID0090 | C | GLYCEROPHOSPHODIESTER PHOSPHODIESTERASE. |
| ID0091 | C | ATP SYNTHASE ALPHA SUBUNIT (EC 3.6.1.34). |
| ID0092 | C | *Staphylococcus aureus* respiratory nitrate reductase alpha su |
| ID0093 | C | MANGANESE-DEPENDENT INORGANIC PYROPHOSPHATASE (EC 3.6.1.1) (P |
| ID0094 | C | PROBABLE NADH-DEPENDENT BUTANOL DEHYDROGENASE 1 (EC 1.1.1.—) |
| ID0095 | C | MALATE DEHYDROGENASE (EC 1.1.1.37). |
| ID0096 | C | ASSIMILATORY NITRITE REDUCTASE (SUBUNIT). |
| ID0097 | C | ISOCITRATE DEHYDROGENASE (EC 1.1.1.42). |
| ID0098 | C | NITRATE REDUCTASE (FRAGMENT). |
| ID0099 | C | ASSIMILATORY NITRITE REDUCTASE (SUBUNIT). |

-continued

| | | |
|---|---|---|
| ID0100 | C | ALDEHYDE DEHYDROGENASE, THERMOSTABLE (EC 1.2.1.3). |
| ID1010 | C | BH0875 PROTEIN. |
| ID0102 | C | ALDEHYDE DEHYDROGENASE. |
| ID0103 | C | SUCCINATE-SEMIALDEHYDE DEHYDROGENASE. |
| ID0104 | C | HYDA (FRAGMENT). |
| ID0105 | C | PROBABLE ALDEHYDE DEHYDROGENASE YCBD (EC 1.2.1.3). |
| ID0106 | C | PTS SYSTEM, MANNITOL-SPECIFIC ENZYME II, BC COMPONENT. |
| ID0107 | C | PROBABLE ALDEHYDE DEHYDROGENASE YWDH (EC 1.2.1.3). |
| ID0108 | C | ATP SYNTHASE SUBUNIT C (EC 3.6.1.34). |
| ID0109 | C | ATP SYNTHASE A SUBUNIT (EC 3.6.1.34). |
| ID0110 | C | NADP-DEPENDENT ALDEHYDE DEHYDROGENASE (EC 1.2.1.3). |
| ID0111 | C | L-ARABINOSE UTILIZATION PROTEIN. |
| ID0112 | C | PROBABLE ALDEHYDE DEHYDROGENASE YCBD (EC 1.2.1.3). |
| ID0113 | C | L-RIBULOKINASE. |
| ID0114 | C | L-ARABINOSE UTILIZATION PROTEIN. |
| ID0115 | C | ALDEHYDE DEHYDROGENASE, THERMOSTABLE (EC 1.2.1.3). |
| ID0116 | C | CYTOCHROME CAA3 OXIDASE (SUBUNIT I). |
| ID0117 | C | GLYCEROL-3-PHOSPHATE DEHYDROGENASE. |
| ID0118 | C | GLYCEROL-3-PHOSPHATE DEHYDROGENASE (EC 1.1.99.5). |
| ID0119 | C | OXOGLUTARATE DEHYDROGENASE. |
| ID0120 | C | PHOSPHOENOLPYRUVATE CARBOXYLASE (EC 4.1.1.31) (PEPCASE) (PEP |
| ID0121 | C | PHOSPHOENOLPYRUVATE CARBOXYLASE (EC 4.1.1.31) (PEPCASE) (PEP |
| ID0122 | C | NADPH-FLAVIN OXIDOREDUCTASE. |
| ID0123 | C | Protein encoded by C. trachomatis LGV II clone 4C9-18 # 2. |
| ID0124 | C | Staphylococcus carnosus nitrate reductase NarJ subunit. |
| ID0125 | C | HYPOTHETICAL OXIDOREDUCTASE IN CSTA-AHPC INTERGENIC REGION. |
| ID0126 | C | PROBABLE NADH-DEPENDENT BUTANOL DEHYDROGENASE 1 (EC 1.1.1.—) |
| ID0127 | C | MG++/CITRATE COMPLEX TRANSPORTER. |
| ID0128 | C | MALATE SYNTHASE. |
| ID0129 | C | SUCCINATE DEHYDROGENASE FLAVOPROTEIN (EC 1.3.99.1). |
| ID0130 | C | MALIC ENZYME (MALATE DEHYDROGENASE) (EC 1.1.1.38). |
| ID0131 | C | SUCCINATE DEHYDROGENASE IRON-SULFUR PROTEIN (EC 1.3.99.1). |
| ID0132 | C | MALATE OXIDOREDUCTASE (NAD) (MALIC ENZYME) (EC 1.1.1.38). |
| ID0133 | C | FUMARATE HYDRATASE. |
| ID0134 | C | NAD-DEPENDENT METHANOL DEHYDROGENASE. |
| ID0135 | C | SUCCINYL-COA SYNTHETASE (ALPHA SUBUNIT). |
| ID0136 | C | NADH-DEPENDENT FLAVIN OXIDOREDUCTASE PUTATIVE. |
| ID0137 | C | CYTOCHROME CAA3 OXIDASE (SUBUNIT III). |
| ID0138 | C | CYTOCHROME CAA3 OXIDASE (SUBUNIT IV). |
| ID0139 | C | GLYCEROL DEHYDROGENASE (EC 1.1.1.6) (GLDH). |
| ID0140 | C | ALDEHYDE DEHYDROGENASE. |
| ID0141 | C | ORF starting with ATG of length 942 |
| ID0142 | C | CYTOCHROME AA3 QUINOL OXIDASE SUBUNIT I (EC 1.10.3.). |
| ID0143 | C | CYTOCHROME AA3 QUINOL OXIDASE SUBUNIT II (EC 1.10.3.). |
| DI0144 | C | ASSIMILATORY NITRATE REDUCTASE CATALYTIC SUBUNIT (EC 1.7.99. |
| ID0145 | C | RIESKE. |
| ID0146 | C | PYRUVATE DEHYDROGENASE E1 COMPONENT, BETA SUBUNIT (EC 1.2.4. |
| ID0147 | C | SUCCINYL-COA SYNTHETASE (BETA SUBUNIT). |
| ID0148 | C | BH1718 PROTEIN. |
| ID0149 | C | ACETOIN DEHYDROGENASE E1 COMPONENT (TPP-DEPENDENT BETA SUBUN |
| ID0150 | C | HYPOTHETICAL 47.8 KDA PROTEIN. |
| ID0151 | C | CITRATE PERMEASE/TRANSPORTER. |
| ID0152 | C | PUTATIVE MALATE OXIDOREDUCTASE. |
| ID0153 | C | ALDEHYDE DEHYDROGENASE, THERMOSTABLE (EC 1.2.1.3). |
| ID0154 | C | MAGNESIUM CITRATE SECONDARY TRANSPORTER. |
| ID0155 | C | DIHYDROLIPOAMIDE SUCCINYLTRANSFERASE COMPONENT OF 2-OXOGLUTA |
| ID0156 | C | FERREDOXIN. |
| ID0157 | C | ACETOIN DEHYDROGENASE E2 COMPONENT (DIHYDROLIPOAMIDEACETYLTR |
| ID0158 | C | OXIDOREDUCTASE, N5, N10-METHYLENETETRAHYDROMETHANOPTERIN REDU |
| ID0159 | C | PROBABLE ALDEHYDE DEHYDROGENASE YCBD (EC 1.2.1.3). |
| ID0160 | C | CITRATE TRANSPORTER. |
| ID0161 | C | GLYCOLATE OXIDASE SUBUNIT. |
| ID0162 | C | BH3449 PROTEIN. |
| ID0163 | C | PYRUVATE CARBOXYLASE. |
| ID0164 | C | SULFONATE MONOOXYGENASE. |
| ID0165 | C | ORF starting with ATG of length 702 |
| ID0166 | C | ATP SYNTHASE GAMMA SUBUNIT (EC 3.6.1.34). |
| ID0167 | C | ATP SYNTHASE ALPHA SUBUNIT (EC 3.6.1.34). |
| ID0168 | C | ATP SYNTHASE DELTA SUBUNIT (EC 3.6.1.34). |
| ID0169 | C | ATP SYNTHASE B SUBUNIT (EC 3.6.1.34). |
| ID0170 | C | GLYCEROPHOSPHODIESTER PHOSPHODIESTERASE. |
| ID0171 | C | GLYCOLATE OXIDASE IRON-SULFUR SUBUNIT. |
| ID0172 | C | METHYLMALONATE-SEMIALDEHYDE DEHYDROGENASE. |
| ID0173 | C | BH0303 PROTEIN. |
| ID0174 | C | ASSIMILATORY NITRITE REDUCTASE (SUBUNIT). |
| ID0175 | C | ALDEHYDE DEHYDROGENASE, THERMOSTABLE (EC 1.2.1.3). |
| ID0176 | C | PYRUVATE DEHYDROGENASE E1 COMPONENT, BETA SUBUNIT (EC 1.2.4. |
| ID0177 | CHR | YVCT PROTEIN. |
| ID0178 | CP | ORF1 (NA+/H+ ANTIPORTER). |

-continued

| | | |
|---|---|---|
| ID0179 | CP | MULTIPLE RESISTANCE AND PH REGULATION RELATED PROTEIN A. |
| ID0180 | CP | NADH DEHYDROGENASE, PUTATIVE. |
| ID0181 | CP | ORF1 (NA+/H+ ANTIPORTER). |
| ID0182 | CP | YUFT PROTEIN. |
| ID0183 | CP | NA+/H+ ANTIPORTER. |
| ID0184 | CR | ORF starting with ATG of length 626 |
| ID0185 | D | SEPTUM SITE-DETERMINING PROTEIN. |
| ID0186 | D | CELL-SHAPE DETERMINING PROTEIN. |
| ID0187 | D | BH0975 PROTEIN. |
| ID0188 | D | HYPOTHETICAL 53.5 KDA PROTEIN IN SPOIIE-HPT INTERGENIC REGIO |
| ID0189 | D | YUKA PROTEIN. |
| ID0190 | D | CENTROMERE-LIKE FUNCTION INVOLVED IN FORESPORE CHROMOSOME PA |
| ID0191 | D | CELL SHAPE DETERMINING PROTEIN (MREB-LIKE PROTEIN). |
| ID0192 | D | CELL-CYCLE PROTEIN. |
| ID0193 | D | STAGE V SPORULATION PROTEIN E. |
| ID0194 | D | SPOIIIE PROTEIN. |
| ID0195 | D | SPORULATION PROTEIN SPOIIIE. |
| ID0196 | D | STAGE V SPORULATION PROTEIN E. |
| ID0197 | D | GLUCOSE INHIBITED DIVISION PROTEIN A. |
| ID0198 | D | BH0975 PROTEIN. |
| ID0199 | D | SCDA. |
| ID0200 | D | STAGE V SPORULATION PROTEIN E. |
| ID0201 | D | CELL-SHAPE DETERMINING PROTEIN. |
| ID0202 | D | CELL-SHAPE DETERMINING PROTEIN. |
| ID0203 | D | CAPSULAR POLYSACCHARIDE BIOSYNTHESIS. |
| ID0204 | D | SPOIIIE PROTEIN. |
| ID0205 | D | SA0276 PROTEIN. |
| ID0206 | D | BH0975 PROTEIN. |
| ID0207 | D | DIARHHEAL TOXIN. |
| ID0208 | D | ORF starting with ATG of length 351 |
| ID0209 | D | ORF starting with ATG of length 1014 |
| ID0210 | D | CHROMOSOME PARTITION PROTEIN SMC. |
| ID0211 | D | GLUCOSE-INHIBITED DIVISION PROTEIN. |
| ID0212 | D | STAGE V SPORULATION PROTEIN E. |
| ID0213 | D | CELL-SHAPE DETERMINING PROTEIN. |
| ID0214 | D | LATENT NUCLEAR ANTIGEN. |
| ID0215 | D | CELL-DIVISION INITIATION PROTEIN (SEPTUM PLACEMENT). |
| ID0216 | D | CELL-DIVISION INITIATION PROTEIN (SEPTUM FORMATION). |
| ID0217 | D | CELL-DIVISION PROTEIN (SEPTUM FORMATION). |
| ID0218 | D | CELL-DIVISION PROTEIN (SEPTUM FORMATION). |
| ID0219 | D | CHROMOSOME SEGREGATION SMC PROTEIN. |
| ID0220 | D | STAGE II SPORULATION PROTEIN D. |
| ID0221 | D | CELL SHAPE DETERMINING PROTEIN (MREB-LIKE PROTEIN). |
| ID0222 | D | GLUCOSE INHIBITED DIVISION PROTEIN A. |
| ID0223 | D | ATP-BINDING MRP PROTEIN (MRP/NBP35 FAMILY). |
| ID0224 | D | STAGE V SPORULATION PROTEIN E (REQUIRED FOR SPORE CORTEX SYN |
| ID0225 | D | DNA TRANSLOCASE (STAGE III SPORULATION PROTEIN SPOIIIE). |
| ID0226 | D | GLUCOSE-INHIBITED DIVISION PROTEIN. |
| ID0227 | D | CENTROMERE-LIKE FUNCTION INVOLVED IN PORESPORE CHROMOSOME PA |
| ID0228 | D | GLUCOSE-INHIBITED DIVISION PROTEIN. |
| ID0229 | D | SPOIIIE PROTEIN. |
| ID0230 | D | Amino acid sequence of a *Chlamydia trachomatis* protein. |
| ID0231 | D | STAGE V SPORULATION PROTEIN E. |
| ID0232 | D | 186AA LONG HYPOTHETICAL MAF PROTEIN. |
| ID0233 | E | CYSTATHIONINE GAMMA-SYNTHASE (O-SUCCINYLHOMOSERINE (THIOL)-L |
| ID0234 | E | SA1216 PROTEIN. |
| ID0235 | E | RIESKE. |
| ID0236 | E | CEPHALOSPORIN ACYLASE. |
| ID0237 | E | DIAMINOPIMELATE DECARBOXYLASE. |
| ID0238 | E | 5-METHYLTETRAHYDROFOLATE S-HOMOCYSTEINE METHYLTRANSFERASE (EC |
| ID0239 | E | TRYPTOPHAN SYNTHASE (ALPHA SUBUNIT). |
| ID0240 | E | HOMOSYSTEIN METHYL TRANSFERASE. |
| ID0241 | E | GLUTAMATE SYNTHASE (LARGE SUBUNIT). |
| ID0242 | E | TRYPTOPHAN SYNTHASE (BETA SUBUNIT). |
| ID0243 | E | PHOSPHORIBOSYL ANTHRANILATE ISOMERASE. |
| ID0244 | E | HOMOCITRATE SYNTHASE. |
| ID0245 | E | HOMOSYSTEIN METHYL TRANSFERASE. |
| ID0246 | E | ORF starting with ATG of length 417 |
| ID0247 | E | PROLINE OXIDASE (PROLINE DEHYDROHENASE). |
| ID0248 | E | ASPARAGINE SYNTHETASE. |
| ID0249 | E | GAMMA-GLUTAMYL KINASE. |
| ID0250 | E | L-CYSTEINE SULFURTRANSFERASE (IRON-SULFUR COFACTOR SYNTHESIS |
| ID0251 | E | AMINOTRANSFERASE REQUIRED FOR NAD BIOSYNTHESIS (NIFS PROTEIN |
| ID0252 | E | HYPOTHETICAL 38.3 KDA PROTEIN IN PEPT-KATB INTERGENIC REGION |
| ID0253 | E | ORF starting with ATG of length 357 |
| ID0254 | E | AROMATIC AMINO ACID TRANSPORTER. |
| ID0255 | E | FE-S CLUSTER FORMATION PROTEIN. |
| ID0256 | E | GLUTAMINE TRANSPORT ATP-BINDING PROTEIN GLNQ. |
| ID0257 | E | UROCANATE HYDRATASE. |

-continued

| | | |
|---|---|---|
| ID0258 | E | PROBABLE AMINOTRANSFERASE IN KATA 3'REGION (EC 2.6.—.—) (ORF |
| ID0259 | E | DPPA. |
| ID0260 | E | TETRAHYDRODIPICOLINATE SUCCINYLASE. |
| ID0261 | E | ARGININOSUCCINATE SYNTHASE (CITRULLINE-ASPARATE LIGASE) (EC |
| ID0262 | E | INDOLE-3-GLYCEROL PHOSPHATE SYNTHASE (EC 4.1.1.48) (IGPS). |
| ID0263 | E | SA0678 PROTEIN. |
| ID0264 | E | HOMOSERINE DEHYDROGENASE (EC 1.1.1.3). |
| ID0265 | E | LYSINE-SPECIFIC PERMEASE. |
| ID0266 | E | BH0591 PROTEIN. |
| ID0267 | E | PREPHENATE DEHYDROGENASE. |
| ID0268 | E | HISTIDINOL-PHOSPHATE AMINOTRANSFERASE (EC 2.6.1.9) (IMIDAZOL |
| ID0269 | E | HYPOTHETICAL 34.8 KDA PROTEIN PH1048. |
| ID0270 | E | O-ACETYLHOMOSERINE SULFHYDRYLASE. |
| ID0271 | E | *Arabidopsis thaliana* protein fragment SEQ ID NO: 8020. |
| ID0272 | E | PROLINE OXIDASE (PROLINE DEHYDROHENASE). |
| ID0273 | E | FOSFOMYCIN RESISTANCE PROTEIN. |
| ID0274 | E | *Corynebacterium glutamicum* MP protein sequence SEQ ID NO:338 |
| ID0275 | E | ARGININOSUCCINATE LYASE (EC 4.3.2.1). |
| ID0276 | E | HOMOSERINE KINASE (EC 2.7.1.39). |
| ID0277 | E | ASPARTATE AMINOTRANSFERASE. |
| ID0278 | E | PROBABLE CYSTEINE SYNTHASE (EC 4.2.99.8) (O-ACETYLSERINESULF |
| ID0279 | E | GLYCINE DEHYDROGENASE SUBUNIT 1. |
| ID0280 | E | PROLINE DEHYDROGENASE. |
| ID0281 | E | SERINE ACETYLTRANSFERASE (EC 2.3.1.30) (SAT). |
| ID0282 | E | LYSINE DECARBOXYLASE. |
| ID0283 | E | YLMB PROTEIN. |
| ID0284 | E | GLYCINE DEHYDROGENASE SUBUNIT 2. |
| ID0285 | E | PROBABLE GLYCINE DEHYDROGENASE (DECARBOXYLATING) SUBUNIT 1 (E |
| ID0286 | E | BH3148 PROTEIN. |
| ID0287 | E | ORNITHINE AMINOTRANSFERASE (EC 2.6.1.13) (ORNITHINE--OXO-ACI |
| ID0288 | E | HYPOTHETICAL CYCLODEAMINASE Y4TK (EC 4.3.1.—). |
| ID0289 | E | PEPTIDASE T (EC 3.4.11.—) (AMINOTRIPEPTIDASE) (TRIPEPTIDASE) |
| ID0290 | E | ORF starting with ATG of length 1224 |
| ID0291 | E | YURW PROTEIN. |
| ID0292 | E | HYDANTOINASE. |
| ID0293 | E | 3-DEHYDROQUINATE SYNTHASE. |
| ID0294 | E | *S. pneumoniae* phospho-2-dehydro-3-deoxyheptonate aldolase. |
| ID0295 | E | CHORISMATE SYNTHASE (EC 4.6.1.4) (5-ENOLPYRUVYLSHIKIMATE-3-P |
| ID0296 | E | BH1779 PROTEIN. |
| ID0297 | E | UROCANATE HYDRATASE. |
| ID0298 | E | TRANSCRIPTIONAL REGULATOR OF ARGININE METABOLISM EXPRESSION. |
| ID0299 | E | HYPOTHETICAL 63.8 KDA PROTEIN IN SIPU-PBPC INTERGENIC REGION |
| ID0300 | E | AMINOMETHYLTRANFERASE. |
| ID0301 | E | PUTATIVE THREONINE DEHYDRATASE (EC 4.2.1.16) (THREONINE DEAM |
| ID0302 | E | BH2170 PROTEIN. |
| ID0303 | E | AROMATIC AMINO ACID TRANSPORTER. |
| ID0304 | E | GLUTAMATE SYNTHASE (LARGE SUBUNIT). |
| ID0305 | E | AROMATIC AMINO ACID TRANSPORTER. |
| ID0306 | E | AMINOTRANSFERASE. |
| ID0307 | E | 0 DAY NEONATE SKIN CDNA, RIKEN FULL-LENGTH ENCRICHED LIBRARY, |
| ID0308 | E | DIAMINOBUTRYRIC ACID AMINOTRANSFERASE. |
| ID0309 | E | L-SERINE DEHYDRATASE BETA SUBUNIT. |
| ID0310 | E | L-SERINE DEHYDRATASE ALPHA SUBUNIT. |
| ID0311 | E | BH0606 PROTEIN. |
| ID0312 | E | TRYPTOPHAN 2,3-DIOXYGENASE, PUTATIVE. |
| ID0313 | E | XAA-PRO DIPEPTIDASE. |
| ID0314 | E | CYSTEINE SYNTHASE A (EC 4.2.99.8). |
| ID0315 | E | PROBABLE PERMEASE OF ABC TRANSPORTER. |
| ID0316 | E | SA1675 PROTEIN. |
| ID0317 | E | HIGH-AFFINITY PERIPLASMIC GLUTAMINE BINDING PROTEIN. |
| ID0318 | E | ORF starting with ATG length 1137 |
| ID0319 | E | GLYCINE BETAINE TRANSPORT SYSTEM PERMEASE PROTEIN. |
| ID0320 | E | ORF starting with ATG of length 499 |
| ID0321 | E | SHIKIMATE 5-DEHYDROGENASE. |
| ID0322 | E | ARGININOSUCCINATE LYASE (EC 4.3.2.1) (ARGINOSUCCINASE) (ASAL |
| ID0323 | E | PROLIDASE (PROLINE DIPEPTIDASE) (EC 3.4.13.9). |
| ID0324 | E | LEUCINE DEHYDROGENASE (EC 1.4.1.9) (LEUDH). |
| ID0325 | E | ATPASE HOMOLOG GBUA. |
| ID0326 | E | CYSTEIN SYNTHASE. |
| ID0327 | E | BH3306 PROTEIN. |
| ID0328 | E | OLIGOENDOPEPTIDASE F. |
| ID0329 | E | BH1629 PROTEIN. |
| ID0330 | E | 5-METHYLTETRAHYDROFOLATE S-HOMOCYSTEINE METHYLTRANSFERASE (EC |
| ID0331 | E | BH1629 PROTEIN. |
| ID0332 | E | BH0654 PROTEIN. |
| ID0333 | E | LYSINE DECARBOXYLASE. |
| ID0334 | E | GLYCINE BETAINE-BINDING PROTEIN PRECURSOR. |
| ID0335 | E | BH1629 PROTEIN. |
| ID0336 | E | ORF starting with ATG of length 525 |

-continued

| | | |
|---|---|---|
| ID0337 | E | GLUTAMINE ABC TRANSPORTER (GLUTAMINE-BINDING PROTEIN). |
| ID0338 | E | LYSINE DECARBOXYLASE. |
| ID0339 | E | GLUTAMINE ABC TRANSPORTER (INTEGRAL MEMBRANE PROTEIN). |
| ID0340 | E | GLUTAMINE ABC TRANSPORTER (INTEGRAL MEMBRANE PROTEIN). |
| ID0341 | E | ORF starting with ATG of length 492 |
| ID0342 | E | GLUTAMINE SYNTHETASE. |
| ID0343 | E | CYSS. |
| ID0344 | E | CYSTEINE SYNTHASE. |
| ID0345 | E | ORF starting with ATG of length 240 |
| ID0346 | E | CYSTATHIONINE GAMMA-LYASE. |
| ID0347 | E | HYPOTHETICAL 39.7 KDA PROTEIN IN GLNQ-ANSR INTERGENIC REGION |
| ID0348 | E | ASPARATE AMMONIA-LYASE. |
| ID0349 | E | 5-METHYLTETRAHYDROFOLATE S-HOMOCYSTEINE METHYLTRANSFERASE(EC |
| ID0350 | E | ALANINE DEHYDROGENASE (STAGE V SPORULATION PROTEIN N) (EC 1. |
| ID0351 | E | GLUTAMINE SYNTHETASE. |
| ID0352 | E | GLUTAMINE SYNTHETASE (GLUTAMATE--AMMONIA LIGASE) (EC 6.3.1.2 |
| ID0353 | E | *T. vaginalis* homocysteinase # 2. |
| ID0354 | E | BH0774 PROTEIN. |
| ID0355 | E | XAA-PRO DIPEPTIDASE. |
| ID0356 | E | CYSTATHIONINE GAMMA-LYASE. |
| ID0357 | E | NON-ESSENTIAL GENE FOR COMPETENCE (PYRROLINE-5-CARBOXYLATE R |
| ID0358 | E | MLR3804 PROTEIN. |
| ID0359 | E | THERMOSTABLE DIPEPTIDASE BDP. |
| ID0360 | E | N-CARBAMOYL-L-AMINO ACID AMIDOHYDROLASE (AMAB) (EC 3.5.1.). |
| ID0361 | E | THREONINE DEHYDRATASE. |
| ID0362 | E | MLR3804 PROTEIN. |
| ID0363 | E | NAD BIOSYNTHESIS. |
| ID0364 | E | 3-PHOSPHOSHIKIMATE 1-CARBOXYVINYLTRANSFERASE. |
| ID0365 | E | GLUTAMATE DEHYDROGENASE. |
| ID0366 | E | PREPHENATE DEHYDRATASE. |
| ID0367 | E | N-CARBAMOYL-L-AMINO ACID AMIDOHYDROLASE (EC 3.5.1.—) (L-CARB |
| ID0368 | E | 3-PHOSPHOSHIKIMATE 1-CARBOXYVINYLTRANSFERASE. |
| ID0369 | E | HYPOTHETICAL 39.4 KDA OXIDOREDUCTASE IN HOM-MRGA INTERGENIC |
| ID0370 | E | PROBABLE D-SERINE DEHYDRATASE (EC 4.2.1.14) (D-SERINE DEAMIN |
| ID0371 | E | SERINE DEAMINASE (FRAGMENT). |
| ID0372 | E | ANTHRANILATE PHOSPHORIBOSYLTRANSFERASE (EC 2.4.2.18). |
| ID0373 | E | HISTIDINOL DEHYDROGENASE (EC 1.1.1.23). |
| ID0374 | E | ATP PHOSPHORIBOSYLTRANSFERASE (EC 2.4.2.17). |
| ID0375 | E | N-ACETYLORNITHINE AMINOTRANSFERASE (EC 2.6.1.11). |
| ID0376 | E | GLYCINE BETAINE/CARNITINE/CHOLINE ABC TRANSPORTER (ATP-BINDI |
| ID0377 | E | ACETYLORNITHINE DEACETYLASE (EC 3.5.1.16) (ACETYLORNITHINASE |
| ID0378 | E | ORF starting with ATG of length 778 |
| ID0379 | E | GLYCINE DEHYDROGENASE SUBUNIT 2. |
| ID0380 | E | SA0677 PROTEIN. |
| ID0381 | E | CHOLINE ABC TRANSPORTER ATP BINDING PROTEIN. |
| ID0382 | E | ARGININOSUCCINATE LYASE. |
| ID0383 | E | PUTATIVE GLYCINE-BETAINE BINDING PERMEASE PROTEIN. |
| ID0384 | E | ORF starting with ATG of length 564 |
| ID0385 | E | 3-ISOPROPYLMALATE DEHYDROGENASE (EC 1.1.1.85). |
| ID0386 | E | DEF-6 PROTEIN. |
| ID0387 | E | YUSX PROTEIN. |
| ID0388 | E | 3-ISOPROPYLMALATE DEHYDRATASE SMALL SUBUNIT (EC 4.2.1.33). |
| ID0389 | E | 3-ISOPROPYLMALATE DEHYDRATASE LARGE SUBUNIT (EC 4.2.1.33). |
| ID0390 | E | PROBABLE PEPTIDASE YUXL (EC 3.4.21.—). |
| ID0391 | E | ORF starting with ATG of length 612 |
| ID0392 | E | PHOSPHORIBOSYLFORMIMINO-5-AMINOIMIDAZOLE CARBOXAMIDE RIBOTID |
| ID0393 | E | ABC TRANSPORTER (ATP-BINDING PROTEIN). |
| ID0394 | E | PROBABLE AMINO-ACID ABC TRANSPORTER PERMEASE PROTEIN YCKA. |
| ID0395 | E | PROBABLE ABC TRANSPORTER EXTRACELLULAR BINDING PROTEIN YCKB |
| ID0396 | E | HOMOSERINE DEHYDROGENASE. |
| ID0397 | E | ORF starting with ATG of length 492 |
| ID0398 | E | AMINO ACID CARRIER PROTEIN (SODIUM/ALANINE SYMPORTER). |
| ID0399 | E | 3-HYDROXY-3-METHYLGLUTARATE-COA LYASE. |
| ID0400 | E | XAA-PRO DIPEPTIDASE. |
| ID0401 | E | AMIDOTRANSFERASE HISH (EC 2.4.2.—). |
| ID0402 | E | PHOSPHORIBOSYLFORMIMINO-5-AMINOIMIDAZOLE CARBOXAMIDE RIBOTID |
| ID0403 | E | SHIKIMATE KINASE. |
| ID0404 | E | ASPARAGINE SYNTHETASE [GLUTAMINE-HYDROLYZING] 3 (EC 6.3.5.4) |
| ID0405 | E | HYDANTOINASE. |
| ID0406 | E | HYPOTHETICAL 39.5 KDA PROTEIN. |
| ID0407 | E | ORF starting with ATG of length 465 |
| ID0408 | E | CYSTEINE SYNTHASE. |
| ID0409 | E | PEPTIDASE, M20/M25/M40 FAMILY. |
| ID0410 | E | ILVA. |
| ID0411 | E | HYPOTHETICAL 33.1 KDA PROTEIN IN MTLD-SIPU INTERGENIC REGION |
| ID0412 | E | GAMMA-GLUTAMYL PHOSPHATE REDUCTASE (GPR) (EC 1.2.1.41) (GLUT |
| ID0413 | E | CYCLASE. |
| ID0414 | E | HISTIDINE BIOSYNTHESIS BIFUNCTIONAL PROTEIN HISIE (INCLUDES: |
| ID0415 | E | SA0010 PROTEIN. |

-continued

| | | |
|---|---|---|
| ID0416 | E | DIAMINOPIMELATE DECARBOXYLASE. |
| ID0417 | E | BH3875 PROTEIN. |
| ID0418 | E | PROBABLE PEPTIDASE YUXL (EC 3.4.21.—). |
| ID0419 | E | ASPARTATE AMMONIA-LYASE (EC 4.3.1.1) (ASPARTASE). |
| ID0420 | E | PROBABLE AMINO-ACID ABC TRANSPORTER ATP-BINDING PROTEIN Y4TH |
| ID0421 | E | ACETYLORNITHINE AMINOTRANSFERASE (EC 2.6.1.11) (ACOAT). |
| ID0422 | E | ORNITHINE AMINOTRANSFERASE. |
| ID0423 | E | BH3875 PROTEIN. |
| ID0424 | E | DIAMINOPIMELATE EPIMERASE. |
| ID0425 | E | MEMBRANE PERMEASE OPUCD. |
| ID0426 | E | AMINOTRANSFERASE REQUIRED FOR NAD BIOSYNTHESIS (NIFS PROTEIN |
| ID0427 | E | GLYCINE DEHYDROGENASE SUBUNIT 2. |
| ID0428 | E | GLYCINE DEHYDROGENASE SUBUNIT 1. |
| ID0429 | E | ORNITHINE AMINOTRANSFERASE (EC 2.6.1.13) (ORNITHINE--OXO-ACI |
| ID0430 | E | 3-DEHYDROQUINATE SYNTHASE. |
| ID0431 | E | HISTIDASE (HISTIDINE AMMONIA-LYASE) (EC 4.3.1.3). |
| ID0432 | E | 3-PHOSPHOSHIKIMATE 1-CARBOXYVINYLTRANSFERASE. |
| ID0433 | E | BH0606 PROTEIN. |
| ID0434 | E | SHIKIMATE KINASE. |
| ID0435 | E | ORF starting with ATG of length 327 |
| ID0436 | EF | CARBAMOYL-PHOSPHATE SYNTHETASE (CATALYTIC SUBUNIT). |
| ID0437 | EF | CARBAMOYL-PHOSPHATE SYNTHETASE (CATALYTIC SUBUNIT). |
| ID0438 | EF | CARBAMOYL-PHOSPHATE SYNTHASE, PYRIMIDINE-SPECIFIC, SMALL CHA |
| ID0439 | EF | CARBAMOYL-PHOSPHATE SYNTHETASE (CATALYTIC SUBUNIT). |
| ID0440 | EF | ARGININE SPECIFIC CARBAMOYL-PHOSPHATE SYNTHASE SUBUNIT A (EC |
| ID0441 | EF | CARBAMOYL-PHOSPHATE SYNTHETASE (CATALYTIC SUBUNIT). |
| ID0442 | EF | CARBAMOYL-PHOSPHATE SYNTHETASE (CATALYTIC SUBUNIT). |
| ID0443 | EF | ORF starting with ATG of length 462 |
| ID0444 | EF | CARBAMOYL-PHOSPHATE SYNTHASE LARGE SUBUNIT. |
| ID0445 | EF | ARGININE SPECIFIC CARBAMOYL-PHOSPHATE SYNTHASE SUBUNIT B (EC |
| ID0446 | EF | *H. pylori* cytoplasmic protein 04ge10816orf2. |
| ID0447 | EF | ARGININE SPECIFIC CARBAMOYL-PHOSPHATE SYNTHASE SUBUNIT B (EC |
| ID0448 | EG | HYPOTHETICAL 69.4 KDA PROTEIN IN PERR-ARGF INTERGENIC REGION |
| ID0449 | EG | HYPOTHETICAL 69.4 KDA PROTEIN IN PERR-ARGF INTERGENIC REGION |
| ID0450 | EH | KETOL-ACID REDUCTOISOMERASE (EC 1.1.1.86). |
| ID0451 | EH | ACETOLACTATE SYNTHASE LARGE SUBUNIT. |
| ID0452 | EH | KETOL-ACID REDUCTOISOMERASE (EC 1.1.1.86). |
| ID0453 | EH | ACETOLACTATE SYNTHASE LARGE SUBUNIT (EC 4.1.3.18) (AHAS) (ACE |
| ID0454 | EH | ANTHRANILATE SYNTHASE. |
| ID0455 | EH | MYO-INOSITOL CATABOLISM. |
| ID0456 | EH | ANTHRANILATE SYNTHASE BETA SUBUNIT. |
| ID0457 | EH | PARA-AMINOBENZOATE/ANTHRANILATE SYNTHASE GLUTAMINE AMIDOTRAN |
| ID0458 | EH | 4-AMINO-4-DEOXYCHORISMATE LYASE (EC 4.). |
| ID0459 | EH | PARA-AMINOBENZOATE SYNTHASE COMPONENT I (EC 4.1.3.). |
| ID0460 | EH | ANTHRANILATE SYNTHASE COMPONENT I (EC 4.1.3.27). |
| ID0461 | EH | ORF starting with ATG of length 1008 |
| ID0462 | EH | MYO-INOSITOL CATABOLISM. |
| ID0463 | EH | PARA-AMINOBENZOATE/ANTHRANILATE SYNTHASE GLUTAMINE AMIDOTRAN |
| ID0464 | EH | 4-AMINO-4-DEOXYCHORISMATE LYASE (EC 4.—.—.—) (ADC LYASE) (AD |
| ID0465 | EH | ORF starting with ATG of length 840 |
| ID0466 | EH | ORF starting with TTG or GTG of length 546 |
| ID0467 | EHR | NA+/MYO-INOSITOL CONTRANSPORTER. |
| ID0468 | EHR | HYPOTHETICAL 55.0 KDA PROTEIN IN EPR-GALK INTERGENIC REGION. |
| ID0469 | EHR | HYPOTHETICAL PROTEIN HI1728. |
| ID0470 | EHR | OSMOREGULATED PROLINE TRANSPORTER (SODIUM/PROLINE SYMPORTER) |
| ID0471 | EHR | NA+/MYO-INOSITOL COTRANSPORTER. |
| ID0472 | EHR | ORF starting with ATG of length 1269 |
| ID0473 | EHR | BH1820 PROTEIN. |
| ID0474 | EJ | L-ASPARGINASE (EC 3.5.1.1) (L-ASPARAGINE AMIDOHYDROLASE). |
| ID0475 | EM | PROBABLE 5-DEHYDRO-4-DEOXYGLUCARATE DEHYDRATASE (EC 4.2.1.41 |
| ID0476 | EM | PROBABLE 5-DEHYDRO-4-DEOXYGLUCARATE DEHYDRATASE (EC 4.2.1.41 |
| ID0477 | EM | HYPOTHETICAL 33.3 KDA PROTEIN IN PERR-ARGF INTERGENIC REGION |
| ID0478 | EP | OLIGOPEPTIDE ABC TRANSPORTER (OLIGOPEPTIDE-BINDING PROTEIN). |
| ID0479 | EP | ORF starting with ATG of length 408 |
| ID0480 | EP | DIPEPTIDE TRANSPORT SYSTEM PERMEASE PROTEIN DPPB. |
| ID0481 | EP | BH1159 PROTEIN. |
| ID0482 | EP | DIPEPTIDE TRANSPORT SYSTEM PERMEASE PROTEIN DPPC. |
| ID0483 | EP | OLIGOPEPTIDE ABC TRANSPORTER (OLIGOPEPTIDE-BINDING PROTEIN). |
| ID0484 | EP | OLIGOPEPTIDE ABC TRANSPORTER (OLIGOPEPTIDE-BINDING PROTEIN). |
| ID0485 | EP | OLIGOPEPTIDE ABC TRANSPORTER (ATP-BINDING PROTEIN). |
| ID0486 | EP | 420AA LONG HYPOTHETICAL OLIGOPEPTIDE TRANSPORT ATP-BINDING P |
| ID0487 | EP | OLIGOPEPTIDE ABC TRANSPORTER (PERMEASE). |
| ID0488 | EP | OLIGOPEPTIDE ABC TRANSPORTER (OLIGOPEPTIDE-BINDING PROTEIN). |
| ID0489 | EP | OPPB PROTEIN. |
| ID0490 | EP | OLIGOPEPTIDE ABC TRANSPORTER (ATP-BINDING PROTEIN). |
| ID0491 | EP | OLIGOPEPTIDE ABC TRANSPORTER (OLIGOPEPTIDE-BINDING PROTEIN). |
| ID0492 | EP | OLIGOPEPTIDE TRANSPORT ATP-BINDING PROTEIN APPF. |
| ID0493 | EP | *B. subtilis* oppC membrane protein. |
| ID0494 | EP | ORF starting with ATG of length 768 |

-continued

| | | |
|---|---|---|
| ID0495 | EP | OLIGOPEPTIDE ABC TRANSPORTER PERMEASE PROTEIN. |
| ID0496 | EP | OGILOPEPTIDE-BINDING PROTEIN APPA PRECURSOR. |
| ID0497 | EP | OLIGOPEPTIDE ABC TRANSPORTER ATP-BINDING PROTEIN. |
| ID0498 | EP | DIPEPTIDE-BINDING PROTEIN DPPE PRECURSOR. |
| ID0499 | EP | OLIGOPEPTIDE ABC TRANSPORTER ATP-BINDING PROTEIN HOMOLOG. |
| ID0500 | EP | PROBABLE OLIGOPEPTIDE TRANSPORT ATP-BINDING PROTEIN APPF (FR |
| ID0501 | EP | OLIGOPEPTIDE ABC TRANSPORTER ATP-BINDING PROTEIN. |
| ID0502 | EP | OLIGOPEPTIDE ABC TRANSPORTER (PERMEASE). |
| ID0503 | EP | OLIGOPEPTIDE ABC TRANSPORTER (ATP-BINDING PROTEIN). |
| ID0504 | EP | OLIGOPEPTIDE ABC TRANSPORTER (ATP-BINDING PROTEIN). |
| ID0505 | EP | DIPEPTIDE TRANSPORT ATP-BINDING PROTEIN DPPD. |
| ID0506 | EP | *Enterococcus faecalis* antigenic polypeptide fragment EF045. |
| ID0507 | EP | OLIGOPEPTIDE ABC TRANSPORTER (PERMEASE). |
| ID0508 | EP | ORF starting with ATG of length 711 |
| ID0509 | EP | DIPEPTIDE ABC TRANSPORTER (DIPEPTIDE-BINDING PROTEIN). |
| ID0510 | EP | OLIGOPEPTIDE ABC TRANSPORTER (PERMEASE). |
| ID0511 | EP | OLIGOPEPTIDE ABC TRANSPORTER (PERMEASE). |
| ID0512 | EP | DPPD PROTEIN. |
| ID0513 | EP | OLIGOPEPTIDE ABC TRANSPORTER (OLIGOPEPTIDE-BINDING PROTEIN). |
| ID0514 | EP | OLIGOPEPTIDE ABC TRANSPORTER (OLIGOPEPTIDE-BINDING PROTEIN). |
| ID0515 | EP | DIPEPTIDE ABC TRANSPORTER (PERMEASE). |
| ID0516 | EP | DPPB PROTEIN. |
| ID0517 | EP | DIPEPTIDE TRANSPORTER PROTEIN DPPA (FRAGMENT). |
| ID0518 | EP | DIPEPTIDE TRANSPORT SYSTEM PERMEASE PROTEIN DPPB. |
| ID0519 | EP | ORF starting wiht ATG of length 1161 |
| ID0520 | EP | OLIGOPEPTIDE ABC TRANSPORTER (PERMEASE). |
| ID0521 | EP | OLIGOPEPTIDE TRANSPORT SYSTEM INTEGRAL MEMBRANE PROTEIN. |
| ID0522 | EP | DIPEPTIDE ABC TRANSPORTER (PERMEASE). |
| ID0523 | EP | OLIGOPEPTIDE ABC TRANSPORTER (PERMEASE). |
| ID0524 | EP | OLIGOPEPTIDE ABC TRANSPORTER (OLIGOPEPTIDE-BINDING PROTEIN). |
| ID0525 | EP | OLIGOPEPTIDE ABC TRANSPORTER (PERMEASE). |
| ID0526 | EP | OLIGOPEPTIDE ABC TRANSPORTER (ATP-BINDING PROTEIN). |
| ID0527 | EP | OLIGO/DIPEPTIDE TRANSPORT, ATP BINDING PROTEIN CARBOXY-END |
| ID0528 | EP | OPPF PROTEIN. |
| ID0529 | EP | SA0851 PROTEIN. |
| ID0530 | EP | OLIGOPEPTIDE ABC TRANSPORTER, ATP-BINDING PROTEIN. |
| ID0531 | EP | ORF starting with ATG of length 708 |
| ID0532 | EPGR | *Corynebacterium glutamicum* MCT protein SEQ ID NO:522. |
| ID0533 | ER | GLUTAMATE SYNTHASE SMALL CHAIN. |
| ID0534 | ER | ZINC-CONTAINING ALCOHOL DEHYDROGENASE. |
| ID0535 | ER | GLUTAMATE SYNTHASE, BETA SUBUNIT. |
| ID0536 | ER | DEHYDROGENASE. |
| ID0537 | ER | *Arabidopsis thaliana* protein fragment SEQ ID NO: 1993. |
| ID0538 | ER | SORBITOL DEHYDROGENASE (EC 1.1.1.14). |
| ID0539 | ER | SORBITOL DEHYDROGENASE (EC 1.1.1.14). |
| ID0540 | ER | SORBITOL DEHYDROGENASE (EC 1.1.1.14). |
| ID0541 | ER | YTVP. |
| ID0542 | ER | GLUTAMATE SYNTHASE (SMALL SUBUNIT). |
| ID0543 | ER | GLUTAMATE SYNTHASE (SMALL SUBUNIT). |
| ID0544 | ER | FISSION YEAST (FRAGMENT). |
| ID0545 | FE | PHOSPHORIBOSYL PYROPHOSPHATE SYNTHETASE (EC 2.7.6.1). |
| ID0546 | FE | PHOSPHORIBOSYL PYROPHOSPHATE SYNTHETASE (EC 2.7.6.1). |
| ID0547 | FE | PHOSPHORIBOSYL PYROPHOSPHATE SYNTHETASE (EC 2.7.6.1). |
| ID0548 | F | PHOSPHORIBOSYLGLYCINAMIDE SYNTHETASE. |
| ID0549 | F | ORF starting wiht ATG of length 531 |
| ID0550 | F | PHOSPHORIBOSYLAMINOIMIDAZOLE SYNTHETASE. |
| ID0551 | F | PHOSPHORIBOSYLGLYCINAMIDE FORMYLTRANSFERASE. |
| ID0552 | F | GUANYLATE KINASE (EC 2.7.4.8). |
| ID0553 | F | CYTOSINE PERMEASE. |
| ID0554 | F | PHOSPHORIBOSYLFORMYLGLYCINAMIDINE SYNTHETASE I. |
| ID0555 | F | DIHYDROOROTASE. |
| ID0556 | F | URACIL TRANSPORTER (PERMEASE). |
| ID0557 | F | PHOSPHORIBOSYLAMINOIMIDAZOLECARBOXAMIDE FORMYLTRANSFERASE/IM |
| ID0558 | F | THIAMIN BIOSYNTHESIS. |
| ID0559 | F | TGLUTAMINE AMIDOTRANSFERASE |
| ID0560 | F | PHOSPHORIBOSYLAMINOIMIDAZOLE SYNTHETASE. |
| ID0561 | F | PHOSPHORIBOSYLGLYCINAMIDE FORMYLTRANSFERASE. |
| ID0562 | F | INOSINE-URIDINE NUCLEOSIDE HYDROLASE. |
| ID0563 | F | DEOXYCYTIDINE TRIPHOSPHATE DEAMINASE. |
| ID0564 | F | MTA/SAH NUCLEOSIDASE (P46). |
| ID0565 | F | ASPARTATE CARBAMOYLTRANSFERASE. |
| ID0566 | F | DIHYDROOROTASE (EC 3.5.2.3) (DHOASE). |
| ID0567 | F | ADENYLOSUCCINATE LYASE (EC 4.3.2.2) (ADENYLOSUCCINASE) (ASL) |
| ID0568 | F | METHYLPHOSPHOTRIESTER-DNA ALKYLTRANSFERASE. |
| ID0569 | F | THYMIDYLATE KINASE (EC 2.7.4.9). |
| ID0570 | F | URACIL PHOSPHORIBOSYLTRANSFERASE (EC 2.4.2.9) (UMP PYROPHOSP |
| ID0571 | F | PUR OPERON REPRESSOR. |
| ID0572 | F | CYTOSINE PERMEASE. |

-continued

| | | |
|---|---|---|
| ID0573 | F | TRANSCRIPTIONAL REPRESSOR OF THE PURINE OPERON. |
| ID0574 | F | THYMIDYLATE SYNTHASE B (EC 2.1.1.45). |
| ID0575 | F | ORF starting with ATG of length 528 |
| ID0576 | F | PHOSPHORIBOSYLAMINOIMIDAZOLECARBOXAMIDE FORMYLTRANSFERASE/IM |
| ID0577 | F | FORMYLTETRAHYDROFOLATE DEFORMYLASE. |
| ID0578 | F | ORF starting with ATG of length 1554 |
| ID0579 | F | THYMIDYLATE SYNTHASE B (EC 2.1.1.45). |
| ID0580 | F | BH3453 PROTEIN. |
| ID0581 | F | OROTIDINE 5'-PHOSPHATE DECARBOXYLASE. |
| ID0582 | F | OROTATE PHOSPHORIBOSYLTRANSFERASE. |
| ID0583 | F | DIHYDROOROTATE DEHYDROGENASE, CATALYTIC SUBUNIT (EC 1.3.3.1) |
| ID0584 | F | PHOSPHORIBOSYLFORMYLGLYCINAMIDINE SYNTHETASE I. |
| ID0585 | F | PHOSPHORIBOSYLFORMYLGLYCINAMIDINE SYNTHETASE II. |
| ID0586 | F | D-HYDANTOINASE (EC 3.5.2.2) (DIHYDROPYRIMDINASE) (DHPASE). |
| ID0587 | F | PROBABLE OXIDOREDUCTASE. |
| ID0588 | F | XANTHINE PHOSPHORIBOSYLTRANSFERASE. |
| ID0589 | F | PUTATIVE INOSINE-URIDINE PREFERRING NUCLEOSIDE HYROLASE. |
| ID0590 | F | NUCLEOSIDE TRANSPORTER. |
| ID0591 | F | BH1014 PROTEIN. |
| ID0592 | F | ADENINE DEAMINASE (EC 3.5.4.2) (ADENASE) (ADENINE AMINASE). |
| ID0593 | F | ADENINE DEAMINASE. |
| ID0594 | F | PYRIMIDINE-NUCLEOSIDE PHOSPHORYLASE (EC 2.4.2.2). |
| ID0595 | F | ADENYLATE KINASE (EC 2.7.4.3) (ATP-AMP TRANSPHOSPHORYLASE). |
| ID0596 | F | ADENINE DEAMINASE. |
| ID0597 | F | LATE COMPETENCE OPERON REQUIRED FOR DNA BINDING AND UPTAKE. |
| ID0598 | F | THYMIDINE KINASE (EC 2.7.1.21). |
| ID0599 | F | CYTOSINE PERMEASE/TRANSPORT. |
| ID0600 | F | S. pneumoniae adenylosuccinate lyase. |
| ID0601 | F | ADENYLOSUCCINATE SYNTHETASE. |
| ID0602 | F | GMP SYNTHASE [GLUTAMINE-HYDROLYZING] (EC 6.3.5.2) (GLUTAMINE |
| ID0603 | F | ADENINE PHOSPHORIBOSYLTRANSFERASE. |
| ID0604 | F | NUCLEOTIDASE PRECURSOR. |
| ID0605 | F | ORF starting with ATG of length 247 |
| ID0606 | F | GMP SYNTHETASE. |
| ID0607 | F | CYTIDYLATE KINASE (EC 2.7.4.14) (CK) (CYTIDINE MONOPHOSPHATE |
| ID0608 | F | RIBONUCLEOSIDE-DIPHOSPHATE REDUCTASE BETA CHAIN (EC 1.17.4.1 |
| ID0609 | F | RIBONUCLEOSIDE-DIPHOSPHATE REDUCTASE ALPHA CHAIN (EC 1.17.4. |
| ID0610 | F | BH1015 PROTEIN. |
| ID0611 | F | BH1015 PROTEIN. |
| ID0612 | F | MTA/SAH NUCLEOSIDASE (P46). |
| ID0613 | F | TRANSCRIPTIONAL ATTENUATION OF THE PYRIMIDINE OPERON/URACILP |
| ID0614 | F | URACIL TRANSPORTER (PERMEASE). |
| ID0615 | F | PHOSPHORIBOSYLAMINOIMIDAZOLE SUCCINOCARBOXAMIDE SYNTHETASE. |
| ID0616 | F | ORF starting with ATG of length 1377 |
| ID0617 | F | ADENYLOSUCCINATE LYASE. |
| ID0618 | F | PHOSPHORIBOSYLAMINOIMIDAZOLE SUCCINOCARBOXAMIDE SYNTHETASE. |
| ID0619 | F | BH0627 PROTEIN. |
| ID0620 | F | PHOSPHORIBOSYLFORMLGLYCINAMIDE SYNTHASE I (EC 6.3.5.3) (F |
| ID0621 | F | FGAM SYNTHETASE (FRAGMENT). |
| ID0622 | F | PHOSPHORIBOSYLFORMYLGLYCINAMIDINE SYNTHETASE I. |
| ID0623 | F | PHOSPHORIBOSYLFORMYLGLYCINAMIDINE SYNTHETASE I. |
| ID0624 | F | URACIL TRANSPORTER (PERMEASE). |
| ID0625 | F | PHOSPHORIBOSYLAMINOIMIDAZOLE SUCCINOCARBOXAMIDE SYNTHETASE. |
| ID0626 | F | BH0627 PROTEIN. |
| ID0627 | F | PHOSPHORIBOSYLFORMYLGLYCINAMIDINE SYNTHETASE II. |
| ID0628 | F | BH1014 PROTEIN. |
| ID0629 | F | DNA TOPOLOGY MODULATION PROTEIN FLAR-RELATED PROTEIN. |
| ID0630 | F | HYPOTHETICAL 43.5 KDA PROTEIN. |
| ID0631 | F | ADENINE PHOSPHORIBOSYLTRANSFERASE. |
| ID0632 | FGR | HIT-LIKE PROTEIN INVOLVED IN CELL-CYCLE REGULATION. |
| ID0633 | FGR | ORF starting with ATG of length 333 |
| ID0634 | FGR | CELL-CYCLE REGULATION HISTIDINE TRIAD (HIT FAMILY). |
| ID0635 | FJ | HYPOTHETICAL 17.8 KDA PROTEIN IN SERS-DNAH INTERGENIC REGION |
| ID0636 | FJ | YKOA. |
| ID0637 | FR | BH1692 PROTEIN. |
| ID0638 | FR | HYPOTHETICAL PROTEIN MTH1505. |
| ID0639 | FR | E. coli cytosine-deaminase. |
| ID0640 | GC | HYPOTHETICAL GLYCOSYL TRANSFERASE. |
| ID0641 | GE | GLUCONATE PERMEASE. |
| ID0642 | GE | BH3897 PROTEIN. |
| ID0643 | GE | LOW-AFFINITY GLUCONATE TRANSPORTER (GLUCONATE PERMEASE) (GNT |
| ID0644 | GE | BH3897 PROTEIN. |
| ID0645 | GE | GLUCONATE PERMEASE. |
| ID0646 | GE | PUTATIVE GLUCONATE PERMEASE (FRAGMENT). |
| ID0647 | GE | GNTP (GLUCONATE PERMEASE). |
| ID0648 | GE | PUTATIVE GLUCONATE PERMEASE (FRAGMENT). |
| ID0649 | GE | GLUCONATE PERMEASE. |
| ID0650 | GE | GNTP (GLUCONATE PERMEASE). |

-continued

| | | |
|---|---|---|
| ID0651 | GE | BH3897 PROTEIN. |
| ID0652 | GEPR | BH1161 PROTEIN. |
| ID0653 | GEPR | MULTIDRUG RESISTANCE EFFLUX PUMP. |
| ID0654 | GEPR | BH1161 PROTEIN. |
| ID0655 | GEPR | PUTATIVE SUGAR EFFLUX TRANSPORTER DR1322. |
| ID0656 | GEPR | ORF starting with ATG of length 432 |
| ID0657 | GEPR | ORF starting with ATG of length 534 |
| ID0658 | GEPR | ORF starting with ATG of length 1077 |
| ID0659 | GEPR | ORF starting with ATG of length 735 |
| ID0660 | GEPR | ORF starting with ATG of length 1092 |
| ID0661 | GEPR | MULTIDRUG RESISTANCE PROTEIN 2 (MULTIDRUG-EFFLUX TRANSPORTER |
| ID0662 | GEPR | MULTIDRUG RESISTANCE PROTEIN 2 (MULTIDRUG-EFFLUX TRANSPORTER |
| ID0663 | GEPR | ORF starting with ATG of length 885 |
| ID0664 | GEPR | HYPOTHETICAL 44.9 KDA PROTEIN. |
| ID0665 | GEPR | TRANSPORTER. |
| ID0666 | GEPR | HOMOLOGUE OF MULTIDRUG RESISTANCE PROTEIN B, EMRB, OF *E. COL* |
| ID0667 | GER | BH0725 PROTEIN. |
| ID0668 | GER | ORF starting with ATG of length 522 |
| ID0669 | GER | HYPOTHETICAL 33.6 KDA PROTEIN IN CSPC-NAP INTERGENIC REGION. |
| ID0670 | GER | BH1931 PROTEIN. |
| ID0671 | G | LACTOSE TRANSPORT SYSTEM PERMEASE PROTEIN LACG. |
| ID0672 | G | PROBABLE ABC-TRANSPORT PROTEIN, INNER MEMBRANE COMPONENT. |
| ID0673 | G | PUTATIVE TRANSPORT SYSTEM INNER MEMBRANE PROTEIN. |
| ID0674 | G | CONSERVED HYPOTHETICAL PROTEIN. |
| ID0675 | G | PUTATIVE PTS ENZYME III. |
| ID0676 | G | PHOSPHOENOLPYRUVATE MUTASE. |
| ID0677 | G | GALACTOKINASE. |
| ID0678 | G | L-ARABINOSE ABC TRANSPORTER (ATP-BINDING PROTEIN). |
| ID0679 | G | L-ARABINOSE MEMBRANE PERMEASE. |
| ID0680 | G | PUTATIVE TRANSKETOLASE N-TERMINAL SECTION (EC 2.2.1.1) (TK). |
| ID0681 | G | HYPOTHETICAL 37.6 KDA PROTEIN. |
| ID0682 | G | *Arabidopsis thaliana* protein fragment SEQ ID NO: 43508. |
| ID0683 | G | Lung cancer associated polypeptide sequence SEQ ID 769. |
| ID0684 | G | *Paenibacillus pabuli* 2,6-beta-D-fructan hydrolase. |
| ID0685 | G | *Streptococcus pneumoniae* photomutase yhxB. |
| ID0686 | G | SUGAR ABC TRANSPORTER (PERMEASE). |
| ID0687 | G | BETA-GLUCOSIDASE (EC 3.2.1.21). |
| ID0688 | G | XYLOSIDASE/ARABINOSIDASE [INCLUDES: BETA-XYLOSIDASE (EC 3.2. |
| ID0689 | G | ALPHA-GLUCURONIDASE. |
| ID0690 | G | RHAMNULOKINASE. |
| ID0691 | G | SA0233 PROTEIN. |
| ID0692 | G | SUGAR HYDROLASE. |
| ID0693 | G | ORF starting with ATG of length 348 |
| ID0694 | G | ALGM1. |
| ID0695 | G | TRANSMEMBRANE LIPOPROTEIN. |
| ID0696 | G | *S. pneumoniae* derived protein #253. |
| ID0697 | G | PHOSPHOENOLPYRUVATE-PROTEIN PHOSPHOTRANSFERASE (EC 2.7.3.9) ( |
| ID0698 | G | ALTRONATE HYDROLASE. |
| ID0699 | G | GLUCONOKINASE (EC 2.7.1.12) (GLUCONATE KINASE). |
| ID0700 | G | ALPHA-GLUCOSIDASE. |
| ID0701 | G | PHOSPHO-CELLOBIASE (EC 3.2.1.—). |
| ID0702 | G | ORF starting with ATG of length 906 |
| ID0703 | G | YBCL PROTEIN. |
| ID0704 | G | ABC TRANSPORTER SUGAR PERMEASE. |
| ID0705 | G | ABC TRANSPORTER SUGAR PERMEASE. |
| ID0706 | G | BETA-GALACTOSIDASE. |
| ID0707 | G | PUTATIVE N-ACETYLMANNOSAMINE-6-P EPIMERASE. |
| ID0708 | G | GLUCONATE-6-PHOSPHATE DEHYDROGENASE, DECARBOXYLATING. |
| ID0709 | G | BH1117 PROTEIN. |
| ID0710 | G | PUTATIVE GLUTAMYL-AMINOPEPTIDASE (FRAGMENT). |
| ID0711 | G | ENDO-1,4-BETA-GLUCANASE. |
| ID0712 | G | Non-maltogenic exoamylase amino acid sequence. |
| ID0713 | G | Non-maltogenic exoamylase amino acid sequence. |
| ID0714 | G | ENOLASE (EC 4.2.1.11) (2-PHOSPHOGLYCERATE DEHYDRATASE) (2-PH |
| ID0715 | G | ENOLASE (2-PHOSPHOGLYCERATE DEHYDRATASE (EC 4.2.1.11). |
| ID0716 | G | *Enterococcus faecalis* protein EF048. |
| ID0717 | G | XYLQ. |
| ID0718 | G | PROBABLE SUGAR TRANSPORT PROTEIN (PERMEASE). |
| ID0719 | G | BH1905 PROTEIN. |
| ID0720 | G | PROBABLE FRUCTOSE-BISPHOSPHATE ALDOLASE 2 (EC 4.1.2.13). |
| ID0721 | G | SPERMIDIN/PUTRESCINE TRANSPORT ATP-BINDING PROTEIN POTA. |
| ID0722 | G | 6-PHOSPHO-BETA-GLUCOSIDASE. |
| ID0723 | G | SUGAR TRANSPORT SYSTEM (PERMEASE) (BINDING PROTEIN DEPENDENT |
| ID0724 | G | HYPOTHETICAL 38.4 KDA PROTEIN IN DPPE-HMP INTERGENIC REGION. |
| ID0725 | G | PROBABLE ABC-TRANSPORT PROTEIN, INNER MEMBRANE COMPONENT. |
| ID0726 | G | BETA-GLUCOSIDASE. |
| ID0727 | G | HYPOTHETICAL 48.4 KDA PROTEIN. |
| ID0728 | G | MALTOSE TRANSPORTOR ATP-BINDING PROTEIN. |
| ID0729 | G | SUGAR ABC TRANSPORTER (PERMEASE). |

-continued

| | | |
|---|---|---|
| ID0730 | G | PUTATIVE CARBOXYVINYL-CARBOXYPHOSPHONATE PHOSPHORYLMUTASE (EC |
| ID0731 | G | PTS SYSTEM, FRUCTOSE-SPECIFIC IIABC COMPONENT (FRUA-1). |
| ID0732 | G | PTS SYSTEM, MANNITOL-1-PHOSPHATE DEHYDROGENASE (ENZYME III). |
| ID0733 | G | SUCROSE-6-P HYDROLASE. |
| ID0734 | G | PUTATIVE SUCROSE-SPECIFIC PTS PERMEASE, ENZYME II. |
| ID0735 | G | DEOXYPHOSPHOGLUCONATE ALDOLASE. |
| ID0736 | G | TRANSMEMBRANE LIPOPROTEIN. |
| ID0737 | G | SUGAR ABC TRANSPORTER (PERMEASE). |
| ID0738 | G | ENDO-1,4-BETA-XYLANASE. |
| ID0739 | G | SUGAR TRANSPORT SYSTEM (PERMEASE) (BINDING PROTEIN DEPENDENT |
| ID0740 | G | *S. pneumoniae* derived protein #302. |
| ID0741 | G | FRUCTOSE BISPHOSPHATE ALDOLASE. |
| ID0742 | G | BH1074 PROTEIN. |
| ID0743 | G | SA0233 PROTEIN. |
| ID0744 | G | ALPHA-GALACTOSIDASE. |
| ID0745 | G | URONATE ISOMERASE (EC 5.3.1.12) (GLUCURONATE ISOMERASE) (URO |
| ID0746 | G | ORF starting with ATG of length 633 |
| ID0747 | G | endo 1,5 alpha-L-arabinase |
| ID0748 | G | BETA-XYLOSIDASE / ALPHA-L-ARABINOSIDASE. |
| ID0749 | G | FBAA. |
| ID0750 | G | ORF starting with ATG of length 558 |
| ID0751 | G | ALPHA-GALACTOSIDASE (EC 3.2.1.22) (MELIBIASE). |
| ID0752 | G | ALPHA-GALACTCSIDASE (EC 3.2.1.22) (MELIBIASE). |
| ID0753 | G | 6-PHOSPHO-BETA-GLUCOSIDASE. |
| ID0754 | G | L-ARABINOSE MEMBRANE PERMEASE. |
| ID0755 | G | PTS SYSTEM, CELLOBIOSE-SPECIFIC IIA COMPONENT (EIIA-CEL) (CE |
| ID0756 | G | *Streptococcus pneumoniae* type 4 protein sequence #56. |
| ID0757 | G | ALPHA-GALACTOSIDASE (EC 3.2.1.22) (MELIBIASE). |
| ID0758 | G | XYLOSE ISOMERASE (EC 5.3.1.5). |
| ID0759 | G | BH1878 PROTEIN. |
| ID0760 | G | LIPOPROTEIN. |
| ID0761 | G | TRANSMEMBRANE LIPOPROTEIN. |
| ID0762 | G | ABC TRANSPORTER (PERMIASE). |
| ID0763 | G | ENDO-1,4-BETA-GLUCANASE. |
| ID0764 | G | 362AA LONG HYPOTHETICAL MALTOSE/MALTODEXTRIN TRANSPORT ATP-B |
| ID0765 | G | FRUCTOKINASE. |
| ID0766 | G | BH1117 PROTEIN. |
| ID0767 | G | LACTOSE TRANSPORT SYSTEM (PERMEASE). |
| ID0768 | G | ORF starting with ATG of length 666 |
| ID0769 | G | GLUCOSIDASE. |
| ID0770 | G | SUGAR TRANSPORT SYSTEM (PERMEASE) (BINDING PROTEIN DEPENDENT |
| ID0771 | G | SULFATE ABC TRANSPORTER, ATP-BINDING PROTEIN. |
| ID0772 | G | 2,3-BISPHOSPHOGLYCERATE-INDEPENDENT PHOSPHOGLYCERATE MUTASE. |
| ID0773 | G | LIPOPROTEIN. |
| ID0774 | G | PTS SYSTEM, FRUCTOSE-SPECIFIC IIBC COMPONENT (EIIBC-FRU) (FR |
| ID0775 | G | PHOSPHOTRANSFERASE SYSTEM (PTS) FRUCTOSE-SPECIFIC ENZYME IIB |
| ID0776 | G | PHOSPHOGLYCERATE KINASE (EC 2.7.2.3). |
| ID0777 | G | TRIOSEPHOSPHATE ISOMERASE (EC 5.3.1.1) (TIM). |
| ID0778 | G | ORF starting with ATG of length 774 |
| ID0779 | G | PHOSPHOMANNOMUTASE. |
| ID0780 | G | Recombinant glucose-6-phosphate dehydrogenase. |
| ID0781 | G | MELIBIASE (ALPHA-GALACTOSIDASE) (EC 3.2.1.22). |
| ID0782 | G | 6-PHOSPHOGLUCONATE DEHYDROGENASE, DECARBOXYLATING (EC 1.1.1. |
| ID0783 | G | HYPOTHETICAL 24.5 KDA PROTEIN. |
| ID0784 | G | ORF starting with ATG of length 642 |
| ID0785 | G | PUTATIVE SUGAR HYDROLASE. |
| ID0786 | G | PTS SYSTEM, CELLOBIOSE-SPECIFIC ENZYME II, B COMPONENT (EIIA |
| ID0787 | G | ORF starting with ATG of length 375 |
| ID0788 | G | PTS SYSTEM, CELLOBIOSE-SPECIFIC ENZYME II, C COMPONENT (EIIA |
| ID0789 | G | HYPOTHETICAL 38.7 KDA PROTEIN. |
| ID0790 | G | PUTATIVE SUGAR TRANSPORT SYSTEM PERMEASE PROTEIN. |
| ID0791 | G | ORF starting with ATG of length 615 |
| ID0792 | G | HYPOTHETICAL 54.3 KDA PROTEIN. |
| ID0793 | G | PUTATIVE SUGAR ABC TRANSPORTER (ATP-BINDING PROTEIN). |
| ID0794 | G | PUTATIVE CARBOXYVINYL-CARBOXYPHOSPHONATE PHOSPHORYLMUTASE (EC |
| ID0795 | G | PTS SYSTEM, FRUCTOSE-SPECIFIC ENZYME II, BC COMPONENT. |
| ID0796 | G | 1-PHOSPHOFRUCTOKINASE (EC 2.7.1.56) (FRUCTOSE 1-PHOSPHATE KI |
| ID0797 | G | PTS SYSTEM, BETA-GLUCOSIDE-SPECIFIC ENZYME II, ABC COMPONENT |
| ID0798 | G | PUTATIVE TRANSKETOLASE C-TERMINAL SECTION (EC 2.2.1.1) (TK). |
| ID0799 | G | EXO-INULINASE. |
| ID0800 | G | SUCROSE-6-PHOSPHATE HYDROLASE (EC 3.2.1.26) (SUCRASE) (INVER |
| ID0801 | G | SURFACE PROTEIN PLS. |
| ID0802 | G | YBCL PROTEIN. |
| ID0803 | G | SUCROSE-6-PHOSPHATE HYDROLASE. |
| ID0804 | G | PYRUVATE KINASE (EC 2.7.1.40) (PK). |
| ID0805 | G | PHOSPHOCARRIER PROTEIN HPR (CATABOLITE REPRESSION). |
| ID0806 | G | BH0789 PROTEIN. |

-continued

| | | |
|---|---|---|
| ID0807 | G | PUTATIVE SUCROSE-SPECIFIC PTS PERMEASE, ENZYME II. |
| ID0808 | G | SCRB. |
| ID0809 | G | L-FUCULOSE PHOSPHATE ALDOLASE (EC 4.1.2.17) (L-FUCULOSE-1-PH |
| ID0810 | G | FRUCTOSE-SPECIFIC PTS SYSTEM ENZYME IIBC COMPONENT (EC 2.7.1 |
| ID0811 | G | 6-PHOSPHOFRUCTOKINASE (EC 2.7.1.11) (PHOSPHOFRUCTOKINASE) (PH |
| ID0812 | G | HYPOTHETICAL 40.2 KDA PROTEIN. |
| ID0813 | G | ORF starting with ATG of length 975 |
| ID0814 | G | PUTATIVE SUCROSE-SPECIFIC PTS PERMEASE, ENZYME II. |
| ID0815 | G | HYPOTHETICAL PROTEIN HI1028 PRECURSOR. |
| ID0816 | G | LACTOSE TRANSPORT SYSTEM (PERMEASE). |
| ID0817 | G | BH1117 PROTEIN. |
| ID0818 | G | CHLORAMPHENICOL RESISTANCE PROTEIN. |
| ID0819 | G | PROTEIN HI0146 PRECURSOR. |
| ID0820 | G | *Streptococcus pneumoniae* type 4 protein sequence #18. |
| ID0821 | G | HYPOTHETICAL 43.3 KDA PROTEIN. |
| ID0822 | G | HYPOTHETICAL ABC TRANSPORTER PERMEASE PROTEIN YURN. |
| ID0823 | G | ORF starting with ATG of length 454 |
| ID0824 | G | MYO-INOSITOL CATABOLISM. |
| ID0825 | G | *B. subtilis* hexulose phosphate synthase. |
| ID0826 | G | MALTOSE/MALTODEXTRIN TRANSPORT SYSTEM (PERMEASE). |
| ID0827 | G | SA2241 PROTEIN. |
| ID0828 | G | YBCL PROTEIN. |
| ID0829 | G | ORF starting with ATG of length 861 |
| ID0830 | G | SA0233 PROTEIN. |
| ID0831 | G | ZY044582 signal trapped geneweak similarity to yeso type gen |
| ID0832 | G | TRANSMEMBRANE LIPOPROTEIN. |
| ID0833 | G | ABC TRANSPORTER (PERMIASE) |
| ID0834 | G | 2-KETO-3-DEOXY-GLUCONATE KINASE. |
| ID0835 | G | D-MANNONATE HYDROLASE. |
| ID0836 | G | ORF starting with ATG of length 385 |
| ID0837 | G | ORF starting with ATG of length 680 |
| ID0838 | G | XYLOSE ISOMERASE (EC 5.3.1.5). |
| ID0839 | G | XYLULOSE KINASE (EC 2.7.1.17) (XYLULOKINASE). |
| ID0840 | G | SUCROSE-SPECIFIC PTS PERMEASE. |
| ID0841 | G | XYLOSIDASE/ARABINOSIDASE [INCLUDES: BETA-XYLOSIDASE (EC 3.2. |
| ID0842 | G | MYO-INOSITOL CATABOLISM. |
| ID0843 | G | SUGAR TRANSPORT SYSTEM (PERMEASE). |
| ID0844 | G | CHITOOLIGOSACCHARIDE DEACETYLASE (EC 3.5.1.). |
| ID0845 | G | ARAD. |
| ID0846 | G | SUGAR ABC TRANSPORTER (PERMEASE). |
| ID0847 | G | ORF starting with ATG of length 534 |
| ID0848 | G | SUGAR FERMENTATION STIMULATION PROTEIN. |
| ID0849 | G | PHOSPHOMANNOMUTASE. |
| ID0850 | G | PHOSPHOGLUCOSAMINE MUTASE. |
| ID0851 | G | BH0285 PROTEIN. |
| ID0852 | G | BH1066 PROTEIN. |
| ID0853 | G | INTEGRAL MEMBRANE PROTEIN. |
| ID0854 | G | LIPOPROTEIN. |
| ID0855 | G | N-ACETYLGLUCOSAMINE-SPECIFIC IIABC COMPONENT. |
| ID0856 | G | GLUCOSIDASE. |
| ID0857 | G | SUGAR ABC TRANSPORTER (PERMEASE). |
| ID0858 | G | PTS SYSTEM FRUCTOSE-LIKE IIB COMPONENT 1. |
| ID0859 | G | N-ACETYLGLUCOSAMINE-6-PHOSPHATE ISOMERASE (EC 5.3.1.10). |
| ID0860 | G | GLUCOSAMINE-6-ISOMERASE. |
| ID0861 | G | PROTEIN YCGS. |
| ID0862 | G | ORF starting with ATG of length 435 |
| ID0863 | G | SUGAR TRANSPORT SYSTEM (PERMEASE). |
| ID0864 | G | ORF starting with ATG of length 520 |
| ID0865 | G | PTS SYSTEM, SUCROSE-SPECIFIC IIBC COMPONENT (EIIBC-SCR) (SUC |
| ID0866 | G | RHAMNULOKINASE. |
| ID0867 | G | L-ARABINOSE ISOMERASE. |
| ID0868 | G | SA1198 PROTEIN. |
| ID0869 | G | LPLB PROTEIN. |
| ID0870 | G | *S. pneumoniae* derived protein #253. |
| ID0871 | G | TRANSKETOLASE (EC 2.2.1.1) |
| ID0872 | G | PROBABLE ABC-TRANSPORT PROTEIN, INNER MEMBRANE COMPONENT. |
| ID0873 | G | GLUCOSE-6-PHOSPHATE ISOMERASE A (GPI A) (EC 5.3.1.9) (PHOSPH |
| ID0874 | G | PHOSPHOGLUCOSAMINE MUTASE. |
| ID0875 | G | BH0222 PROTEIN. |
| ID0876 | G | PUTATIVE TRANSPORT SYSTEM INNER MEMBRANE PROTEIN. |
| ID0877 | G | LACTOSE TRANSPORT SYSTEM (PERMEASE). |
| ID0878 | G | ORF starting with ATG of length 672 |
| ID0879 | G | SUGAR TRANSPORT SYSTEM (PERMEASE) (BINDING PROTEIN DEPENDENT |
| ID0880 | G | ORF starting with ATG of length 375 |
| ID0881 | G | SUGAR ABC TRANSPORTER (ATP-BINDING PROTEIN). |
| ID0882 | G | SUGAR TRANSPORT SYSTEM (SUGAR-BINDING PROTEIN). |
| ID0883 | G | GLYCEROL-3-PHOSPHATE ABC TRANSPORTER (PERMEASE). |
| ID0884 | G | GLYCEROL-3-PHOSPHATE ABC TRANSPORTER (PERMEASE). |
| ID0885 | G | TEICHOIC ACID TRANSLOCATION ATP-BINDING PROTEIN TAGH. |

-continued

| ID | | Description |
|---|---|---|
| ID0886 | G | ABC-TRANSPORTER ATP-BINDING PROTEIN. |
| ID0887 | G | ALTRONATE HYDROLASE. |
| ID0888 | G | *Streptococcus pneumoniae* SP0014 protein. |
| ID0889 | G | SUGAR BINDING PROTEIN |
| ID0890 | G | 6-PHOSPHO-BETA-GLUCOSIDASE. |
| ID0891 | G | FRUCTOSE 1-PHOSPHATE KINASE. |
| ID0892 | G | BETA-GLUCOSIDASE. |
| ID0893 | G | GLCA PROTEIN. |
| ID0894 | G | HYPOTHETICAL 24.3 KDA PROTEIN. |
| ID0895 | G | ABC TRANSPORTER SUGAR PERMEASE. |
| ID0896 | G | ORF starting with ATG of length 369 |
| ID0897 | G | METHYLGLYOXAL SYNTHASE (EC 4.2.99.11). |
| ID0898 | G | BH0592 PROTEIN. |
| ID0899 | G | SUGAR TRANSPORT SYSTEM (PERMEASE). |
| ID0900 | G | MYO-INOSITOL CATABOLISM. |
| ID0901 | G | ORF starting with ATG of length 714 |
| ID0902 | G | SUCROSE-6-PHOSPHATE HYDROLASE. |
| ID0903 | G | D-MANNONATE HYDROLASE. |
| ID0904 | G | SA2244 PROTEIN. |
| ID0905 | G | MULTIPLE SUGAR TRANSPORT SYSTEM (MULTIPLE SUGAR-BINDING PROT |
| ID0906 | G | ALTRONATE OXIDOREDUCTASE. |
| ID0907 | G | DIHYDROXYACETONE KINASE. |
| ID0908 | G | PTS SYSTEM, GLUCOSE-SPECIFIC IIABC COMPONENT (EIIABC-GLC) (G |
| ID0909 | G | PTS SYSTEM, CELLOBIOSE-SPECIFIC ENZYME II, B COMPONENT (EIIA |
| ID0910 | G | DECARBOXYLATING 6-PHOSPHOGLUCONATE DEHYDROGENASE (EC 1.1.1.4 |
| ID0911 | G | ALTRONATE OXIDOREDUCTASE. |
| ID0912 | G | HYPOTHETICAL 54.3 KDA PROTEIN. |
| ID0913 | G | PTS SYSTEM, CELLOBIOSE-SPECIFIC IIA COMPONENT (EIIA-CEL) (CE |
| ID0914 | G | PTS SYSTEM, CELLOBIOSE-SPECIFIC ENZYME II, C COMPONENT. |
| ID0915 | G | PTS SYSTEM, CELLOBIOSE-SPECIFIC IIB COMPONENT (EIIB-CEL) (CE |
| ID0916 | G | PTS SYSTEM, CELLOBIOSE-SPECIFIC ENZYME II, C COMPONENT. |
| ID0917 | G | PTS SYSTEM, CELLOBIOSE-SPECIFIC IIA COMPONENT (EIIA-CEL) (CE |
| ID0918 | G | HYPOTHETICAL 54.3 KDA PROTEIN. |
| ID0919 | G | ALTRONATE HYDROLASE. |
| ID0920 | G | MALTOSE TRANSPORTOR ATP-BINDING PROTEIN. |
| ID0921 | G | 6-PHOSPHO-BETA-GLUCOSIDASE. |
| ID0922 | G | MALTOGENIC AMYLASE. |
| ID0923 | G | BH1066 PROTEIN. |
| ID0924 | G | INTEGRAL MEMBRANE PROTEIN. |
| ID0925 | G | ORF starting with ATG of length 529 |
| ID0926 | G | ALPHA,ALPHA-PHOSPHOTREHALASE (EC 3.2.1.93). |
| ID0927 | G | PHOSPHOCARRIER PROTEIN HPR (CATABOLITE REPRESSION). |
| ID0928 | G | KBAY. |
| ID0929 | G | LACTOSE TRANSPORT SYSTEM (PERMEASE). |
| ID0930 | G | *Streptococcus pneumoniae* type 4 protein sequence #55. |
| ID0931 | G | 6-PHOSPHO-BETA-GLUCOSIDASE A, CRYPTIC. |
| ID0932 | G | PTS SYSTEM, CELLOBIOSE-SPECIFIC IIA COMPONENT (EIIA-CEL) (CE |
| ID0933 | G | ORF starting with ATG of length 552 |
| ID0934 | G | 6-PHOSPHOGLUCONATE DEHYDROGENASE (EC 1.1.1.44). |
| ID0935 | G | Recombinant glucose-6-phosphate dehydrogenase. |
| ID0936 | G | Recombinant glucose-6-phosphate dehydrogenase. |
| ID0937 | G | ORF starting with ATG of length 924 |
| ID0938 | G | HYPOTHETICAL PROTEIN. |
| ID0939 | G | CONSERVED HYPOTHETICAL PROTEIN. |
| ID0940 | G | BETA-GLUCOSIDE SPECIFIC TRANSPORT PROTEIN. |
| ID0941 | G | PROBABLE HEXULOSE-6-PHOSPHATE SYNTHASE (EC 4.1.2.—) (HUMPS) |
| ID0942 | G | 2-KETO-3-DEOXYGLUCONATE KINASE (EC 2.7.1.45). |
| ID0943 | G | HYPOTHETICAL 38.7 KDA PROTEIN. |
| ID0944 | G | YTCQ. |
| ID0945 | G | PUTATIVE SUGAR HYDROLASE. |
| ID0946 | G | PTS SYSTEM, CELLOBIOSE-SPECIFIC ENZYME II, C COMPONENT (EIIA |
| ID0947 | G | TRANSKETOLASE, C-TERMINAL SECTION (TKT-2) (EC 2.2.1.1). |
| ID0945 | G | FRUCTOSE-SPECIFIC PTS SYSTEM ENZYME IIBC COMPONENT (EC 2.7.1 |
| ID0949 | G | ORF starting with ATG of length 2064 |
| ID0950 | G | MYO-INOSITOL CATABOLISM. |
| ID0951 | G | TRIOSEPHOSPHATE ISOMERASE. |
| ID0952 | G | P-NITROPHENYL PHOSPHATASE. |
| ID0953 | G | CHITOOLIGOSACCHARIDE DEACETYLASE (EC 3.5.1.). |
| ID0954 | G | ORF starting with ATG of length 612 |
| ID0955 | G | ORF starting with ATG of length 222 |
| ID0956 | G | ORF starting with ATG of length 552 |
| ID0957 | GR | YOAN. |
| ID0958 | GR | YOAN. |
| ID0959 | GR | YOAN. |
| ID0960 | GR | ORF starting with ATG of length 330 |
| ID0961 | GT | PHOSPHOTRANSFERASE SYSTEM (PTS) FRUCTOSE-SPECIFIC ENZYME IIB |
| ID0962 | GT | PTS SYSTEM MANNITOL-SPECIFIC COMPONENT IIA (EIIA-MTL). |
| ID0963 | GT | MANNITOL ENZYME IIA. |
| ID0964 | GT | PTS SYSTEM, FRUCTOSE-SPECIFIC ENZYME II, BC COMPONENT. |

-continued

| ID | Type | Description |
|---|---|---|
| ID0965 | GT | MANNITOL ENZYME IIA. |
| ID0966 | GT | PTS SYSTEM, FRUCTOSE-SPECIFIC ENZYME II, BC COMPONENT. |
| ID0967 | GT | HYPOTHETICAL 16.1 KDA PROTEIN. |
| ID0968 | GT | ORF starting with ATG of length 410 |
| ID0969 | HC | DIHYDROOROTATE DEHYDROGENASE (ELECTRON TRANSFER SUBUNIT). |
| ID0970 | HC | DIHYDROOROTATE DEHYDROGENASE (ELECTRON TRANSFER SUBUNIT). |
| ID0971 | HE | PHOSPHOSERINE AMINOTRANSFERASE (EC 2.6.1.52). |
| ID0972 | HE | PHOSPHOSERINE AMINOTRANSFERASE. |
| ID0973 | H | THID. |
| ID0974 | H | FOLYL-POLYGLUTAMATE SYNTHETASE (EC 6.3.2.17). |
| ID0975 | H | ORF starting with ATG of length 483 |
| ID0976 | H | ABC TRANSPORT SYSTEM PERMEASE PROTEIN. |
| ID0977 | H | GLUTAMATE-1-SEMIALDEHYDE AMINOTRANSFERASE. |
| ID0978 | H | FLAVOPROTEIN. |
| ID0979 | H | MOLYBDOPTERIN BIOSYNTHESIS PROTEIN. |
| ID0980 | H | ORF starting with ATG of length 552 |
| ID0981 | H | MOLYBDOPTERIN CONVERTING FACTOR (SUBUNIT 2). |
| ID0962 | H | ORF starting with ATG of length 823 |
| ID0983 | H | BH1752 PROTEIN. |
| ID0984 | H | RIBOFLAVIN KINASE / FAD SYNTHASE. |
| ID0985 | H | RIBOFLAVIN BIOSYNTHESIS PROTEIN RIBA [INCLUDES: GTP CYCLOHYD |
| ID0986 | H | DGOA PROTEIN [INCLUDES: 2-DEHYDRO-3-DEOXYPHOSPHOGALACTONATE |
| ID0987 | H | 2-HEPTAPRENYL-1,4-NAPHTHOQUINONE METHYLTRANSFERASE (SPORE GE |
| ID0988 | H | YQHM PROTEIN. |
| ID0989 | H | SA1729 PROTEIN. |
| ID0990 | H | GERANYLTRANSTRANSFERASE (EC 2.5.1.10) (FARNESYL-DIPHOSPHATE |
| ID0991 | H | GLUTAMATE-1-SEMIALDEHYDE AMINOTRANSFERASE. |
| ID0992 | H | PROBABLE AROMATIC ACID DECARBOXYLASE (EC 4.1.1.—). |
| ID0993 | H | NH3-DEPENDENT NAD SYNTHETASE (EC 6.3.1.5). |
| ID0994 | H | BH1752 PROTEIN. |
| ID0995 | H | TRANSCRIPTIONAL REPRESSOR OF THE BIOTIN OPERON. |
| ID0996 | H | HEPTAPRENYL DIPHOSPHATE SYNTHASE COMPONENT II (EC 2.5.1.30) |
| ID0997 | H | SPORE GERMINATION PROTEIN C3 (FRAGMENT). |
| ID0998 | H | 4-HYDROXYBENZOATE OCTAPRENYLTRANSFERASE. |
| ID0999 | H | PUTATIVE OCTAPRENYLTRANSFERASE. |
| ID1000 | H | PANTOTHENATE METABOLISM FLAVOPROTEIN HOMOLOG. |
| ID1001 | H | DIHYDROFOLATE REDUCTASE (EC 1.5.1.3). |
| ID1002 | H | GLUTAMATE-1-SEMIALDEHYDE 2,1-AMINOMUTASE 2 (EC 5.4.3.8) (GSA |
| ID1003 | H | BH1752 PROTEIN. |
| ID1004 | H | BH1752 PROTEIN. |
| ID1005 | H | GERANYLTRANSTRANSFERASE (EC 2.5.1.10) (FARNESYL-DIPHOSPHATE |
| ID1006 | H | CYSG. |
| ID1007 | H | DELTA-AMINOLEVULINIC ACID DEHYDRATASE (EC 4.2.1.24). |
| ID1008 | H | PORPHOBILINOGEN DEAMINASE (EC 4.3.1.8). |
| ID1009 | H | S. carnosus nitrate reductase molybdenum cofactor MoeB. |
| ID1010 | H | MOLYBDOPTERIN BIOSYNTHESIS. |
| ID1011 | H | ABC TRANSPORT SYSTEM PERMEASE PROTEIN. |
| ID1012 | H | ASPARTATE 1-DECARBOXYLASE. |
| ID1013 | H | PANTOATE BETA-ALANINE LIGASE. |
| ID1014 | H | Cis-epoxysuccinate hydrolase alpha subunit amino acid sequen |
| ID1015 | H | TRANSCRIPTIONAL REGULATOR. |
| ID1016 | H | DIHYDROFOLATE REDUCTASE (EC 1.5.1.3). |
| ID1017 | H | UNKNOWN (PYRIDOXAL PHOSPHATE BIOSYNTHETIC PROTEIN). |
| ID1018 | H | HYPOTHETICAL PROTEIN VC0880. |
| ID1019 | H | PYRIDOXAL PHOSPHATE BIOSYNTHETIC PROTEIN PDXA. |
| ID1020 | H | Cis-epoxysuccinate hydrolase alpha subunit amino acid sequen |
| ID1021 | H | UROPORPHYRINOGEN III DECARBOXYLASE. |
| ID1022 | H | BH3930 PROTEIN. |
| ID1023 | H | IRON (III) TRANSPORT SYSTEM (PERMEASE). |
| ID1024 | H | PROBABLE AROMATIC ACID DECARBOXYLASE (EC 4.1.1.—). |
| ID1025 | H | BH0072 PROTEIN. |
| ID1026 | H | DGOA PROTEIN [INCLUDES: 2-DEHYDRO-3-DEOXYPHOSPHOGALACTONATE |
| ID1027 | H | THIAMINE PHOSPHATE PYROPHOSPHORYLASE. |
| ID1028 | H | CONSERVED HYPOTHETICAL PROTEIN. |
| ID1029 | H | FERROCHELATASE (EC 4.99.1.1) (PROTOHEME FERRO-LYASE) (HEMESY |
| ID1030 | H | PROTOPORPHYRINOGEN IX AND COPROPORPHYRINOGEN III OXIDASE. |
| ID1031 | H | ORF starting with ATG of length 990 |
| ID1032 | H | MOLYBDENUM COFACTOR BIOSYNTHESIS PROTEIN C. |
| ID1033 | H | PROBABLE AMINOTRANSFERASE YHXA (EC 2.6.—.—). |
| ID1034 | H | ORF starting with ATG of length 624 |
| ID1035 | H | FERROCHELATASE (EC 4.99.1.1) (PROTOHEME FERRO-LYASE) (HEMESY |
| ID1036 | H | DIHYDRONEOPTERIN ALDOLASE (EC 4.1.2.25) (DHNA). |
| ID1037 | H | FOLATE SYNTHESIS BIFUNCTIONAL PROTEIN [INCLUDES: 2-AMINO-4-H |
| ID1038 | H | DIHYDROPTEROATE SYNTHASE (DIHYDROPTEROATE PYROPHOSPHORYLASE) |
| ID1039 | H | SUPEROXIDE-INDUCIBLE PROTEIN. |
| ID1040 | H | AMIDOTRANSFERASE. |
| ID1041 | H | ORF starting with ATG of length 267 |
| ID1042 | H | PANTOATE BETA-ALANINE LIGASE. |
| ID1043 | H | QUINOLINATE SYNTHETASE. |

-continued

| | | |
|---|---|---|
| ID1044 | H | CONSERVED HYPOTHETICAL PROTEIN. |
| ID1045 | H | GLUTAMATE-1-SEMIALDEHYDE 2,1-AMINOTRANSFERASE (EC 5.4.3.8). |
| ID1046 | H | PHOSPHOMETHYLPYRIMIDINE KINASE (EC 2.7.4.7) (HMP-PHOSPHATE K |
| ID1047 | H | L-ASPARTATE OXIDASE. |
| ID1048 | H | FOLYL-POLYGLUTAMATE SYNTHETASE (EC 6.3.2.17). |
| ID1049 | H | CYTOCHROME CAA3 OXIDASE ASSEMBLY FACTOR. |
| ID1050 | H | 6,7-DIMETHYL-8-RIBITYLLUMAZINE SYNTHASE (EC 2.5.1.9). |
| ID1051 | H | PROBABLE 2-DEHYDROPANTOATE 2-REDUCTASE (EC 1.1.1.169) (KETOP |
| ID1052 | H | PORPHOBILINOGEN DEAMINASE (EC 4.3.1.8). |
| ID1053 | H | GLUTAMYL-TRNA REDUCTASE (EC 1.2.1.). |
| ID1054 | H | BS PROMOTER (FRAGMENT). |
| ID1055 | H | GLUTAMATE-1-SEMIALDEHYDE AMINOTRANSFERASE. |
| ID1056 | H | UNKNOWN (PYRIDOXAL PHOSPHATE BIOSYNTHETIC PROTEIN). |
| ID1057 | H | S-ADENOSYLMETHIONINE SYNTHETASE (EC 2.5.1.6) (METHIONINEADEN |
| ID1058 | H | DIHYDROPTEROATE SYNTHASE (DIHYDROPTEROATE PYROPHOSPHORYLASE) |
| ID1059 | H | DIHYDRONEOPTERIN ALDOLASE (EC 4.1.2.25). |
| ID1060 | H | ORF starting with ATG of length 216 |
| ID1061 | H | ORF starting with ATG of length 387 |
| ID1062 | HI | 1-DEOXYXYLULOSE-5-PHOSPHATE SYNTHASE. |
| ID1063 | HI | Corn 1-deoxy-D-xylulose 5-phosphate synthase putative protei |
| ID1064 | HR | BH3411 PROTEIN. |
| ID1065 | HR | BH3143 PROTEIN. |
| ID1066 | HR | BH3143 PROTEIN. |
| ID1067 | HR | BH3411 PROTEIN. |
| ID1068 | I | PYRUVATE CARBOXYLASE. |
| ID1069 | I | PROTEIN LOW TEMPERATURE REQUIREMENT C. |
| ID1070 | I | 3-HYDROXYACYL-COA DEHYDROGENASE. |
| ID1071 | I | SHORT-CHAIN-SPECIFIC ACYL-COA DEHYDROGENASE. |
| ID1072 | I | *E. coli* proliferation associated protein sequence SEQ ID NO: |
| ID1073 | I | ENOYL-[ACYL-CARRIER PROTEIN] REDUCTASE. |
| ID1074 | I | ACETYL-COA SYNTHETASE (EC 6.2.1.1). |
| ID1075 | I | PUTATIVE ACYL CARRIER PROTEIN PHOSPHODIESTERASE (EC 3.1.4.14 |
| ID1076 | I | ORF starting with ATG of length 341 |
| ID1077 | I | HYPOTHETICAL 24.9 KDA PROTEIN IN CYTOCHROME P450MEG GENE 3'R |
| ID1078 | I | FATTY ACID DESATURASE (EC 1.14.99.). |
| ID1079 | I | FATTY ACID DESATURASE. |
| ID1080 | I | METHYLMALONYL-COA DECARBOXYLASE, SUBUNIT A LPHA (MMDA). |
| ID1081 | I | PROBABLE CARDIOLIPIN SYNTHETASE 2 (EC 2.7.8.—) (CARDIOLIPIN |
| ID1082 | I | BUTYRYL-COA DEHYDROGENASE. |
| ID1083 | I | ACETYL-COA CARBOXYLASE TRANSFERASE BETA SUBUNIT (EC 6.4.1.2) |
| ID1084 | I | PROPIONYL-COA CARBOXYLASE. |
| ID1085 | I | ORF starting with ATG of length 549 |
| ID1086 | I | ACETYL-COA SYNTHETASE (EC 6.2.1.1). |
| ID1087 | I | YVAB PROTEIN. |
| ID1088 | I | PHOSPHATIDYLGLYCEROPHOSPHATE SYNTHASE. |
| ID1089 | I | 3-HYDROXYISOBUTYRATE DEHYDROGENASE. |
| ID1090 | I | ORF starting with ATG of length 561 |
| ID1091 | I | HYPOTHETICAL 38.4 KDA PROTEIN. |
| ID1092 | I | LIPASE (ESTERASE). |
| ID1093 | I | BACITRACIN TRANSPORT PERMEASE PROTEIN BCRC. |
| ID1094 | I | YWJE PROTEIN. |
| ID1095 | I | 3-HYDROXYISOBUTYRATE DEHYDROGENASE. |
| ID1096 | I | ACETYL-COA SYNTHETASE (EC 6.2.1.1). |
| ID1097 | I | ACETYL-COA ACETYLTRANSFERASE (EC 2.3.1.9). |
| ID1098 | I | ACYL-COA DEHYDROGENASE (EC 1.3.99.). |
| ID1099 | I | ORF starting with ATG of length 600 |
| ID1100 | I | PROBABLE SUCCINYL-COA:3-KETOACID-COENZYME A TRANSFERASE SUBU |
| ID1101 | I | 1-DEOXY-D-XYLULOSE 5-PHOSPHATE REDUCTOISOMERASE (EC 1.1.1.—) |
| ID1102 | I | ACETYL-COA CARBOXYLASE BIOTIN CARBOXYLASE SUBUNIT (EC 6.4.1. |
| ID1103 | I | ACETATE-COA LIGASE. |
| ID1104 | I | MALONYL COA-ACYL CARRIER PROTEIN TRANSACYLASE (EC 2.3.1.39). |
| ID1105 | I | BH1635 PROTEIN. |
| ID1106 | I | PHOSPHATIDATE CYTIDYLYLTRANSFERASE. |
| ID1107 | I | UNDECAPRENYL PYROPHOSPHATE SYNTHETASE (EC 2.5.1.31). |
| ID1108 | I | HYPOTHETICAL 48.2 KDA PROTEIN (FRAGMENT). |
| ID1109 | I | PROBABLE SUCCINYL-COA:3-KETOACID-COENZYME A TRANSFERASE SUBU |
| ID1110 | I | ORF starting with ATG of length 597 |
| ID1111 | I | PROBABLE CARDIOLIPIN SYNTHETASE 2 (EC 2.7.8.—) (CARDIOLIPIN |
| ID1112 | I | HYPOTHETICAL 25.2 KDA PROTEIN. |
| ID1113 | I | ACETATE-COA LIGASE (EC 6.2.1.1). |
| ID1114 | I | ACETATE-COA LIGASE. |
| ID1115 | I | PHOSPHATIDYLGLYCEROPHOSPHATE SYNTHASE. |
| ID1116 | I | BIOTIN CARBOXYLASE. |
| ID1117 | I | BUTYRYL-COA DEHYDROGENASE. |
| ID1118 | I | BACITRACIN TRANSPORT PERMEASE PROTEIN BCRC. |
| ID1119 | I | 3-HYDROXYACYL-COA DEHYDROGENASE. |
| ID1120 | I | INVOLVED IN FATTY ACID/PHOSPHOLIPID SYNTHESIS. |
| ID1121 | I | SHORT-CHAIN FATTY ACIDS TRANSPORTER. |
| ID1122 | I | 3-HYDROXYACYL-COA DEHYDROGENASE. |

-continued

| | | |
|---|---|---|
| ID1123 | I | BUTYRYL-COA DEHYDROGENASE. |
| ID1124 | I | SIMILAR TO PROPIONYL COENZYME A CARBOXYLASE, ALPHA POLYPEPTI |
| ID1125 | I | PROTEIN LOW TEMPERATURE REQUIREMENT C. |
| ID1126 | I | ACETYL-COA ACETYLTRANSFERASE (EC 2.3.1.9). |
| ID1127 | I | NAD-DEPENDENT BETA-HYDROXYBUTYRYL COENZYME A DEHYDROGENASE ( |
| ID1128 | I | HYPOTHETICAL 18.7 KDA PROTEIN IN HOM-MRGA INTERGENIC REGION. |
| ID1129 | IQ | LONG-CHAIN-FATTY-ACID--COA LIGASE (EC 6.2.1.3) (LONG-CHAIN A |
| ID1130 | IQ | LONG-CHAIN FATTY-ACID-COA LIGASE. |
| ID1131 | IQ | MEDIUM-CHAIN FATTY ACID-COA LIGASE. |
| ID1132 | IQ | ACID-COA LIGASE. |
| ID1133 | IQ | ACID-COA LIGASE. |
| ID1134 | IQ | LONG CHAIN FATTY ACID ACYL-COA LIGASE. |
| ID1135 | J | BH1439 PROTEIN. |
| ID1136 | J | VALYL-TRNA SYNTHETASE (EC 6.1.1.9) (VALINE--TRNA LIGASE) (VA |
| ID1137 | J | BH1243 PROTEIN. |
| ID1138 | J | RIBOSOMAL PROTEIN L6 (BL8). |
| ID1139 | J | RIBOSOMAL PROTEIN L18. |
| ID1140 | J | RIBOSOMAL PROTEIN S5. |
| ID1141 | J | *Streptococcus pneumoniae* prfC protein sequence. |
| ID1142 | J | METHIONYL-TRNA FORMYLTRANSFERASE (EC 2.1.2.9). |
| ID1143 | J | GLYCYL-TRNA SYNTHETASE (ALPHA SUBUNIT). |
| ID1144 | J | LYSYL-TRNA SYNTHETASE (EC 6.1.1.6). |
| ID1145 | J | RIBOSOMAL PROTEIN N-ACETYLTRANSFERASE, PUTATIVE. |
| ID1146 | J | ISOLEUCYL-TRNA SYNTHETASE. |
| ID1147 | J | BH2847 PROTEIN. |
| ID1148 | J | ASPARAGINYL-TRNA SYNTHETASE (EC 6.1.1.22) (ASPARAGINE--TRNA |
| ID1149 | J | Leucyl-tRNA synthetase from *Staph. aureus*. |
| ID1150 | J | ASPARAGINYL-TRNA SYNTHETASE. |
| ID1151 | J | TRNA PSEUDOURIDINE 5S SYNTHASE. |
| ID1152 | J | METHIONYL-TRNA FORMYLTRANSFERASE (EC 2.1.2.9). |
| ID1153 | J | SA1060 PROTEIN. |
| ID1154 | J | GLYCYL-TRNA SYNTHETASE BETA CHAIN (EC 6.1.1.14) (GLYCINE--TR |
| ID1155 | J | METHIONINE AMINOPEPTIDASE A. |
| ID1156 | J | RIBOSOMAL PROTEIN S30AE FAMILY. |
| ID1157 | J | GLYCYL-TRNA SYNTHETASE (BETA SUBUNIT). |
| ID1158 | J | RRNA METHYLASE. |
| ID1159 | J | TRYPTOPHANYL-TRNA SYNTHETASE. |
| ID1160 | J | 16S PSEUDOURIDYLATE SYNTHASE. |
| ID1161 | J | PUTATIVE TRNA SYNTHETASE. |
| ID1162 | J | LEUCYL-TRNA SYNTHETASE (EC 6.1.1.4). |
| ID1163 | J | TRNA/RRNA METHYLTRANSFERASE. |
| ID1164 | J | HYPOTHETICAL 35.7 KDA PROTEIN IN MALA 3'REGION (ORF3). |
| ID1165 | J | PROTOPORPHYRINOGEN OXIDASE. |
| ID1166 | J | CYSTEINYL-TRNA SYNTHETASE (EC 6.1.1.16) (CYSTEINE--TRNA LIGA |
| ID1167 | J | ISOLEUCYL-TRNA SYNTHETASE, MUPIROCIN RESISTANT (EC 6.1.1.5) ( |
| ID1168 | J | TRANSLATION INITIATION INHIBITOR. |
| ID1169 | J | CYTOSOLIC AXIAL FILAMENT PROTEIN. |
| ID1170 | J | *H. pylori* GHPO 728 protein. |
| ID1171 | J | ORF starting with ATG of length 609 |
| ID1172 | J | ORF starting with ATG of length 966 |
| ID1173 | J | THREONYL-TRNA SYNTHETASE 1 (EC 6.1.1.3) (THREONINE--TRNA LIG |
| ID1174 | J | POLY (A) POLYMERASE. |
| ID1175 | J | ORF starting with ATG of length 543 |
| ID1176 | J | ASPARTYL-TRNA SYNTHETASE. |
| ID1177 | J | TRANSLATION INITIATION FACTOR IF-2. |
| ID1178 | J | ASPARTYL-TRNA SYNTHETASE (EC 6.1.1.12) (ASPARTATE--TRNA LIGA |
| ID1179 | J | HISTIDYL-TRNA SYNTHETASE (EC 6.1.1.21). |
| ID1180 | J | ORF starting with ATG of length 321 |
| ID1181 | J | TRANSLATION INITIATION FACTOR IF-2. |
| ID1182 | J | ORF starting with ATG of length 2301 |
| ID1183 | J | RIBOSOME-BINDING FACTOR A. |
| ID1184 | J | BH3010 PROTEIN. |
| ID1185 | J | RIBOSOMAL PROTEIN L27. |
| ID1186 | J | BH1351 PROTEIN. |
| ID1187 | J | PROBABLE METHYLTRANSFERASE (EC 2.1.1.—). |
| ID1188 | J | RIBOSOMAL PROTEIN L27. |
| ID11B9 | J | BH3010 PROTEIN. |
| ID1190 | J | METHYLTRANSFERASE. |
| ID1191 | J | LEUCYL-TRNA SYNTHETASE (EC 6.1.1.4). |
| ID1192 | J | PHENYLALANYL-TRNA SYNTHETASE BETA CHAIN (EC 6.1.1.20) (PHENY |
| ID1193 | J | PSEUDOURIDYLATE SYNTHASE (EC 4.2.1.70). |
| ID1194 | J | POLY(A) POLYMERASE. |
| ID1195 | J | POLY(A) POLYMERASE. |
| ID1196 | J | YFJO PROTETN. |
| ID1197 | J | ISOLEUCYL-TRNA SYNTHETASE (EC 6.1.1.5) (ISOLEUCINE--TRNA LIG |
| ID1198 | J | BH0299 PROTEIN. |
| ID1199 | J | TRANSLATION ELONGATION FACTOR G (EF-G). |
| ID1200 | J | YBXF PROTEIN (RIBOSOMAL PROTEIN L7AE FAMILY). |
| ID1201 | J | RIBOSOMAL PROTEIN S12. |

-continued

| | | |
|---|---|---|
| ID1202 | J | RIBOSOMAL PROTEIN S7 (BS7). |
| ID1203 | J | ELONGATION FACTCR G (EF-G) (FRAGMENT). |
| ID1204 | J | TRANSLATION ELONGATION FACTOR G (EF-G). |
| ID1205 | J | SERYL-TRNA SYNTHETASE (EC 6.1.1.11) (SERINE--TRNA LIGASE) (S |
| ID1206 | J | ARGINYL-TRNA SYNTHETASE (EC 6.1.1.19) (ARGININE--TRNA LIGASE |
| ID1207 | J | RNA METHYLTRANSFERASE. |
| ID1208 | J | GLUTAMYL-TRNA(GLN) AMIDOTRANSFERASE SUBUNIT A (EC 6.3.5.—) ( |
| ID1209 | J | *Arabidopsis thaliana* protein fragment SEQ ID NO: 29871. |
| ID1210 | J | PROBABLE GLUTAMYL-TRNA(GLN) AMIDOTRANSFERASE SUBUNIT B, MITO |
| ID1211 | J | GLUTAMYL-TRNAGLN AMIDOTRANSFERASE SUBUNIT B. |
| ID1212 | J | SERYL-TRNA SYNTHETASE (EC 6.1.1.11). |
| ID1213 | J | DIMETHYLADENOSINE TRANSFERASE (EC 2.1.1.—) (S-ADENOSYLMETHIO |
| ID1214 | J | RIBONUCLEASE PH (EC 2.7.7.56). |
| ID1215 | J | HYPOTHETICAL 9.7 KDA PROTEIN IN MFD-DIVIC INTERGENIC REGION. |
| ID1216 | J | HISTIDYL-TRNA SYNTHETASE (EC 6.1.1.21) (HISTIDINE--TRNA LIGA |
| ID1217 | J | YFLG PROTEIN. |
| ID1219 | J | YFLG PROTEIN. |
| ID1219 | J | PUTATIVE METHYLTRANSFERASE (EC 2.1.1.). |
| ID1220 | J | *Enantioselective amidase* of *Rhodococcus*. |
| ID1221 | J | 50S RIBOSOMAL PROTEIN L30. |
| ID1222 | J | 50S RIBOSOMAL PROTEIN L15. |
| ID1223 | J | 50S RIBOSOMAL PROTEIN L15. |
| ID1224 | J | HISTIDYL-TRNA SYNTHETASE (EC 6.1.1.21) (HISTIDINE--TRNA LIGA |
| ID1225 | J | 30S RIBOSOMAL PROTEIN S19. |
| ID1226 | J | 50S RIBOSOMAL PROTEIN L22. |
| ID1227 | J | 30S RIBOSOMAL PROTEIN S17. |
| ID1228 | J | 50S RIBOSOMAL PROTEIN L14. |
| ID1229 | J | 50S RIBOSOMAL PROTEIN L24. |
| ID1230 | J | 50S RIBOSOMAL PROTEIN L5. |
| ID1231 | J | ASPARTYL-TRNA SYNTHETASE. |
| ID1232 | J | 30S RIBOSOMAL PROTEIN S3. |
| ID1233 | J | 50S RIBOSOMAL PROTEIN L16. |
| ID1234 | J | CHLOROPLAST 50S RIBOSOMAL PROTEIN L16 (FRAGMENT). |
| ID1235 | J | 50S RIBOSOMAL PROTEIN L29. |
| ID1236 | J | PLASMID PMD101 DNA. |
| ID1237 | J | ORF starting with ATG of length 756 |
| ID1238 | J | METHIONYL-TRNA SYNTHETASE (EC 6.1.1.10). |
| ID1239 | J | 30S RIBOSOMAL PROTEIN S17. |
| ID1240 | J | 50S RIBOSOMAL PROTEIN L14. |
| ID1241 | J | ARGS. |
| ID1242 | J | ARGINYL-TRNA SYNTHETASE (EC 6.1.1.19). |
| ID1243 | J | GLUTAMYL-TRNA SYNTHETASE 1 (EC 6.1.1.17) (GLUTAMATE--TRNA LI |
| ID1244 | J | RIBOSOME-BINDING FACTOR A. |
| ID1245 | J | TRANSLATION INITIATION FACTOR IF-2. |
| ID1246 | J | HISTIDYL-TRNA SYNTHETASE (EC 6.1.1.21). |
| ID1247 | J | THREONYL-TRNA SYNTHETASE 1 (EC 6.1.1.3). |
| ID1248 | J | BH2542 PROTEIN. |
| ID1249 | J | METHIONYL-TRNA SYNTHETASE (EC 6.1.1.10). |
| ID1250 | J | GLUTAMYL-TRNA(GLN) AMIDOTRANSFERASE SUBUNIT A. |
| ID1251 | J | TRYPTOPHANYL-TRNA SYNTHETASE. |
| ID1252 | J | BH1636 PROTEIN. |
| ID1253 | J | RIBOSOME RECYCLING FACTOR. |
| ID1254 | J | GLUTAMYL-TRNA SYNTHETASE (EC 6.1.1.17). |
| ID1255 | J | 30S RIBOSOMAL PROTEIN S14 HOMOLOG. |
| ID1256 | J | RIBOSOMAL PROTEIN L17. |
| ID1257 | J | LEUCYL-TRNA SYNTHETASE (EC 6.1.1.4). |
| ID1258 | J | RIBOSOMAL PROTEIN S11 (BS11). |
| ID1259 | J | GLUTAMYL-TRNA(GLN) AMIDOTRANSFERASE SUBUNIT A (EC 6.3.5.—) ( |
| ID1260 | J | GLUTAMYL-TRNA (GLN) AMIDOTRANSFERASE SUBUNIT B. |
| ID1261 | J | TRYPTOPHANYL-TRNA SYNTHETASE. |
| ID1262 | J | RIBOSOMAL PROTEIN L28. |
| ID1263 | J | BH2507 PROTEIN. |
| ID1264 | J | ARGINYL-TRNA SYNTHETASE (EC 6.1.1.19) (ARGININE--TRNA LIGASE |
| ID1265 | J | 50S RIBOSOMAL PROTEIN L19. |
| ID1266 | J | RIBONUCLEASE P PROTEIN COMPONENT (EC 3.1.26.5) (PROTEIN C5) |
| ID1267 | J | RIBOSOMAL PROTEIN S9 (BS10). |
| ID1268 | J | GENERAL STRESS PROTEIN. |
| ID1269 | J | PEPTIDYL-TRNA HYDROLASE. |
| ID1270 | J | 50S RIBOSOMAL PROTEIN L10. |
| ID1271 | J | RIBOSOMAL PROTEIN L7/L12. |
| ID1272 | J | BH0124 PROTEIN. |
| ID1273 | J | PEPTIDE CHAIN RELEASE FACTOR 2 IN TRANSLATION. |
| ID1274 | J | RIBOSOMAL PROTEIN L11 (BL11). |
| ID1275 | J | BH3771 PROTEIN. |
| ID1276 | J | ORF starting with ATG of length 544 |
| ID1277 | J | ISOLEUCYL-TRNA SYNTHETASE, MUPIROCIN RESISTANT (EC 6.1.1.5) ( |
| ID1278 | J | THREONYL-TRNA SYNTHETASE 2 (EC 6.1.1.3) (THREONINE--TRNA LIG |
| ID1279 | J | PHENYLALANYL-TRNA SYNTHETASE ALPHA CHAIN (EC 6.1.1.20) (PHEN |
| ID1280 | J | T9A4.4 PROTEIN. |

-continued

| | | |
|---|---|---|
| ID1281 | J | ISOLEUCYL-TRNA SYNTHETASE, MUPIROCIN RESISTANT (EC 6.1.1.5) ( |
| ID1282 | J | ILE-TRNA SYNTHETASE. |
| ID1283 | J | RNA METHYLTRANSFERASE. |
| ID1284 | J | BH3085 PROTEIN. |
| ID1285 | J | ISOLEUCYL-TRNA SYNTHETASE, MUPIROCIN RESISTANT (EC 6.1.1.5) ( |
| ID1286 | J | PUTATIVE SERYL-TRNA SYNTHETASE (EC 6.1.1.11). |
| ID1287 | J | BH0299 PROTEIN. |
| ID1288 | J | RIBONUCLEASE PH (FRAGMENT). |
| ID1289 | J | HISTIDYL-TRNA SYNTHETASE (EC 6.1.1.21). |
| ID1290 | J | ARGINYL-TRNA SYNTHETASE (EC 6.1.1.19). |
| ID1291 | J | PUTATIVE ARGINYL-TRNA SYNTHASE (FRAGMENT). |
| ID1292 | J | TRNA/RRNA METHYLTRANSFERASE. |
| ID1293 | J | TRANSLATION ELONGATION FACTOR EF-P. |
| ID1294 | J | PROLYL-TRNA SYNTHETASE. |
| ID1295 | J | ORF starting with ATG of length 264 |
| ID1296 | KE | *Brevibacterium lactofermentum* aspC protein. |
| ID1297 | KE | HYPOTHETICAL 46.8 KDA PROTEIN. |
| ID1296 | KE | YDFD PROTEIN. |
| ID1299 | KE | *Staphylococcus aureus* regulator protein. |
| ID1300 | KE | YDFD PROTEIN. |
| ID1301 | KE | ORF starting with ATG of length 542 |
| ID1302 | KE | AMINOTRANSFERASE. |
| ID1303 | K | TRANSCRIPTIONAL REGULATOR (LACI FAMILY). |
| ID1304 | K | TRANSCRIPTIONAL REGULATOR. |
| ID1305 | K | TRANSCRIPTIONAL REPRESSOR OF THE TREHALOSE OPERON. |
| ID1306 | K | ORF starting with ATG of length 565 |
| ID1307 | K | SUGAR KINASE. |
| ID1308 | K | BH2511 PROTEIN. |
| ID1309 | K | STAGE 0 SPORULATION PROTEIN J. |
| ID1310 | K | RIBONUCLEASE R (EC 3.1.—.—) (RNASE R) (VACB PROTEIN HOMOLOG) |
| ID1311 | K | TRANSCRIPTIONAL REGULATOR INVOLVED IN CARBON CATABOLITE CONT |
| ID1312 | K | RNA POLYMERASE SIGMA-F FACTOR (STAGE II SPORULATION PROTEIN |
| ID1313 | K | HYPOTHETICAL PROTEIN TM0326. |
| ID1314 | K | DNA-DIRECTED RNA POLYMERASE BETA CHAIN (EC 2.7.7.6) (TRANSCR |
| ID1315 | K | TRANSCRIPTIONAL ANTITERMINATOR OF GLYCEROL UPTAKE OPERON. |
| ID1316 | K | BH0406 PROTEIN. |
| ID1317 | K | TRANSCRIPTIONAL REGULATOR (LRP/ASNC FAMILY). |
| ID1318 | K | STAGE 0 SPORULATION PROTEIN J. |
| ID1319 | K | VIRULENCE-ASSOCIATED PROTEIN. |
| ID1320 | K | TRANSCRIPTIONAL REGULATOR (CNTR FAMILY). |
| ID1321 | K | TRANSCRIPTIONAL REPRESSOR OF THE TREHALOSE OPERON. |
| ID1322 | K | XYLOSE OPERON REGULATORY PROTEIN (XYLR-2). |
| ID1323 | K | TRANSCRIPTIONAL REGULATOR (GNTR FAMILY). |
| ID1324 | K | BH1706 PROTEIN. |
| ID1325 | K | PUTATIVE FIBRONECTIN-BINDING PROTEIN (YLOA PROTEIN). |
| ID1326 | K | PUTATIVE FIBRONECTIN-BINDING PROTEIN (YLOA PROTEIN). |
| ID1327 | K | TRANSCRIPTIONAL REGULATOR. |
| ID1328 | K | BH0677 PROTEIN. |
| ID1329 | K | ORF starting with ATG of length 462 |
| ID1330 | K | TRANSCRIPTIONAL REGULATOR (MERR FAMILY). |
| ID1331 | K | TRANSCRIPTIONAL TERMINATOR. |
| ID1332 | K | ORF starting with ATG of length 585 |
| ID1333 | K | TRANSCRIPTIONAL REGULATOR (MERR FAMILY). |
| ID1334 | K | ORF starting with ATG of length 675 |
| ID1335 | K | TRANSCRIPTIONAL REPRESSOR OF THE XYLOSE OPERON. |
| ID1336 | K | BH3429 PROTEIN. |
| ID1337 | K | BH3146 PROTEIN. |
| ID1338 | K | BH0391 PROTEIN. |
| ID1339 | K | TRANSCRIPTIONAL REGULATOR (GNTR FAMILY). |
| ID1340 | K | ORF starting with ATG of length 573 |
| ID1341 | K | GLUCOSE KINASE. |
| ID1342 | K | TRANSCRIPTIONAL REGULATOR. |
| ID1343 | K | TRANSCRIPTIONAL REGULATOR (LYSR FAMILY). |
| ID1344 | K | COLD SHOCK PROTEIN CSPC. |
| ID1345 | K | ORF starting with ATG of length 624 |
| ID1346 | K | TWO-COMPONENT RESPONSE REGULATOR. |
| ID1347 | K | ORF starting with ATG of length 540 |
| ID1348 | K | TRANSCRIPTIONAL PLEIOTROPIC REGULATOR OF TRANSITION STATE GE |
| ID1349 | K | YBGA PROTEIN. |
| ID1350 | K | TRANSCRIPTIONAL PLEIOTROPIC REGULATOR OF TRANSITION STATE GE |
| ID1351 | K | STAGE V SPORULATION PROTEIN T. |
| ID1352 | K | HYPOTHETICAL 29.9 KDA PROTEIN. |
| ID1353 | K | ORF starting with ATG of length 504 |
| ID1354 | K | HYPOTHETICAL 26.2 KDA PROTEIN IN FTSH-CYSK INTERGENIC REGION |
| ID1355 | K | TRANSCRIPTIONAL REGULATOR (ARAC/XYLS FAMILY). |
| ID1356 | K | VIRULENCE-ASSOCIATED PROTEIN. |
| ID1357 | K | VIRULENCE-ASSOCIATED PROTEIN. |
| ID1358 | K | TRANSCRIPTIONAL REGULATOR (TETR/ACRR FAMILY). |
| ID1359 | K | BH0655 PROTEIN. |

-continued

| | | |
|---|---|---|
| ID1360 | K | TRANSCRIPTIONAL REGULATOR INVOLVED IN CARBON CATABOLITE CONT |
| ID1361 | K | TRANSCRIPTIONAL REGULATOR (HEX REGULON REPRESSOR). |
| ID1362 | K | TRANSCRIPTIONAL REGULATOR (MERR FAMILY). |
| ID1363 | K | TRANSCRIPTIONAL REGULATOR. |
| ID1364 | K | HYPOTHETICAL 13.3 KDA PROTEIN. |
| ID1365 | K | MLL3592 PROTEIN. |
| ID1366 | K | TRANSCRIPTIONAL REGULATOR (LYSR FAMILY). |
| ID1367 | K | MLL3592 PROTEIN. |
| ID1368 | K | RNA POLYMERASE SIGMA-54 FACTOR. |
| ID1369 | K | TRANSCRIPTIONAL REGULATOR. |
| ID1370 | K | TRANSCRIPTIONAL REGULATOR (LACI FAMILY). |
| ID1371 | K | TRANSCRIPTIONAL REGULATOR (GNTR FAMILY). |
| ID1372 | K | ORF starting with ATG of length 375 |
| ID1373 | K | ORF starting with ATG of length 225 |
| ID1374 | K | RNA POLYMERASE GENERAL STRESS SIGMA FACTOR(SIGMA B). |
| ID1375 | K | HYPOTHETICAL TRANSCRIPTIONAL REGULATOR IN COTF-TETB INTERGEN |
| ID1376 | K | PUTATIVE GNTR-FAMILY TRANSCRIPTIONAL REGULATOR. |
| ID1377 | K | TRANSCRIPTIONAL REGULATOR. |
| ID1378 | K | RNA POLYMERASE SIGMA FACTOR (SIGMA54). |
| ID1379 | K | RNA POLYMERASE SIGMA-D FACTOR. |
| ID1380 | K | TRANSCRIPTIONAL FACTOR. |
| ID1381 | K | TRANSCRIPTION REGULATOR. |
| ID1382 | K | PROBABLE HTH_ARAC_FAMILY OF TRANSCRIPTIONAL REGULATOR. |
| ID1383 | K | HYPOTHETICAL TRANSCRIPTIONAL REGULATOR YRAN. |
| ID1384 | K | BH0317 PROTEIN. |
| ID1385 | K | DNA-DIRECTED RNA POLYMERASE BETA SUBUNIT (EC 2.7.7.6). |
| ID1386 | K | RNA POLYMERASE BETA SUBUNIT. |
| ID1387 | K | ORF starting with ATG of length 603 |
| ID1388 | K | TRANSCRIPTIONAL REGULATOR (GNTR FAMILY). |
| ID1389 | K | TRANSCRIPTIONAL REGULATOR. |
| ID1390 | K | PUTATIVE TRANSCRIPTIONAL REGULATOR (TRANSCRIPTIONAL REGULATO |
| ID1391 | K | ORF starting with ATG of length 312 |
| ID1392 | K | TRANSCRIPTIONAL TERMINATOR. |
| ID1393 | K | RNA POLYMERASE SIGMA FACTOR (SIGMA K) PRECURSOR. |
| ID1394 | K | TWO-COMPONENT RESPONSE REGULATOR. |
| ID1395 | K | TRANSCRIPTIONAL REGULATOR (GNTR FAMILY). |
| ID1396 | K | TRANSCRIPTIONAL REGULATOR. |
| ID1397 | K | STAGE V SPORULATION PROTEIN T. |
| ID1398 | K | TRANSCRIPTIONAL REGULATOR, LACI FAMILY. |
| ID1399 | K | TRANSCRIPTIONAL REGULATOR INVOLVED IN CARBON CATABOLITE CONT |
| ID1400 | K | PURR. |
| ID1401 | K | DNA-DIRECTED RNA POLYMERASE BETA CHAIN (EC 2.7.7.6) (TRANSCR |
| ID1402 | K | PROTEASE PRODUCTION REGULATORY PROTEIN HPR. |
| ID1403 | K | DNA-DIRECTED RNA POLYMERASE DELTA SUBUNIT (EC 2.7.7.6). |
| ID1404 | K | PUTATIVE SUCROSE OPERON REPRESSOR. |
| ID1405 | K | ORF starting with ATG of length 513 |
| ID1406 | K | SIMILAR TO B. SUBTILIS YWGB GENE (BH0656 PROTEIN). |
| ID1407 | K | FIBRONECTIN/FIBRINOGEN-BINDING PROTEIN. |
| ID1408 | K | DNA-DIRECTED RNA POLYMERASE ALPHA SUBUNIT (EC 2.7.7.6). |
| ID1409 | K | DNA-DIRECTED RNA POLYMERASE ALPHA SUBUNIT (EC 2.7.7.6). |
| ID1410 | K | RNA POLYMERASE GENERAL STRESS SIGMA FACTOR (SIGMA B). |
| ID1411 | K | RIBONUCLEASE III. |
| ID1412 | K | BH3951 PROTEIN. |
| ID1413 | K | YOZA PROTEIN. |
| ID1414 | K | TRANSCRIPTIONAL ACTIVATOR OF THE GLUTAMATE SYNTHASE OPERON ( |
| ID1415 | K | TRANSCRIPTIONAL REGULATOR. |
| ID1416 | K | TRANSCRIPTIONAL ELONGATION FACTOR. |
| ID1417 | K | ORF starting with ATG of length 599 |
| ID1418 | K | ORF starting with ATG of length 600 |
| ID1419 | K | CATABOLITE CONTROL PROTEIN A. |
| ID1420 | K | ORF starting with ATG of length 461 |
| ID1421 | K | METHICILLIN RESISTANCE PROTEIN MECI. |
| ID1422 | K | HIPOTHETICAL PROTEIN. |
| ID1423 | K | DNA-DIRECTED RNA POLYMERASE BETA CHAIN (EC 2.7.7.6) (TRANSCR |
| ID1424 | K | BH0406 PROTEIN. |
| ID1425 | K | TRANSCRIPTIONAL REGULATOR. |
| ID1426 | K | COLD SHOCK PROTEIN CSPC. |
| ID1427 | K | YDEB PROTEIN (ORFC). |
| ID1428 | K | ORF starting with ATG of length 663 |
| ID1429 | K | TRANSCRIPTIONAL REGULATOR (LRP/ASNC FAMILY). |
| ID1430 | K | HYPOTHETICAL 21.8 KDA PROTETN YVBF (ORF1). |
| ID1431 | K | HYPOTHETICAL 31.6 KDA PROTEIN. |
| ID1432 | K | ORF starting with ATG of length 582 |
| ID1433 | K | YVNA. |
| ID1434 | K | TRANSCRIPTIONAL REGULATOR (ARAC/XYLS FAMILY). |
| ID1435 | K | TRANSCRIPTIONAL REGULATOR INVOLVED IN CARBON CATABOLITE CONT |
| ID1436 | K | TRANSCRIPTIONAL REGULATOR OF EXTRACELLULAR ENZYME GENES. |
| ID1437 | K | TRANSCRIPTIONAL REGULATOR (GNTR FAMILY). |
| ID1438 | K | DNA-DIRECTED RNA POLYMERASE BETA' CHAIN (EC 2.7.7.6) (TRANSC |

-continued

| | | |
|---|---|---|
| ID1439 | K | DNA-DIRECTED RNA POLYMERASE BETA' CHAIN (EC 2.7.7.6) (TRANSC |
| ID1440 | K | TRANSCRIPTIONAL REGULATOR (GNTR FAMILY). |
| ID1441 | K | TRANSCRIPTIONAL REPRESSOR OF THE TREHALOSE OPERON. |
| ID1442 | K | STAGE 0 SPORULATION PROTEIN J. |
| ID1443 | K | DNA-BINDING PROTEIN SPO0J-LIKE HOMOLOG. |
| ID1444 | K | TRANSCRIPTIONAL REGULATOR (GNTR FAMILY). |
| ID1445 | K | ORF starting with ATG of length 642 |
| ID1446 | K | HYPOTHETICAL TRANSCRIPTIONAL REGULATOR YKUM. |
| ID1447 | K | RNA POLYMERASE SIGMA FACTOR (SIGMA54). |
| ID1448 | K | TRANSCRIPTIONAL REGULATOR (LACI FAMILY). |
| ID1449 | K | TRANSCRIPTIONAL REGULATOR (MARR FAMILY). |
| ID1450 | K | ORF starting with ATG of length 603 |
| ID1451 | K | TRANSCRIPTIONAL REGULATOR. |
| ID1452 | KG | PUTATIVE LACTOSE PHOSPHOTRANSFERASE SYSTEM REPRESSOR PROTEIN |
| ID1453 | KG | YTZE PROTEIN. |
| ID1454 | KG | ORF starting with ATG of length 792 |
| ID1455 | KG | TRANSCRIPTIONAL REGULATOR (DEOR FAMILY). |
| ID1456 | KG | DNA-BINDING PROTEIN IOLR. |
| ID1457 | KL | SNF2 HELICASE. |
| ID1458 | KL | SNF2 HELICASE. |
| ID1459 | KL | ORF starting with ATG of length 489 |
| ID1460 | KL | HELICASE (SNF2/RAD54 FAMILY). |
| ID1461 | KL | HELICASE (SNF2/RAD54 FAMILY). |
| ID1462 | KL | SNF2 HELICASE. |
| ID1463 | KL | SNF2 HELICASE. |
| ID1464 | KR | BH1438 PROTEIN. |
| ID1465 | KR | BH0466 PROTEIN. |
| ID1466 | KR | BH2157 PROTEIN. |
| ID1467 | KR | BH2157 PROTEIN. |
| ID1468 | KR | Protease gene expression protein. |
| ID1469 | KR | ACETYLTRANSFERASE, PUTATIVE. |
| ID1470 | KR | BH0478 PROTEIN. |
| ID1471 | KT | TRANSCRIPTIONAL REPRESSOR OF THE SOS REGULON. |
| ID1472 | KT | TRANSCRIPTIONAL REPRESSOR OF THE SOS REGULON. |
| ID1473 | L | DNA GYRASE SUBUNIT A (EC 5.99.1.3). |
| ID1474 | L | RECF PROTEIN (DNA REPAIR AND GENETIC RECOMBINATION). |
| ID1475 | L | ORF starting with TTG or GTG of length 557 |
| ID1476 | L | PRIMOSOMAL REPLICATION FACTOR Y. |
| ID1477 | L | PRIMOSOMAL REPLICATION FACTOR Y. |
| ID1478 | L | TRANSPOSASE (09). |
| ID1479 | L | YOQV PROTEIN. |
| ID1480 | L | TRANSPOSASE (08). |
| ID1481 | L | EXCINUCLEASE ABC (SUBUNIT C). |
| ID1482 | L | DNA POLYMERASE III ALPHA SUBUNIT (EC 2.7.7.7). |
| ID1483 | L | PUTATIVE TRANSPOSASE. |
| ID1484 | L | DNA TOPOISOMERASE IV SUBUNIT A. |
| ID1485 | L | ORF starting with ATG of length 426 |
| ID1486 | L | PRIMOSOMAL REPLICATION FACTOR Y. |
| ID1487 | L | DNA-DEPENDENT DNA POLYMERASE BETA CHAIN. |
| ID1488 | L | TANSPOSASE. |
| ID1489 | L | HYPOTHETICAL 60.7 KDA PROTEIN. |
| ID1490 | L | TRANSPOSASE (10). |
| ID1491 | L | BH2209 PROTEIN. |
| ID1492 | L | PUTATIVE 3-METHYLADENINE DNA GLYCOSYLASE (EC 3.2.2.—). |
| ID1493 | L | HYPOTHETICAL 45.9 KDA PROTEIN IN GLNQ-ANSR INTERGENIC REGION |
| ID1494 | L | ATP/GTP-BINDING PROTEIN (IMPB/MUCB/SAMB FAMILY). |
| ID1495 | L | DNA PRIMASE. |
| ID1496 | L | DNA TOPOISOMERASE IV SUBUNIT B. |
| ID1497 | L | DNA MISMATCH REPAIR PROTEIN (MISMATCH RECOGNITION STEP). |
| ID1498 | L | DNA MISMATCH REPAIR PROTEIN. |
| ID1499 | L | EXODEOXYRIBONUCLEASE VII (SMALL SUBUNIT). |
| ID1500 | L | PUTATIVE TRANSPOSASE. |
| ID1501 | L | ORF starting with ATG of length 615 |
| ID1502 | L | BH4041 PROTEIN. |
| ID1503 | L | YKFC PROTEIN. |
| ID1504 | L | EXODEOXYRIBONUCLEASE VII (LARGE SUBUNIT). |
| ID1505 | L | TRANSPOSASE (09). |
| ID1506 | L | METHYLATED-DNA--PROTEIN-CYSTEINE METHYLTRANSFERASE (EC 2.1.1 |
| ID1507 | L | EXCINUCLEASE ABC (SUBUNIT B). |
| ID1508 | L | ENDONUCLEASE-LIKE PROTEIN. |
| ID1509 | L | PUTATIVE TRANSPOSASE. |
| ID1510 | L | DNAX, YAAK, RECR, YAAL, BOFA, RRNB-16S, RRNB-23S, RRNB-5S, O |
| ID1511 | L | PRIMOSOME COMPONENT (HELICASE LOADER). |
| ID1512 | L | TYPE I RESTRICTION ENZYME STYSPI M PROTEIN (EC 2.1.1.72) (M. |
| ID1513 | L | TYPE I RESTRICTION ENZYME ECOKI R PROTEIN (EC 3.1.21.3) (R.E |
| ID1514 | L | ORF starting with ATG of length 693 |
| ID1515 | L | TRANSPOSASE (08). |
| ID1516 | L | EXCINUCLEASE ABC (SUBUNIT A). |
| ID1517 | L | DNA MISMATCH REPAIR PROTEIN MUTL. |

-continued

| | | |
|---|---|---|
| ID1518 | L | YRRC PROTEIN. |
| ID1519 | L | DNA GYRASE SUBUNIT B (EC 5.99.1.3). |
| ID1520 | L | DNA GYRASE SUBUNIT A (EC 5.99.1.3). |
| ID1521 | L | PROBABLE ENDONUCLEASE IV (FRAGMENT). |
| ID1522 | L | FORMAMIDOPYRIMIDINE-DNA GLYCOSIDASE (EC 3.2.2.23). |
| ID1523 | L | STRESS-AND STARVATION-INDUCED GENE CONTROLLED BY SIGMA-B. |
| ID1524 | L | HOLLIDAY JUNCTION DNA HELICASE. |
| ID1525 | L | YLBH PROTEIN. |
| ID1526 | L | EXCINUCLEASE ABC (SUBUNIT A). |
| ID1527 | L | PROBABLE DNA TOPOISOMERASE III (EC 5.99.1.2) (RELAXING ENZYM |
| ID1528 | L | PROBABLE DNA TOPOISOMERASE III (EC 5.99.1.2) (RELAXING ENZYM |
| ID1529 | L | YVGS PROTEIN. |
| ID1530 | L | BH4041 PROTEIN. |
| ID1531 | L | INTEGRASE/RECOMBINASE. |
| ID1532 | L | TRANSPOSASE (09). |
| ID1533 | L | DNA POLYMERASE III ALPHA SUBUNIT (EC 2.7.7.7). |
| ID1534 | L | DNA POLYMERASE III ALPHA SUBUNIT (EC 2.7.7.7). |
| ID1535 | L | PUTATIVE DNA POLYMERASE III , ALPHA SUBUNIT (DNA POLYMERASE |
| ID1536 | L | HYPOTHETICAL 17.0 KDA PROTEIN. |
| ID1537 | L | DNA GYRASE SUBUNIT A (EC 5.99.1.3). |
| ID1538 | L | HYPOTHETICAL PROTEIN IN TETL 3'REGION (FRAGMENT). |
| ID1539 | L | RESTRICTION MODIFICATION ENZYME. |
| ID1540 | L | TRANSPOSASE (23). |
| ID1541 | L | TRANSPOSASE. |
| ID1542 | L | Potentiai *M. capsulatus* transposase. |
| ID1543 | L | PXO1-18. |
| ID1544 | L | TRANSPOSASE. |
| ID1545 | L | DNA MISMATCH REPAIR PROTEIN. |
| ID1546 | L | ORF starting with ATG of length 366 |
| ID1547 | L | HYPOTHETICAL 20.7 KDA PROTEIN IN METS-KSGA INTERGENIC REGION |
| ID1548 | L | ATP-DEPENDENT DNA HELICASE. |
| ID1549 | L | ORF starting with ATG of length 629 |
| ID1550 | L | RIBONUCLEASE HII (EC 3.1.26.4) (RNASE HII). |
| ID1551 | L | DNA POLYMERASE III SUBUNIT GAMMA/TAU (EC 2.7.7.7). |
| ID1552 | L | COME OPERON PROTEIN 1. |
| ID1553 | L | DNA POLYMERASE III GAMMA AND TAU SUBUNITS (EC 2.7.7.7). |
| ID1554 | L | DNA REPAIR PROTEIN UVRA. |
| ID1555 | L | EXCINUCLEASE ABC (SUBUNIT B). |
| ID1556 | L | EXCINUCLEASE ABC (SUBUNIT A). |
| ID1557 | L | BH3832 PROTEIN. |
| ID1558 | L | ATP-DEPENDENT DNA HELICASE. |
| ID1559 | L | *Streptomyces globisporus* C-1027 gene cluster ORF −1. |
| ID1560 | L | ATP-DEPENDENT DNA HELICASE. |
| ID1561 | L | YVGS PROTEIN. |
| ID1562 | L | EXODEOXYRIBONUCLEASE (EC 3.1.11.2). |
| ID1563 | L | INT459. |
| ID1564 | L | DNA REPAIR AND GENETIC RECOMBINATION. |
| ID1565 | L | BH2382 PROTEIN. |
| ID1566 | L | DNA REPAIR AND GENETIC RECOMBINATION. |
| ID1567 | L | RESTRICTION ENDONUCLEASE. |
| ID1568 | L | SINGLE-STRAND DNA-SPECIFIC EXONUCLEASE. |
| ID1569 | L | DNA POLYMERASE III, DELTA' SUBUNIT (EC 2.7.7.7). |
| ID1570 | L | 5'-3' EXONUCLEASE. |
| ID1571 | L | 5'-3' EXONUCLEASE. |
| ID1572 | L | ATP-DEPENDENT DNA HELICASE. |
| ID1573 | L | TYPE I RESTRICTION-MODIFICATION SYSTEM SPECIFICITY DETERMINA |
| ID1574 | L | DNA POLYMERASE I (EC 2.7.7.7). |
| ID1575 | L | FORMAMIDOPYRIMIDINE-DNA GLYCOSIDASE (EC 3.2.2.23). |
| ID1576 | L | DNA POLYMERASE I (EC 2.7.7.7). |
| ID1577 | L | BH1765 PROTEIN. |
| ID1578 | L | SPORE PHOTOPRODUCT LYASE (EC 4.1.99.—). |
| ID1579 | L | ATP-DEPENDENT DNA HELICASE. |
| ID1580 | L | DNA GYRASE SUBUNIT A (EC 5.99.1.3). |
| ID1581 | L | ORF starting with ATG of length 426 |
| ID1582 | L | TRANSPOSASE-IS1562. |
| ID1583 | L | TYPE I RESTRICTION ENZYME ECOKI R PROTEIN (EC 3.1.21.3) (R.E |
| ID1584 | L | 5'-3' EXONUCLEASE. |
| ID1585 | L | DNA-3-METHYLADENINE GLYCOSYLASE (EC 3.2.2.21) (3-METHYLADENI |
| ID1586 | L | DNA POLYMERASE III (ALPHA SUBUNIT). |
| ID1587 | L | HELICASE IV (EC 3.6.1.—) (75 KDA HELICASE). |
| ID1588 | L | DNA POLYMERASE III (ALPHA SUBUNIT). |
| ID1589 | L | TYPE I RESTRICTION ENZYME ECOKI R PROTEIN (EC 3.1.21.3) (R.E |
| ID1590 | L | METHYLTRANSFERASE. |
| ID1591 | L | BH1269 PROTEIN. |
| ID1592 | L | EXCINUCLEASE ABC (SUBUNIT B). |
| ID1593 | L | DNAH PROTEIN (DNA POLYMERASE III) (BETA SUBUNIT). |
| ID1594 | L | RECF PROTEIN (DNA REPAIR AND GENETIC RECOMBINATION). |
| ID1595 | L | DNA GYRASE SUBUNIT B (EC 5.99.1.3). |
| ID1596 | L | A gyrase protein sequence. |

-continued

| ID | | Description |
|---|---|---|
| ID1597 | L | TRANSPOSASE (27). |
| ID1598 | L | DNA MISMATCH REPAIR PROTEIN. |
| ID1599 | L | TRANSPOSASE (09). |
| ID1600 | L | CASSETTE CHROMOSOME RECOMBINASE B1. |
| ID1601 | L | TOPOISOMERASE IV SUBUNIT A (EC 5.99.1.—). |
| ID1602 | L | ATP-DEPENDENT DNA HELICASE RECQ (EC 3.6.1.—). |
| ID1603 | L | ATP-DEPENDENT DNA HELICASE RECQ. |
| ID1604 | L | TRANSPOSASE (10). |
| ID1605 | L | HYPOTHETICAL 17.0 KDA PROTEIN. |
| ID1606 | L | DNA MISMATCH REPAIR PROTEIN (MISMATCH RECOGNITION STEP). |
| ID1607 | L | DNA MISMATCH REPAIR PROTEIN. |
| ID1608 | L | DNA MISMATCH REPAIR PROTEIN (MISMATCH RECOGNITION STEP). |
| ID1609 | L | ORF starting with ATG of length 468 |
| ID1610 | L | TRANSPOSASE. |
| ID1611 | L | TRANSPOSASE (08). |
| ID1612 | L | STRESS-AND STARVATION-INDUCED GENE CONTROLLED BY SIGMA-B. |
| ID1613 | L | HYPOTHETICAL 17.0 KDA PROTEIN. |
| ID1614 | L | PUTATIVE TRANSPOSASE. |
| ID1615 | L | PXO1-120. |
| ID1616 | L | ORF starting with ATG of length 1380 |
| ID1617 | L | RIBONUCLEASE HII (EC 3.1.26.4) (RNASE HII). |
| ID1618 | L | YVGS PROTEIN. |
| ID1619 | L | CASSETTE CHROMOSOME RECOMBINASE B1. |
| ID1620 | L | BH3609 PROTEIN. |
| ID1621 | L | DNA-3-METHYLADENINE GLYCOSYLASE (EC 3.2.2.21) (3-METHYLADENI |
| ID1622 | L | DNA REPAIR PROTEIN. |
| ID1623 | LK | TRANSCRIPTION-REPAIR COUPLING FACTOR (TRCF). |
| ID1624 | LK | ATP-DEPENDENT DNA HELICASE (EC 3.6.1.). |
| ID1625 | LK | ATP-DEPENDENT DNA HELICASE (EC 3.6.1.). |
| ID1626 | LK | TRANSCRIPTION-REPAIR COUPLING FACTOR. |
| ID1627 | LKJ | ATP-DEPENDENT RNA HELICASE. |
| ID1628 | LKJ | ATP-DEPENDENT RNA HELICASE. |
| ID1629 | LKJ | ATP-DEPENDENT RNA HELICASE. |
| ID1630 | LKJ | LATE COMPETENCE PROTEIN. |
| ID1631 | LR | MUTATOR MUTT PROTEIN. |
| ID1632 | LR | BH0986 PROTEIN. |
| ID1633 | LR | ORF10291-1 (FRAGMENT). |
| ID1634 | LR | BH1281 PROTEIN. |
| ID1635 | M | HYPOTHETICAL 73.2 KDA PROTEIN IN SODA-COMGA INTERGENIC REGIO |
| ID1636 | M | S. fradiae tylosin biosynthetic pathway D-alanine carboxypep |
| ID1637 | M | PENICILLIN-BINDING PROTEIN DACF PRECURSOR (D-ALANYL-D-ALANIN |
| ID1638 | M | UDP-N-ACETYLGLUCOSAMINE 1-CARBOXYVINYLTRANSFERASE (EC 2.5.1. |
| ID1639 | M | ORF starting with ATG of length 882 |
| ID1640 | M | CELL-SHAPE DETERMINING PROTEIN. |
| ID1641 | M | GLYCINE BETAINE TRANSPORTER. |
| ID1642 | M | CELL-SHAPE DETERMINING PROTEIN. |
| ID1643 | M | Sequence translated from reading frame b of plasmid pASK46. |
| ID1644 | M | autolysin useful in degrading bacterial cell walls such as i |
| ID1645 | M | N-ACETYLMURAMCYL-L-ALANINE AMIDASE. |
| ID1646 | M | ORF starting with ATG of length 360 |
| ID1647 | M | PENICILLIN-BINDING PROTEINS 1A/1B. |
| ID1648 | M | ORF starting with ATG of length 537 |
| ID1649 | M | PENICILLIN-BINDING PROTEIN 2A (SPORE OUTGROWTH). |
| ID1650 | M | S. aureus MurB protein #1. |
| ID1651 | M | DNAG, RPOD, CPOA GENES AND ORF3 AND ORF5 (FRAGMENT). |
| ID1652 | M | UDP-GLUCOSE 4-EPIMERASE (EC 5.1.3.2) (GALACTOWALDENASE) (UDP |
| ID1653 | M | UDP-N-ACETYLGLUCOSAMINE PYROPHOSPHORYLASE (EC 2.7.7.23). |
| ID1654 | M | GCPE PROTEIN HOMOLOG. |
| ID1655 | M | BETA-LACTAMASE III PRECURSOR (EC 3.5.2.6). |
| ID1656 | M | PENICILLIN-BINDING PROTEIN 3 (PBP 3) (PSPB20). |
| ID1657 | M | B. subtilis hexulose phosphate synthase. |
| ID1658 | M | PENICILLIN-BINDING PROTEIN 5* PRECURSOR (D-ALANYL-D-ALANINEC |
| ID1659 | M | YKFC. |
| ID1660 | M | S. aureus gidB protein sequence. |
| ID1661 | M | B. stearothermophilus alanine racemase. |
| ID1662 | M | HYPOTHETICAL 20.0 KDA PROTEIN IN TLPC-SRFAA INTERGENIC REGIO |
| ID1663 | M | BH1683 PROTEIN. |
| ID1664 | M | UDP-N-ACETYLGLUCOSAMINE PYROPHOSPHORYLASE (EC 2.7.7.23). |
| ID1665 | M | YRVJ PROTEIN. |
| ID1666 | M | SUBSTRATE BINDING PROTEIN OPUCC. |
| ID1667 | M | UDP-GLUCOSE 4-EPIMERASE (EC 5.1.3.2) (GALACTOWALDENASE) (UDP |
| ID1668 | M | PENICILLIN-BINDING PROTEIN 4* (PBP 4*) (PBP 4A). |
| ID1669 | M | OUTER MEMBRANE LIPOPROTEIN GNA1946. |
| ID1670 | M | BH1683 PROTEIN. |
| ID1671 | M | autolysin useful in degrading bacterial cell walls such as i |
| ID1672 | M | PENICILLIN-BINDING PROTEIN 1A (GERMINATION). |
| ID1673 | M | ORF starting with ATG of length 453 |
| ID1674 | M | PENICILLIN-BINDING PROTEIN 1A (GERMINATION). |
| ID1675 | M | PENICILLIN-BINDING PROTEINS 1A/1B. |

-continued

| | | |
|---|---|---|
| ID1676 | M | CELL WALL-BINDING PROTEIN. |
| ID1677 | M | PENICILLIN-BINDING PROTEIN 1A. |
| ID1678 | M | HYPOTHETICAL 20.0 KDA PROTEIN IN TLPC-SRFAA INTERGENIC REGIO |
| ID1679 | M | PENICILLIN-BINDING PROTEIN 1A. |
| ID1680 | M | D-ALANINE-D-ALANINE LIGASE A. |
| ID1681 | M | PUTATIVE D-ALANINE:D-ALANINE LIGASE (DDL) (FRAGMENT). |
| ID1682 | M | HYPOTHETICAL 42.0 KDA PROTEIN IN DAPB-PAPS INTERGENIC REGION |
| ID1683 | M | PENICILLIN-BINDING PROTEIN. |
| ID1684 | M | CSBB PROTEIN. |
| ID1685 | M | UDP-N-ACETYLMURAMATE-ALANINE LIGASE (EC 6.3.2.8). |
| ID1686 | M | PUTATIVE GLYCOSYLTRANSFERASE (FRAGMENT). |
| ID1687 | M | PENICILLIN-BINDING PROTEIN 2B (CELL-DIVISION SEPTUM). |
| ID1688 | M | D-ALANINE--D-ALANINE LIGASE A (EC 6.3.2.4) (D-ALANYLALANINES |
| ID1689 | M | STAGE V SPORULATION PROTEIN (SOPRULATION SPECIFIC PENICILLIN |
| ID1690 | M | SIMILAR TO *Pseudomonas aeruginosa* GDP-MANNOSE.6-DEHYDROGENAS |
| ID1691 | M | TUAG PROTEIN. |
| ID1692 | M | UDP-GLUCOSE 6-DEHYDROGENASE. |
| ID1693 | M | BH2420 PROTEIN. |
| ID1694 | M | YFNI. |
| ID1695 | M | TUAG PROTEIN. |
| ID1696 | M | DNAG, RPOD, CPOA GENES AND ORF3 AND ORF5. |
| ID1697 | M | SPORE CORTEX-LYTIC ENZYME. |
| ID1698 | M | BH1391 PROTEIN. |
| ID1699 | M | PROLIPOPROTEIN DIACYLGLYCERYL TRANSFERASE (EC 2.4.99.). |
| ID1700 | M | PUTATIVE PENICILLIN BINDING PROTEIN PRECURSOR. |
| ID1701 | M | PROLIPOPROTEIN DIACYLGLYCERYL TRANSFERASE (EC 2.4.99.). |
| ID1702 | M | STAGE V SPORULATION PROTEIN (SOPRULATION SPECIFIC PENICILLIN |
| ID1703 | M | UDP-N-ACETYLMURAMOYLALANYL-D-GLUTAMYL-2, 6-DIAMINOPIMELATE L |
| ID1704 | M | STAGE II SPORULATION PROTEIN. |
| ID1705 | M | D-ALANINE-D-ALANINE LIGASE A. |
| ID1706 | M | UDP-N-ACETYLGLUCOSAMINE-LIKE PROTEIN. |
| ID1707 | M | UDP-N-ACETYLGLUCOSAMINE 1-CARBOXYVINYLTRANSFERASE (EC 2.5.1. |
| ID1708 | M | BH3436 PROTEIN. |
| ID1709 | M | TEICHOIC ACID BIOSYNTHESIS PROTEIN. |
| ID1710 | M | TEICHOIC ACID TRANSLOCATION PERMEASE PROTEIN TAGG. |
| ID1711 | M | TEICHOIC ACID TRANSLOCATION PERMEASE PROTEIN TAGG. |
| ID1712 | M | UTP--GLUCOSE-1-PHOSPHATE URIDYLYLTRANSFERASE (EC 2.7.7.9) (U |
| ID1713 | M | N-ACETYLMURAMOYL-L-ALANINE AMIDASE (MAJOR AUTOLYSIN). |
| ID1714 | M | LIPOPOLYSACCHARIDE BIOSYNTHESIS PROTEIN. |
| ID1715 | M | INTERCOMPARTMENTAL SIGNALLING OF PRO-SIGMA-K PROCESSING/ACTI |
| ID1716 | M | UTP--GLUCOSE-1-PHOSPHATE URIDYLYLTRANSFERASE (EC 2.7.7.9) (U |
| ID1717 | M | GLYCINE BETAINE TRANSPORTER BETL. |
| ID1718 | M | *Racillus subtilis* teichoic acid polymerase. |
| ID1719 | M | HYPOTHETICAL 73.2 KDA PROTEIN IN SODA-COMGA INTERGENIC REGIO |
| ID1720 | M | LYTIC TRANSGLYCOSYLASE. |
| ID1721 | M | ORF starting with ATG of length 894 |
| ID1722 | M | PENICILLIN-BINDING PROTEIN 4 PRECURSOR (PBP 4). |
| ID1723 | M | PENICILLIN-BINDING PROTEIN 4 PRECURSOR (PBP 4). |
| ID1724 | M | BH3268 PROTEIN. |
| ID1725 | M | UDP-N-ACETYLMURAMOYLALANINE--D-GLUTAMATE LIGASE (EC 6.3.2.9) |
| ID1726 | M | *Racillus subtilis* teichoic acid polymerase. |
| ID1727 | M | MRAW PROTEIN (YLLC PROTEIN). |
| ID1728 | M | ORF starting with ATG of length 459 |
| ID1729 | M | PENICILLIN-BINDING PROTEIN 2B (CELL-DIVISION SEPTUM). |
| ID1730 | M | S. pneumoniae derived protein #264. |
| ID1731 | M | PUTATIVE GLYCOSYLTRANSFERASE. |
| ID1732 | M | BH3436 PROTEIN. |
| ID1733 | M | ORF starting with ATG of length 888 |
| ID1734 | M | BH2666 PROTEIN. |
| ID1735 | M | *Staphylococcus aureus* protein SEQ ID #5196. |
| ID1736 | M | L-GLUTAMINE-D-FRUCTOSE-6-PHOSPHATE AMIDOTRANSFERASE (EC 2.6. |
| ID1737 | M | CELL-SHAPE DETERMINING PROTEIN. |
| ID1738 | M | ORF starting with ATG of length 438 |
| ID1739 | M | *S. aureus* gidB protein sequence. |
| ID1740 | M | *S. aureus* MurB protein SEQ ID 1. |
| ID1741 | M | GLYCINE BETAINE/CARNITINE/CHOLINE ABC TRANSPORTER (OSMOPROTE |
| ID1742 | M | TEICHOIC ACID BIOSYNTHESIS PROTEIN F. |
| ID1743 | M | PENICILLIN-BINDING PROTEIN 2B (CELL-DIVISION SEPTUM). |
| ID1744 | M | PROTEOPHOSPHOGLYCAN PRECURSOR (FRAGMENT). |
| ID1745 | M | STAGE V SPORULATION PROTEIN (SOPRULATION SPECIFIC PENICILLIN |
| ID1746 | M | PUTATIVE UNDECAPRENYL-PHOSPHATE N-ACETYLGLUCOSAMINYLTRANSFER |
| ID1747 | M | CELL-DIVISION INITIATION PROTEIN (SEPTUM FORMATION). |
| ID1748 | M | DNAG, RPOD, CPOA GENES AND ORF3 AND ORF5 (FRAGMENT). |
| ID1749 | MG | GDP-D-MANNOSE DEHYDRATASE. |
| ID1750 | MG | PROBABLE EPIMERASE. |
| ID1751 | MG | HYPOTHETICAL 22.8 KDA PROTEIN. |
| ID1752 | MI | GCT. |
| ID1753 | MJ | GLUCOSE-1-PHOSPHATE THYMIDYLYLTRANSFERASE. |
| ID1754 | MJ | GLUCOSE-1-PHOSPHATE THYMIDYLYLTRANSFERASE. |

-continued

| ID | | |
|---|---|---|
| ID1755 | N | METHYL-ACCEPTING CHEMOTAXIS PROTEIN TLPA. |
| ID1756 | N | HYPOTHETICAL LIPOPROTEIN YUFN PRECURSOR. |
| ID1757 | N | BH0721 PROTEIN. |
| ID1758 | N | SIGNAL PEPTIDASE I (EC 3.4.21.89) (SPASE I) (LEADER PEPTIDAS |
| ID1759 | N | ORF starting with ATG of length 819 |
| ID1760 | N | METHYL-ACCEPTING CHEMOTAXIS PROTEIN. |
| ID1761 | N | PREPROTEIN TRANSLOCASE SUBUNIT. |
| ID1762 | N | ORF starting with ATG of length 693 |
| ID1763 | N | PREPROTEIN TRANSLOCASE, SECA. |
| ID1764 | N | METHYL-ACCEPTING CHEMOTAXIS PROTEIN TLPB. |
| ID1765 | N | DNA TRANSPORT MACHINERY. |
| ID1766 | N | ORF starting with ATG of length 771 |
| ID1767 | N | HYPOTHETICAL PROTEIN BH0553. |
| ID1768 | N | FLAGELLAR HOOK-ASSOCIATED PROTEIN 3 (HAP3). |
| ID1769 | N | ORF starting with ATG of length 762 |
| ID1770 | N | FLAGELLAR HOOK-ASSOCIATED PROTEIN 1 (FLGK). |
| ID1771 | N | METHYL-ACCEPTING CHEMOTAXIS PROTEIN TLPA. |
| ID1772 | N | FLAGELLAR BIOSYNTHESIS PROTEIN FLHF (FLAGELLA ASSOCIATED GTP |
| ID1773 | N | CHEMOTAXIS MOTB PROTEIN (MOTILITY PROTEIN B). |
| ID1774 | N | FLAGELLAR MOTOR SWITCH PROTEIN. |
| ID1775 | N | PROTEIN-EXPORT MEMBRANE PROTEIN. |
| ID1776 | N | PROTEIN-EXPORT MEMBRANE PROTEIN. |
| ID1777 | N | ORF starting with ATG of length 522 |
| ID1778 | N | PREPROTEIN TRANSLOCASE SUBUNIT. |
| ID1779 | N | FLAGELLAR-SPECIFIC ATP SYNTHASE. |
| ID1780 | N | FLAGELLAR MOTOR SWITCH PROTEIN. |
| ID1781 | N | ORF starting with ATG of length 763 |
| ID1782 | N | BH0721 PROTEIN. |
| ID1783 | N | PREPROTEIN TRANSLOCASE SECY SUBUNIT. |
| ID1784 | N | ORF starting with ATG of length 2031 |
| ID1785 | N | SIGNAL PEPTIDASE (TYPE I). |
| ID1786 | N | PREPROTEIN TRANSLOCASE SECY SUBUNIT. |
| ID1787 | N | FLAGELLAR BASAL-BODY M-RING PROTEIN. |
| ID1788 | N | ORF starting with ATG of length 669 |
| ID1789 | N | CHEMOTAXIS PROTEIN CHEW. |
| ID1790 | N | YDII (BH0552 PROTEIN). |
| ID1791 | N | PREPROTEIN TRANSLOCASE SECA SUBUNIT (FRAGMENT). |
| ID1792 | N | FLAGELLAR BIOSYNTHETIC PROTEIN FLIP. |
| ID1793 | N | GTP-BINDING PROTEIN (ELONGATION FACTOR FAMILY). |
| ID1794 | N | FLAGELLAR HOOK-BASAL BODY PROTEIN. |
| ID1795 | N | GTP-BINDING PROTEIN TYPA/BIPA (TYROSINE PHOSPHORYLATED PROTE |
| ID1796 | N | HYPOTHETICAL 24.1 KDA PROTEIN IN SULA-HELD INTERGENIC REGION |
| ID1797 | N | SPOIIIJ PROTEIN (ESSENTIAL FOR SIGMA-G ACTIVITY AT STAGE III |
| ID1798 | N | FLAGELLAR HOOK-BASAL BODY PROTEIN. |
| ID1799 | N | FLAGELLAR HOOK-BASAL BODY COMPLEX PROTEIN FLHO. |
| ID1800 | N | FLAGELLAR PROTEIN REQUIRED FOR FLAGELLAR FORMATION. |
| ID1801 | N | FLAGELLAR PROTEIN REQUIRED FOR FLAGELLAR FORMATION. |
| ID1802 | N | FLAGELLA-ASSOCIATED PROTEIN. |
| ID1803 | N | FLAGELLAR BIOSYNTHESIS PROTEIN FLHA. |
| ID1804 | N | METHYL-ACCEPTING CHEMOTAXIS PROTEIN. |
| ID1805 | N | FLAGELLAR HOOK-ASSOCIATED PROTEIN 1 (HAP1). |
| ID1806 | N | TYPE 4 PREPILIN-LIKE PROTEINS LEADER PEPTIDE PROCESSING ENZY |
| ID1807 | N | SIGNAL PEPTIDASE I (EC 3.4.21.89) (SPASE I) (LEADER PEPTIDAS |
| ID1808 | N | ORF starting with ATG of length 402 |
| ID1809 | N | ORF starting with ATG of length 288 |
| ID1810 | NO | PUTATIVE PROTEASE. |
| ID1811 | NO | ATP-DEPENDENT CLP PROTEASE PROTEOLYTIC SUBUNIT. |
| ID1812 | NO | ATP-DEPENDENT CLP PROTEASE PROTEOLYTIC SUBUNIT (EC 3.4.21.). |
| ID1813 | NT | FLAGELLAR MOTOR SWITCH PROTEIN. |
| ID1814 | NT | FLAGELLAR MOTOR SWITCH PROTEIN FLIY. |
| ID1815 | NT | CHEMOTAXIS PROTEIN CHED. |
| ID1816 | OC | BH1942 PROTEIN. |
| ID1817 | OC | BH2664 PROTEIN. |
| ID1818 | O | MINOR EXTRACELLULAR SERINE PROTEASE. |
| ID1819 | O | PROTEIN-DISULFIDE OXIDOREDUCTASE. |
| ID1820 | O | TRANSCRIPTIONAL REGULATOR. |
| ID1821 | O | LEMB (FRAGMENT). |
| ID1822 | O | PUTATIVE TRANSCRIPTIONAL REGULATOR. |
| ID1823 | O | YMAD PROTEIN. |
| ID1824 | O | PYRROLIDONE-CARBOXYLATE PEPTIDASE (EC 3.4.19.3). |
| ID1825 | O | GLUTATHIONE PEROXIDASE. |
| ID1826 | O | NITROGEN FIXATION PROTEIN (NIFU PROTEIN). |
| ID1827 | O | MINOR EXTRACELLULAR SERINE PROTEASE (EC 3.4.21.). |
| ID1828 | O | ATP-DEPENDENT CLP PROTEASE (HEAT-SHOCK PROTEIN). |
| ID1829 | O | Subtilisin protein sequence. |
| ID1830 | O | CLASS III STRESS RESPONSE-RELATED ATPASE. |
| ID1831 | O | DNA REPAIR PROTEIN. |
| ID1832 | O | BH3598 PROTEIN. |
| ID1833 | O | PEPTIDE METHIONINE SULFOXIDE REDUCTASE. |

-continued

| | | |
|---|---|---|
| ID1834 | O | BH1447 PROTEIN. |
| ID1835 | O | CELL-DIVISION PROTEIN (ATP-DEPENDENT ZN METALLOPEPTIDASE) (EC |
| ID1836 | O | ARGININE UTILIZATION REGULATORY PROTEIN ROCR. |
| ID1837 | O | THIOREDOXIN REDUCTASE (NADPH) (EC 1.6.4.5). |
| ID1838 | O | THIOREDOXIN REDUCTASE (EC 1.6.4.5) (TRXR) (GENERAL STRESS PR |
| ID1839 | O | HEAT-SHOCK PROTEIN (ACTIVATION OF DNAK). |
| ID1840 | O | HEAT SHOCK PROTEIN HTPG (HIGH TEMPERATURE PROTEIN G). |
| ID1841 | O | ATP-DEPENDENT CLP PROTEASE ATP-BINDING SUBUNIT (CLASS III HE |
| ID1842 | O | TRIGGER FACTOR (PROLYL ISOMERASE). |
| ID1843 | O | ORF starting with ATG of length 612 |
| ID1844 | O | NEGATIVE EFFECTOR OF THE CONCENTRATION OF HEMA. |
| ID1845 | O | ARGININE UTILIZATION REGULATORY PROTEIN ROCR. |
| ID1846 | O | PUTATIVE SIGMA L-DEPENDENT TRANSCRIPTIONAL REGULATOR IN MMGE |
| ID1847 | O | TRANSCRIPTIONAL REGULATOR (H-T-H). |
| ID1848 | O | ORF starting with ATG of length 1242 |
| ID1849 | O | ORF starting with ATG of length 1145 |
| ID1850 | O | THIOREDOXINE REDUCTASE. |
| ID1851 | O | ORF starting with ATG of length 429 |
| ID1852 | O | 10 KDA CHAPERONIN (PROTEIN CPN10) (PROTEIN GROES). |
| ID1853 | O | CLASS I HEAT-SHOCK PROTEIN (CHAPERONIN). |
| ID1854 | O | STAGE V SPORULATION PROTEIN K. |
| ID1855 | O | CLASS I HEAT-SHOCK PROTEIN (CHAPERONIN). |
| ID1856 | O | DNA REPAIR PROTEIN. |
| ID1857 | O | STAGE V SPORULATION PROTEIN K. |
| ID1858 | O | CLASS I HEAT-SHOCK PROTEIN (CHAPERONIN). |
| ID1859 | O | BH1623 PROTEIN. |
| ID1860 | O | PROBABLE O-SIALOGLYCOPROTEIN ENDOPEPTIDASE (EC 3.4.24.57) (GL |
| ID1861 | O | SERINE PROTEASE DO. |
| ID1862 | O | SERINE PROTEASE DO. |
| ID1863 | O | GENERAL STRESS PROTEIN 17O (GSP17O). |
| ID1864 | O | HEAT-SHOCK PROTEIN (ACTIVATION OF DNAK). |
| ID1865 | O | CLASS I HEAT-SHOCK PROTEIN (CHAPERONIN). |
| ID1866 | O | GRPE PROTEIN. |
| ID1867 | O | CLASS III STRESS RESPONSE-RELATED ATPASE. |
| ID1868 | O | CYTOCHROME C BIOGENESIS. |
| ID1869 | O | C5A PEPTIDASE PRECURSOR (EC 3.4.21.—) (SCP). |
| ID1870 | O | ORF starting with ATG of length 1056 |
| ID1871 | O | PROTEASE. |
| ID1872 | O | CLASS III STRESS RESPONSE-RELATED ATPASE. |
| ID1873 | O | BH2189 PROTEIN. |
| ID1874 | O | CLASS I HEAT-SHOCK PROTEIN (CHAPERONIN). |
| ID1875 | O | CELL DIVISION CYCLE CDC48 HOMOLOG (YJOB PROTEIN). |
| ID1876 | O | CELL DIVISION PROTEIN FTSH HOMOLOG (EC 3.4.24.—). |
| ID1877 | O | THIOREDOXIN REDUCTASE. |
| ID1878 | O | PEPTIDYL-PROLYL CIS-TRANS ISOMERASE B. |
| ID1879 | O | BH3598 PROTEIN. |
| ID1880 | O | PROTEIN SECRETION (PCST-TRANSLOCATION CHAPERONIN). |
| ID1881 | O | YKVL PROTEIN. |
| ID1882 | O | ATP-DEPENDENT PROTEASE LA (EC 3.4.21.53). |
| ID1883 | O | ATP-DEPENDENT PROTEINASE LA (EC 3.4.21.). |
| ID1884 | O | ATP-DEPENDENT PROTEINASE LA 1 (LON) (CLASS III HEAT-SHOCK PR |
| ID1885 | O | ATP-DEPENDENT PROTEINASE LA (EC 3.4.21.). |
| ID1886 | O | NEGATIVE EFFECTOR OF THE CONCENTRATION OF HEMA. |
| ID1887 | O | Subtilisin protein sequence. |
| ID1888 | O | GLUTATHIONE PEROXIDASE HOMOLOG BSAA. |
| ID1889 | O | BH3598 PROTEIN. |
| ID1890 | O | STAGE V SPORULATTON PROTEIN K. |
| ID1891 | O | CLASS III STRESS RESPONSE-RELATED ATPASE. |
| ID1892 | O | DNA REPAIR PROTEIN. |
| ID1893 | O | 10 KDA CHAPERONIN (PROTEIN CPN10) (PROTEIN GROES). |
| ID1894 | O | CLASS I HEAT-SHOCK PROTEIN (CHAPERONIN). |
| ID1895 | P | SODIUM-DEPENDENT PHOSPHATE TRANSPORTER. |
| ID1896 | P | SULFATE ADENYLYLTRANSFERASE. |
| ID1897 | P | BH1407 PROTEIN. |
| ID1898 | P | BH1407 PROTEIN. |
| ID1899 | P | SUPEROXIDE DISMUTASE. |
| ID1900 | P | Partial sequence of human manganese superoxide dismutase (bM |
| ID1901 | P | YDFA PROTEIN. |
| ID1902 | P | HYPOTHETICAL PROTEIN YWRB. |
| ID1903 | P | YBXA PROTEIN (ABC TRANSPORTER) (ATP-BINDING PROTEIN). |
| ID1904 | P | ORF2 (NA+/H+ ANTIPORTER). |
| ID1905 | P | MULTIPLE RESISTANCE AND PH REGULATION RELATED PROTEIN C. |
| ID1906 | P | YTGA. |
| ID1907 | P | FIMA. |
| ID1908 | P | BH2760 PROTEIN. |
| ID1909 | P | TRANSCRIPTIONAL REGULATOR (FUR FAMILY). |
| ID1910 | P | HYPOTHETICAL 31.8 KDA PROTEIN IN GABP-GUAA INTERGENIC REGION |
| ID1911 | P | MULTIPLE RESISTANCE AND PH REGULATION RELATED PROTETN F. |
| ID1912 | P | MULTIPLE RESISTANCE AND PH REGULATION RELATED PROTEIN E. |

-continued

| | | |
|---|---|---|
| ID1913 | P | HYPOTHETICAL 43.2 KDA PROTEIN IN DNAC-RPLI INTERGENIC REGION |
| ID1914 | P | YVRC PROTEIN. |
| ID1915 | P | TRANSCRIPTIONAL REGULATOR (FUR FAMILY) (YGAG). |
| ID1916 | P | YTGD. |
| ID1917 | P | HYPOTHETICAL 11.3 KDA PROTEIN IN HMP-PROB INTERGENIC REGION. |
| ID1918 | P | THIOSULFATE SULFURTRANSFERASE. |
| ID1919 | P | CATALASE X (EC 1.11.1.6). |
| ID1920 | P | CATION-TRANSPORTING ATPASE (EC 3.6.1.). |
| ID1921 | P | YVGQ (FRAGMENT). |
| ID1922 | P | PROBABLE PERMEASE OF ABC TRANSPORTER. |
| ID1923 | P | PROBABLE CADMIUM-TRANSPORTING ATPASE (EC 3.6.1.—) (CADMIUM E |
| ID1924 | P | ABC TRANSPORTER (ATP-BINDING PROTEIN). |
| ID1925 | P | MGTE. |
| ID1926 | P | *Bacilus megaterium* YkoY protein. |
| ID1927 | P | SA0168 PROTEIN. |
| ID1928 | P | HYPOTHETICAL 12.2 KDA PROTEIN. |
| ID1929 | P | SA0579 PROTEIN. |
| ID1930 | P | HYPOTHETICAL 17.1 KDA PROTEIN IN PHOB-GROES INTERGENIC REGIO |
| ID1931 | P | SULFATE TRANSPORT ATP-BINDING PROTEIN CYSA. |
| ID1932 | P | *Staphylococcus carnosus* nitrate reductase NarH subunit. |
| ID1933 | P | PROBABLE CATION-TRANSPORTING ATPASE F (EC 3.6.1.—). |
| ID1934 | P | YVGQ PROTEIN. |
| ID1935 | P | SA0167 PROTEIN. |
| ID1936 | P | CATION-TRANSPORTING ATPASE PMA1 (EC 3.6.1.—). |
| ID1937 | P | HYPOTHETICAL 38.5 KDA PROTEIN (FRAGMENT). |
| ID1938 | P | HYPOTHETICAL 38.5 KDA PROTEIN (FRAGMENT). |
| ID1939 | P | ARSENICAL PUMP MEMBRANE PROTEIN. |
| ID1940 | P | YVGP PROTEIN. |
| ID1941 | P | PUTATIVE ALIPHATIC SULFONATES TRANSPORT ATP-BINDING PROTEIN |
| ID1942 | P | CADMIUM-TRANSPORTING ATPASE. |
| ID1943 | P | CONSERVED HYPOTHETICAL PROTEIN. |
| ID1944 | P | PROBABLE ABC TRANSPORTER PERMEASE PROTEIN YQGI. |
| ID1945 | P | ORF starting with ATG of length 822 |
| ID1946 | P | PUTATIVE TRANSCRIPTION REGULATOR. |
| ID1947 | P | YTLB. |
| ID1948 | P | PUTATIVE TRANSPORTER. |
| ID1949 | P | CATALASE X (EC 1.11.1.6). |
| ID1950 | P | BH2760 PROTEIN. |
| ID1951 | P | CATALASE. |
| ID1952 | P | BH1028 PROTEIN. |
| ID1953 | P | SA1709 PROTEIN. |
| ID1954 | P | AMMONIUM TRANSPORTER. |
| ID1955 | P | ALKALINE PHOSPHATASE. |
| ID1956 | P | PUTATIVE MONOOXYGENASE CY21B4.10C (EC 1.14.13.—). |
| ID1957 | P | NOVC. |
| ID1958 | P | STEROID MONOOXYGENASE. |
| ID1959 | P | PUTATIVE TRANSPORTER. |
| ID1960 | P | YTLD. |
| ID1961 | P | ABC TRANSPORTER (PERMEASE). |
| ID1962 | P | ABC TRANSPORTER (SUBSTRATE-BINDING PROTEIN). |
| ID1963 | P | HYPOTHETICAL 43.2 KDA PROTEIN IN DNAC-RPLI INTERGENIC REGION |
| ID1964 | P | ZINC ABC TRANSPORTER PERMEASE PROTEIN. |
| ID1965 | P | YCEA. |
| ID1966 | P | ZINC ABC TRANSPORTER ATP BINDING PROTEIN. |
| ID1967 | P | HYPOTHETICAL ABC TRANSPORTER ATP-BINDING PROTEIN YQGK. |
| ID1968 | P | YVGP PROTEIN. |
| ID1969 | P | STEROID MONOOXYGENASE. |
| ID1970 | P | COPPER-TRANSPORTING ATPASE. |
| ID1971 | P | SULFATE ABC TRANSPORTER, PERMEASE PROTEIN. |
| ID1972 | P | POTASSIUM UPTAKE PROTEIN. |
| ID1973 | P | ORF starting with ATG of length 1164 |
| ID1974 | P | PROBABLE CADMIUM-TRANSPORTING ATPASE (EC 3.6.1.—) (CADMIUM E |
| ID1975 | P | COPPER-TRANSPORTING ATPASE. |
| ID1976 | P | SULFATE ABC TRANSPORTER (PERMEASE). |
| ID1977 | P | PROBABLE CADMIUM-TRANSPORTING ATPASE (EC 3.6.1.—) (CADMIUM E |
| ID1978 | P | BH1440 PROTEIN. |
| ID1979 | P | CHROMATE TRANSPORTER. |
| ID1980 | P | SULFATE ADENYLYLTRANSFERASE (EC 2.7.7.4) (SULFATE ADENYLATET |
| ID1981 | P | CHROMATE TRANSPORTER. |
| ID1982 | P | NA+/H+ ANTIPORTER. |
| ID1983 | P | HYPOTHETICAL 28.4 KDA PROTEIN IN SACT-SACP INTERGENIC REGION |
| ID1984 | P | SA0582 PROTEIN. |
| ID1985 | P | PROBABLE CATION-TRANSPORTING ATPASE F (EC 3.6.1.—). |
| ID1986 | P | CATION-TRANSPORTING P-ATPASE PACL. |
| ID1987 | P | CATALASE (EC 1.11.1.6). |
| ID1988 | P | CATALASE (EC 1.11.1.6). |
| ID1989 | P | YTGC. |
| ID1990 | P | ORF starting with ATG of length 470 |
| ID1991 | P | SUPEROXIDE DISMUTASE. |

-continued

| | | |
|---|---|---|
| ID1992 | P | ABC TRANSPORTER ATP-BINDING SUBUNIT. |
| ID1993 | P | CHAPERONIN. |
| ID1994 | P | HYPOTHETICAL 57.2 KDA PROTEIN. |
| ID1995 | P | BH2861 PROTEIN. |
| ID1996 | P | PUTATIVE ABC-TRANSPORTER (FRAGMENT). |
| ID1997 | P | NITRITE EXTRUSION PROTEIN (NITRITE FACILITATOR). |
| ID1998 | P | PROBABLE ABC TRANSPORTER PERMEASE PROTEIN YQGH. |
| ID1999 | P | NA+-TRANSPORTING ATP SYNTHASE. |
| ID2000 | P | YVGR PROTEIN. |
| ID2001 | P | CARBONIC ANHYDRASE. |
| ID2002 | P | PHOSPHONATES TRANSPORT SYSTEM (PERMEASE). |
| ID2003 | P | NA+-TRANSPORTING ATP SYNTHASE. |
| ID2004 | P | SUPEROXIDE DISMUTASE. |
| ID2005 | P | YVGR PROTEIN. |
| ID2006 | P | ABC TRANSPORTER ATP-BINDING SUBUNIT. |
| ID2007 | P | CADMIUM-TRANSPORTING ATPASE. |
| ID2008 | P | NITRITE EXTRUSION PROTEIN (NITRITE FACILITATOR). |
| ID2009 | P | FERRITIN. |
| ID2010 | P | STEROID MONOOXYGENASE. |
| ID2011 | P | ORF starting with ATG of length 723 |
| ID2012 | P | YCEA. |
| ID2013 | PH | *Corynebacterium glutamicum* MCT protein SEQ ID NO:566. |
| ID2014 | PH | YVRB PROTEIN. |
| ID2015 | PH | ORF starting with ATG of length 567 |
| ID2016 | PH | HOMOLOGUE OF FERRIC ANGUIBACTIN TRANSPORT SYSTEM PERMERASE P |
| ID2017 | PH | ORF starting with ATG of length 954 |
| ID2018 | PH | HOMOLOGUE OF FERRIC ANGUIBACTIN TRANSPORT SYSTEM PERMERASE P |
| ID2019 | PH | HOMOLOGUE OF IRON DICITRATE TRANSPORT ATP-BINDING PROTEIN FE |
| ID2020 | PH | FERRICHROME ABC TRANSPORTER (PERMEASE). |
| ID2021 | PH | FERRICHROME TRANSPORT ATP-BINDING PROTEIN FHUC. |
| ID2022 | PH | FERRICHROME TRANSPORT SYSTEM PERMEASE PROTEIN FHUG. |
| ID2023 | PR | ASSIMILATORY NITRITE REDUCTASE (SUBUNIT). |
| ID2024 | PR | ASSIMILATORY NITRITE REDUCTASE (SUBUNIT). |
| ID2025 | PR | ASSIMILATORY NITRITE REDUCTASE (SUBUNIT). |
| ID2026 | Q | YERP PROTEIN. |
| ID2027 | Q | ORF starting with ATG of length 929 |
| ID2028 | Q | BH2163 PROTEIN. |
| ID2029 | Q | ABC TRANSPORTER (ATP-BINDING PROTEIN). |
| ID2030 | Q | ABC TRANSPORTER (ATP-BINDING PROTEIN). |
| ID2031 | Q | SPORE COAT PROTEIN A. |
| ID2032 | Q | NATA. |
| ID2033 | Q | ABC TRANSPORTER (ATP-BINDING PROTEIN). |
| ID2034 | Q | ABC TRANSPORTER (ATP-BINDING PROTEIN). |
| ID2035 | Q | ABC TRANSPORTER (ATP-BINDING PROTEIN). |
| ID2036 | Q | BH3008 PROTEIN. |
| ID2037 | Q | IMIDAZOLONEPROPIONASE (EC 3.5.2.7) (IMIDAZOLONE-5-PROPIONATE |
| ID2038 | Q | ABC TRANSPORTER (ATP-BINDING PROTEIN). |
| ID2039 | Q | HYPOTHETICAL ABC TRANSPORTER ATP-BINDING PROTEIN IN ACDA 5'R |
| ID2040 | Q | BH1071 PROTEIN. |
| ID2041 | Q | SPAF. |
| ID2042 | Q | ABC TRANSPORTER (ATP-BINDING PROTEIN). |
| ID2043 | Q | NARINGENIN-CHALCONE SYNTHASE. |
| ID2044 | Q | ABC TRANSPORTER (ATP-BINDING PROTEIN). |
| ID2045 | Q | HYPOTHETICAL 20.8 KDA PROTEIN IN SERS-DNAZ INTERGENIC REGION |
| ID2046 | Q | SA0829 PROTEIN. |
| ID2047 | Q | BH3008 PROTEIN. |
| ID2048 | Q | Amino acid sequence of picromycin/methymycin cytochrome P450 |
| ID2049 | Q | BH3008 PROTEIN. |
| ID2050 | Q | DIHYDROPYRIMIDINASE RELATED PROTEIN-3 (DRP-3) (NEURAL SPECIF |
| ID2051 | Q | ORF starting with ATG of length 669 |
| ID2052 | Q | ABC TRANSPORTER ATP-BINDING PROTEIN. |
| ID2053 | Q | ACETYLXYLAN ESTERASE (CEPHALOSPORIN-C DEACETYLASE) (EC 3.1.1 |
| ID2054 | Q | YERP PROTEIN. |
| ID2055 | Q | PUTATIVE TRANSMEMBRANE PROTEIN (FRAGMENT). |
| ID2056 | Q | HYPOTHETICAL 28.2 KDA PROTEIN. |
| ID2057 | Q | HYPOTHETICAL ABC TRANSPORTER ATP-BINDING PROTEIN 2 IN GLVBC |
| ID2058 | Q | HYPOTHETICAL ABC TRANSPORTER ATP-BINDING PROTEIN 1 IN GLVBC |
| ID2059 | Q | HYPOTHETICAL 64.5 KDA PROTEIN. |
| ID2060 | Q | ABC TRANSPORTER (ATP-BINDING PROTEIN). |
| ID2061 | Q | ABC TRANSPORTER ATP-BINDING PROTEIN. |
| ID2062 | Q | YERP PROTEIN. |
| ID2063 | Q | ABC TRANSPORTER (ATP-BINDING PROTEIN). |
| ID2064 | Q | ORF starting with ATG of length 639 |
| ID2065 | Q | ABC TRANSPORTER (ATP-BINDING PROTEIN). |
| ID2066 | Q | ORF starting with ATG of length 951 |
| ID2067 | Q | ABC TRANSPORTER (ATP-BINDING PROTEIN). |
| ID2068 | Q | Group *B Streptococcus* protein sequence SEQ ID NO:4. |
| ID2069 | Q | ABC TRANSPORTER (ATP-BINDING PROTEIN). |
| ID2070 | Q | 4-HYDROXYPHENYLACETATE-3-HYDROXYLASE. |

-continued

| | | |
|---|---|---|
| ID2071 | Q | FATTY ACID ALPHA HYDROXYLASE. |
| ID2072 | Q | SA1734 PROTEIN. |
| ID2073 | Q | BH2620 PROTEIN. |
| ID2074 | Q | MRSF PROTEIN. |
| ID2075 | Q | ABC TRANSPORTER (ATP-BINDING PROTEIN). |
| ID2076 | Q | ABC TRANSPORTER (ATP-BINDING PROTEIN). |
| ID2077 | Q | YERP PROTEIN. |
| ID2078 | Q | ABC TRANSPORTER (ATP-BINDING PROTEIN). |
| ID2079 | Q | ABC TRANSPORTER (ATP-BINDING PROTEIN). |
| ID2080 | Q | ABC TRANSPORTER (ATP-BINDING PROTEIN). |
| ID2081 | Q | ABC TRANSPORTER (ATP-BINDING PROTEIN). |
| ID2082 | Q | BH2163 PROTEIN. |
| ID2083 | Q | ABC TRANSPORTER (ATP-BINDING PROTEIN). |
| ID2084 | Q | ABC TRANSPORTER (ATP-BINDING PROTEIN). |
| ID2085 | Q | ABC TRANSPORTER (ATP-BINDING PROTEIN). |
| ID2086 | Q | ORF starting with ATG of length 461 |
| ID2087 | Q | ABC TRANSPORTER (ATP-BINDING PROTEIN). |
| ID2088 | QR | BH3955 PROTEIN. |
| ID2089 | QR | Amino acid sequence of a beta-ketoacyl-ACP reductase protein |
| ID2090 | QR | 3-OXOACYL-[ACYL-CARRIER PROTEIN] REDUCTASE (EC 1.1.1.100) (3 |
| ID2091 | QR | 2,5-DICHLORO-2,5-CYCLOHEXADIENE-1,4-DIOL DEHYDROGENASE. |
| ID2092 | QR | D-MANNONATE OXIDOREDUCTASE. |
| ID2093 | QR | BH2367 PROTEIN. |
| ID2094 | QR | YVAG PROTEIN. |
| ID2095 | QR | SORBITOL-6-PHOSPHATE DEHYDROGENASE. |
| ID2096 | QR | ORF starting with ATG of length 810 |
| ID2097 | QR | 3-OXOACYL-[ACYL-CARRIER PROTEIN] REDUCTASE. |
| ID2098 | QR | ORF starting with ATG of length 885 |
| ID2099 | QR | DEHYDROGENASE/REDUCTASE FAMILY. |
| ID2100 | QR | 2-DEOXY-D-GLUCONATE 3-DEHYDROGENASE (EC 1.1.1.125). |
| ID2101 | QR | HYPOTHETICAL OXIDOREDUCTASE IN RTP-PELB INTERGENIC REGION (E |
| ID2102 | QR | BH1330 PROTEIN. |
| ID2103 | QR | BH0410 PROTEIN. |
| ID2104 | QR | 3-OXOACYL-[ACYL CARRIER PROTEIN] REDUCTASE. |
| ID2105 | QR | SHORT CHAIN ALCOHOL DEHYDROGENASE. |
| ID2106 | QR | HYPOTHETICAL 28.3 KDA PROTEIN IN XPAC-ABRB INTERGENIC REGION |
| ID2107 | QR | HYPOTHETICAL OXIDOREDUCTASE IN CHEV-MOBA INTERGENIC REGION(E |
| ID2108 | QR | ORF starting with ATG of length 504 |
| ID2109 | QR | D-MANNONATE OXIDOREDUCTASE. |
| ID2110 | QR | 3-OXOACYL-[ACYL-CARRIER PROTEIN] REDUCTASE (EC 1.1.1.100). |
| ID2111 | QR | 3-OXOACYL-[ACYL CARRIER PROTEIN] REDUCTASE. |
| ID2112 | R | INDOLE-3-ACETYL-ASPARTIC ACID HYDROLASE. |
| ID2113 | R | BH3467 PROTEIN. |
| ID2114 | R | HYPOTHETICAL 13.6 KDA PROTEIN. |
| ID2115 | R | HMRA. |
| ID2116 | R | HYPOTHETICAL 30.2 KDA PROTEIN IN IDH-DEOR INTERGENIC REGION. |
| ID2117 | R | HYPOTHETICAL 38.3 KDA PROTEIN. |
| ID2118 | R | METHANOL DEHYDROGENASE REGULATORY PROTEIN. |
| ID2119 | R | PUTATIVE ABC TRANSPORTER, INTEGRAL MEMBRANE SUBUNIT. |
| ID2120 | R | HYPOTHETICAL PROTEIN. |
| ID2121 | R | IMMUNOGENIC PROTEIN. |
| ID2122 | R | YBFQ PROTEIN. |
| ID2123 | R | BH2689 PROTEIN. |
| ID2124 | R | PUTATIVE ESTERASE/LIPASE. |
| ID2125 | R | BH1482 PROTEIN. |
| ID2126 | R | BH1746 PROTEIN. |
| ID2127 | R | YKPA PROTEIN. |
| ID2128 | R | SPORE CORTEX PROTEIN. |
| ID2129 | R | ABC TRANSPORTER (ATP-BINDING PROTEIN). |
| ID2130 | R | CARBOXYLESTERASE. |
| ID2131 | R | GUAB (FRAGMENT). |
| ID2132 | R | YLQF (BH2476 PROTEIN). |
| ID2133 | R | BH1362 PROTEIN. |
| ID2134 | R | SODIUM-DEPENDENT TRANSPORTER. |
| ID2135 | R | SEQUENCE 1 FROM PATENT WO9934002. |
| ID2136 | R | ABC TRANSPORTER (ATP-BINDING PROTEIN). |
| ID2137 | R | CONSERVED HYPOTHETICAL PROTEIN. |
| ID2138 | R | BH3108 PROTEIN. |
| ID2139 | R | HMRA. |
| ID2140 | R | LATE COMPETENCE OPERON REQUIRED FOR DNA BINDING AND UPTAKE. |
| ID2141 | R | BH2099 PROTEIN. |
| ID2142 | R | ORF starting with ATG of length 734 |
| ID2143 | R | PHENOL 2-HYDROXYLASE COMPONENT B. |
| ID2144 | R | BH2155 PROTEIN. |
| ID2145 | R | ATP-BINDING PROTEIN. |
| ID2146 | R | HYPOTHETICAL PROTEIN PA4923. |
| ID2147 | R | BH1122 PROTEIN. |
| ID2148 | R | BH1372 PROTEIN. |
| ID2149 | R | BH3923 PROTEIN. |

-continued

| | | |
|---|---|---|
| ID2150 | R | ORF starting with ATG of length 599 |
| ID2151 | R | BH3254 PROTEIN. |
| ID2152 | R | *B. subtilis* hydrolase protein YFHM. |
| ID2153 | R | BH0079 PROTEIN. |
| ID2154 | R | CONSERVED HYPOTHETICAL PROTEIN. |
| ID2155 | R | BH1308 PROTEIN. |
| ID2156 | R | YKOQ. |
| ID2157 | R | YISU PROTEIN. |
| ID2158 | R | BH3866 PROTEIN. |
| ID2159 | R | HYPOTHETICAL 37.5 KDA PROTEIN IN DEGA-NPRB INTERGENIC REGION |
| ID2160 | R | ORF starting with ATG of length 570 |
| ID2161 | R | RIBOSOMAL-PROTEIN (S18)-ALANINE ACETYLTRANSFERASE. |
| ID2162 | R | BH1956 PROTEIN. |
| ID2163 | R | HYPOTHETICAL 32.8 KDA PROTEIN. |
| ID2164 | R | HYPOTHETICAL 17.9 KDA PROTEIN IN PHOB-GROES INTERGENIC REGIO |
| ID2165 | R | CONSERVED HYPOTHETICAL PROTEIN. |
| ID2166 | R | BH3279 PROTEIN. |
| ID2167 | R | PHT4-RELATED PROTEIN. |
| ID2168 | R | BH0392 PROTEIN. |
| ID2169 | R | BH1700 PROTEIN. |
| ID2170 | R | ORF starting with ATG of length 933 |
| ID2171 | R | NADH OXIDASE (EC 1.6.99.3) (NOXASE). |
| ID2172 | R | *Neisseria meningitidis* strain A antigen encoded by ORF6. |
| ID2173 | R | MMGE PROTEIN. |
| ID2174 | R | HYPOTHETICAL 23.3 KDA PROTEIN. |
| ID2175 | R | PENICILLIN G ACYLASE. |
| ID2176 | R | PROTEASE (PROCESSING OF PRO-SIGMA-K TO ACTIVE SIGMA-K). |
| ID2177 | R | BH3470 PROTEIN. |
| ID2178 | R | BH2835 PROTEIN. |
| ID2179 | R | HYPOTHETICAL ABC TRANSPORTER ATP-BINDING PROTEIN TM0352. |
| ID2180 | R | SODIUM-DEPENDENT TRANSPORTER. |
| ID2181 | R | HYPOTHETICAL 37.8 KDA PROTEIN. |
| ID2182 | R | BH2854 PROTEIN. |
| ID2183 | R | MLL8760 PROTEIN. |
| ID2184 | R | HYPOTHETICAL 28.1 KDA PROTEIN IN SIPU 3'REGION. |
| ID2185 | R | ORF starting with ATG of length 600 |
| ID2186 | R | HYPOTHETICAL 32.2 KDA PROTEIN. |
| ID2187 | R | PUTATIVE OXIDOREDUCTASE. |
| ID2188 | R | ABC TRANSPORTER (ATP-BINDING PROTEIN). |
| ID2189 | R | BH3572 PROTEIN. |
| ID2190 | R | ABC TRANSPORTER. |
| ID2191 | R | ABC TRANSPORTER. |
| ID2192 | R | BH3569 PROTEIN. |
| ID2193 | R | YUSC PROTEIN. |
| ID2194 | R | ORF starting with ATG of length 621 |
| ID2195 | R | BH1266 PROTEIN. |
| ID2196 | R | BH1896 PROTEIN. |
| ID2197 | R | SA0211 PROTEIN. |
| ID2198 | R | BH1421 PROTEIN. |
| ID2199 | R | ABC TRANSPORTER, PERMEASE PROTEIN. |
| ID2200 | R | BH2013 PROTEIN. |
| ID2201 | R | ORF starting with ATG of length 701 |
| ID2202 | R | BH2498 PROTEIN. |
| ID2203 | R | ORF starting with ATG of length 474 |
| ID2204 | R | THERMOSTABLE CARBOXYPEPTIDASE (CPSA-2) (EC 3.4.17.). |
| ID2205 | R | ORF starting with ATG of length 972 |
| ID2206 | R | ORF starting with ATG of length 396 |
| ID2207 | R | CARBOXYLESTERASE. |
| ID2208 | R | ORF starting with ATG of length 431 |
| ID2209 | R | METHANOL DEHYDROGENASE REGULATORY PROTEIN. |
| ID2210 | R | BH0720 PROTEIN. |
| ID2211 | R | COMPETENCE-DAMAGE INDUCIBLE PROTEIN CINA. |
| ID2212 | R | HYPOTHETICAL 36.8 KDA PROTEIN. |
| ID2213 | R | BH3279 PROTEIN. |
| ID2214 | R | *Bacillus subtilis* metalloprotease YhaA. |
| ID2215 | R | SPORE CORTEX PROTEIN. |
| ID2216 | R | BH0287 PROTEIN. |
| ID2217 | R | BH0287 PROTEIN. |
| ID2218 | R | HYPOTHETICAL 43.5 KDA PROTEIN. |
| ID2219 | R | WZX. |
| ID2220 | R | AMINOBENZOYL-GLUTAMATE UTILIZATION PROTEIN A HOMOLOG. |
| ID2221 | R | BH2392 PROTEIN. |
| ID2222 | R | HYPOTHETICAL 49.4 KDA PROTEIN. |
| ID2223 | R | BH2703 PROTEIN. |
| ID2224 | R | FLORFENICOL RESISTANCE PROTEIN. |
| ID2225 | R | BH0105 PROTEIN. |
| ID2226 | R | BH2921 PROTEIN. |
| ID2227 | R | HYPOTHETICAL. |
| ID2228 | R | BH2279 PROTEIN. |

-continued

| | | |
|---|---|---|
| ID2229 | R | ORF starting with ATG of length 552 |
| ID2230 | R | BH4031 PROTEIN. |
| ID2231 | R | HYPOTHETICAL PROTEIN. |
| ID2232 | R | BH3883 PROTEIN. |
| ID2233 | R | BH1700 PROTEIN. |
| ID2234 | R | BH0531 PROTEIN. |
| ID2235 | R | ABC TRANSPORTER (ATP-BINDING PROTEIN). |
| ID2236 | R | ABC TRANSPORTER (ATP-BINDING PROTEIN). |
| ID2237 | R | ORF starting with ATG of length 626 |
| ID2238 | R | BH0822 PROTEIN. |
| ID2239 | R | HYPOTHETICAL ABC TRANSPORTER ATP-BINDING PROTEIN YDIF. |
| ID2240 | R | BH0560 PROTEIN. |
| ID2241 | R | NADH OXIDASE (NOX). |
| ID2242 | R | YLQF (BH2476 PROTEIN). |
| ID2243 | R | HYPOTHETICAL PROTEIN YWRF. |
| ID2244 | R | BH2835 PROTEIN. |
| ID2245 | R | ORF starting with ATG of length 489 |
| ID2246 | R | SA0780 PROTEIN. |
| ID2247 | R | HYPOTHETICAL 19.2 KDA PROTEIN IN RPH-ILVB INTERGENIC REGION. |
| ID2248 | R | BH2805 PROTEIN. |
| ID2249 | R | ORF starting with ATG of length 906 |
| ID2250 | R | NADH-DEPENDENT DEHYDROGENASE HOMOLOG. |
| ID2251 | R | LATE COMPETENCE OPERON REQUIRED FOR DNA BINDING AND UPTAKE. |
| ID2252 | R | HYPOTHETICAL PROTEIN. |
| ID2253 | R | ABC TRANSPORTER ATP BINDING PROTEIN. |
| ID2254 | R | ORFL1. |
| ID2255 | R | HYPOTHETICAL 73.4 KDA PROTEIN. |
| ID2256 | R | HYPOTHETICAL 44.4 KDA PROTEIN IN EPR-GALK INTERGENIC REGION. |
| ID2257 | R | CONSERVED HYPOTHETICAL PROTEIN. |
| ID2258 | R | ORF starting with ATG of length 663 |
| ID2259 | R | BH1362 PROTEIN. |
| ID2260 | R | PUTATIVE TRANSPORTER. |
| ID2261 | R | RIBONUCLEASE H-RELATED PROTEIN. |
| ID2262 | R | BH2393 PROTEIN. |
| ID2263 | R | INVOLVED IN SPORE CORTEX SYNTHESIS. |
| ID2264 | R | BH1363 PROTEIN. |
| ID2265 | R | BH1362 PROTEIN. |
| ID2266 | R | GTP-BINDING PROTEIN INVOLVED IN INITIATION OF SPORLULATION. |
| ID2267 | R | BH0106 PROTEIN. |
| ID2268 | R | YTPR. |
| ID2269 | R | BH0052 PROTEIN. |
| ID2270 | R | TWO-COMPONENT SENSOR HISTIDINE KINASE. |
| ID2271 | R | BH1746 PROTEIN. |
| ID2272 | R | BH1089 PROTEIN. |
| ID2273 | R | *Bacillus subtilis* metalloprotease YmfH. |
| ID2274 | R | THDF PROTEIN (THIOPHEN AND FURAN OXIDATION). |
| ID2275 | R | BH0487 PROTEIN. |
| ID2276 | R | BH2820 PROTEIN. |
| ID2277 | R | BH3178 PROTEIN. |
| ID2278 | R | TRANSCRIPTIONAL REGULATOR INVOLVED IN NITROGEN REGULATION (N |
| ID2279 | R | YFIN (BH1056 PROTEIN). |
| ID2280 | R | BH3470 PROTEIN. |
| ID2281 | R | ABC TRANSPORTER (ATP-BINDING PROTEIN). |
| ID2282 | R | HYPOTHETICAL ABC TRANSPORTER ATP-BINDING PROTEIN YLIA. |
| ID2283 | R | HYPOTHETICAL 89.7 KDA PROTEIN. |
| ID2284 | R | HYPOTHETICAL 8.1 KDA PROTEIN IN KDGK 5'REGION (K2 ORF). |
| ID2285 | R | BH3359 PROTEIN. |
| ID2286 | R | BH2393 PROTEIN. |
| ID2287 | R | HYPOTHETICAL 33.7 KDA PROTEIN. |
| ID2288 | R | BH1669 PROTEIN. |
| ID2289 | R | PHOSPHOGLYCOLATE PHOSPHATASE. |
| ID2290 | R | ORF starting with ATG of length 397 |
| ID2291 | R | BH3054 PROTEIN. |
| ID2292 | R | HYPOTHETICAL 24.1 KDA PROTEIN YDIH. |
| ID2293 | R | BH1266 PROTEIN. |
| ID2294 | R | BH1266 PROTEIN. |
| ID2295 | R | BH0608 PROTEIN. |
| ID2296 | R | HYPOTHETICAL 73.4 KDA PROTEIN. |
| ID2297 | R | HYPOTHETICAL 43.4 KDA PROTEIN IN CTAF 3'REGION (ORF2). |
| ID2298 | R | BH3254 PROTEIN. |
| ID2299 | R | ABC TRANSPORTER (ATP-BINDING PROTEIN). |
| ID2300 | R | BH2587 PROTEIN. |
| ID2301 | R | CG3609 PROTEIN. |
| ID2302 | R | ORF starting with ATG of length 431 |
| ID2303 | R | BH2165 PROTEIN. |
| ID2304 | R | *Staphylococcal* ABC transporter protein. |
| ID2305 | R | ORF starting with ATG of length 574 |
| ID2306 | R | GTP-BINDING PROTEIN INVOLVED IN INITIATION OF SPORULATION. |
| ID2307 | R | BH2503 PROTEIN. |

-continued

| | | |
|---|---|---|
| ID2308 | R | HYPOTHETICAL 41.6 KDA PROTEIN IN FMT-SPOVM INTERGENIC REGION |
| ID2309 | R | UNKNOWN. |
| ID2310 | R | COMF OPERON PROTEIN 3. |
| ID2311 | R | ORF starting with ATG of length 347 |
| ID2312 | R | BH3121 PROTEIN. |
| ID2313 | R | BH2498 PROTEIN. |
| ID2314 | R | BH0720 PROTEIN. |
| ID2315 | R | COMPETENCE-DAMAGE INDUCIBLE PROTEIN. |
| ID2316 | R | ORF starting with ATG of length 465 |
| ID2317 | R | HYPOTHETICAL ABC TRANSPORTER ATP-BINDING PROTEIN IN IDH 3'RE |
| ID2318 | R | ORF11. |
| ID2319 | R | IMMUNOGENIC PROTEIN. |
| ID2320 | R | BH1271 PROTEIN. |
| ID2321 | R | GTP-BINDING PROTEIN (ERA/THDF FAMILY). |
| ID2322 | R | JAG PROTEIN (SPOIIIJ-ASSOCIATED PROTEIN). |
| ID2323 | R | BH2906 PROTEIN. |
| ID2324 | R | BH3090 PROTEIN. |
| ID2325 | R | BH3467 PROTEIN. |
| ID2326 | R | BH3359 PROTEIN. |
| ID2327 | R | ORF starting with ATG of length 452 |
| ID2328 | R | BH3090 PROTEIN. |
| ID2329 | R | BH2378 PROTEIN. |
| ID2330 | R | ORFA1. |
| ID2331 | R | PUTATIVE VIRULENCE FACTOR. |
| ID2332 | R | BH1811 PROTEIN. |
| ID2333 | R | YKVM PROTEIN. |
| ID2334 | R | BH0590 PROTEIN. |
| ID2335 | R | HYPOTHETICAL 32.8 KDA PROTEIN. |
| ID2336 | R | HOMOLOGUES TO NITRILE HYDRATASE REGION 3'-HYPOTHETICAL PROTE |
| ID2337 | R | HYPOTHETICAL 35.7 KDA PROTEIN. |
| ID2338 | R | ATP-BINDING PROTEIN ABC. |
| ID2339 | R | ORF starting with ATG of length 549 |
| ID2340 | R | BH1679 PROTEIN. |
| ID2341 | R | ORF starting with ATG of length 1227 |
| ID2342 | R | UNKNOWN (BH3837 PROTEIN). |
| ID2343 | R | BH2972 PROTEIN. |
| ID2344 | R | SODIUM-DEPENDENT TRANSPORTER. |
| ID2345 | R | HYPOTHETICAL 28.1 KDA PROTEIN IN SIPU 3'REGION. |
| ID2346 | R | BH2030 PROTEIN. |
| ID2347 | R | MYO-INOSITOL 2-DEHYDROGENASE. |
| ID2348 | R | BH3289 PROTEIN. |
| ID2349 | R | *Ammonifex degensii* KC4 alkaline phosphatase (3ALA=3A2A). |
| ID2350 | R | ORF starting with ATG of length 756 |
| ID2351 | R | ALUMINUM RESISTANCE PROTEIN (FRAGMENT). |
| ID2352 | R | BH1047 PROTEIN. |
| ID2353 | R | ORF starting with ATG of length 749 |
| ID2354 | R | FORMATE DEHYDROGENASE ALPHA SUBUNIT HOMOLOG. |
| ID2355 | R | BH1746 PROTEIN. |
| ID2356 | R | ORF starting with ATG of length 750 |
| ID2357 | R | HYPOTHETICAL PROTEIN YWRF. |
| ID2358 | R | BH1362 PROTEIN. |
| ID2359 | R | WZX. |
| ID2360 | R | YMFF PROTEIN. |
| ID2361 | R | BH2393 PROTEIN. |
| ID2362 | R | BH2392 PROTEIN. |
| ID2363 | R | ORF starting with ATG of length 933 |
| ID2364 | R | ORF starting with ATG of length 1126 |
| ID2365 | R | BH1421 PROTEIN. |
| ID2366 | R | HYPOTHETICAL 26.3 KDA PROTEIN. |
| ID2367 | R | HYPOTHETICAL 36.8 KDA PROTEIN. |
| ID2368 | R | HYPOTHETICAL 33.7 KDA PROTEIN. |
| ID2369 | R | BH0105 PROTEIN. |
| ID2370 | R | BH0106 PROTEIN. |
| ID2371 | R | BH2921 PROTEIN. |
| ID2372 | R | CONSERVED HYPOTHETICAL PROTEIN. |
| ID2373 | R | YLQF (BH2476 PROTEIN). |
| ID2374 | R | HYPOTHETICAL 19.2 KDA PROTEIN IN RPH-ILVB INTERGENIC REGION. |
| ID2375 | R | PUTATIVE TRANSPORTER. |
| ID2376 | R | CMP-BINDING PROTEIN. |
| ID2377 | R | ORF starting with ATG of length 559 |
| ID2378 | R | ORF starting with ATG of length 216 |
| ID2379 | R | ORF starting with ATG of length 202 |
| ID2380 | R | ORF starting with ATG of length 339 |
| ID2381 | R | ORF starting with ATG of length 386 |
| ID2382 | S | GALACTOSE-1-PHOSPHATE URIDYLTRANSFERASE. |
| ID2383 | S | BH2588 PROTEIN. |
| ID2384 | S | BH1442 PROTEIN. |
| ID2385 | S | BH1440 PROTEIN. |
| ID2386 | S | BH1437 PROTEIN. |

-continued

| | | |
|---|---|---|
| ID2387 | S | BH1436 PROTEIN. |
| ID2388 | S | CITS (TWO-COMPONENT SENSOR HISTIDINE KINASE). |
| ID2389 | S | ORF starting with ATG of length 324 |
| ID2390 | S | HYPOTHETICAL 16.2 KDA PROTEIN IN COMF-FLGM INTERGENIC REGION |
| ID2391 | S | PUTATIVE TWO-COMPONENT SYSTEM SENSOR KINASE. |
| ID2392 | S | DNA, COMPLETE SEQUENCE. |
| ID2393 | S | GTP-BINDING PROTEIN. |
| ID2394 | S | BH4052 PROTEIN. |
| ID2395 | S | BH1263 PROTEIN. |
| ID2396 | S | BH2161 PROTEIN. |
| ID2397 | S | ORF starting with ATG of length 315 |
| ID2398 | S | BH1789 PROTEIN. |
| ID2399 | S | ORF starting with ATG of length 302 |
| ID2400 | S | YDHG PROTEIN. |
| ID2401 | S | MULTIDRUG RESISTANCE PROTEIN. |
| ID2402 | S | BH1496 PROTEIN. |
| ID2403 | S | ORF starting with ATG of length 510 |
| ID2404 | S | DIAMINOPIMELATE EPIMERASE (EC 5.1.1.7) (DAP EPIMERASE). |
| ID2405 | S | BH3939 PROTEIN. |
| ID2406 | S | ORF starting with ATG of length 330 |
| ID2407 | S | HYPOTHETICAL 11.7 KDA PROTEIN. |
| ID2408 | S | *Staphylococcus aureus* protein homologous to hypothetical pro |
| ID2409 | S | ORF starting with ATG of length 390 |
| ID2410 | S | BH1410 PROTEIN. |
| ID2411 | S | ORF starting with ATG of length 450 |
| ID2412 | S | ORF starting with ATG of length 499 |
| ID2413 | S | ORF starting with ATG of length 498 |
| ID2414 | S | STAGE V SPORULATION PROTEIN AF. |
| ID2415 | S | STAGE V SPORULATION PROTEIN AE. |
| ID2416 | S | SPORE GERMINATION PROTEIN A3 PRECURSOR. |
| ID2417 | S | BH2169 PROTEIN. |
| ID2418 | S | GCPE PROTEIN HOMOLOG. |
| ID2419 | S | ORF starting with ATG of length 390 |
| ID2420 | S | HYPOTHETICAL 19.7 KDA PROTEIN. |
| ID2421 | S | BH1740 PROTEIN. |
| ID2422 | S | ORF starting with ATG of length 234 |
| ID2423 | S | HYPOTHETICAL 18.9 KDA PROTEIN IN CYPA-AADK INTERGENIC REGION |
| ID2424 | S | ORF starting with ATG of length 237 |
| ID2425 | S | BH0605 PROTEIN. |
| ID2426 | S | DAUNORUBICIN RESISTANCE ATP-BINDING PROTEIN DRRA. |
| ID2427 | S | GLUCOSIDASE |
| ID2428 | S | ORF starting with ATG of length 351 |
| ID2429 | S | ORF starting with ATG of length 747 |
| ID2430 | S | ORF starting with ATG of length 336 |
| ID2431 | S | HYPOTHETICAL 7.1 KDA PROTEIN. |
| ID2432 | S | ORF starting with ATG of length 363 |
| ID2433 | S | YFHO PROTEIN. |
| ID2434 | S | ORF starting with ATG of length 258 |
| ID2435 | S | HYPOTHETICAL 22.4 KDA PROTEIN IN RPMF-FTSL INTERGENIC REGION |
| ID2436 | S | ORF starting with ATG of length 336 |
| ID2437 | S | BH2332 PROTEIN. |
| ID2438 | S | HYPOTHETICAL 93.5 KDA PROTEIN. |
| ID2439 | S | ORF starting with ATG of length 314 |
| ID2440 | S | MANGANESE ABC TRANSPORTER ATP BINDING PROTEIN. |
| ID2441 | S | TRANSPOSASE FOR TRANSPOSON IN554. |
| ID2442 | S | HYPOTHETICAL 23.7 KDA PROTEIN. |
| ID2443 | S | *E. coli* proliferation associated protein sequence SEQ ID NO: |
| ID2444 | S | ORF starting with ATG of length 348 |
| ID2445 | S | ALDOSE 1-EPIMERASE. |
| ID2446 | S | BH3567 PROTEIN. |
| ID2447 | S | SCRT. |
| ID2448 | S | BH0789 PROTEIN. |
| ID2449 | S | YFHO PROTEIN. |
| ID2450 | S | *Streptococcus pneumoniae* polypeptide. |
| ID2451 | S | BH1373 PROTEIN. |
| ID2452 | S | NAD-DEPENDENT METHANOL DEHYDROGENASE. |
| ID2453 | S | BH1064 PROTEIN. |
| ID2454 | S | SMALL ACID-SOLUBLE SPORE PROTEIN. |
| ID2455 | S | ORF starting with ATG of length 621 |
| ID2456 | S | STREPTOCOCCAL HEMAGGLUTININ. |
| ID2457 | S | ORF starting with ATG of length 1032 |
| ID2458 | S | *M. tuberculosis* polypeptide sequence comprising Mtb-81 antig |
| ID2459 | S | ORF starting with ATG of length 885 |
| ID2460 | S | pJH10 gene product - bacterial endotoxin with insecticidal a |
| ID2461 | S | Sequence attached to hepatitis B virus (HBV) pre-S(1) sequen |
| ID2462 | S | CHLORAMPHENICOL ACETYLTRANSFERASE (EC 2.3.1.28). |
| ID2463 | S | ORF starting with ATG of length 332 |
| ID2464 | S | ORF starting with ATG of length 422 |
| ID2465 | S | GALACTOSE-1-PHOSPHATE URIDYLTRANSFERASE. |

-continued

| | | |
|---|---|---|
| ID2466 | S | BH1694 PROTEIN. |
| ID2467 | S | ORF, HYPOTHETICAL PROTEIN. |
| ID2468 | S | IOLB PROTEIN. |
| ID2469 | S | ORF starting with ATG of length 322 |
| ID2470 | S | INVOLVED IN SPORE CORTEX SYNTHESIS. |
| ID2471 | S | BH1398 PROTEIN. |
| ID2472 | S | *Staphylococcus aureus* protein homologous to subunit fmdE. |
| ID2473 | S | *Staphylococcus aureus* protein homologous to hypothetical pro |
| ID2474 | S | SURFACE PROTEIN PLS. |
| ID2475 | S | BH2296 PROTEIN. |
| ID2476 | S | BH2295 PROTEIN. |
| ID2477 | S | HYPOTHETICAL 25.5 KDA PROTEIN. |
| ID2478 | S | ACETOIN DEHYDROGENASE. |
| ID2479 | S | YFLM PROTEIN. |
| ID2480 | S | BH3472 PROTEIN. |
| ID2481 | S | BH3473 PROTEIN. |
| ID2482 | S | HYPOTHETICAL 25.7 KDA PROTEIN IN BCSA-DEGR INTERGENIC REGION |
| ID2483 | S | HYPOTHETICAL 15.7 KDA PROTEIN IN SPOIIIC-CWLA INTERGENIC REG |
| ID2484 | S | RELATED TO DIMERIC DIHYDRODIOL DEHYDROGENASE. |
| ID2485 | S | BH0220 PROTEIN. |
| ID2486 | S | ORF starting with ATG of length 402 |
| ID2487 | S | DNA TOPOISOMERASE III-LIKE PROTEIN. |
| ID2488 | S | L-ASPARAGINASE (EC 3.5.1.1) (L-ASPARAGINE AMIDOHYDROLASE). |
| ID2489 | S | Amino acid sequence of a partial holB polypeptide. |
| ID2490 | S | CYTOCHROME P450 107B1 (EC 1.14.—.—) (P450CVIIB1). |
| ID2491 | S | PUTATIVE ISOCHORISMATASE. |
| ID2492 | S | HYPOTHETICAL 17.8 KDA PROTEIN. |
| ID2493 | S | ORF starting with ATG of length 693 |
| ID2494 | S | SPORE PROTEASE (DEGRADATION OF SASPS). |
| ID2495 | S | BH4053 PROTEIN. |
| ID2496 | S | ORF starting with ATG of length 324 |
| ID2497 | S | BIOTIN SYNTHASE, PUTATIVE. |
| ID2498 | S | INITIATION OF CHROMOSOME REPLICATION. |
| ID2499 | S | PROBABLE GLUTAMINASE YLAM (EC 3.5.1.2). |
| ID2500 | S | PHOH-LIKE PROTEIN. |
| ID2501 | S | BH1399 PROTEIN. |
| ID2502 | S | PROBABLE ABC TRANSPORTER PERMEASE PROTEIN IN OPUD-BIOI INTER |
| ID2503 | S | ORF starting with ATG of length 933 |
| ID2504 | S | YOBO. |
| ID2505 | S | PHAGE-LIKE ELEMENT PBSX PROTEIN XKDV. |
| ID2506 | S | ORF starting with ATG of length 2268 |
| ID2507 | S | ORF starting with ATG of length 375 |
| ID2508 | S | SA2422 PROTEIN. |
| ID2509 | S | YURZ PROTEIN. |
| ID2510 | S | BH0817 PROTEIN. |
| ID2511 | S | BH2983 PROTEIN. |
| ID2512 | S | ORF starting with ATG of length 564 |
| ID2513 | S | BH1703 PROTEIN. |
| ID2514 | S | PROPIONYL-COA CARBOXYLASE, ALPHA SUBUNIT, PUTATIVE. |
| ID2515 | S | ORF starting with ATG of length 503 |
| ID2516 | S | HYPOTHETICAL PROTEIN. |
| ID2517 | S | PROLIDASE (XAA-PRO DIPEPTIDASE) (PEPQ-LIKE2) (EC 3.4.13.9). |
| ID2518 | S | ORF starting with ATG of length 463 |
| ID2519 | S | ORF starting with ATG of length 347 |
| ID2520 | S | ORF starting with ATG of length 279 |
| ID2521 | S | ORF10. |
| ID2522 | S | FERRICHROME ABC TRANSPORTER (PERMEASE). |
| ID2523 | S | GLYCINE BETAINE TRANSPORTER BETL. |
| ID2524 | S | ORF starting with ATG of length 363 |
| ID2525 | S | BH3219 PROTEIN. |
| ID2526 | S | SMALL PROTEIN B. |
| ID2527 | S | ORF starting with ATG of length 373 |
| ID2528 | S | BH0893 PROTEIN. |
| ID2529 | S | YTJA. |
| ID2530 | S | BH0407 PROTEIN. |
| ID2531 | S | ORF starting with ATG of length 234 |
| ID2532 | S | C4-DICARBOXYLATE TRANSPORT SYSTEM (PERMEASE LARGE PROTEIN). |
| ID2533 | S | CHROMOSOME PARTITION PROTEIN SMC. |
| ID2534 | S | ORF starting with ATG of length 249 |
| ID2535 | S | TRANSCRIPTIONAL REGULATOR. |
| ID2536 | S | TRANSPOSASE (07). |
| ID2537 | S | PTS SYSTEM, GALACTITOL-SPECIFIC ENZYME II, B COMPONENT (EC 2 |
| ID2538 | S | ORF starting with ATG of length 547 |
| ID2539 | S | UNSATURATED GLUCURONYL HYDROLASE. |
| ID2540 | S | THID. |
| ID2541 | S | HYPOTHETICAL 56.4 KDA PROTEIN IN SODA-COMGA INTERGENIC REGIO |
| ID2542 | S | *Streptococcus pneumoniae* encoded polypeptide. |
| ID2543 | S | HYPOTHETICAL 14.9 KDA PROTEIN. |
| ID2544 | S | Amino acid sequence at a *Chlamydia pneumoniae* protein. |

-continued

| | | |
|---|---|---|
| ID2545 | S | HYPOTHETICAL PROTEIN TC0114. |
| ID2546 | S | PTS SYSTEM, BETA-GLUCOSIDE-SPECIFIC ENZYME II, ABC COMPONENT |
| ID2547 | S | HYPOTHETICAL 57.5 KDA PROTEIN IN VMA7-RPS25A INTERGENIC REGI |
| ID2548 | S | BH0193 PROTEIN. |
| ID2549 | S | SUGAR TRANSPORT SYSTEM (PERMEASE) (BINDING PROTEIN DEPENDENT |
| ID2550 | S | GLUCOSE 1-DEHYDROGENASE. |
| ID2551 | S | SMALL ACID-SOLUBLE SPORE PROTEIN (MAJOR GAMMA-TYPE SASP). |
| ID2552 | S | TRANSCRIPTIONAL REPRESSOR. |
| ID2553 | S | BH1432 PROTEIN. |
| ID2554 | S | BH1770 PROTEIN. |
| ID2555 | S | ORF13. |
| ID2556 | S | PROBABLE AMINO ACID PERMEASE. |
| ID2557 | S | 228AA LONG HYPOTHETICAL HYDANTOIN RACEMASE. |
| ID2558 | S | HYPOTHETICAL 30.7 KDA PROTEIN. |
| ID2559 | S | FUMARATE REDUCTASE FLAVOPROTEIN SUBUNIT PRECURSOR (EC 1.3.99 |
| ID2560 | S | BH2577 PROTEIN. |
| ID2561 | S | BH2576 PROTEIN. |
| ID2562 | S | BH2208 PROTEIN. |
| ID2563 | S | ORF starting with ATG of length 433 |
| ID2564 | S | ORF starting with ATG of length 567 |
| ID2565 | S | ORF starting with ATG of length 340 |
| ID2566 | S | ORF starting with ATG of length 230 |
| ID2567 | S | ORF starting with ATG of length 340 |
| ID2568 | S | CONSERVED HYPOTHETICAL PROTEIN. |
| ID2569 | S | BH1373 PROTEIN. |
| ID2570 | S | STAGE III SPORULATION PROTEIN D. |
| ID2571 | S | ORF starting with ATG of length 924 |
| ID2572 | S | BH2734 PROTEIN. |
| ID2573 | S | BH3113 PROTEIN. |
| ID2574 | S | BH3134 PROTEIN. |
| ID2575 | S | ORF starting with ATG of length 569 |
| ID2576 | S | ORF starting with ATG of length 280 |
| ID2577 | S | CELL WALL HYDROLASE (SPORULATION). |
| ID2578 | S | HYPOTHETICAL 20.3 KDA PROTEIN IN UNG-ROCA INTERGENIC REGION. |
| ID2579 | S | BH3828 PROTETN. |
| ID2580 | S | BH3829 PROTEIN. |
| ID2581 | S | BH0790 PROTEIN. |
| ID2582 | S | BH3416 PROTEIN. |
| ID2583 | S | BH2326 PROTEIN. |
| ID2584 | S | ORF starting with ATG of length 381 |
| ID2585 | S | BH1357 PROTEIN. |
| ID2586 | S | BH1704 PROTEIN. |
| ID2587 | S | BH3063 PROTEIN. |
| ID2588 | S | BH2916 PROTEIN. |
| ID2589 | S | SUCROSE-6-PHOSPHATE HYDROLASE. |
| ID2590 | S | YFLK PROTEIN. |
| ID2591 | S | HYPOTHETICAL 41.2 KDA PROTEIN. |
| ID2592 | S | 3-OXOACYL-(ACYL-CARRIER PROTEIN) REDUCTASE. |
| ID2593 | S | HYPOTHETICAL 33.7 KDA PROTEIN. |
| ID2594 | S | ORF starting with ATG of length 300 |
| ID2395 | S | CONSERVED HYPOTHETICAL PROTEIN. |
| ID2596 | S | ORF starting with ATG of length 324 |
| ID2597 | S | PTS SYSTEM GLUCOSE-SPECIFIC IIBC COMPONENT (EIIBC-GLC) (GLU |
| ID2598 | S | YFHO PROTEIN. |
| ID2599 | S | BH1692 PROTEIN. |
| ID2600 | S | DEDA FAMILY PROTEIN. |
| ID2601 | S | ORF starting with ATG of length 258 |
| ID2602 | S | BH1610 PROTEIN. |
| ID2603 | S | CONSERVED HYPOTEHTICAL PROTEIN. |
| ID2604 | S | ORF starting with ATG of length 351 |
| ID2605 | S | SPORE GERMINATION PROTEIN A2. |
| ID2606 | S | SPORE GERMINATION PROTEIN A3 PRECURSOR. |
| ID2607 | S | HYPOTHETICAL 27.6 KDA PROTEIN IN FNR-NARG INTERGENIC REGION. |
| ID2608 | S | BH1148 PROTEIN. |
| ID2609 | S | BH2691 PROTEIN. |
| ID2610 | S | YVNB. |
| ID2611 | S | PUTATIVE INNER MEMBRANE PROTEIN. |
| ID2612 | S | UNDECAPRENOL KINASE (BACITRACIN RESISTANCE PROTEIN). |
| ID2613 | S | C4-DICARBOXYLATE TRANSPORT SYSTEM (PERMEASE LARGE PROTEIN). |
| ID2614 | S | THREONINE SYNTHASE (EC 4.2.99.2). |
| ID2615 | S | SPORE GERMINATION PROTEIN. |
| ID2616 | S | HYPOTHETICAL 41.2 KDA PROTEIN IN GAPA-RND INTERGENIC REGION. |
| ID2617 | S | PUTATIVE DNA BINDING PROTEIN. |
| ID2618 | S | ADENINE DEAMINASE. |
| ID2619 | S | BH1400 PROTEIN. |
| ID2620 | S | BH1399 PROTEIN. |
| ID2621 | S | HYPOTHETICAL 13.3 KDA PROTEIN IN AROD-COMER INTERGENIC REGIO |
| ID2622 | S | TRANSCRIPTIONAL PLEIOTROPIC REPRESSOR. |
| ID2623 | S | TRYPTOPHANYL-TRNA SYNTHETASE. |

-continued

| | | |
|---|---|---|
| ID2624 | S | BH2871 PROTEIN. |
| ID2625 | S | BH2872 PROTEIN. |
| ID2626 | S | HYPOTHETICAL 21.0 KDA LIPOPROTEIN IN CSPB-GLPP INTERGENIC RE |
| ID2627 | S | ORF starting with ATG of length 549 |
| ID2628 | S | BH1162 PROTEIN. |
| ID2629 | S | SA2180 PROTEIN. |
| ID2630 | S | YLNF PROTEIN. |
| ID2631 | S | BH1789 PROTEIN. |
| ID2632 | S | TRANSCRIPTIONAL REGULATOR (GNTR FAMILY). |
| ID2633 | S | RNA POLYMERASE SIGMA FACTOR (SIGMA54). |
| ID2634 | S | BH3562 PROTEIN. |
| ID2635 | S | PRE-NECK APPENDAGE PROTEIN (LATE PROTEIN GP12). |
| ID2636 | S | BH1560 PROTEIN. |
| ID2637 | S | LACTOSE TRANSPORT SYSTEM (PERMEASE). |
| ID2638 | S | CYSTEINYL-TRNA SYNTHETASE (EC 6.1.1.16) (CYSTEINE--TRNA LIGA |
| ID2639 | S | SPORE GERMINATION PROTEIN. |
| ID2640 | S | TRANSCRIPTIONAL REGULATOR. |
| ID2641 | S | SPAE. |
| ID2642 | S | ORF starting with ATG of lengtb 396 |
| ID2643 | S | ENDO-BETA-1,3-GLUCANASE PRECURSOR. |
| ID2644 | S | SPORE MATURATION PROTEIN. |
| ID2645 | S | SPORE MATURATION PROTEIN. |
| ID2646 | S | YOBO. |
| ID2647 | S | BH0709 PROTEIN. |
| ID2648 | S | ORF starting with ATG of length 459 |
| ID2649 | S | SENSOR KINASE. |
| ID2650 | S | SENSOR REGULATOR. |
| ID2651 | S | ORF starting with ATG of length 353 |
| ID2652 | S | BH2838 PROTEIN. |
| ID2653 | S | PROBABLE ABC TRANSPORTER PERMEASE PROTEIN YQGI. |
| ID2654 | S | BH0618 PROTEIN. |
| ID2655 | S | BH1625 PROTEIN. |
| ID2656 | S | YFHO PROTEIN. |
| ID2657 | S | YFHO PROTEIN. |
| ID2658 | S | ACETOHYDROXY ACID SYNTHASE (EC 4.1.3.18) (ACETOLACTATE SYNTH |
| ID2659 | S | ORF starting with ATG of length 588 |
| ID2660 | S | TRANSPOSASE (22). |
| ID2661 | S | ORF starting with ATG of length 488 |
| ID2662 | S | ORF starting with ATG of length 327 |
| ID2663 | S | ORF starting with ATG of length 354 |
| ID2664 | S | ORF starting with ATG of length 354 |
| ID2665 | S | CONSERVED HYPOTHETICAL PROTEIN. |
| ID2666 | S | ORF starting with ATG of length 474 |
| ID2667 | S | WZX. |
| ID2668 | S | TRANSCRIPTIONAL ANTITERMINATOR. |
| ID2669 | S | PTS SYSTEM, GLUCITOL/SORBITOL-SPECIFIC ENZYME IIA COMPONENT. |
| ID2670 | S | SORBITOL OPERON ACTIVATOR. |
| ID2671 | S | BH1565 PROTEIN. |
| ID2672 | S | BH3147 PROTEIN. |
| ID2673 | S | STAGE V SPORULATION PROTEIN AF. |
| ID2674 | S | ORF starting with ATG of length 564 |
| ID2675 | S | PXO1-40. |
| ID2676 | S | ORF starting with ATG of length 378 |
| ID2677 | S | Human ORFX ORF873 polypeptide sequence SEQ ID NO:1746. |
| ID2678 | S | BH1913 PROTEIN. |
| ID2679 | S | ORF starting with ATG of length 567 |
| ID2680 | S | ORF starting with ATG of length 237 |
| ID2681 | S | ORF starting with ATG of length 567 |
| ID2682 | S | YDAS PROTEIN. |
| ID2683 | S | YFMR. |
| ID2684 | S | CHORISMATE MUTASE (ISOZYMES 1 AND 2). |
| ID2685 | S | HYPOTHETICAL 42.4 KDA PROTEIN. |
| ID2686 | S | BH3142 PROTEIN. |
| ID2687 | S | HYPOTHETICAL 32.8 KDA PROTEIN PH1052. |
| ID2688 | S | BH0392 PROTEIN. |
| ID2689 | S | ORF starting with ATG of length 435 |
| ID2690 | S | MLL6980 PROTEIN. |
| ID2691 | S | 217AA LONG HYPOTHETICAL AROM PROTEIN. |
| ID2692 | S | HYPOTHETICAL 34.0 KDA PROTEIN PH1050. |
| ID2693 | S | Amino acid sequence of threonyl-tRNA synthetase I. |
| ID2694 | S | BR3142 PROTEIN. |
| ID2695 | S | Endo-beta-N-acetylglucosaminidase A. |
| ID2696 | S | BH0854 PROTEIN. |
| ID2697 | S | SPORULATION PROTEIN. |
| ID2698 | S | ORF starting with ATG of length 425 |
| ID2699 | S | HYPOTHETICAL (PUTATIVE. |
| ID2700 | S | BH1883 PROTEIN. |
| ID2701 | S | MULTIDRUG RESISTANCE PROTEIN. |
| ID2702 | S | STAGE V SPORULATION PROTEIN AF. |

-continued

| | | |
|---|---|---|
| ID2703 | S | YUEI PROTEIN. |
| ID2704 | S | ORF starting with ATG of length 510 |
| ID2705 | S | ORF1 PROTEIN. |
| ID2706 | S | YUNF PROTEIN. |
| ID2707 | S | BH2855 PROTEIN. |
| ID2708 | S | YJBK PROTEIN. |
| ID2709 | S | ORF 13. |
| ID2710 | S | OLIGOPEPTIDE ABC TRANSPORTER (ATP-BINDING PROTEIN). |
| ID2711 | S | BH0971 PROTEIN. |
| ID2712 | S | BH0971 PROTEIN. |
| ID2713 | S | UNKNOWN PROTEIN. |
| ID2714 | S | ORF starting with ATG of length 360 |
| ID2715 | S | HYPOTHETICAL 30.7 KDA PROTEIN. |
| ID2716 | S | BH2709 PROTEIN. |
| ID2717 | S | SPORE GERMINATION PROTEIN GERYA. |
| ID2718 | S | SPORE GERMINATION PROTEIN. |
| ID2719 | S | SPORE GERMINATION PROTEIN. |
| ID2720 | S | *S. pneumoniae* derived protein #199. |
| ID2721 | S | GLYCEROPHOSPHODIESTER PHOSPHODIESTERASE. |
| ID2722 | S | YUNB PROTEIN. |
| ID2723 | S | YUNB PROTEIN. |
| ID2724 | S | 5-KETO-4-DEOXYURONATE ISOMERASE. |
| ID2725 | S | BH1876 PROTEIN. |
| ID2726 | S | BH2417 PROTEIN. |
| ID2727 | S | Nitrate reductase alpha chain protein. |
| ID272B | S | BH0697 PROTEIN. |
| ID2729 | S | ORF starting with ATG of length 347 |
| ID2730 | S | ORF starting with ATG of length 524 |
| ID2731 | S | TRANSCRIPTIONAL REGULATOR (ARAC/XYLS FAMILY). |
| ID2732 | S | BH1350 PROTEIN. |
| ID2733 | S | *Staphylococcus aureus* histidine kinase polypeptide sequence. |
| ID2734 | S | DNA POLYMERASE, BACTERIOPHAGE-TYPE. |
| ID2735 | S | STAGE V SPORULATION PROTEIN AD. |
| ID2736 | S | STAGE V SPORULATION PROTEIN AC. |
| ID2737 | S | BH1418 PROTEIN. |
| ID2738 | S | MOLYBDOPTERIN BIOSYNTHESIS. |
| ID2739 | S | NADH-DEPENDENT FMN REDUCTASE (EC 1.6.8.1). |
| ID2740 | S | SA2369 PROTEIN. |
| ID2741 | S | BH1387 PROTEIN. |
| ID2742 | S | BETA-GLUCOSIDASE. |
| ID2743 | S | ORF starting with ATG of length 540 |
| ID2744 | S | ASSIMILATORY NITRATE REDUCTASE ELECTRON TRANSFER SUBUNIT. |
| ID2745 | S | BH1114 PROTEIN. |
| ID2746 | S | ORF starting with ATG of length 404 |
| ID2747 | S | ORF starting with ATG of length 696 |
| ID2748 | S | BH3142 PROTEIN. |
| ID2749 | S | ORF starting with ATG of length 316 |
| ID2750 | S | BH2938 PROTEIN. |
| ID2751 | S | TRANSCRIPTION-REPAIR COUPLING FACTOR (TRCF). |
| ID2752 | S | BH0354 PROTEIN. |
| ID2753 | S | BH3134 PROTEIN. |
| ID2754 | S | ORF starting with ATG of length 420 |
| ID2755 | S | ORF starting with ATG of length 678 |
| ID2756 | S | PTS SYSTEM, GLUCITOL/SORBITOL-SPECIFIC IIC2 COMPONENT (EIIC2 |
| ID2757 | S | ORF starting with ATG of length 369 |
| ID2758 | S | ORF starting with ATG of length 334 |
| ID2759 | S | *Staphylococcus aureus* protein of unknown function. |
| ID2760 | S | PROBABLE METHYLTRANSFERASE. |
| ID2761 | S | ORF starting with ATG of length 1317 |
| ID2762 | S | HYPOTHETICAL 15.9 KDA PROTEIN IN ILVD-THYB INTERGENIC REGION |
| ID2763 | S | THIOREDOXIN. |
| ID2764 | S | OXIDOREDUCTASE (SHORT CHAIN DEHYDROGENASE/REDUCTASE FAMILY). |
| ID2765 | S | VIOMYCIN PHOSPHOTRANSFERASE (EC 2.7.1.103) (VIOMYCIN KINASE) |
| ID2766 | S | ORF starting with ATG of length 534 |
| ID2767 | S | BH3881 PROTEIN. |
| ID2768 | S | RNA POLYMERASE ECF-TYPE SIGMA FACTOR. |
| ID2769 | S | NA+/H+ ANTIPORTER. |
| ID2770 | S | HYPOTHETICAL 51.3 KDA PROTEIN. |
| ID2771 | S | BH2161 PROTEIN. |
| ID2772 | S | ORF starting with ATG of length 240 |
| ID2773 | S | HYPOTHETICAL 32.5 KDA PROTEIN IN CCCA-SODA INTERGENIC REGION |
| ID2774 | S | CHEMOTAXIS MOTA PROTEIN (MOTILITY PROTEIN A). |
| ID2775 | S | UROPORPHYRINOGEN III SYNTHASE/METHYLTRANSFERASE (EC 4.2.1.75 |
| ID2776 | S | BH3888 PROTEIN. |
| ID2777 | S | ORF starting with ATG of length 483 |
| ID2778 | S | ORF starting with ATG of length 228 |
| ID2779 | S | HYPOTHETICAL 43.6 KDA PROTEIN IN GBSA-TLPB INTERGENIC REGION |
| ID2780 | S | YOKH PROTEIN. |
| ID2781 | S | ORF starting with ATG of length 455 |

-continued

| | | |
|---|---|---|
| ID2782 | S | *Streptococcus pneumoniae* encoded polypeptide. |
| ID2783 | S | HYPOTHETICAL 14.9 KDA PROTEIN. |
| ID2784 | S | Amino acid sequence of a *Chlamydia pneumoniae* protein. |
| ID2785 | S | HYPOTHETICAL PROTEIN TC0114. |
| ID2786 | S | C4-DICARBOXYLATE TRANSPORT SYSTEM (PERMEASE LARGE PROTEIN). |
| ID2787 | S | BH3131 PROTEIN. |
| ID2788 | S | ORF starting with ATG of length 373 |
| ID2789 | S | MULTIDRUG RESISTANCE PROTEIN. |
| ID2790 | S | SIGMA-54-DEPENDENT TRANSCRIPTIONAL ACTIVATOR. |
| ID2791 | S | ORF starting with ATG of length 753 |
| ID2792 | S | HYPOTHETICAL PROTEIN VC1334. |
| ID2793 | S | CITS (TWO-COMPONENT SENSOR HISTIDINE KINASE). |
| ID2794 | S | ASPARAGINE SYNTHETASE. |
| ID2795 | S | YJDC PROTEIN. |
| ID2796 | S | HYPOTHETICAL 48.5 KDA PROTEIN. |
| ID2797 | S | BH3666 PROTEIN. |
| ID2798 | S | ORF starting with ATG of length 684 |
| ID2799 | S | BH1222 PROTEIN. |
| ID2800 | S | PROBABLE POLY(A) POLYMERASE (EC 2.7.7.19) (PAP). |
| ID2801 | S | TRANSCRIPTIONAL REGULATOR (GNTR FAMILY). |
| ID2802 | S | ORF starting with ATG of length 324 |
| ID2803 | S | ORF starting with ATG of length 273 |
| ID2804 | S | ORF starting with ATG of length 1043 |
| ID2805 | S | BH0896 PROTEIN. |
| ID2806 | S | ALKALINE PHOSPHATASE LIKE PROTEIN. |
| ID2807 | S | YFID (BH3304 PROTEIN). |
| ID2808 | S | ORF starting with ATG of length 537 |
| ID2809 | S | BH3040 PROTEIN. |
| ID2810 | S | ORF starting with ATG of length 711 |
| ID2811 | S | BH3040 PROTEIN. |
| ID2812 | S | HYPOTHETICAL 34.3 KDA PROTEIN. |
| ID2813 | S | BH1235 PROTEIN. |
| ID2814 | S | INVOLVED IN SPORE CORTEX SYNTHESIS. |
| ID2815 | S | PTS SYSTEM, GLUCITOL/SORBITOL-SPECIFIC ENZYME II, BC COMPONE |
| ID2816 | S | ORF starting with ATG of length 602 |
| ID2817 | S | ORF starting with ATG of length 822 |
| ID2818 | S | BH2596 PROTEIN. |
| ID2819 | S | TRANSCRIPTIONAL REGULATOR (ICLR FAMILY). |
| ID2820 | S | TRANSCRIPTIONAL ANTITERMINATOR. |
| ID2821 | S | BH2622 PROTEIN. |
| ID2822 | S | ORF starting with ATG of length 465 |
| ID2823 | S | ORF starting with ATG of length 390 |
| ID2824 | S | ORF starting with ATG of length 226 |
| ID2825 | S | ALPHA-MANNOSIDASE. |
| ID2826 | S | ORF starting with ATG of length 365 |
| ID2827 | S | ORF starting with ATG of length 406 |
| ID2828 | S | ORF starting with ATG of length 549 |
| ID2829 | S | ORF starting with ATG of length 372 |
| ID2830 | S | ORF starting with ATG of length 510 |
| ID2831 | S | ORF starting with ATG of length 1235 |
| ID2832 | S | ORF starting with ATG of length 1418 |
| ID2833 | S | ORF starting with ATG of length 825 |
| ID2834 | S | PUTATIVE TRANSCRIPTION REGULATOR. |
| ID2835 | S | ORF starting with ATG of length 593 |
| ID2836 | S | HYPOTHETICAL 16.3 KDA PROTEIN IN TGL-PGI INTERGENIC REGION. |
| ID2837 | S | BH0852 PROTEIN. |
| ID2838 | S | HYPOTHETICAL 15.0 KDA PROTEIN. |
| ID2839 | S | TWO-COMPONENT RESPONSE REGULATOR. |
| ID2840 | S | YVRD PROTEIN. |
| ID2841 | S | ORF starting with ATG of length 387 |
| ID2842 | S | SERINE PROTEASE DO. |
| ID2843 | S | BH4024 PROTEIN. |
| ID2844 | S | STAGE V SPORULATION PROTEIN AD. |
| ID2845 | S | SIMILAR TO *STAPHYLOCOCCUS AUREUS* CAPA PROTEIN. |
| ID2846 | S | YVBK PROTEIN. |
| ID2847 | S | ORF starting with ATG of length 510 |
| ID2848 | S | BH0988 PROTEIN. |
| ID2849 | S | HYPOTHETICAL 9.7 KDA PROTEIN IN PURC-PURL INTERGENIC REGION. |
| ID2850 | S | ORF starting with ATG of length 890 |
| ID2851 | S | ORF starting with ATG of length 381 |
| ID2852 | S | HYPOTHETICAL OXIDOREDUCTASE IN GBSA-TLPB INTERGENIC REGION(E |
| ID2853 | S | ORF starting with ATG of length 468 |
| ID2854 | S | ORF starting with ATG of length 283 |
| ID2855 | S | ORF starting with ATG of length 601 |
| ID2856 | S | ORF starting with ATG of length 930 |
| ID2857 | S | HYPOTHETICAL 25.4 KDA PROTEIN IN DPPE-HMP INTERGENIC REGION. |
| ID2858 | S | HYPOTHETICAL. |
| ID2859 | S | ORF starting with ATG of length 564 |
| ID2860 | S | HOMOLOG OF PECTIN DEGRADING ENZYME 5-KETO 4-DEOXYURONATE ISO |

-continued

| | | |
|---|---|---|
| ID2861 | S | ORF26. |
| ID2862 | S | ORF starting with ATG of length 237 |
| ID2863 | S | BH0236 PROTEIN. |
| ID2864 | S | HYPOTHETICAL 33.9 KDA PROTEIN IN CRH-TRXB INTERGENIC REGION. |
| ID2865 | S | BH3568 PROTEIN. |
| ID2866 | S | BH2633 PROTEIN. |
| ID2867 | S | BH2637 PROTEIN. |
| ID2868 | S | ORF starting with ATG of length 882 |
| ID2869 | S | BH2252 PROTEIN. |
| ID2870 | S | HYPOTHETICAL 45.4 KDA PROTEIN IN THIAMINASE I 5′REGION. |
| ID2871 | S | TRANSPOSASE (22). |
| ID2872 | S | ABC TRANSPORTER (PERMEASE). |
| ID2873 | S | PTS SYSTEM, FRUCTOSE-SPECIFIC IIABC COMPONENT. |
| ID2874 | S | PHOSPHOTRANSFERASE ENZYME II (EC 2.7.1.69) (PROTEIN-N(PI)-PHO |
| ID2875 | S | BH3567 PROTEIN. |
| ID2876 | S | ORF starting with ATG of length 306 |
| ID2877 | S | BH2855 PROTEIN. |
| ID2878 | S | BH2638 PROTEIN. |
| ID2879 | S | BH2637 PROTEIN. |
| ID2880 | S | BH2284 PROTEIN. |
| ID2881 | S | HYPOTHETICAL 100.1 KDA PROTEIN. |
| ID2882 | S | BH2857 PROTEIN. |
| ID2883 | S | Endo-beta-N-acetylglucosaminidase A. |
| ID2884 | S | BH0676 PROTEIN. |
| ID2885 | S | BH1374 PROTEIN. |
| ID2886 | S | C4-DICARBOXYLATE TRANSPORT SYSTEM (PERMEASE LARGE PROTEIN). |
| ID2887 | S | C4-DICARBOXYLATE TRANSPORT SYSTEM (PERMEASE LARGE PROTEIN). |
| ID2888 | S | PUTATIVE METHYLTRANSFERASE. |
| ID2889 | S | BH1465 PROTEIN. |
| ID2890 | S | ORF starting with ATG of length 693 |
| ID2891 | S | BH1921 PROTEIN. |
| ID2892 | S | E22 PROTEIN (GENE 43 PROTEIN). |
| ID2893 | S | ORFZ (FRAGMENT). |
| ID2894 | S | HYPOTHETICAL PROTEIN. |
| ID2895 | S | ORF starting with ATG of length 791 |
| ID2896 | S | BH0586 PROTEIN. |
| ID2897 | S | BH0587 PROTEIN. |
| ID2898 | S | ORF starting with ATG of length 504 |
| ID2899 | S | ORF starting with ATG of length 282 |
| ID2900 | S | *S. pneumoniae* 30S ribosomal protein S2. |
| ID2901 | S | ORF starting with ATG of length 486 |
| ID2902 | S | HYPOTHETICAL 39.5 KDA PROTEIN IN SIGZ-CSN INTERGENIC REGION. |
| ID2903 | S | INDIRECT NEGATIVE REGULATOR OF SIGMA-B ACTIVITY (SERINE PHOS |
| ID2904 | S | DIHYDROLIPOAMIDE DEHYDROGENASE. |
| ID2905 | S | ORF starting with ATG of length 399 |
| ID2906 | S | MULTIDRUG RESISTANCE PROTEIN. |
| ID2907 | S | BH2837 PROTEIN. |
| ID2908 | S | ORF starting with ATG of length 387 |
| ID2909 | S | ORF starting with ATG of length 362 |
| ID2910 | S | GERMINATION (CORTEX HYDROLYSIS) AND SPORULATION (STAGE II, M |
| ID2911 | S | HYPOTHETICAL TRANSCRIPTIONAL REGULATOR IN FEUA-SIGW INTERGEN |
| ID2912 | S | YNGK PROTEIN. |
| ID2913 | S | TWO-COMPONENT SENSOR HISTIDINE KINASE. |
| ID2914 | S | BH1943 PROTEIN. |
| ID2915 | S | PENICILLIN-BINDING PROTEIN 1A (GERMINATION). |
| ID2916 | S | BH2802 PROTEIN. |
| ID2917 | S | BH1071 PROTEIN. |
| ID2918 | S | *Corynebacterium glutamicum* SMP protein sequence SEQ ID NO:50 |
| ID2919 | S | TRIOSEPHOSPHATE ISOMERASE (EC 5.3.1.1) (TIM). |
| ID2920 | S | ORF starting with ATG of length 492 |
| ID2921 | S | BH3562 PROTEIN. |
| ID2922 | S | MODIFICATION METHYLASE CEQI (EC 2.1.1.72) (ADENINE-SPECIFICM |
| ID2923 | S | BH4007 PROTEIN. |
| ID2924 | S | BH4008 PROTEIN. |
| ID2925 | S | BH0058 PROTEIN. |
| ID2926 | S | BH0589 PROTEIN. |
| ID2927 | S | ORF starting with ATG of length 297 |
| ID2926 | S | BH3197 PROTEIN. |
| ID2929 | S | PUTATIVE HOST CELL SURFACE-EXPOSED LIPOPROTEIN. |
| ID2930 | S | BH0962 PROTEIN. |
| ID2931 | S | ORF starting with ATG of length 294 |
| ID2932 | S | TWO-COMPONENT SENSOR HISTIDINE KINASE. |
| ID2933 | S | BH2007 PROTEIN. |
| ID2934 | S | PENICILLIN TOLERANCE PROTEIN. |
| ID2935 | S | BH3341 PROTEIN. |
| ID2936 | S | ORF starting with ATG of length 357 |
| ID2937 | S | BH3829 PROTEIN. |
| ID2938 | S | PUTATIVE SUGAR TRANSPORTER SUGAR BINDING PROTEIN. |
| ID2939 | S | Nitrate reductase alpha chain protein. |

-continued

| | | |
|---|---|---|
| ID2940 | S | YETF PROTEIN. |
| ID2941 | S | SMALL, ACID-SOLUBLE SPORE PROTEIN D (SASP). |
| ID2942 | S | BH4008 PROTEIN. |
| ID2943 | S | YYDA PROTEIN. |
| ID2944 | S | PUTATIVE REPLICATION FACTOR. |
| ID2945 | S | ORF starting with ATG of length 570 |
| ID2946 | S | ORF starting with ATG of length 389 |
| ID2947 | S | SPORULATION INITIATION PHOSPHOPROTEIN. |
| ID2948 | S | ORF starting with ATG of length 388 |
| ID2949 | S | XYLOSIDASE/ARABINOSIDASE. |
| ID2950 | S | HYPOTHETICAL 56.0 KDA PROTEIN IN GLGB-GBSB INTERGENIC REGION |
| ID2951 | S | ALKALINE PHOSPHATASE. |
| ID2952 | S | ORF starting with ATG of length 231 |
| ID2953 | S | BH3404 PROTEIN. |
| ID2954 | S | BH3402 PROTEIN. |
| ID2955 | S | ORF starting with ATG of length 420 |
| ID2956 | S | PTS SYSTEM, GLUCITOL/SORBITOL-SPECIFIC ENZYME II, C2 COMPONE |
| ID2957 | S | PTS SYSTEM, GLUCITOL/SORBITOL-SPECIFIC ENZYME II, BC COMPONE |
| ID2958 | S | ORF starting with ATG of length 469 |
| ID2959 | S | ORF, HYPOTHETICAL PROTEIN. |
| ID2960 | S | YFHO PROTEIN. |
| ID2961 | S | HYPOTHETICAL 13.1 KDA PROTEIN C29B12.12 IN CHROMOSOME I. |
| ID2962 | S | BH1053 PROTEIN. |
| ID2963 | S | ENOYL-[ACYL-CARRIER PROTEIN] REDUCTASE. |
| ID2964 | S | BH2840 PROTEIN. |
| ID2965 | S | X-LINKED RETINOPATHY PROTEIN (FRAGMENT). |
| ID2966 | S | TRANSPORTER. |
| ID2967 | S | *Staphylococcus aureus* protein of unknown function. |
| ID2968 | S | CYTIDINE DEAMINASE (EC 3.5.4.5). |
| ID2969 | S | BH0315 PROTEIN. |
| ID2970 | S | SMALL CORE PROTEIN (J PROTEIN). |
| ID2971 | S | SCAFFOLDING PROTEIN D (GPD). |
| ID2972 | S | CAPSID PROTEIN (F PROTEIN) (GPF). |
| ID2973 | S | BH1682 PROTEIN. |
| ID2974 | S | 50S RIBOSOMAL PROTEIN L30. |
| ID2975 | S | ORF starting with ATG of length 519 |
| ID2976 | S | BH2274 PROTEIN. |
| ID2977 | S | ORF starting with ATG of length 336 |
| ID2978 | S | ORF starting with ATG of length 588 |
| ID2979 | S | BH2981 PROTEIN. |
| ID2980 | S | BH1804 PROTEIN. |
| ID2981 | S | HYPOTHETICAL PROTEIN VC1332. |
| ID2982 | S | ORF starting with ATG of length 333 |
| ID2983 | S | BH3423 PROTEIN. |
| ID2984 | S | BH3430 PROTEIN. |
| ID2965 | S | ORF starting with ATG of length 600 |
| ID2986 | S | BH1089 PROTEIN. |
| ID2987 | S | BH1707 PROTEIN. |
| ID2988 | S | ORF starting with ATG of length 360 |
| ID2989 | S | YUBB PROTEIN. |
| ID2990 | S | YNGK PROTEIN. |
| ID2991 | S | YTER. |
| ID2992 | S | TRANSCRIPTION ANTITERMINATOR. |
| ID2993 | S | BH1883 PROTEIN. |
| ID2994 | S | EXTENSIN PRECURSOR (CELL WALL HYDROXYPROLINE-RICH GLYCOPROTE |
| ID2995 | S | ORF starting with ATG of length 389 |
| ID2996 | S | BH1336 PROTEIN. |
| ID2997 | S | TWO-COMPONENT SENSOR HISTIDINE KINASE. |
| ID2998 | S | ORF starting with ATG of length 498 |
| ID2999 | S | THYMIDINE KINASE (EC 2.7.1.21). |
| ID3000 | S | YVRI PROTEIN. |
| ID3001 | S | ORF starting with ATG of length 270 |
| ID3002 | S | ORF starting with ATG of length 486 |
| ID3003 | S | HYPOTHETICAL 11.0 KDA PROTEIN IN HSP18 3'REGION (ORFA1). |
| ID3004 | S | BH0973 PROTEIN. |
| ID3005 | S | BH0974 PROTEIN. |
| ID3006 | S | Cyclohexanone monooxygenase sequence. |
| ID3007 | S | HYPOTHETICAL 76.9 KDA PROTEIN. |
| ID3006 | S | MN CATALASE. |
| ID3009 | S | SA0330 PROTEIN. |
| ID3010 | S | ORNITHINE CARBAMOYLTRANSFERASE. |
| ID3011 | S | ACETOIN DEHYDROGENASE. |
| ID3012 | S | ORF starting with ATG of length 258 |
| ID3013 | S | HYPOTHETICAL 6.4 KDA PROTEIN. |
| ID3014 | S | HYPOTHETICAL 48.6 KDA PROTEIN IN SERS-DNAZ INTERGENIC REGION |
| ID3015 | S | MINOR TEICHOIC ACIDS BIOSYNTHESIS PROTEIN GGAA. |
| ID3016 | S | HYPOTHETICAL PROTEIN XF1280. |
| ID3017 | S | ORF starting with ATG of length 472 |
| ID3018 | S | BH3318 PROTEIN. |

-continued

| | | |
|---|---|---|
| ID3019 | S | ORF starting with ATG of length 616 |
| ID3020 | S | *Bacillus clausii* NN049095 BXM20 beta-1,4-mannanase precursor |
| ID3021 | S | ORF starting with ATG of length 474 |
| ID3022 | S | HYPOTHETICAL 4.8 KDA PROTEIN. |
| ID3023 | S | HYPOTHETICAL 8.0 KDA PROTEIN. |
| ID3024 | S | SPORE COAT PROTEIN X (INSOLUBLE FRACTION). |
| ID3025 | S | TRANSCRIPTIONAL REGULATOR. |
| ID3026 | S | ORF starting with ATG of length 771 |
| ID3027 | S | DAUNORUBICIN RESISTANCE PROTEIN. |
| ID3028 | S | MLL2253 PROTEIN. |
| ID3029 | S | ORF starting with ATG of length 495 |
| ID3030 | S | ORF starting with ATG of length 402 |
| ID3031 | S | SPAG. |
| ID3032 | S | YOLA. |
| ID3033 | S | *S. pneumoniae* diacylglycerol kinase. |
| ID3034 | S | CHORISMATE MUTASE. |
| ID3035 | S | TRANSCRIPTIONAL ANTITERMINATOR. |
| ID3036 | S | TRANSCRIPTIONAL REGULATOR (LYSR FAMILY). |
| ID3037 | S | HYPOTHETICAL 37.5 KDA PROTEIN (FRAGMENT). |
| ID3038 | S | BH0105 PROTEIN. |
| ID3039 | S | GLYCEROL-3-PHOSPHATE CYTIDYLTRANSFERASE. |
| ID3040 | S | BH1230 PROTEIN. |
| ID3041 | S | ORF starting with ATG of length 456 |
| ID3042 | S | *Streptococcus pneumoniae* encoded polypeptide. |
| ID3043 | S | HYPOTHETICAL 14.9 KDA PROTEIN. |
| ID3044 | S | Amino acid sequence of a *Chlamydia pneumoniae* protein. |
| ID3045 | S | HYPOTHETICAL PROTEIN TC0114. |
| ID3046 | S | CATION TRANSPORT ATPASE, E1-E2 FAMILY. |
| ID3047 | S | MLL1121 PROTEIN. |
| ID3048 | S | BH1620 PROTEIN. |
| ID3049 | S | ORF starting with ATG of length 386 |
| ID3050 | S | BH2390 PROTEIN. |
| ID3051 | S | ORF starting with ATG of length 294 |
| ID3052 | S | ID867. |
| ID3053 | S | VALYL-TRNA SYNTHETASE (EC 6.1.1.9). |
| ID3054 | S | BH0488 PROTEIN. |
| ID3055 | S | ORF starting with ATG of length 844 |
| ID3056 | S | BH1492 PROTEIN. |
| ID3057 | S | ORF starting with ATG of length 366 |
| ID3058 | S | BH2821 PROTEIN. |
| ID3059 | S | CONSERVED HYPOTHETICAL PROTEIN. |
| ID3060 | S | BH1550 PROTEIN. |
| ID3061 | S | BH2938 PROTEIN. |
| ID3062 | S | PXO1-37. |
| ID3063 | S | BH3176 PROTEIN. |
| ID3064 | S | HYPOTHETICAL 50.9 KDA PROTEIN IN KATA 3'REGION (ORF A). |
| ID3065 | S | ORF starting with ATG of length 534 |
| ID3066 | S | BH3627 PROTEIN. |
| ID3067 | S | ORF starting with ATG of length 558 |
| ID3068 | S | ORF starting with ATG of length 632 |
| ID3069 | S | ORF starting with ATG of length 650 |
| ID3070 | S | L-RHAMNOSE ISOMERASE. |
| ID3071 | S | BH2412 PROTEIN. |
| ID3072 | S | DNA TRANSPORT MACHINERY. |
| ID3073 | S | BH0051 PROTEIN. |
| ID3074 | S | OLIGOPEPTIDE ABC TRANSPORTER (PERMEASE). |
| ID3075 | S | PXO1-37. |
| ID3076 | S | ORF starting with ATG of length 588 |
| ID3077 | S | IMMUNOGENIC PROTEIN. |
| ID3078 | S | ORF starting with ATG of length 518 |
| ID3079 | S | BH1232 PROTEIN. |
| ID3080 | S | SENSOR HISTIDINE KINASE CHEA. |
| ID3081 | S | REPRESSOR. |
| ID3082 | S | BH2052 PROTEIN. |
| ID3083 | S | SSPF PROTEIN. |
| ID3084 | S | ORF starting with ATG of length 279 |
| ID3085 | S | ORF starting with ATG of length 569 |
| ID3086 | S | ANTHRANILATE SYNTHASE COMPONENT I (EC 4.1.3.27). |
| ID3087 | S | SPORE GERMINATION PROTEIN A1. |
| ID3088 | S | MUTANTS BLOCK SPORULATION AFTER ENGULFMENT. |
| ID3089 | S | MUTANTS BLOCK SPORULATION AFTER ENGULFMENT. |
| ID3090 | S | ORF starting with ATG of length 272 |
| ID3091 | S | SPORE GERMINATION PROTEIN KC. |
| ID3092 | S | YBFO PROTEIN. |
| ID3093 | S | PEPTIDASE. |
| ID3094 | S | ORF starting with TTG or GTG of length 573 |
| ID3095 | S | SODIUM-DEPENDENT PHOSPHATE TRANSPORTER. |
| ID3096 | S | HYPOTHETICAL 41.4 KDA PROTEIN IN IADA-MCRD INTERGENIC REGION |
| ID3097 | S | STAGE III SPORULATION PROTEIN AE. |

-continued

| | | |
|---|---|---|
| ID3098 | S | STAGE III SPORULATION PROTEIN AF. |
| ID3099 | S | BH0266 PROTEIN. |
| ID3100 | S | BH2381 PROTEIN. |
| ID3101 | S | ORF starting with ATG of length 312 |
| ID3102 | S | BH0315 PROTEIN. |
| ID3103 | S | PUTATIVE RNA POLYMERASE SIGMA FACTOR. |
| ID3104 | S | BH3310 PROTEIN. |
| ID3105 | S | HYPOTHETICAL 18.1 KDA PROTEIN. |
| ID3106 | S | HYPOTHETICAL 44.9 KDA PROTEIN. |
| ID3107 | S | GLYCEROL UPTAKE OPERON ANTITERMINATOR REGULATORY PROTEIN. |
| ID3108 | S | CDNA FLJ20489 FIS, CLONE KAT08285. |
| ID3109 | S | CREATINE KINASE. |
| ID3110 | S | YVRH PROTEIN (RECEIVER MODULE OF PUTATIVE RESPONSE REGULATOR |
| ID3111 | S | YFIT PROTEIN. |
| ID3112 | S | BH3588 PROTEIN. |
| ID3113 | S | YFIT PROTEIN. |
| ID3114 | S | YRVE PROTEIN. |
| ID3115 | S | BH1239 PROTEIN. |
| ID3116 | S | ORF starting with ATG of length 379 |
| ID3117 | S | BH2912 PROTEIN. |
| ID3118 | S | BH0043 PROTEIN. |
| ID3119 | S | BH3320 PROTEIN. |
| ID3120 | S | BH3319 PROTEIN. |
| ID3121 | S | BH1498 PROTEIN. |
| ID3122 | S | DNA POLYMERASE III DELTA' SUBUNIT (EC 2.7.7.7). |
| ID3123 | S | SIGNAL PEPTIDASE-LIKE PROTEIN. |
| ID3124 | S | ORF starting with ATG of length 435 |
| ID3125 | S | Human secreted protein sequence encoded by gene 45 SEQ ID NO |
| ID3126 | S | Human secreted protein, SEQ ID NO: 7174. |
| ID3127 | S | ORFII. |
| ID3128 | S | BH1265 PROTEIN. |
| ID3129 | S | BH1264 PROTEIN. |
| ID3130 | S | FLAGELLAR BIOSYNTHETIC PROTEIN FLIZ PRECURSOR. |
| ID3131 | S | ORF starting with ATG of length 498 |
| ID3132 | S | MOLYBDOPTERIN CONVERTING FACTOR (SUBUNIT 1). |
| ID3133 | S | BH4017 PROTEIN. |
| ID3134 | S | PUTATTVE HSDS. |
| ID3135 | S | ORF starting with TTG or GTG of length 534 |
| ID3136 | S | D-FRUCTOSE-1,6-BIPHOSPHATE ALDOLASE (FRAGMENT). |
| ID3137 | S | BH1341 PROTEIN. |
| ID3138 | S | STAGE II SPORULATION PROTEIN P. |
| ID3139 | S | BH1765 PROTEIN. |
| ID3140 | S | BH3095 PROTEIN. |
| ID3141 | S | YFNK. |
| ID3142 | S | SPORE GERMINATION PROTEIN. |
| ID3143 | S | ORF starting with ATG of length 336 |
| ID3144 | S | NA+/H+ ANTIPORTER. |
| ID3145 | S | ORF starting with ATG of length 645 |
| ID3146 | S | PUTATIVE RESPONSE REGULATOR. |
| ID3147 | S | ORF starting with ATG of length 558 |
| ID3148 | S | 2-KETO-3-DEOXYGLUCONATE PERMEASE (KDG PERMEASE). |
| ID3149 | S | BH0802 PROTEIN. |
| ID3150 | S | BH0285 PROTEIN. |
| ID3151 | S | ORF starting with ATG of length 287 |
| ID3152 | S | HYPOTHETICAL 30.6 KDA PROTEIN (ORF266). |
| ID3153 | S | STAGE II SPORULATION PROTEIN M. |
| ID3154 | S | YFNK. |
| ID3155 | S | TRANSCRIPTION ANTITERMINATOR. |
| ID3156 | S | Human secreted protein, SEQ ID NO: 7519. |
| ID3157 | S | 5-AMINOLEVULINIC ACID DEHYDRATASE (EC 4.2.1.24). |
| ID3158 | S | GLUCOSAMINE-6-PHOSPHATE ISOMERASE (EC 5.3.1.10) (GLUCOSAMINE |
| ID3159 | S | PUTATIVE TETR-FAMILY TRANSCRIPTIONAL REGULATOR. |
| ID3160 | S | ABC TRANSPORTER (ATP-BINDING PROTEIN). |
| ID3161 | S | YLBM PROTEIN. |
| ID3162 | S | GLYCINE BETAINE TRANSPORTER. |
| ID3163 | S | INTEGRASE HOMOLOG. |
| ID3164 | S | ORF starting with ATG of length 300 |
| ID3165 | S | ORF starting with ATG of length 259 |
| ID3166 | S | PUTATIVE XYLOSE OPERON REGULATORY PROTEIN. |
| ID3167 | S | ORF starting with ATG of length 256 |
| ID3168 | S | CELL WALL LYTIC ACTIVITY. |
| ID3169 | S | BH3591 PROTEIN. |
| ID3170 | S | YTOQ. |
| ID3171 | S | SPORE GERMINATION PROTEIN. |
| ID3172 | S | ORF starting with ATG of length 692 |
| ID3173 | S | ORF starting with ATG of length 459 |
| ID3174 | S | ALKYL HYDROPEROXIDE REDUCTASE LARGE SUBUNIT (EC 1.6.99.3) (P |
| ID3175 | S | MOLYBDOPTERIN BIOSYNTHESIS. |
| ID3176 | S | NA(+)/H(+) ANTIPORTER (SODIUM/PROTON ANTIPORTER). |

-continued

| | | |
|---|---|---|
| ID3177 | S | ORF starting with ATG of length 480 |
| ID3178 | S | OLIGOPEPTIDE ABC TRANSPORTER (PERMEASE). |
| ID3179 | S | TWO-COMPONENT SENSOR HISTIDINE KINASE. |
| ID3180 | S | ORF starting with TTG or GTG of length 1386 |
| ID3181 | S | HYPOTHETICAL 29.1 KDA PROTEIN. |
| ID3182 | S | *Streptococcus pneumoniae* type 4 protein sequence #75. |
| ID3183 | S | SPORE GERMINATION PROTEIN. |
| ID3184 | S | ORF starting with ATG of length 351 |
| ID3185 | S | SPORE GERMINATION PROTEIN KA. |
| ID3186 | S | ORF starting with ATG of length 274 |
| ID3187 | S | SOPRE GERMINATION PROTEIN. |
| ID3188 | S | ORF starting with ATG of length 266 |
| ID3189 | S | ORF13. |
| ID3190 | S | KYNURENINASE (EC 3.7.1.3) (L-KYNURENINE HYDROLASE). |
| ID3191 | S | BH0970 PROTEIN. |
| ID3192 | S | ORF starting with ATG of length 434 |
| ID3193 | S | ORF starting with ATG of length 735 |
| ID3194 | S | MLL3044 PROTEIN. |
| ID3195 | S | HYPOTHETICAL OXIDOREDUCTASE IN RTP-PELB INTERGENIC REGION (E |
| ID3196 | S | HYPOTHETICAL 47.4 KDA PROTEIN. |
| ID3197 | S | ORF starting with ATG of length 554 |
| ID3198 | S | ORF starting with ATG of length 372 |
| ID3199 | S | ORF starting with ATG of length 300 |
| ID3200 | S | BH2631 PROTEIN. |
| ID3201 | S | HYPOTHETICAL 8.2 KDA PROTEIN IN NPRE-PYCA INTERGENIC REGION. |
| ID3202 | S | ORF starting with ATG of length 279 |
| ID3203 | S | BH0602 PROTEIN. |
| ID3204 | S | YFKK PROTEIN. |
| ID3205 | S | HYPOTHETICAL 35.5 KDA PROTEIN. |
| ID3206 | S | ORF starting with ATG of length 696 |
| ID3207 | S | BH0717 PROTEIN. |
| ID3208 | S | BH3320 PROTEIN. |
| ID3209 | S | ORF11. |
| ID3210 | S | TRANSCRIPTIONAL ACTIVATOR OF THE GLUTAMATE SYNTHASE OPERON ( |
| ID3211 | S | ORF starting with ATG of length 347 |
| ID3212 | S | FERRICHROME TRANSPORT PERMEASE. |
| ID3213 | S | TRANSCRIPTIONAL REGULATOR. |
| ID3214 | S | CELL DIVISION CYCLE CDC48 HOMOLOG (YJOB PROTEIN). |
| ID3215 | S | PUTATIVE SECRETED PROTEIN. |
| ID3216 | S | TYPE I RESTRICTION ENZYME ECOKI M PROTEIN (EC 2.1.1.72) (M.E |
| ID3217 | S | A2-5A ORF1 (FRAGMENT). |
| ID3218 | S | PHI PVL ORF 63 HOMOLOGUE. |
| ID3219 | S | ORF starting with ATG of length 477 |
| ID3220 | S | ORF22. |
| ID3221 | S | URIDINE KINASE (EC 2.7.1.48) (URIDINE MONOPHOSPHOKINASE). |
| ID3222 | S | HYPOTHETICAL 30.7 KDA PROTEIN. |
| ID3223 | S | BH3410 PROTEIN. |
| ID3224 | S | PROBABLE AMINO-ACID ABC TRANSPORTER PERMEASE PROTEIN YCKA. |
| ID3225 | S | HYPOTHETICAL PROTEIN. |
| ID3226 | S | TRANSCRIPTION REGULATOR. |
| ID3227 | S | SERINE/THREONINE PROTEIN KINASE. |
| ID3228 | S | ORF starting with ATG of length 960 |
| ID3229 | S | ORF starting with TTG or GTG of length 561 |
| ID3230 | S | ORF11. |
| ID3231 | S | PTS SYSTEM, SUCROSE PHOSPHOTRANSFERASE ENZYME II, BC COMPONE |
| ID3232 | S | HYPOTHETICAL PROTEIN. |
| ID3233 | S | GERMINATION PROTEIN. |
| ID3234 | S | DIAMINOBUTYRIC ACID ACETYLTRANSFERASE. |
| ID3235 | S | *Staphylococcus aureus* protein of unknown function. |
| ID3236 | S | HYPOTHETICAL 38.4 KDA PROTEIN. |
| ID3237 | S | RELATED TO A-AGGLUTININ CORE PROTEIN AGA1. |
| ID3238 | S | DEACETYLASE, PUTATIVE. |
| ID3239 | S | *E. coli* aspartokinase III variant No.169 (T352I, S369F). |
| ID3240 | S | BH1501 PROTEIN. |
| ID3241 | S | BH2389 PROTEIN. |
| ID3242 | S | ORF starting with ATG of length 278 |
| ID3243 | S | PROBABLE TWO-COMPONENT SENSOR. |
| ID3244 | S | BH0892 PROTEIN. |
| ID3245 | S | BH1268 PROTEIN. |
| ID3246 | S | BH1270 PROTEIN. |
| ID3247 | S | ORF starting with ATG of length 969 |
| ID3248 | S | ORF starting with ATG of length 312 |
| ID3249 | S | ABC TRANSPORTER (ATP-BINDING PROTEIN) (DAUNORUBICIN RESISTAN |
| ID3250 | S | *Streptococcus pneumoniae* SP0014 protein. |
| ID3251 | S | L-ASPARTATE OXIDASE (EC 1.4.3.16) (QUINOLINATE SYNTHETASE B) |
| ID3252 | S | BH2905 PROTEIN. |
| ID3253 | S | INNER SPORE COAT PROTEIN D. |
| ID3254 | S | ORF starting with ATG of length 237 |
| ID3255 | S | ORF starting with ATG of length 452 |

| | | |
|---|---|---|
| ID3256 | S | REGULATORY PROTEIN BLAR1. |
| ID3257 | S | ORF starting with ATG of length 1200 |
| ID3258 | S | ORF starting with ATG of length 219 |
| ID3259 | S | BH1892 PROTEIN. |
| ID3260 | S | ORF starting with ATG of length 624 |
| ID3261 | S | INTEGRASE HOMOLOG. |
| ID3262 | S | HYPOTHETICAL 7.6 KDA PROTEIN. |
| ID3263 | S | HYPOTHETICAL 40.9 KDA PROTEIN IN CCCA-SODA INTERGENIC REGION |
| ID3264 | S | BH1955 PROTEIN. |
| ID3265 | S | TRANSCRIPTIONAL REGULATOR OF SPORE COAT PROTEIN (SPORE GERMI |
| ID3266 | S | BH3205 PROTEIN. |
| ID3267 | S | BH1176 PROTEIN. |
| ID3268 | S | BH1402 PROTEIN. |
| ID3269 | S | LACZ ALPHA PEPTIDE. |
| ID3270 | S | TRANSCRIPTIONAL REGULATOR OF SPORE COAT PROTEIN (SPORE GERMI |
| ID3271 | S | BH2907 PROTEIN. |
| ID3272 | S | BH2908 PROTEIN. |
| ID3273 | S | STAGE II SPORULATION PROTEIN R. |
| ID3274 | S | BH1678 PROTEIN. |
| ID3275 | S | BICYCLOMYCIN RESISTANCE PROTEIN. |
| ID3276 | S | *Synechocystis sp* phytochrome-related gene Cph1. |
| ID3277 | S | ORF starting with ATG of length 222 |
| ID3278 | S | BH3205 PROTEIN. |
| ID3279 | S | BH0535 PROTEIN. |
| ID3280 | S | HYPOTHETICAL PROTEIN TC0114. |
| ID3281 | S | Amino acid sequence of a *Chlamydia pneumoniae* protein. |
| ID3282 | S | HYPOTHETICAL 14.9 KDA PROTEIN. |
| ID3283 | S | *Streptococcus pneumoniae* encoded polypeptide. |
| ID3284 | S | ORF starting with ATG of length 456 |
| ID3285 | S | HYPOTHETICAL 6.9 KDA PROTEIN APES063. |
| ID3286 | S | *Chlamydia pneumoniae* lipoprotein sequence. |
| ID3287 | S | ORF starting with ATG of length 411 |
| ID3288 | S | BH0407 PROTEIN. |
| ID3289 | S | BH3604 PROTEIN. |
| ID3290 | S | CAPSULAR POLYSACCHARIDE BIOSYNTHESIS. |
| ID3291 | S | BH3874 PROTEIN. |
| ID3292 | S | ORF starting with ATG of length 501 |
| ID3293 | S | BETA-N-ACETYLGLUCOSAMINIDASE PRECURSOR (EC 3.2.1.—). |
| ID3294 | S | *Chlamydia pneumoniae* lipoprotein sequence. |
| ID3295 | S | HYPOTHETICAL 6.9 KDA PROTEIN APES063. |
| ID3296 | S | ORF starting with ATG of length 456 |
| ID3297 | S | *Streptococcus pneumoniae* encoded polypeptide. |
| ID3298 | S | HYPOTHETICAL 14.9 KDA PROTEIN. |
| ID3299 | S | Amino acid sequence of a *Chlamydia pneumoniae* protein. |
| ID3330 | S | HYPOTHETICAL PROTEIN TC0114. |
| ID3301 | S | *Chlamydia pneumoniae* lipoprotein sequence. |
| ID3302 | S | YHCG (ABC TRANSPORTER) (ATP-BINDING PROTEIN). |
| ID3303 | S | SPOIISA PROTEIN. |
| ID3304 | S | BH1232 PROTEIN. |
| ID3305 | S | TRANSPOSASE (11). |
| ID3306 | S | ORF starting with ATG of length 462 |
| ID3307 | S | ORF starting with ATG of length 672 |
| ID3308 | S | RESPONSE REGULATOR ASPARTATE PHOSPHATASE. |
| ID3309 | S | HYPOTHETICAL 56.9 KDA PROTEIN PH1047. |
| ID3310 | S | BH0590 PROTEIN. |
| ID3311 | S | RIBOFLAVIN BIOSYNTHESIS PROTEIN RIBA [INCLUDES: GTP CYCLOHYD |
| ID3312 | S | HYPOTHETICAL 21.0 KDA PROTEIN IN CTAF 3'REGION (ORF1). |
| ID3313 | S | HYPOTHETICAL 17.8 KDA PROTEIN IN CTAF 3'REGION (ORF3). |
| ID3314 | S | BH1678 PROTEIN. |
| ID3315 | S | ORF starting with ATG of length 384 |
| ID3316 | S | BH2622 PROTEIN. |
| ID3317 | S | STAGE IV SPORULATION PROTEIN A (SPORE CORTEX FORMATION AND C |
| ID3318 | S | ORF, HYPOTHETICAL PROTEIN. |
| ID3319 | S | INTRACELLULAR PROTEINASE (EC 3.2.). |
| ID3320 | S | RETINITIS PIGMENTOSA GTPASE REGULATOR-LIKE PROTEIN (FRAGMENT |
| ID3321 | S | ORF22. |
| ID3322 | S | BH1644 PROTEIN. |
| ID3323 | S | BH0861 PROTEIN. |
| ID3324 | S | MEMBRANE-TYPE MOSAIC SERINE PROTEASE. |
| ID3325 | S | ORF starting with ATG of length 488 |
| ID3326 | S | BH1720 PROTEIN. |
| ID3327 | S | HYPOTHETICAL 20.5 KDA PROTEIN. |
| ID3328 | S | YFIL. |
| ID3329 | S | BH3604 PROTEIN. |
| ID3330 | S | SPORE GERMINATION PROTEIN. |
| ID3331 | S | ORF starting with ATG of length 1109 |
| ID3332 | S | BH0842 PROTEIN. |
| ID3333 | S | AMINO ACID ABC TRANSPORTER PROTEIN, SOLUTE-BINDING COMPONENT |
| ID3334 | S | BH0589 PROTEIN. |

-continued

| | | |
|---|---|---|
| ID3335 | S | YFKB PROTEIN. |
| ID3336 | S | BH0883 PROTEIN. |
| ID3337 | S | BH3772 PROTEIN. |
| ID3338 | S | STAGE II SPORULATION PROTEIN R. |
| ID3339 | S | ORF starting with ATG of length 255 |
| ID3340 | S | ORF26. |
| ID3341 | S | ORF25. |
| ID3342 | S | ORF16. |
| ID3343 | S | ORF starting with ATG of length 1107 |
| ID3344 | S | BH1721 PROTEIN. |
| ID3345 | S | YJBK PROTEIN. |
| ID3346 | S | BH2850 PROTEIN. |
| ID3347 | S | GTP PYROPHOSPHOKINASE. |
| ID3348 | S | NAD KINASE. |
| ID3349 | S | BH2209 PROTEIN. |
| ID3350 | S | BH2208 PROTEIN. |
| ID3351 | S | YVMA. |
| ID3352 | S | BH1114 PROTEIN. |
| ID3353 | S | TRANSCRIPTION REGULATOR. |
| ID3354 | S | FRUCTOSE 1-PHOSPHATE KINASE. |
| ID3355 | S | ORF starting with ATG of length 782 |
| ID3356 | S | ORF starting with ATG of length 466 |
| ID3357 | S | HYPOTHETICAL 22.4 KDA PROTEIN IN RPMF-FTSL INTERGENIC REGION |
| ID3358 | S | BH2580 PROTEIN. |
| ID3359 | S | ORF starting with ATG of length 324 |
| ID3360 | S | HYPOTHETICAL 48.9 KDA PROTEIN PH0207. |
| ID3361 | S | SPORE CORTEX-LYTIC ENZYME. |
| ID3362 | S | HYPOTHETICAL 62.6 KDA PROTEIN IN RPMF-FTSL INTERGENIC REGION |
| ID3363 | S | ORF starting with ATG of length 393 |
| ID3364 | S | ORF starting with ATG of length 403 |
| ID3365 | S | ORF starting with ATG of length 294 |
| ID3366 | S | BH4024 PROTEIN. |
| ID3367 | S | RESOLVASE. |
| ID3368 | S | BLMT. |
| ID3369 | S | ORF starting with ATG of length 285 |
| ID3370 | S | BH0236 PROTEIN. |
| ID3371 | S | BH0942 PROTEIN. |
| ID3372 | S | ORF starting with ATG of length 339 |
| ID3373 | S | ORF starting with ATG of length 424 |
| ID3374 | S | PHAGE-RELATED PROTEIN. |
| ID3375 | S | BH1913 PROTEIN. |
| ID3376 | S | HYPOTHETICAL 19.4 KDA PROTEIN IN SPOIIR-GLYC INTERGENIC REGI |
| ID3377 | S | BH1404 PROTEIN. |
| ID3378 | S | OUTER SPORE COAT PROTEIN. |
| ID3379 | S | HYPOTHETICAL 28.2 KDA PROTEIN IN BIOI 3'REGION (ORF2). |
| ID3380 | S | ORF starting with ATG of length 537 |
| ID3381 | S | MLR2098 PROTEIN. |
| ID3382 | S | RELATED TO DIMERIC DIHYDRODIOL DEHYDROGENASE. |
| ID3383 | S | PUTATIVE FRUCTOSE-SPECIFIC PERMEASE. |
| ID3384 | S | TWO-COMPONENT SENSOR HISTIDINE KINASE. |
| ID3385 | S | SIGMA 54 ACTIVATOR. |
| ID3386 | S | ORF starting with ATG of length 331 |
| ID3387 | S | BH0913 PROTEIN. |
| ID3388 | S | BH2208 PROTEIN. |
| ID3389 | S | ORF starting with ATG of length 414 |
| ID3390 | S | HYPOTHETICAL TRANSCRIPTIONAL REGULATOR AF1627. |
| ID3391 | S | BH1722 PROTEIN. |
| ID3392 | S | HYPOTHETICAL 39.0 KDA PROTEIN. |
| ID3393 | S | ORF starting with ATG of length 315 |
| ID3394 | S | BH3770 PROTEIN. |
| ID3395 | S | BH1676 PROTEIN. |
| ID3396 | S | ORF45. |
| ID3397 | S | ORF starting with ATG of length 436 |
| ID3398 | S | PUTATIVE INTEGRAL MEMBRANE TRANSPORTER. |
| ID3399 | S | BH1148 PROTEIN. |
| ID3400 | S | BH1812 PROTEIN. |
| ID3401 | S | TYROSYL-TRNA SYNTHETASE 2 (EC 6.1.1.1) (TYROSINE--TRNA LIGAS |
| ID3402 | S | BH0365 PROTEIN. |
| ID3403 | S | BH2667 PROTEIN. |
| ID3404 | S | PTS SYSTEM, GLUCITOL/SORBITOL-SPECIFIC IIBC COMPONENT (EIIBC |
| ID3405 | S | ORF starting with ATG of length 702 |
| ID3406 | S | BH4015 PROTEIN. |
| ID3407 | S | BH0346 PROTEIN. |
| ID3408 | S | ORF starting with ATG of length 335 |
| ID3409 | S | ORF starting with ATG of length 350 |
| ID3410 | S | ORF starting with ATG of length 506 |
| ID3411 | S | ORF starting with ATG of length 621 |
| ID3412 | S | HYPOTHETICAL TRANSCRIPTIONAL REGULATOR IN OPUE-RAPH INTERGEN |
| ID3413 | S | BH1410 PROTEIN. |

-continued

| | | |
|---|---|---|
| ID3414 | S | ORF starting with ATG of length 346 |
| ID3415 | S | ORF starting with ATG of length 542 |
| ID3416 | S | DAUNORUBICIN RESISTANCE PROTEIN. |
| ID3417 | S | BH2291 PROTEIN. |
| ID3418 | S | ORF starting with ATG of length 645 |
| ID3419 | S | BH3410 PROTEIN. |
| ID3420 | S | PROBABLE AMINO-ACID ABC TRANSPORTER PERMEASE PROTEIN YCKA. |
| ID3421 | S | ORF starting with ATG of length 696 |
| ID3422 | S | NITRIC OXIDE SYNTHASE. |
| ID3423 | S | BH3568 PROTEIN. |
| ID3424 | S | BH3567 PROTEIN. |
| ID3425 | S | MLR2098 PROTEIN. |
| ID3426 | S | ORF starting with ATG of length 396 |
| ID3427 | S | ORF starting with ATG of length 945 |
| ID3428 | S | STAGE IV SPORULATION PROTEIN. |
| ID3429 | S | BH2350 PROTEIN. |
| ID3430 | S | DNA, COMPLETE SEQUENCE. |
| ID3431 | S | ORF10. |
| ID3432 | S | ORF starting with ATG of length 700 |
| ID3433 | S | ORF starting with ATG of length 801 |
| ID3434 | S | BH4025 PROTEIN. |
| ID3435 | S | UNKNOWN PROTEIN. |
| ID3436 | S | HYPOTHETICAL 46.1 KDA PROTEIN IN PLSC 3′REGION. |
| ID3437 | S | BH2390 PROTEIN. |
| ID3438 | S | BH2389 PROTEIN. |
| ID3439 | S | ORF starting with ATG of length 426 |
| ID3440 | S | TRANSPOSASE (22). |
| ID3441 | S | ORF starting with ATG of length 588 |
| ID3442 | S | LPLC PROTEIN. |
| ID3443 | S | ORF starting with ATG of length 2421 |
| ID3444 | S | BH0970 PROTEIN. |
| ID3445 | S | CHORISMATE MUTASE (ISOZYMES 1 AND 2). |
| ID3446 | S | ORF starting with ATG of length 525 |
| ID3447 | S | ORF starting with ATG of length 486 |
| ID3448 | S | ORF starting with ATG of length 609 |
| ID3449 | S | HYPOTHETICAL 30.7 KDA PROTEIN. |
| ID3450 | S | Human gene 8 encoded secreted protein HMAM121, SEQ ID NO:137 |
| ID3451 | S | BH1071 PROTEIN. |
| ID3452 | S | BH1089 PROTEIN. |
| ID3453 | S | ORF starting with ATG of length 363 |
| ID3454 | S | *Staphylococcus aureus* protein homologous to subunit fmdE. |
| ID3455 | S | MAGNESIUM CITRATE SECONDARY TRANSPORTER. |
| ID3456 | S | BH0709 PROTEIN. |
| ID3457 | S | UNKNOWN PROTEIN. |
| ID3458 | S | ORF starting with ATG of length 483 |
| ID3459 | S | YJDC PROTEIN. |
| ID3460 | S | BH2596 PROTEIN. |
| ID3461 | S | BH2622 PROTEIN. |
| ID3462 | S | ORF starting with ATG of length 662 |
| ID3463 | S | BH0236 PROTEIN. |
| ID3464 | S | BH2637 PROTEIN. |
| ID3465 | S | BH2638 PROTEIN. |
| ID3466 | S | BH0424 PROTEIN. |
| ID3467 | S | SUGAR TRANSPORT SYSTEM (PERMEASE). |
| ID3468 | S | ENOYL-[ACYL-CARRIER PROTEIN] REDUCTASE. |
| ID3469 | S | BH2840 PROTEIN. |
| ID3470 | S | ORF starting with ATG of length 807 |
| ID3471 | S | BH2838 PROTEIN. |
| ID3472 | S | BH2837 PROTEIN. |
| ID3473 | S | GERMINATION (CORTEX HYDROLYSIS) AND SPORULATION (STAGE II, M |
| ID3474 | S | REGULATORY PROTEIN. |
| ID3475 | S | PUTATIVE GLYCOSYLTRANSFERASE CPSIVM. |
| ID3476 | S | INNER SPORE COAT PROTEIN D. |
| ID3477 | S | TWO-COMPONENT SENSOR HISTIDINE KINASE. |
| ID3478 | S | YETF PROTEIN. |
| ID3479 | S | SMALL, ACID-SOLUBLE SPORE PROTEIN D (SASP). |
| ID3480 | S | Cyclohexanone monooxygenase sequence. |
| ID3481 | S | KIAA1655 PROTEIN (FRAGMENT). |
| ID3482 | S | RIBONUCLEASE HII (EC 3.1.26.4) (RNASE HII) (FRAGMENT). |
| ID3483 | S | CAPSID PROTEIN (F PROTEIN) (GPF). |
| ID3484 | S | BH1804 PROTEIN. |
| ID3485 | S | ORF starting with ATG of length 288 |
| ID3486 | S | ORF starting with ATG of length 417 |
| ID3487 | S | ORF starting with ATG of length 469 |
| ID3486 | S | BH3433 PROTEIN. |
| ID3489 | S | BH3337 PROTEIN. |
| ID3490 | S | BH3430 PROTEIN. |
| ID3491 | S | ORF starting with ATG of length 809 |
| ID3492 | S | ORF starting with ATG of length 1188 |

-continued

| | | |
|---|---|---|
| ID3493 | S | HYPOTHETICAL 15.7 KDA PROTEIN IN PBPD-COMA INTERGENIC REGION |
| ID3494 | S | BH2622 PROTEIN. |
| ID3495 | S | ORF15. |
| ID3496 | S | TRANSCRIPTIONAL REGULATOR (LYSR FAMILY). |
| ID3497 | S | ORF starting with ATG of length 478 |
| ID3498 | S | ORF starting with ATG of length 526 |
| ID3499 | S | TRANSPOSASE (22). |
| ID3500 | S | *Chlamydia pneumoniae* lipoprotein sequence. |
| ID3501 | S | BRANCHED-CHAIN ALPHA-KETO ACID DEHYDROGENASE E2. |
| ID3502 | S | BH1247 PROTEIN. |
| ID3503 | S | ORF starting with ATG of length 696 |
| ID3504 | S | ORF starting with ATG of length 364 |
| ID3505 | S | ORF starting with ATG of length 621 |
| ID3506 | S | HYPOTHETICAL 25.4 KDA PROTEIN IN DPPE-HMP INTERGENIC REGION. |
| ID3507 | S | ORF starting with ATG of length 226 |
| ID3508 | S | ORF starting with ATG of length 233 |
| ID3509 | S | ORF starting with ATG of length 216 |
| ID3510 | S | ORF starting with ATG of length 396 |
| ID3511 | S | ORF starting with ATG of length 441 |
| ID3512 | S | ORF starting with ATG of length 296 |
| ID3513 | S | ORF starting with ATG of length 273 |
| ID3514 | S | ORF starting with ATG of length 339 |
| ID3515 | S | ORF starting with ATG of length 213 |
| ID3516 | S | ORF starting with ATG of length 271 |
| ID3517 | S | ORF starting with ATG of length 384 |
| ID3518 | S | ORF starting with ATG of length 267 |
| ID3519 | S | ORF starting with ATG of length 240 |
| ID3520 | S | ORF starting with ATG of length 249 |
| ID3521 | S | ORF starting with ATG of length 231 |
| ID3522 | S | ORF starting with ATG of length 270 |
| ID3523 | S | ORF starting with ATG of length 437 |
| ID3524 | S | ORF starting with ATG of length 474 |
| ID3525 | S | ORF starting with ATG of length 309 |
| ID3526 | S | ORF starting with ATG of length 273 |
| ID3527 | S | ORF starting with ATG of length 246 |
| ID3528 | S | ORF starting with ATG of length 543 |
| ID3529 | S | ORF starting with ATG of length 318 |
| ID3530 | S | ORF starting with ATG of length 249 |
| ID3531 | S | ORF starting with ATG of length 213 |
| ID3532 | S | ORF starting with ATG of length 260 |
| ID3533 | S | ORF starting with ATG of length 203 |
| ID3534 | S | ORF starting with ATG of length 243 |
| ID3535 | S | ORF starting with ATG of length 218 |
| ID3536 | S | ORF starting with ATG of length 219 |
| ID3537 | S | ORF starting with ATG of length 219 |
| ID3538 | S | ORF starting with ATG of length 573 |
| ID3539 | S | ORF starting with ATG of length 648 |
| ID3540 | S | ORF starting with ATG of length 204 |
| ID3541 | S | ORF starting with ATG of length 351 |
| ID3542 | S | ORF starting with ATG of length 387 |
| ID3543 | S | ORF starting with ATG of length 267 |
| ID3544 | S | ORF starting with ATG of length 285 |
| ID3545 | S | ORF starting with ATG of length 337 |
| ID3546 | S | ORF starting with ATG of length 441 |
| ID3547 | S | ORF starting with ATG of length 325 |
| ID3548 | S | ORF starting with ATG of length 226 |
| ID3549 | S | ORF starting with ATG of length 437 |
| ID3550 | S | ORF starting with ATG of length 288 |
| ID3551 | S | ORF starting with ATG of length 306 |
| ID3552 | S | ORF starting with ATG of length 549 |
| ID3553 | S | ORF starting with ATG of length 375 |
| ID3554 | S | ORF starting with ATG of length 326 |
| ID3555 | S | ORF starting with ATG of length 339 |
| ID3556 | S | ORF starting with ATG of length 453 |
| ID3557 | S | ORF starting with ATG of length 312 |
| ID3558 | S | ORF starting with ATG of length 354 |
| ID3559 | S | ORF starting with ATG of length 225 |
| ID3560 | S | ORF starting with ATG of length 370 |
| ID3561 | S | ORF starting with ATG of length 273 |
| ID3562 | S | ORF starting with ATG of length 281 |
| ID3563 | S | ORF starting with ATG of length 240 |
| ID3564 | S | ORF starting with ATG of length 258 |
| ID3565 | S | ORF starting with ATG of length 347 |
| ID3566 | S | ORF starting with ATG of length 204 |
| ID3567 | S | ORF starting with TTG or GTG of length 485 |
| ID3568 | S | ORF starting with ATG of length 448 |
| ID3569 | S | ORF starting with ATG of length 249 |
| ID3570 | S | ORF starting with ATG of length 366 |
| ID3571 | S | ORF starting with ATG of length 302 |

-continued

| | | |
|---|---|---|
| ID3572 | S | ORF starting with TTG or GTG of length 408 |
| ID3573 | S | ORF starting with ATG of length 240 |
| ID3574 | S | ORF starting with ATG of length 273 |
| ID3575 | S | ORF starting with ATG of length 249 |
| ID3576 | S | ORF starting with ATG of length 468 |
| ID3577 | S | ORF starting with ATG of length 339 |
| ID3578 | S | ORF starting with ATG of length 209 |
| ID3579 | S | ORF starting with ATG of length 293 |
| ID3580 | S | ORF starting with ATG of length 207 |
| ID3581 | S | ORF starting with ATG of length 246 |
| ID3582 | S | ORF starting with ATG of length 258 |
| ID3583 | S | ORF starting with ATG of length 228 |
| ID3584 | S | ORF starting with ATG of length 213 |
| ID3585 | S | ORF starting with ATG of length 204 |
| ID3586 | S | ORF starting with ATG of length 345 |
| ID3587 | S | ORF starting with ATG of length 561 |
| ID3588 | S | ORF starting with ATG of length 201 |
| ID3589 | S | ORF starting with ATG of length 417 |
| ID3590 | S | ORF starting with ATG of length 376 |
| ID3591 | S | ORF starting with ATG of length 294 |
| ID3592 | S | ORF starting with TTG or GTG of length 408 |
| ID3593 | S | ORF starting with ATG of length 279 |
| ID3594 | S | ORF starting with ATG of length 427 |
| ID3595 | S | ORF starting with ATG of length 318 |
| ID3596 | S | ORF starting with ATG of length 477 |
| ID3597 | S | ORF starting with ATG of length 297 |
| ID3598 | S | ORF starting with ATG of length 222 |
| ID3599 | S | ORF starting with ATG of length 225 |
| ID3600 | S | ORF starting with ATG of length 270 |
| ID3601 | S | ORF starting with ATG of length 435 |
| ID3602 | S | ORF starting with ATG of length 474 |
| ID3603 | S | ORF starting with ATG of length 525 |
| ID3604 | S | ORF starting with TTG or GTG of length 510 |
| ID3605 | S | ORF starting with ATG of length 207 |
| ID3606 | S | ORF starting with ATG of length 222 |
| ID3607 | S | ORF starting with ATG of length 474 |
| ID3608 | S | ORF starting with ATG of length 435 |
| ID3609 | S | ORF starting with ATG of length 261 |
| ID3610 | S | ORF starting with ATG of length 287 |
| ID3611 | S | ORF starting with ATG of length 288 |
| ID3612 | S | ORF starting with ATG of length 212 |
| ID3613 | S | ORF starting with ATG of length 282 |
| ID3614 | S | ORF starting with ATG of length 241 |
| ID3615 | S | ORF starting with ATG of length 243 |
| ID3616 | S | ORF starting with ATG of length 210 |
| ID3617 | S | ORF starting with ATG of length 342 |
| ID3618 | S | ORF starting with ATG of length 250 |
| ID3619 | S | ORF starting with ATG of length 233 |
| ID3620 | S | ORF starting with ATG of length 272 |
| ID3621 | S | ORF starting with ATG of length 558 |
| ID3622 | S | ORF starting with ATG of length 290 |
| ID3623 | S | ORF starting with ATG of length 413 |
| ID3624 | S | ORF starting with ATG of length 213 |
| ID3625 | S | ORF starting with ATG of length 304 |
| ID3626 | S | ORF starting with ATG of length 702 |
| ID3627 | S | ORF starting with ATG of length 351 |
| ID3628 | S | ORF starting with ATG of length 654 |
| ID3629 | S | ORF starting with ATG of length 264 |
| ID3630 | S | ORF starting with ATG of length 264 |
| ID3631 | S | ORF starting with ATG of length 591 |
| ID3632 | S | ORF starting with ATG of length 318 |
| ID3633 | S | ORF starting with ATG of length 268 |
| ID3634 | S | ORF starting with ATG of length 525 |
| ID3635 | S | ORF starting with ATG of length 270 |
| ID3636 | S | ORF starting with ATG of length 609 |
| ID3637 | S | ORF starting with ATG of length 267 |
| ID3638 | S | ORF starting with ATG of length 444 |
| ID3639 | S | ORF starting with ATG of length 285 |
| ID3640 | S | ORF starting with ATG of length 307 |
| ID3641 | S | ORF starting with ATG of length 306 |
| ID3642 | S | ORF starting with ATG of length 397 |
| ID3643 | S | ORF starting with ATG of length 220 |
| ID3644 | S | ORF starting with ATG of length 249 |
| ID3645 | S | ORF starting with TTG or GTG of length 423 |
| ID3646 | S | ORF starting with ATG of length 455 |
| ID3647 | S | ORF starting with ATG of length 227 |
| ID3648 | S | ORF starting with ATG of length 210 |
| ID3649 | S | ORF starting with ATG of length 363 |
| ID3650 | S | ORF starting with ATG of length 366 |

-continued

| ID | | Description |
|---|---|---|
| ID3651 | S | ORF starting with ATG of length 273 |
| ID3652 | S | ORF starting with ATG of length 306 |
| ID3653 | S | ORF starting with TTG or GTG of length 402 |
| ID3654 | S | ORF starting with ATG of length 252 |
| ID3655 | S | ORF starting with ATG of length 231 |
| ID3656 | S | ORF starting with ATG of length 327 |
| ID3657 | S | ORF starting with ATG of length 287 |
| ID3658 | S | ORF starting with ATG of length 204 |
| ID3659 | S | ORF starting with ATG of length 1423 |
| ID3660 | S | ORF starting with ATG of length 309 |
| ID3661 | S | ORF starting with ATG of length 309 |
| ID3662 | S | ORF starting with ATG of length 525 |
| ID3663 | S | ORF starting with ATG of length 225 |
| ID3664 | S | ORF starting with ATG of length 360 |
| ID3665 | S | ORF starting with ATG of length 272 |
| ID3666 | S | ORF starting with ATG of length 201 |
| ID3667 | S | ORF starting with ATG of length 339 |
| ID3668 | S | ORF starting with ATG of length 483 |
| ID3669 | S | ORF starting with ATG of length 384 |
| ID3670 | S | ORF starting with ATG of length 225 |
| ID3671 | S | ORF starting with ATG of length 213 |
| ID3672 | S | ORF starting with ATG of length 234 |
| ID3673 | S | ORF starting with ATG of length 397 |
| ID3674 | S | ORF starting with ATG of length 348 |
| ID3675 | S | ORF starting with ATG of length 258 |
| ID3676 | S | ORF starting with ATG of length 471 |
| ID3677 | S | ORF starting with ATG of length 213 |
| ID3678 | S | ORF starting with ATG of length 285 |
| ID3679 | S | ORF starting with ATG of length 272 |
| ID3680 | S | ORF starting with ATG of length 357 |
| ID3681 | S | ORF starting with TTG or GTG of length 435 |
| ID3682 | S | ORF starting with ATG of length 729 |
| ID3683 | S | ORF starting with ATG of length 909 |
| ID3684 | S | ORF starting with ATG of length 276 |
| ID3685 | S | ORF starting with ATG of length 270 |
| ID3686 | S | ORF starting with ATG of length 330 |
| ID3687 | S | ORF starting with ATG of length 310 |
| ID3688 | S | ORF starting with ATG of length 300 |
| ID3689 | S | ORF starting with ATG of length 615 |
| ID3690 | S | ORF starting with ATG of length 381 |
| ID3691 | S | ORF starting with ATG of length 291 |
| ID3692 | S | ORF starting with ATG of length 207 |
| ID3693 | S | ORF starting with ATG of length 201 |
| ID3694 | S | ORF starting with ATG of length 801 |
| ID3695 | S | ORF starting with ATG of length 501 |
| ID3696 | S | ORF starting with ATG of length 474 |
| ID3697 | S | ORF starting with ATG of length 255 |
| ID3698 | S | ORF starting with ATG of length 300 |
| ID3699 | S | ORF starting with TTG or GTG of length 558 |
| ID3700 | S | ORF starting with ATG of length 204 |
| ID3701 | S | ORF starting with ATG of length 222 |
| ID3702 | S | ORF starting with ATG of length 276 |
| ID3703 | S | ORF starting with ATG of length 559 |
| ID3704 | S | ORF starting with ATG of length 220 |
| ID3705 | S | ORF starting with ATG of length 213 |
| ID3706 | S | ORF starting with ATG of length 375 |
| ID3707 | S | ORF starting with ATG of length 255 |
| ID3708 | S | ORF starting with TTG or GTG of length 435 |
| ID3709 | S | ORF starting with ATG of length 621 |
| ID3710 | S | ORF starting with ATG of length 270 |
| ID3711 | S | ORF starting with ATG of length 204 |
| ID3712 | S | ORF starting with ATG of length 207 |
| ID3713 | S | ORF starting with ATG of length 204 |
| ID3714 | S | ORF starting with ATG of length 309 |
| ID3715 | S | ORF starting with ATG of length 243 |
| ID3716 | S | ORF starting with ATG of length 819 |
| ID3717 | S | ORF starting with ATG of length 213 |
| ID3718 | S | ORF starting with ATG of length 364 |
| ID3719 | S | ORF starting with ATG of length 345 |
| ID3720 | S | ORF starting with ATG of length 207 |
| ID3721 | S | ORF starting with ATG of length 486 |
| ID3722 | S | ORF starting with ATG of length 351 |
| ID3723 | S | ORF starting with ATG of length 213 |
| ID3724 | S | ORF starting with ATG of length 663 |
| ID3725 | S | ORF starting with ATG of length 525 |
| ID3726 | S | ORF starting with ATG of length 228 |
| ID3727 | S | ORF starting with ATG of length 207 |
| ID3728 | S | ORF starting with ATG of length 375 |
| ID3729 | S | ORF starting with ATG of length 564 |

-continued

| | | |
|---|---|---|
| ID3730 | S | ORF starting with ATG of length 369 |
| ID3731 | S | ORF starting with ATG of length 230 |
| ID3732 | S | ORF starting with ATG of length 226 |
| ID3733 | S | ORF starting with ATG of length 654 |
| ID3734 | S | ORF starting with ATG of length 463 |
| ID3735 | S | ORF starting with ATG of length 444 |
| ID3736 | S | ORF starting with ATG of length 375 |
| ID3737 | S | ORF starting with ATG of length 209 |
| ID3738 | S | ORF starting with ATG of length 236 |
| ID3739 | S | ORF starting with ATG of length 349 |
| ID3740 | S | ORF starting with ATG of length 210 |
| ID3741 | S | ORF starting with ATG of length 215 |
| ID3742 | S | ORF starting with ATG of length 267 |
| ID3743 | S | ORF starting with ATG of length 220 |
| ID3744 | S | ORF starting with TTG or GTG of length 411 |
| ID3745 | S | ORF starting with ATG of length 231 |
| ID3746 | S | ORF starting with ATG of length 336 |
| ID3747 | S | ORF starting with ATG of length 320 |
| ID3748 | S | ORF starting with ATG of length 492 |
| ID3749 | S | ORF starting with ATG of length 358 |
| ID3750 | S | ORF starting with ATG of length 270 |
| ID3751 | S | ORF starting with ATG of length 441 |
| ID3752 | S | ORF starting with ATG of length 279 |
| ID3753 | S | ORF starting with ATG of length 493 |
| ID3754 | S | ORF starting with ATG of length 273 |
| ID3755 | S | ORF starting with ATG of length 384 |
| ID3756 | S | ORF starting with ATG of length 577 |
| ID3757 | S | ORF starting with ATG of length 216 |
| ID3758 | S | ORF starting with ATG of length 278 |
| ID3759 | S | ORF starting with TTG or GTG of length 612 |
| ID3760 | S | ORF starting with TTG or GTG of length 432 |
| ID3761 | S | ORF starting with ATG of length 605 |
| ID3762 | S | ORF starting with ATG of length 243 |
| ID3763 | S | ORF starting with ATG of length 363 |
| ID3764 | S | ORF starting with ATG of length 606 |
| ID3765 | S | ORF starting with ATG of length 376 |
| ID3766 | S | ORF starting with ATG of length 279 |
| ID3767 | S | ORF starting with ATG of length 318 |
| ID3768 | S | ORF starting with ATG of length 294 |
| ID3769 | S | ORF starting with ATG of length 557 |
| ID3770 | S | ORF starting with ATG of length 256 |
| ID3771 | S | ORF starting with ATG of length 253 |
| ID3772 | S | ORF starting with ATG of length 408 |
| ID3773 | S | ORF starting with ATG of length 599 |
| ID3774 | S | ORF starting with ATG of length 259 |
| ID3775 | S | ORF starting with TTG or GTG of length 627 |
| ID3776 | S | ORF starting with ATG of length 492 |
| ID3777 | S | ORF starting with ATG of length 376 |
| ID3778 | S | ORF starting with ATG of length 300 |
| ID3779 | S | ORF starting with ATG of length 204 |
| ID3780 | S | ORF starting with ATG of length 1002 |
| ID3781 | S | ORF starting with ATG of length 325 |
| ID3782 | S | ORF starting with ATG of length 255 |
| ID3783 | S | ORF starting with TTG or GTG of length 633 |
| ID3784 | S | ORF starting with ATG of length 309 |
| ID3785 | S | ORF starting with ATG of length 276 |
| ID3786 | S | ORF starting with ATG of length 559 |
| ID3787 | S | ORF starting with ATG of length 231 |
| ID3788 | S | ORF starting with ATG of length 219 |
| ID3789 | S | ORF starting with ATG of length 216 |
| ID3790 | S | ORF starting with ATG of length 681 |
| ID3791 | S | ORF starting with ATG of length 345 |
| ID3792 | S | ORF starting with ATG of length 301 |
| ID3793 | S | ORF starting with ATG of length 202 |
| ID3794 | S | ORF starting with ATG of length 576 |
| ID3795 | S | ORF starting with ATG of length 327 |
| ID3796 | S | ORF starting with ATG of length 461 |
| ID3797 | S | ORF starting with ATG of length 231 |
| ID3798 | S | ORF starting with ATG of length 765 |
| ID3799 | S | ORF starting with ATG of length 210 |
| ID3800 | S | ORF starting with ATG of length 222 |
| ID3801 | S | ORF starting with ATG of length 300 |
| ID3802 | S | ORF starting with ATG of length 322 |
| ID3803 | S | ORF starting with ATG of length 213 |
| ID3804 | S | ORF starting with ATG of length 798 |
| ID3805 | S | ORF starting with ATG of length 537 |
| ID3806 | S | ORF starting with ATG of length 258 |
| ID3807 | S | ORF starting with ATG of length 216 |
| ID3808 | S | ORF starting with ATG of length 224 |

-continued

| | | |
|---|---|---|
| ID3809 | S | ORF starting with ATG of length 426 |
| ID3810 | S | ORF starting with ATG of length 339 |
| ID3811 | S | ORF starting with ATG of length 218 |
| ID3812 | S | ORF starting with ATG of length 495 |
| ID3813 | S | ORF starting with ATG of length 309 |
| ID3814 | S | ORF starting with ATG of length 225 |
| ID3815 | S | ORF starting with ATG of length 210 |
| ID3816 | S | ORF starting with ATG of length 954 |
| ID3817 | S | ORF starting with ATG of length 243 |
| ID3818 | S | ORF starting with ATG of length 336 |
| ID3819 | S | ORF starting with ATG of length 388 |
| ID3820 | S | ORF starting with ATG of length 335 |
| ID3821 | S | ORF starting with ATG of length 226 |
| ID3822 | S | ORF starting with ATG of length 279 |
| ID3823 | S | ORF starting with ATG of length 237 |
| ID3824 | S | ORF starting with ATG of length 339 |
| ID3825 | S | ORF starting with ATG of length 447 |
| ID3826 | S | ORF starting with ATG of length 246 |
| ID3827 | S | ORF starting with ATG of length 366 |
| ID3828 | S | ORF starting with ATG of length 266 |
| ID3829 | S | ORF starting with ATG of length 243 |
| ID3830 | S | ORF starting with ATG of length 954 |
| ID3831 | S | ORF starting with ATG of length 270 |
| ID3832 | S | ORF starting with ATG of length 306 |
| ID3833 | S | ORF starting with ATG of length 366 |
| ID3834 | S | ORF starting with ATG of length 204 |
| ID3835 | S | ORF starting with ATG of length 342 |
| ID3836 | S | ORF starting with ATG of length 339 |
| ID3837 | S | ORF starting with ATG of length 243 |
| ID3838 | S | ORF starting with ATG of length 360 |
| ID3839 | S | ORF Starting with ATG of length 301 |
| ID3840 | S | ORF starting with ATG of length 228 |
| ID3841 | S | ORF starting with ATG of length 465 |
| ID3842 | S | ORF starting with ATG of length 1182 |
| ID3843 | S | ORF starting with ATG of length 516 |
| ID3844 | S | ORF starting with ATG of length 204 |
| ID3845 | S | ORF starting with ATG of length 1000 |
| ID3846 | S | ORF starting with ATG of length 207 |
| ID3847 | S | ORF starting with ATG of length 285 |
| ID3848 | S | ORF starting with ATG of length 339 |
| ID3849 | S | ORF starting with ATG of length 447 |
| ID3850 | S | ORF starting with ATG of length 282 |
| ID3851 | S | ORF starting with ATG of length 819 |
| ID3852 | T | PUTATIVE SIGMA-B REGULATOR. |
| ID3853 | T | NEGATIVE REGULATOR OF SIGMA-B ACTIVITY (ANTAGONIST OF RSBT). |
| ID3854 | T | POSITIVE REGULATOR OF SIGMA-B ACTIVITY (SWITCH PROTEIN/SERIN |
| ID3855 | T | ANTI-SIGMA F FACTOR (STAGE II SPORULATION PROTEIN AB). |
| ID3856 | T | ANTI-SIGMA F FACTOR ANTAGONIST (STAGE II SPORULATION PROTEIN |
| ID3857 | T | GENERAL STRESS PROTEIN 160 (GSP16O). |
| ID3858 | T | TWO-COMPONENT SENSOR HISTIDINE KINASE INVOLVED IN DEGRADATIV |
| ID3859 | T | TRANSCRIPTIONAL REGULATOR. |
| ID3860 | T | TWO-COMPONENT SENSOR HISTIDINE KINASE INVOLVED IN PHOSPHATER |
| ID3861 | T | SERINE PROTEIN KINASE. |
| ID3862 | T | SERINE/THREONINE-PROTEIN KINASE. |
| ID3863 | T | ARSENATE REDUCTASE (EC 1.). |
| ID3864 | T | CONSERVED HYPOTHETICAL PROTEIN. |
| ID3865 | T | CARBON STARVATION PROTEIN A HOMOLOG. |
| ID3866 | T | POLAR FLAGELLAR PROTEIN. |
| ID3867 | T | TWO-COMPONENT SENSOR HISTIDINE KINASE. |
| ID3868 | T | CARBON STARVATION PROTEIN A HOMOLOG. |
| ID3869 | T | CITS (TWO-COMPONENT SENSOR HISTIDINE KINASE). |
| ID3870 | T | KIN1 PROTEIN (PUTATIVE SENSORY TRANSDUCTION HISTIDINE KINASE |
| ID3871 | T | TWO-COMPONENT SENSOR HISTIDINE KINASE. |
| ID3872 | T | BH0289 PROTEIN. |
| ID3873 | T | TWO-COMPONENT SENSOR HISTIDINE KINASE. |
| ID3874 | T | ARSENATE REDUCTASE (ARSENICAL PUMP MODIFIER). |
| ID3875 | T | BH1859 PROTEIN. |
| ID3876 | T | TWO-COMPONENT RESPONSE REGULATOR INVOLVED IN MODULATION OF F |
| ID3877 | T | ORF starting with ATG of length 709 |
| ID3878 | T | TRANSCRIPTIONAL REGULATOR. |
| ID3879 | T | ORF starting with ATG of length 1347 |
| ID3880 | T | PUTATIVE INTEGRAL MEMBRANE PROTEIN (CSTA-LIKE). |
| ID3881 | T | TWO-COMPONENT SENSOR HISTIDINE KINASE. |
| ID3882 | T | CHEMOTAXIS CHEV PROTEIN (EC 2.7.3.—). |
| ID3883 | T | SUBTILIN BIOSYNTHESIS SENSOR PROTEIN SPAK (EC 2.7.3.—). |
| ID3884 | T | NEGATIVE REGULATOR OF SIGMA-B ACTIVITY (SWITCH PROTEIN/SERIN |
| ID3885 | T | TWO-COMPONENT SENSOR HISTIDINE KINASE. |
| ID3886 | T | BH3353 PROTEIN. |
| ID3887 | T | SERINE PROTEIN KINASE. |

-continued

| | | |
|---|---|---|
| ID3888 | T | BH2734 PROTEIN. |
| ID3889 | T | BH3833 PROTEIN. |
| ID3890 | T | VPSR. |
| ID3891 | T | NTRB, NTRC. |
| ID3892 | T | ORF starting with ATG of length 1557 |
| ID3893 | T | YVQE PROTEIN. |
| ID3894 | T | HYPOTHETICAL 40.2 KDA PROTEIN. |
| ID3895 | T | TWO-COMPONENT SENSOR HISTIDINE KINASE. |
| ID3896 | T | TRANSCRIPTIONAL REGULATOR. |
| ID3897 | T | SERINE PROTEIN KINASE. |
| ID3898 | T | HYPOTHETICAL 58.9 KDA PROTEIN. |
| ID3899 | T | NEGATIVE REGULATOR OF SIGMA-B ACTIVITY (SWITCH PROTEIN/SERIN |
| ID3900 | T | YLAK PROTEIN. |
| ID3901 | T | TWO-COMPONENT RESPONSE REGULATOR. |
| ID3902 | T | YTAB PROTEIN. |
| ID3903 | T | SERINE/THREONINE PROTEIN KINASE. |
| ID3904 | T | TWO-COMPDNENT SENSOR HISTIDINE KINASE. |
| ID3905 | T | CARBON STARVATION PROTEIN A, PUTATIVE. |
| ID3906 | T | AUTOLYSIN RESPONSE REGULATOR. |
| ID3907 | T | BH3353 PROTEIN. |
| ID3908 | T | YLOO PROTEIN. |
| ID3909 | T | YTAB PROTEIN. |
| ID3910 | T | KIN1 PROTEIN (PUTATIVE SENSORY TRANSDUCTION HISTIDINE KINASE |
| ID3911 | T | ORF4 PROTEIN. |
| ID3912 | T | BH2734 PROTEIN. |
| ID3913 | T | TWO-COMPONENT SENSOR HISTIDINE KINASE. |
| ID3914 | T | SUBTILIN BIOSYNTHESIS SENSOR PROTEIN SPAK (EC 2.7.3.—). |
| ID3915 | TK | PUTATIVE TWO-COMPONENT RESPONSE REGULATOR. |
| ID3916 | TK | GTP PYROPHOSPHOKINASE (STRINGENT RESPONSE). |
| ID3917 | TK | TWO-COMPONENT RESPONSE REGULATOR INVOLVED IN PHOSPHATE REGUL |
| ID3918 | TK | TRANSCRIPTIONAL REGULATORY PROTEIN DEGU. |
| ID3919 | TK | STAGE II SPORULATION PROTEIN E. |
| ID3920 | TK | *Mycobacterium bovis* regX3 protein. |
| ID3921 | TK | TWO-COMPONENT RESPONSE REGULATOR. |
| ID3922 | TK | TWO-COMPONENT RESPONSE REGULATOR. |
| ID3923 | TK | TWO-COMPONENT RESPONSE REGULATOR. |
| ID3924 | TK | TWO-COMPONENT RESPONSE REGULATOR. |
| ID3925 | TK | STAGE II SPORULATION PROTEIN E. |
| ID3926 | TK | TWO-COMPONENT RESPONSE REGULATOR. |
| ID3927 | TK | TWO-COMPONENT RESPONSE REGULATOR. |
| ID3928 | TK | SUBTILIN BIOSYNTHESIS REGULATORY PROTEIN SPAR. |
| ID3929 | TK | INDIRECT POSITIVE REGULATOR OF SIGMA-B ACTIVITY (SERINE PHOS |
| ID3930 | TK | TWO-COMPONENT RESPONSE REGULATOR. |
| ID3931 | TK | TWO-COMPONENT RESPONSE REGULATOR. |
| ID3932 | TK | TWO-COMPONENT RESPONSE REGULATOR. |
| ID3933 | TK | PUTATIVE RESPONSE REGULATOR. |
| ID3934 | TK | STAGE II SPORULATION PROTEIN E. |
| ID3935 | TK | *Staphylococcus aureus* protein SEQ ID #5239. |
| ID3936 | TK | GTP PYROPHOSPHOKINASE (STRINGENT RESPONSE). |
| ID3937 | TQ | ORF starting with ATG of length 453 |
| ID3938 | TQ | ORF starting with ATG of length 636 |
| ID3939 | TQ | YUK[A,B,C,D,E,F], YUK[I,J,K,L,M] AND ALD GENES. |
| ID3940 | TQ | BH2731 PROTEIN. |
| ID3941 | TQ | BH1735 PROTEIN. |
| ID3942 | TQ | BH0757 PROTEIN. |
| ID3943 | TQ | ORF starting with ATG of length 975 |
| ID3944 | TQ | YUK[A,B,C,D,E,F], YUK[I,J,K,L,M] AND ALD GENES. |
| ID3945 | TQ | ORF starting with ATG of length 513 |
| ID3946 | TQ | ACETOIN DEHYDROGENASE. |
| ID3947 | TQ | BH1735 PROTEIN. |
| ID3948 | Z | transfer RNA-Ala |
| ID3949 | Z | transfer RNA-Ile |
| ID3950 | Z | transfer RNA-Ala |
| ID3951 | Z | transfer RNA-Arg |
| ID3952 | Z | transfer RNA-Asn |
| ID3953 | Z | transfer RNA-Asp |
| ID3954 | Z | transfer RNA-Glu |
| ID3955 | Z | transfer RNA-Gly |
| ID3956 | Z | transfer RNA-Gly |
| ID3957 | Z | transfer RNA-His |
| ID3958 | Z | transfer RNA-Ile |
| ID3959 | Z | transfer RNA-Leu |
| ID3960 | Z | transfer RNA-Leu |
| ID3961 | Z | transfer RNA-Lys |
| ID3962 | Z | transfer RNA-Met |
| ID3963 | Z | transfer RNA-Met |
| ID3964 | Z | transfer RNA-Met |
| ID3965 | Z | transfer RNA-Phe |
| ID3966 | Z | transfer RNA-Pro |

-continued

| ID | | |
|---|---|---|
| ID3967 | Z | transfer RNA-Ser |
| ID3968 | Z | transfer RNA-Ser |
| ID3969 | Z | transfer RNA-Thr |
| ID3970 | Z | transfer RNA-Val |
| ID3971 | Z | transfer RNA-Asn |
| ID3972 | Z | transfer RNA-Asp |
| ID3973 | Z | transfer RNA-Cys |
| ID3974 | Z | transfer RNA-Gln |
| ID3975 | Z | transfer RNA-Glu |
| ID3976 | Z | transfer RNA-Gly |
| ID3977 | Z | transfer RNA-His |
| ID3978 | Z | transfer RNA-Leu |
| ID3979 | Z | transfer RNA-Leu |
| ID3980 | Z | transfer RNA-Met |
| ID3981 | Z | transfer RNA-Phe |
| ID3982 | Z | transfer RNA-Ser |
| ID3983 | Z | transfer RNA-Thr |
| ID3984 | Z | transfer RNA-Trp |
| ID3985 | Z | transfer RNA-Val |
| ID3986 | Z | transfer RNA-Arg |
| ID3987 | Z | transfer RNA-Asp |
| ID3988 | Z | transfer RNA-Gly |
| ID3989 | Z | transfer RNA-Met |
| ID3990 | Z | transfer RNA-Ala |
| ID3991 | Z | transfer RNA-Arg |
| ID3992 | Z | transfer RNA-Asn |
| ID3993 | Z | transfer RNA-Gly |
| ID3994 | Z | transfer RNA-Pro |
| ID3995 | Z | transfer RNA-Thr |
| ID3996 | Z | transfer RNA-Ala |
| ID3997 | Z | transfer RNA-Arg |
| ID3998 | Z | transfer RNA-Gly |
| ID3999 | Z | transfer RNA-Leu |
| ID4000 | Z | transfer RNA-Leu |
| ID4001 | Z | transfer RNA-Lys |
| ID4002 | Z | transfer RNA-Pro |
| ID4003 | Z | transfer RNA-Thr |
| ID4004 | Z | transfer RNA-Val |
| ID4005 | Z | transfer RNA-Ala |
| ID4006 | Z | transfer RNA-Ile |
| ID4007 | Z | transfer RNA-Arg |
| ID4008 | Z | transfer RNA-Asn |
| ID4009 | Z | transfer RNA-Gln |
| ID4010 | Z | transfer RNA-Glu |
| ID4011 | Z | transfer RNA-Leu |
| ID4012 | Z | transfer RNA-Leu |
| ID4013 | Z | transfer RNA-Lys |
| ID4014 | Z | transfer RNA-Ser |
| ID4015 | Z | transfer RNA-Ala |
| ID4016 | Z | transfer RNA-Arg |
| ID4017 | Z | transfer RNA-Gln |
| ID4018 | Z | transfer RNA-Gln |
| ID4019 | Z | transfer RNA-Glu |
| ID4020 | Z | transfer RNA-Glu |
| ID4021 | Z | transfer RNA-Gly |
| ID4022 | Z | transfer RNA-Met |
| ID4023 | Z | transfer RNA-Ser |
| ID4024 | Z | transfer RNA-Thr |
| ID4025 | Z | transfer RNA-Val |
| ID4026 | Z | transfer RNA-Val |
| ID4027 | Z | transfer RNA-Asp |
| ID4028 | Z | transfer RNA-Glu |
| ID4029 | Z | transfer RNA-Lys |
| ID4030 | Z | transfer RNA-Phe |
| ID4031 | Z | ribosomal RNA-16S |
| ID4032 | Z | ribosomal RNA-23S |
| ID4033 | Z | ribosomal RNA-5S |

SEQUENCE LISTING (8481 sequences)

SEQ ID NO: 1 - DNA, 3465 bp, Bacillus licheniformis
tacatgggaagggcagcggcttgattacccttcgacaggccctgatatgccggactttgaaccgcgcggctgtccgcggggagccagcttttcctggtatatatacagcccgctccgcgtgaaatacccgtatgtacgcggtgtgctgatccagatgtggcgcgaggcgctaaacagcagcaaaaatccgcttgaagcatggaaatcaattgtcgaaaaccctgaaaaagcgaaagcctataaacaggcgcgcggaaaaggcggatttgtccgcgccgaatggagcgaagtcctgaagctgatttcggcttcccttctgtataccattgccaaatacggccctgaccgcaatgtcggcttttcgccgattccagccatgtcgatgctcagccatgcagcaggatcacgctttatgtccctgatcggcgggccgatgctgagcttctatgactggtatgccgacctccctcctgcttcaccgcaaatttggggagatcaaaccgacgttccggaaagcagcgactggtacaattctggctacatcatgacatggggctctaatgtcccgcttaccagaacgcctgacgctcactttttagccgaagcccgctataaaggagcaaaagtgatttcgatcagcccggactttgccgagtcctcaaagttttccgatgattggctgagcatcagacaaggcacggacggcgcactggccatggcgatgggccacgttattctgcaagacttttatgtcaaccagaaaacggaacgttttattgattatgcaaaacaatataccgatttcccgtttttggtgactttgaaagaggaaaacggaacgttcacagcaggccgcttcctccatgctaaagatatcgggcgcgcgacagagcacgatgagtggaagcctgccgtttgggacgaagacacagatggatttgcgattccgcagggcacgatgggctcccgctgggacggcaaaggaaaatggaacctgcgcatggttgatgaggattcagaaaaaccgatcacacctcggctttccatgcttggatacgaagatatgatcggcacggtcaacatcccgtatttctcacatgacggcaataaagtgcttgaaagaccgcttccgatcaaaaaagtcatcttgaacggcgaggaagtctttgtttccaccgttttcgacctgactctcgccaactatggcgtcaactgcggaatcggcggacagacgccggcatcatttgatgatcctgaaccgtttacaccggcttggcaagagccgattactggcattaaaagtgaaatggtgatcaagatcgcgagggaattcgcgcaaaatgcgattgacacagagggccgctcgatgatcattgtcggcgccggaattaaccattggttcaattcagacaccatttacagagctgtactgaaccttgtgcttctcgtcggagcccaaggagttaacggaggaggctgggctcactatgtcggccaggaaaaactccggccggccgaaggatggcagacgatcgcgatggccaaggactggggaggccctgccaaactgcaaaacggcacatcatttttctacttcgccaccgaccagtggcgctatgaagatcaggaaatcagcgggctcgcttcaccaatcgcaaaaacatcgcgctacaagcaccatgccgattacaatgtgctggcggcgagactcggctggcttccatcgtatccgacgtttgagaaaaacggcatcgacttgtataaagaagcagaaaaagcgggcgctgagaacgctcagcaagtcggaatctatattgccagacagctcgaggagaaaaagctcaagttttcgattgaagatcctgacaatgaaaagaacttcccgagaaatctatttgtctggagagccaatttaatctcaagctccggcaaaggccatgaatattttctgaaacacttgctcggcacgacaaacggactgatgaacgatgatcaggacagcatccgtccggaagaaatcacttggcgtgacaaagcgcctgaaggcaaactcgatttactgatcaatctcgatttccggatggcgggaacagccctttattcagacatcgtgctccctgcggccacctggtacgaaaaacacgatctcagcagcacggatatgcatccgttcatccacccgtttaatccggcaatcagcgcgccgtgggaagcaaagtctgattgggatatttttaaagcactggcaaaagcggtttccgatctggctgaagaagtggatatggaacctgtcaaagaggctgttgcgactcctcttctccatgacactccacaagaaatggcgcagccgctcgggaaaatcaaagattggagcaaaggcgactgccctgccgtaccaggcaaaacaatgccgcaaattcacgttgtggagcgggattataagcagattttcaataagatgacatcgcttgggccgaatgttgtcaaacagccgtttggtacgaaaggaatgaactggtctgttgaagcggaatataattctctcaaaaaaacgctcggcgtcgtaaaagacgacacgatcgccaagggctgtcccgacatcagtgatgctagacaagctgctgaagcggtattgactctctcttccacttcaaacgggaaagtagccgttaaagcgtgggaatcgcttgaaaaaattacgaatcttgagttgaaagatttagctgaagaacgggaagaggaatgcttcacatttgagcaaatttcagctcagccgaaaacggtgatcacctcccctgctttcagcggttctgaaaaaggcggacgacgctattctccgtttacgacaaacgttgaaaaactgattccgtggagaacgctgaccggcagacagtctttttaccttgatcatgaaatgatgacagaattcggcgaaaacatggcgacattcaagccgatcctgatccaccgccctttcttgaacaagcgtccggatcaggaaggaaaagaaatcgttttaaactacttaacgccgcataataaatggtcggttcacagcatgtattttgattccctgccgatgcttacccttttcagaggcgggccgacagtctggatgaataaagacgatgccgaagaaaccgacattcaggacaacgactggatcgagtgcttcaaccgaaacggtgtcgtcgtcgcacgggccgtgacatcacaccggattccaaagggaatggcgtttatgcaccatgcccaagacagacatatcaacgtgccgggaacaaagctgacgaataaccgcggaggaacccataacagcccgacccgcatccatgtcaagccgacgcagatgatcggaggctacggacagctcagctacggattcaactactacgggccgacaggaaatcagcgcgacctcaatgtcgtgatcagaaaattgaaggaggtcgattggcttgaaga

SEQ ID NO: 2 - DNA, 2238 bp, Bacillus licheniformis
cttgggcgctgacgttttgacaagcggaagccaaaatgtgcgcgccctttcagaattcaggatccgggggaatcaaaacgaacattcctttccttgaaaatgtggcgaaacacgaaaagtttcttacagggcaatacgacacgtcttttatcgatacaacgccagaactttttgtctttcctaagcagagagaccgcggaacgaaaatgctgacatatatcgggaacgtaacggtcaacggcttcccgggcatcgataaaaagaagaagcccgagtttgataagccgcagatcgtcaaaacagatgtcgatcagccaatcgcaagcggaacaaaacagattcttgatgaacgcggagccgaagggctcgtcaaatgggtgaaagatcaagaggaagtgctcctcactgatacgacgttccgcgacgcccatcagtcattgcttgcgacaagagtcagaacgcatgacctgaaaaaaatcgccaatccgacggctgcgctctggccagagcttttcagtcttgaaatgtggggcggcgccacatttgatgtcgcttaccgtttcttgaaagaagatccgtggaaaaggctcgaggagctgcggaaggaaattccgaatacgatgtttcaaatgcttttgagatcttcgaatgccgtcgggtatacaaactaccctgacaacctgattaaaaagttcgtcagcgaatcggctgcggccggaatcgatgtattccgcatttttgacagcttgaactgggttaaagggatgacgctcgccattgatgcagtgcgcgagtcaggcaagcttgccgaagcggcgatctgctatacaggggacattctcgatccgaacagaagcaagtataatcttgaatattatacgtcaatggcaaaagagcttgaagctgcgggggcgcatattctcggcattaaagatatggccggcctgctgagacctcaagcggcatacgaactggtgtcggctttgaaagagacgatcgacattccgatccacttgcatacacacgacacgagcggcaacggtatttttatgtatgcgaaggcgatagaagcaggcgtcgacatcgtcgacgtagcggtcagctcgatggcgggtctgacatcacagccaagcgcaagctcgctttaccatgcgcttgaaggagataaacgccgtccgcagttcaatgtcgatgcggaagaataatagtctcaaaaaaaaaagtctgtcagaaaatattacagcgagtttgagagcggcatgattgcgcctcataccgaaatttacaagcatgaaatgcctggcggccaatacagcaaccttcagcagcaggctaagggagtcggcctcggcgaccgctggaatgaagtgaaagaaatgtacagccgggtcaaccacctgttcggggacatcgtaaaggttacgccgtcatctaaagtcgtcggggatatggcgctttacatggtgcaaaataacctgacggaagatgatatttacgaaaggggagaatctctcgattttcctgactcggttgtcgagctttttaaagggtatatcggtcagcctcacggcggattccctgagaaattgcaaaagctgattttaaaagggcaggagccgattacagtacgccctggagaactgcttgaaccggtttcatttgacgctataaaagcggaattcttggaaaagcatggtatggagctttccgaccaggatgctgttgcatatgcgctttatccgaaagtgtttaccgagtatgtcaagacagcggaactgtacggggatatctctgtgcttgatacaccaaccttcctctacggcatgaccctcggcgaagaaatcgaggtcgagattgaaagagggaaaacgctgatcgtcaaacttgtctctatcggggaaccgcgtccggatgcgacgagagtcgtttattttgaactgaacggccagcctcgcgaagtggtcattaaagacgaaagcattaaatcgtccgttcatcaaaaggtgaaagccgaccgttcaaacccgaatcatatcgcggcatctatgccgggaacggtaatcaagcttcttgtaagcaaaggggaccaagtgaagaagggcgatcatttgatgatcaatgaagcgatgaaaatggaaacgaccgttcaggctccgttttcaggaactgttgaaaacattcacgttacaaacggagaagccattcaaaccggcgaccttctcattgaactgaaaaaat

SEQ ID NO: 3 - DNA, 1937 bp, Bacillus licheniformis
atgaatttgaaatgggacgaattcataattacaggtgacccattaattcttggagcacagatttccattttgcttacttcaattgcaatcgtatttgtgctgacatacttcaaaaaatggaaatggctttggagagagtggattaccaccgtcgatcataaacgtttaggaatcatgtacatcattgccgcagtcattatgttcttccgcggcggtgtcgacgggttaatgatgcgtgcccagctcacgcttcctaataacggctttttagattccaaccactataatgaagtatttacgactcacggtacgatcatgatcatcttcatggcgatgccgtttcttattgggttaatgaacgtggtcgtaccgcttcaaatcggtgcgcgggacgttgcttatccttacttgaacaacttgagcttctggaccttcatggtcggagcgatgctgtttaacatttcattcgtcatcggcggatcgccgaatgcaggatggacggcttacatgccgcttgcaggcaacgagctgagtcctggacctggacagaactattacttgctcggacttcagatcgcgggtatcggtacgcttctcaccgggatcaactttatggttaccatcctgaaaatgcgtacaaaaggcatgactctatggcggatgccgatgttcacttggacaacgctgatcacttgtgtgattatcattttcgccttccctgtcttgacagtggctttggcgctgatgacatttgaccgcttgttcggaacagcctttttcactttggcaaacggcggtatgccgatgctatgggcgaacctgttctggatttggggacatcctgaggtttacatcgttattttgcctgctttcggtattttttcagaaatcattgcaacatttgcgagaaagcagctgttcggctataaagcgatggtttattccattgtggcgatttcggttctcagctttatcgtttggctgcaccactttttcacaatgggcaacagcgcggcggtcaactcgttcttctcgattacgacaatggcgatatcggtgccgaccggggttaaaatctttaactggctgttgacgctgcatcgaggcagaattaaaatcacaacgccgatgctgtggtcgcttgcatttattccgaacttcgtcatcggcggtgttacgggcgttatgcttgcgatggcagctgcggattatcaatatcacaacacatacttcctcgtatcgcacttccactacgtgctgatcgcgggtactgtgtttgcatgtttcgccggattgatcttctggtatccgaaaatgttcggtcacaaactgaacgaacgcatcggaaaatggttcttctggctgttcatgacgggctttaacatctgtttcttcccgatgtatttccttggattgcagggaatgcctcgccgtatttacacatacggagcagaagacggctggactgcattgaacatgattgcgacattcggcgcattgctgatggccgcaggattcatcgttctctgctataacattttctacagcttccgtcattcaaaacgcgaggaatcaggagatgcttggggaatgggtcgcacgcttgaatgggctacatcttctgcgatcccgccgcactataactttgcggttctgcctgaggtcacttcacctgacgcatttgcgcaaatgaaggaagacaatgtcgagattcatcctgaaagcaagtttaaaaagattcatatgccgagcaattcaggccgtccgtttatcatgtcattatgcttcggatttgctggattcgggcttgtctttgaatggttctggatgggaatcgtcggtctgatcggtgtattcctctgtatgattcttcgttcatttgaatatgacgacggctactatgtaagtgttgaggaaataaaagagactgaacgaaa

SEQ ID NO: 4 - DNA, 2004 bp, Bacillus licheniformis
aaaagcagcttgtccttgtagggaacggtatggccggggtcagggccattgaagaaattcttaaaatttcaaacgaagagtttcagatcacgattttcggcagcgaaccgcacccaaactataaccggattcttctttccaaagtgcttcaaggagatacggatgttaaggacattacactgaatgattgggattggtatgaagaaaacggcattcagctgtatacaggtgaagaagtcgttaaagttgatccggagtccaaaaccgtcatcacggatacgggaagagtccagccgtatgatgaactgattttggcgacaggttctctcccttttattctgccattgcccggagcggataaagaaggtgtaacagctttccgtgatatcaaggatacggatatcatgctcgaagcttccaaaacgtacaaaaaagcagcagttatcggcggcgggctgctgggactggaagcagcgcgcggacttctcaaccttggcatggatgttaccgttgtccacctcgcgccatatttgatggagcgtcagcttgatgcagccgcaggacggcttttgcaaaaagagctggaaaagcagggcatgaaatttttactggaaaagcagaccgaagaaatttacggagaaacacgtgtcgaaggcttaaaattcaaagacggctcaacgcttgaggccgatttggtcgtcatggcggtcggaatcaagccgaacgttcagctcggcaaagactgcggccttccggtaaacagaggaatcgtcgtcaatgattacatggagaccgaagttcccaacatttacgctgtcggagaatgcgcggagcataggggcattgcctacggacttgtcgcgcctctttatgaacaggcaaaagtgcttgccaaaaaaatctgcggcgttgaaacggctccgtatgaaggatctgttttatctacccagctgaaggtttccggtgttgaggtcttttctgccggtgactttaatgaggatgacggagaagacaaaaaagcgctcaaagtgtttgacgaacaggacggaatctacaaaaaaatcgttctgcgcggcaatcaggtgatcggcgccgtactgttcggagacagcagcgaaggaaacaggctgttttccatgattcaaaaaggagcggatatttctgatacttcaaaaatttcaatcttgcagcctttgaatcaggaagaaggcatgagcttgaccgctgcgatgagcgacgatgagatcgtgtgcggctgcaacggcgtttcgaaaggaatgatcattcaggcgatcaaagagcagggatgcacatcgacggatgaaattaaagcatgcacaggcgcatcgcgctcttgcggaggatgtaagccgcttgtcgcagagattctccagcatacgctcggctcagaatttgatgcttcagcacaaaaagaagcgatttgcggatgtacggacctttcaagagacgaactcgtggccgaaatcagagaaaaagggctgacccatacaaaagaagtcatgaacgtgctcggctggaaaacggcggaaggctgttccaaatgccgccctgcgcttaactactacctcggcatgatcaatccgaaggaatatgaagatgaaagagaatcccgcttcgtcaatgaacggatgcacgccaacattcaaaaagacggcacatattcagtcgtaccgcggatgtacggcggggtcaccaattcgaatgacttgcggcgcatcgccgatgtcgtcgacaaatatgaaattcctctagtgaaaatgaccggcggccagcggatcgatctgatcggcgtcaaaaaagaggatcttccgaaagtatgggctgatcttgacatgccttctggatttgcttacggaaaaacgctcagaaccgtaaaaacgtgcgtaggcgaacagttctgccgcttcggaacgcaagattcaatggctctcggaattgaccttgagaaaaaatttgaagggctctacacgcctcacaaaatta

SEQ ID NO: 5 - DNA, 2007 bp, Bacillus licheniformis
gttacatccggctcggataaaaagaggattttgataagcggacgaaggagcgccttcaaaagatatgggagaacgtgttcggccaaaagaaactgcttaaagataaaaaaagcggcatcatccatgtcatgtttttttacggctttattctcgttcagttcggagcgatcgattttattttgaaagggctcgttcctgatcaaggcattccgcttggcggcgtctacccggcgtttacgttttttcaggaaatcgtcacactgatgattttaattgttgtagtctgggcttttcacaggcggtatatagaaaaactcgtcaggctgaagcgcaattttaagtcggggatcgtgctcatgctgatcggcggcttgatgtttaccgttttactcggaaacggtatgaacatgatctggcatgaacattcattatcatggcacgaaccgatggcatcaggcatcgcttttgccttcggctttatgggggaaaccgcttcagcggcagtgttctacgcggcgtggtgggcgcaccttctcatcctgctgacatttttagtctatgtaccgcagtcaaagcacgcccacttaattgccggaccggcaaacgtatttttcagccggctgacaaacccgggaaagcttcaaaaaatcgattttgaagatgaaacaaaagaaacgttcggcgtcggacggatcgaggaattcaggcagtcccagctgatcgacctttacgcatgcgtggaatgcgggcgctgtaccaatatgtgcccggctacaggaacaggcaagatgctttcgccgatggatctgattttgcggctcagagaccatttgacagaaaagggagcagcagtgacatcgagaacgccttgggtacccgcaccgctctttcagcatacgaaaggcaaccagctggccatggcggcagggggagaagggtcaagggaagcggctgcttcagaactttacaacccgagcttaatcggcgacatcatcacagaagaagaaatttgggcctgcacaacatgccggaattgtgaagatcagtgcccggtcatgaatgagcacgtcgataagatcatcgatctccgccgctatctcgtgctcacagaaggaaaaatggatgcagatgcccaacgcgccatgacgagcattgaaaggcaggggaacccttggggattaaaccgaaaagaacgtgaaaactggcgtgatataagagacgatgttgaggtgccgacagtaaaagaaatgaagaaaaaaggcgagtcctttgaatacctgttttgggtcgggtcgatgggatcgtatgaccggagaagccagaagatcgccatggctttcgctcgcctcctcaatcaagccggggtcacgttcgcgatattaggcaataaagaaaaaaattcaggcgatacgccgagacggcttggcaacgagtttttattccaggagctagctgcaaaaaacattgaggaatttgaaaaaaatgatgttcaaaaaattgtaactatcgacccgcatgcatacaatattttcaaaaatgaatatcctgattttggtctgaaagcggaagtttatcatcatacagaaattcttgctgccctcattgaagaaggaaagctgaaacctgagtttccggttcacgaaaccgtcacctttcatgattcatgctatttgggccgctacaacgaggtttacgatccgccgcgcgctattctccgctccattccgggcatccgtttagcggaaatggagcgcagccgtgaaaacggaatgtgctgcggagcggggggcggcctcatgtggatggaggaagaggcgggcgcgaggatcaacgttgccagaacggagcaggcgctcagcacatcaccttctgtcatcagctcgggctgtccttactgtttgacgatgctcggcgacggaacaaaagccaaggaattggaggatcaggtcggcacgtatgatgtagcggagctgcttgaacgcgccgtattcgggtcagagcaaaaag

SEQ ID NO: 6 - DNA, 1975 bp, Bacillus licheniformis
atgggaaaaacaaagcatcaaggtccgatgaagctgaataaaaagcccgcgccaaaactgtgggcgtcttgggcgccgatgggactcggaaaggtaaagccgaagcatatcagagatacgatgaaaacagcgtgggacaataaagacaaccttccgtacgcctacagaattttgacgcaaggcgtgtgcgacggctgtgcgctcggtgtgtccggactccgcgatcagacgctcacaggccctcatttatgcacgacgcggctgaacgtcctgcgcttaaatacaatgcctgcgatcgaggacaaatggctgtccgccgacatcgaacagctgcgaaagctggacagcaccgagctgagaaagcttggacgcatcccctatccgctgtcgagaaaaaatggtgaacgatcgttctcgagaatttcgtgggatgaagcgctcagccgaatcgcggacaaaatcaaatcgattgataaacggcagctcgccttttatttaacagccagaggcataacgaatgaggtgtactatacggccgcaaaagcggcgcggtttatcggcacaaacaacattgacaacgcctcgcggatctgccactcgccaagcaaaacggctttaaaaaggtcccttggcatcggcgcctcaagctgcagctaccgagactggatcggaacggatgtcctcgtcttctgggggtctgtcgctgccaataatcagccggtgtcaacaaaatacatgtatgccgccaaaaaagcgggaacgaaaatcattatgatcaatccgtaccgggagccatcgatggagaaatactggattccatcgatacctgagagcgcccttttcggcaccaaaatcaccgatgatgtttaccaagtcaatatcggcggcgacattgcctttatgaacggggtgatgaagcactggtttgaaatggagcgggaggcaccaggttcaagcattgaccgcgcctttatcgatgcacacacaaacgggttcactgagcttaaacagcacatcgaaaaacaaaattggaagacgcttgaagagtcatccggcatatcaaaagagagaatgaaagaattcgccgtcttgctggcccgggcgaaaaccggcgttttcatttggagcatggggcttacacagcaccgttttgcgaccgacaacatttcacaggtggcaaatctcgcccttttacaaggattcatcggcagaaagcattgcggcgttatgccgatcagagggcacagcggtgtgcagggctctggagaaatgggtgccgatcctttcgtcctcccaggcggtgattttgacgaggaaaatgccgcacggatcgagaaggtttggggcttccgcttaccgacttggcaaggcgatacgatcggccagacgatcgaaaacatgctgctgccgagcggaagcgaaagaaaagtaaaagtgttttatacaagcggaggaaactttttggagacgatgccgaaccctgattttatcaaaaaagcattgcaggaagttgaagtgagagtccatcaggacatcatcttcaatacctctaccctggtcgatgccaaagaggaagtcatcattctccctgcgatgacaaggtatgaacagcctggcggaggaacctcgaccagtacggaacggatggtatacttcagccccgaaattaaaggaccgcgcatcggagaagcccgttcagaatgggaaatttatgtagatctcgccaaacgggtccggcccgaagacaaagaactgatccattttgacggcgctgcggaaatccgtgaagaaatcgctgctgccaaccggaattatgacgggattcagcatttaaaaaaacgcggagatgtctttcaatggggcggcgcctggctttgtgaaggcggtgtttgtccgacggcagacggcaggggcaacctgatccctgtcgatcttcctgaaaacagacaaacggaaggacgctttctcgttacga

SEQ ID NO: 7 - DNA, 2097 bp, Bacillus licheniformis
aaaaatcgcatcagcggtaaaacttgcagaagatattagaacctatggccatttaaacgcttccgtcaatccactgagaaaaacacaagagaaacaggagctttttcctcttgctgagtacgggttaactgagcaggatgtgaaaaaaatcccggcgtctgtcatatgcaaagatgcccctaaagaagtaacgaacggtttagaagccatccagtacttaagaaacacatacaaaaaatcgatttcttttgaatttgaccatgtgcacatttttgaagagcgcaactggctgatgaaaaagatcgaatccggggaattattcaccccgaaatcgaaagaaaaactggtagaagttttaagaaggcttacagaagtggaaagccttgaacagtttctccacaaaacctttgtcgggcaaaaacgcttttcaatagaaggacttgatgcgcttgtgcccatgctggatgatattatcgccaagtccgtttcggcaggtacgacaaacgtcaatatcggaatggcgcacaggggccgcctgaatgttcttgcgcatgtgctcggaaaaccttatgaaatcattttttctgaattccagcatgcgccgaacaaagatctcgttccgtcggaaggttcgaccgggatcaattacggctggacgggcgacgtaaaataccacctcggcgccaaccgccagattcaggatgagcatacgaaaacggcgcgcattgcgctcgcgaacaatccgagccaccttgagttcatcgatccgatcgttgagggatcgacaagagccgcccaggaaacgagaacggagagcggctatccggttcaagacgtcaaaaaatcgatggcgattctgattcacggcgatgcggcattcccaggggaaggcattgtcgcggaaacgctgaatttaagccagcttaaagggtatcaagtgggcggagcgattcacattatcgccaataacatgatcggctttacgacggaaagcaatgagtcaagatcgacgaaatatgcaagcgaccttgcgaaaggttttgaaattccgatcgtccacgtcaatgctgatgatcccgaagcatgtctttcagcggttcagctcgctgttgaataccgcatgactttcaacaaagactttttgatcgatctgatcggctaccgccgttttggccacaatgaaatggatgagccgtccgcaacgcagccgatgctgtatgatgcggtcagaaagcatccgaccgtcaaaaacatctttgctgaaaagctgattcataaagggatcgtcgataaagaaaccgtcggcaaaatcaaggacgctgtccagaagcgtttagaagaagcctatcgcaaagtgccggccaaaaaggaagacatgacgcatgaaatcgtacttccagagccggtctccaacggttttcctgatgttgacacatcggttgattttgaaactttgcgcaaaatcaatcaggagcttgtttcatggccggaaaacttcaacgttttcgataagctaaaacgaatccttgaaaggcgcgccaaagctttcgaagatgaccgaaaagtcgactggtcgcttgcagaggcgatggcgtttgcgtcgattttgaaagacggtacgccgctaaggctgaccgggcaggattcagaacgcggcacattcgcacaccgcaaccttgtccttcacgacagcaagacaggggacgaattcatcgcgctgcatcaccttgccgatacgaaagcgtcatttgcggttcacaacagcccgctttctgaagggtccgtcctcggcttcgaatacggctataacgtgtcttcgccggaaacgatggtgatctgggaagcgcagtttggagattttgcaaatgcggcgcaagtttactttgaccagttcatttctgcaggaagagcgaagtggggtcaaaaatcagggctggttgttctcttgccgcacggctatgaagggcaggggcctgagcattcaagcggaagaacagagcgattccttcaattggcggcggaaaacaactggactgtcgccaacctgacgagcgctgcccaatactttcatattttaagaaggcaggcgaagatgct

SEQ ID NO: 8 - DNA, 1950 bp, Bacillus licheniformis
  misc_feature (1)...(1950): n = A,T,C or G
tcggcgttcaaaccgatgagccgtttaaacggtcgcttcagcctttcggcggcatccgaatggcaaagcaggcatgcgaatcctatggttttaaactgaatgaagaagtggaaaggatctttaccgattaccgcaaaactcataaccaaggcgtgtttgacgcatatacggacgaaatgaagctcgcccgaaaagtcggaatcattaccggactgcctgatgcttacgggcgcgggcgcatcatcggtgattaccggagagtggcgctttacggcgtggatttcttgatcgatgaaaagaaaaaagatgcggccggcacctctcgggtgatgtctgaagaaaacatccgccttcgtgaagaactgtcagaacaaatccgagcattgaacgaacttaaagcgcttgcaaaaagctatgggtttgacatttccaagcctgcggcgaatgcaagagaagcatttcaatggctgtattttgcctatttggctgccattaaagagcaaaacggagcagcaatgagccttggccgcgtgtccacgttccttgatatttacatcgaaagagatttgaaaacgggcgtattaacagagcgtgaagcccaagagcttgtcgaccatttcgtcatgaagctgcgtttggtcaaattcgcgcgcacacctgactacaatgaactgttcagcggcgatccgacgtgggtgacagaatcaatcggcggaatggcgcacgaccgacgcgccctggtgacgaaaactcgttccgtttcctgcatacgcttgacaatttaggcccggcgcctgaaccgaatttaccgtttctttggtctgtcagaactgcgcnnaagtttanaactactgtgccaaaatgtcgattaaaacaagctcgatcccatacaaatgacgatatatgcgtccagatacggtgatgactacggaatcgcctgctgtgtatcggcaatggcaatcggcaaacaaatgcagttcttcggagcacgcgccaacttggcgaaagctcttttatatgcgattaacggcggaaaagacgaaaagcataaaatgcaagtcggtccggaaatgccgccggttgcttccgacgtgctggactatgacgaagtgatgcataaattcgatcagacgatggaatggctcgcaggcttgtacatcaacacgctcaatgtcattcactacatgcatgataaatattgctatgaaagaattgaaatggccctgcacgacacggaaattttgcggacgatggccactgggatcgccggcttgagtgttgtcgccgattcattaagcgctgtcaaatatgccaaagtcagcgtggtccgcgatgaaaacggcattgcggtcgattttgaaacagaaggcgactttcctaagtacggaaataacgatgaccgcgtcgacgcgatcgccgttgacattgtcaagcgctttatgaaaaaactgcgcaagcatcagacatatcgccagtccgttcagaccatgtcaattttaacgatcacgtcaaacgtcgtttacggcaagaaaaccggaaatacgccggatggacgccgcgcgggagaaccgtttgctccaggtgcgaatccgatgcacggccgcgatactaaagggacgcttgcatcgctgtcttcagtggcaaagctgccttacagctatgcgctcgacggcatttccaacaccttttcaatcgtcccgaaagcgcttggcaaagacgaagagagccgcgccgccaatttgtcaagcatccttgacggatatgccgcaaaaacaggacatcacttaaatgtaaacgtatttaacagagagacactgctcgacgccatggaacatccagaggaatatccgcagttaacgattcgcgtctcaggctatgcggtcaactttattaagctgacgaaagaacagcagttagacgtcatcagcagaaccttccatgaatcgatgt

SEQ ID NO: 9 - DNA, 1791 bp, Bacillus licheniformis
tgaaaaccccgctgaaacggacgggtccaaaaggagccgggatgtttgaaccgatcagctgggatgaagcgattgaaacgattcgcacccgctggcagtcgctcattgaacaggaaggccccgaaagcattctgccctacagcttttacggaaatatgggaaacttgacggctgaaggaatggacaggcgctttttccaccgcctcggttccagccagcttgaccgggcgatttgcacccctgccggttctgtcggctataaatacacgatgggcggaagcatcggcaccgatcctgaagatacaacggagacaaaactgtttattttttggggaatcaacgcggtctcaaccaacatgcatcaaatcaccattgctcaaaaagcccggaaaaacggcgcaaaaatcgtcgtaatcgatgttcataaaaatcagaccggccggatggccgactggtttattccgattcgccccggcacagacagcgcgcttgcgcttggcatcatgcatgttttattcaaggaacatttggctgatgaatcatttttgaaagaatttacagtcggccacgaagagctgcgccgccacgtgcggcaatacgaccccgccgcagtagaggcggtcaccggcgtatcccggaatgatattatcgagcttgcccgcctgtacggccgcacctccccttcattgattcggatcggcaacggtcttcagcatcatgataatggaggaatgatcgttcgcaccatctcgtgcctgcccgcgatcacgggccaatggacgaaaaaaggaggcggagcgatcaaaggcaacacggcatttttggcctataatacaaaagcattgcagcgccccgatttattaaaaggcagaacgccgagagtcatcaacatgaatcagctcggcaaagctctcttagaaaccgaaccaccgatccgttcgctgtttgtgtacagcagcaatccggccgttgtcgcgcctgaggcgaacaaagtcagaaaaggacttgagcgcgaagatttattcacggttgttcacgatctatttctgacggaaacggcacggtacgccgatatcgtcctgccggcttcttccgctttcgaaaatacggatttctatacatcatattggcaccattatgcgcagattcagaagcctgtgattgagaaatacggcgagagcaagtcaaatacagaagtattcaggcttttggctgaggcgatgggctttgatgatgagccgctgaaagattccgacgaagagatgatcagacaggcgcttgactaccctgataatccgtggctcgatggcattgactatgacagcctgactgaaaagcattttgtcaaagcaaatcgaaaaacggtttttcctgataaactgccgacgcctagcggaaaaattgaattgtattcaaaaatgatggagcagcacggctatccgggcctgccgactcataccccgctcattgaaacggacaagtatccatttttatttgtgcccggcccgaatcacaattttttaaattcgaccttttcaaacaatgaaaaacatatcaaattagaaaaggagccgaaacttcacttaaatataaaagatgccgaagaaaagggcatcgaaaatggagatttggtgaaagtttggaatgaccgcggctcatgcatcctgcccgctgccgtcggagaaaacgtccttccgggcgtggccgtcagccagggattgtgggcggatgcagaagggaagcattatctcgtcaatgcgctgacgcccgaccgtttagctgatatgggcg

SEQ ID NO: 10 - DNA, 1551 bp, Bacillus licheniformis
atgacaacaccttacaaacacgaaccatttacaaatttcgggatcgaagaaaaccggaaggcattcgaaaaagctctggaaacggtaaataacgaatggctgggtcagtcctatcctcttgttatcgatggagaaaggtatgaaacggaaaacaagatcgtatcgatcaaccctgcaaacaaagaagaagttgtaggcacggtatccaaggctactcaggatcatgcggaaaaggccattcaggcggctgcgaaagcgtttgaaacttggagatacacagatcctgaagaaagagcggctgttttattccgcgcggttgccaaagtgcgccgcaaaaagcatgagttctctgcgcttttagtcaaagaagcaggaaaaccttggaatgaagcggatgcggatacggcagaagcgatcgattttatggaatactatgcgcggcaaatgattgagcttgcgaaaggaaagccggttaacagccgtgaaggcgaacgaaatcaatatgtgtacacaccgactggtgttacggttgttattccgccttggaacttcctgttcgcgatcatggccggaacgacagttgcgccgatcgtgacaggaaacacagttgtactgaagcctgcaagcgcagcgcctgtcattgccgcaaagtttgttgaagtgcttgaagaaagcggacttccaaaaggagtagtcaacttcgtccctggaagcggagctgaagtcggggattatttggtggaccatccgaaaacaagcatcattacgtttaccggttcaagggaagtcggaacgcgcatttttgagcgtgcagcgaaggttcagcctggtcagacccacttaaaacaagtgatcgctgagatgggcggaaaagatacggtcgtcgttgatgaagactgtgatattgaattggctgcacaatcaattttcacatctgccttcggctttgcaggccaaaaatgttcagcaggttcacgggctgtcgtgcatgaaaaggtatatgacgaagtattgaagcgcgtgattgaaattacggagtccaagaaagtcggagagcccgacagcgcggacgtttacatgggacctgtcatcgatcaggcatcctttaacaaaatcatggactatatcgaaatcggaaaagaagaaggccgcttagtcagcggaggaaaaggcgatgattcaaaaggctacttcatcgaaccgacgatctttgccgatttagatccgaaagcccggttaatgcaggaagaaattttcggacctgttgttgctttctcaaaagtaagcagctttgatgaggcgctggaagttgccaacaacaccgaatacggcctgacaggcgcggtcattactaaaaaccgcgatcatatcaacagggcaaaacaagaattccatgtcggaaatctgtatttcaaccgcaactgtacaggggcgatcgtcggctaccatccgtttggcggtttcaaaatgtcgggaaccgactctaaagcgggcggacctgattatcttgcgcttcacatgcaggcgaaaacgatcagcgaaatgttttaa

SEQ ID NO: 11 - DNA, 1662 bp, Bacillus licheniformis
acacaatcggagttgactttggaacattgtcagggcgtgcagttctcgtcgatgtccggacaggtgaggaaatcgcgacagctgtcaaagagtacacgcacggggtgatagaccgggagcttccggtctcaaagcgaaagcttccgagagactgggcgctccagcatccggccgattacattgaagtgctggaggaaacgattccgagccttttgaaacagtcaaaagcggatccgaaagaaatcatcggaatcggaatcgatttcacggcttgcacgattttgcccgttgacgagaacgggactcctctttgtatgagggaagagtatgcgtcggaaccgcacagctatgtgaagctttggaagcaccatgctgcacaggagcaggcgaatcgcttaaatcaaatcgcggaagaaagaaatgaaccttttcttcaaacatacggcgggaaaatttcttccgagtggctcgttccaaaagtgatgcaaatcgcggaagaagcgcctgacatttatgatgccgcagccgagatcatggaagcggccgactggatcgtctatatgctgtgcggaaccagaaagcgcaacaattgcacagcgggttataaagcgatttggaacaataagagcggctatccttccgacgatttcttcgcaagcctgcatccgaagctgaaaaatatcgttcgggaaaaactaacggaggatatttattctgtaggcgaaaaagcgggcggactgactgaagaaatggccgggaaaacagggcttctggcaggtacggcggtcgctgtcgcaaatgttgatgctcatgtgtcggttccggcggtcggcatcacagagccgggcaagatgctgatgatcatgggaacgtctacctgtcatatgctgctcggcgaggatgtcaggatggtgccgggaatgtgcggcgtcgttgaagacgggattctgccgggctatgtcggctatgaagcgggccaatcgtgcgttggcgaccattttcattggctgattcaacactttgttccagaagcgtatttgaaagaagctgaagccgaagggatttccatttacgaactgctgtctcaaaaggccggcagtctccaaatcggtgaaagcggtttgcttgcattggattggtggaacggaaaccgttcaacactcgttgatgccgatctgacgggaatgctgctcggtatgacccttgccactaagcctgaagagatataccgtgcattggttgaagcgactgcctacgggacgaggatcattattgaaacgttcagacaaagcggcgtgccgatcgaggagctgtatgccgcaggaggaatcgccgaaaaaaatccgtttatcatgcaggtttacgcggatgtcaccaacatggaaatcaaaatttccggatctccgcaggcgccggctttaggttcagcgatattcggagcgctcgcggccggaagcatgaacggcggttacgaccatatcgaagaagcagtcgcacatatgggcaagatcaaggataaaacgtacaaaccaattcctgaaaacgtttccttatacgatcagctttatgcggaatataaggagctttacacgtacttcggaaagcaaaacaatgtgatgaaacgccttaaaaaattgaaaaacatccagtcccttagttctg

SEQ ID NO: 12 - DNA, 1406 bp, Bacillus licheniformis
atggcaatgaagatcggaacgcagaaatttaaagagcgcgtgtcagacgggctcgacaacgagtttatgaggggggccgtttcaagcgcgcaggagcgcttgagagcgcgccgtcttgaggcggcaaaagagctcgggaactgggaagaatggcggtctctggccgaagaaatcaggcagcacgtgctggaaaatctggattactatctagaacagcttgccgaaaatgtcgccaaaaaaggcgggcacgttttctttgcgcagacggctgaagaagcgacaggctacatccgcgatgtcgtgaaaaagaaaaacggcaaaaaaatcgtcaaatcaaaatcaatggtgaccgaagaaatcaacatgaacgaggcacttgaaagcgacggctgcgaagtggtcgaaaccgatttgggcgaatacatcctccaaatcgatgatcatgatccgccgtcacatatcgtcgcacctgctttgcataaaaacaaagagcaaatccgcgacgtcttcaaagagcggatcggctaccgcaacaccgaaaagccggaagagcttgtcatgcacgcgcgcgccgtgcttagaaagaaatttctcgaagctgatatcggcattacgggctgcaattttgcaattgccgatacgggatctgtcagccttgtcacaaacgagggaaacggacgtctcgtcacgactattccgaagacgcagattaccgtgatggggatggagcggatcgtcccatcattcgacgagtttgaagttctcgtcggcatgctcacaagaagcgcggtcggacagcggctgacgagctatatcacggcgctgacagggccgaggctgcccggtgaagcggacggcccggaggagtttcacctcgtcatcgttgacaacgggcgttccaacattctcggaacggagtttcagtccgtccttcaatgcatccgctgtgcggcctgcatcaatgtctgccccgtttaccgtcatgtcggcgggcattcttacggttcgatctattcaggtccgatcggggctgtattgtcgccgctgctcggcggatatgacgattataaagaactgccgtacgcatcttcgttatgtgcggcttgctctgaagcatgtccggtgaaaatcccgcttcatgagctgcttctaaagcacaggcagcgcatcgttgaaaaagaagggcgcgcgccgatatccgaaaagctggcgatgaaagcgttcggcttgggaacttctgcgccatccctttacaaaatgggctccaaatgggcgccggcagccatgaagccgtttaaagaagacggcaagattacgaagggaccgggtccgttaaaacagtggacccagatacgcgacttccccgcgccgaacaagtcaaggttccgcgactggtttgaggacag

SEQ ID NO: 13 - DNA, 1422 bp, Bacillus licheniformis
atgaaaaaaggacgcgttagccaggtattagggccggtcgtagatgttcgttttgaagacggtcacttgcctgaaatatataatgcgattaaagttacacataaagcgcagaacgagaatgaagtggacatcgatcttacccttgaagtagcgcttcacttgggtgatgattcagttcgtacaattgcaatggcttcaactgacggtgttacacgcggaatggaagccatcgacctgggagagccgatctccgttccggtcggaaacgtaacactcggccgcgtatttaatgtactcggggaaaatatcgatttggatgagccgcttccggctgatgctgccaaagatccgattcacagagaagctccaaaatttgatcagctatcaacagaggttgaaatcttagagacgggtattaaagtcgtcgacttgctcgctccatatatcaaaggcggaaagatcggtcttttcggaggagcgggagttggaaaaaccgttttgattcaggagctgatcaacaacatcgctcaagagcacggcggtatctctgtattcgcaggtgtcggcgagcgtacgcgtgaaggaaacgacctttactatgaaatgaaagattccggcgttatcggcaaaacggcaatggtcttcggtcagatgaacgagccgcctggtgcgcggatgcgcgttgccttgaccggacttacaatggccgagcatttccgtgataaagaaggccaggacgtattgttctttatcgataacatcttccgattcactcaagcaggatctgaagtatctgcacttcttggacgcatgccgtcagcggttggttatcagccgacgcttgcgaccgaaatgggtcagcttcaggaacggatcacatcaacaaatgtcggatctgtaacatcgattcaggcgatctacgttcctgccgatgactatactgacccggcgccggctacgacgttcgctcacttggatgcgacgacgaaccttgagcgtaagctgtcggaaatggggatttatcctgcggtcgatccgcttgcatccacttcccgtgcgctttcgcctgaaatcgtcggagaagagcactatgaagtggcgcgcagcgttcagcagatcctgcagcgctacaaagagcttcaggatatcatcgcgatgctcggaatggatgagttgtcagacgaagataagcttgtcgtcagccgtgcgcgccgcgtacaattcttcctgtcgcaaaacttccacgtagctgaacagtttacaggacaaaaaggttcttacgtacctgtcaaagaaacggtaaaaggcttcaaagaaatccttgaaggtaagtatgatcaccttcctgaggacgctttccgccttgtcggccgaatcgaagaagttgtcgaaaaagcgaaagaaatgggtgtagaagtataa

SEQ ID NO: 14 - DNA, 1848 bp, Bacillus licheniformis
gtacgcttaagaaaaagcaaggttttggggctgtattatgggactatttaacgactgtcgatcataaaaagattgccatcctttatttgctgggcggcgggttcttctttgtgctcggcggaatcgaagcgatgctgatcagggttcagctgatgataccgaacaatgacatcatgagcggcggggtctacaatgaaatcatgacgatgcacggcacaacgatgattttcctggcggcgatgccgctgttgttcgcattgatgaacgccgtcgttccgctgcagataggcgcgcgggatgtcgcgtttccattcttgaactcgctcggcttctggctgtttcttttcggcggcatctttctgaatttaagctggtttttgggaggggcacccgatgccggctggacgtcttatgcgtcgctttcccttcattccgaagggcacgggatcgatttctatgttctcggtctgcaaattgccgggatcggtacgctgattgccgggattaactttctcgcgacgatcatcaacatgagggcgccgggcatgacatacatgaggctgccgcttttcacatggacgacattcgtcgcttcggctttgattttgttcgcgtttccgccgctgaccgtaggcattgcgctcttgatgctggaccggttgttcggaacgagctttttcaatccggaattaggcggaaatacgatcatttgggagcatctgttctggattttcggacaccctgaagtttatattctcgtactcccggcgttcggcattttttcggaaatcattccggtttttgcgagaaaaaggctgttcggctattcttcaatggtatttgcaaccgtattgatcggctttttaggcttcatggtttgggctcaccatatgtttacaacgggactcgggcctgtggcaaacgccatttttgcggtggcgacgatggccattgccgtcccgactggtattaaaatcttcaactggctgctcacggcgtggggcgggagcatcaagtttacaacgccgatgctttacgcgatatcctttatcccgacgtttgttatgggcggggtgacaggcgtcatgcttgctgccgcaccggctgactatcagttccatgacacgtactttgtcgtggcccacttccattacgtcatcatcggcggagtggtgttcgccatcctcgccggagctcattactggtggccgaaaatgttcgggaaaatgctgagcgaagcgttgggcaaaataacgtttgtactctttttcatcgggttccacctgacgttcttcatccagcattggctcggattgtggggaatgccgagacgcgtgttcacatacttgccgaatcagggatttgacatggcgaacctgatcagttcaatcggagctgtgtttatggcggctgcggtcatcatactcgtgatcaatattatcgtgacgactgccaaaggggaaaaagtcggcagcgatccttggcatgacggaagaacgcttgagtgggccgtttcttcgccgcctcctgaatacaacttcaaacagctgcctttggtcagaggccttgatgctttatggatcgaaaaaagagccggcaagcagtcaatgaccgccgcggagccgcttcaggacatccatatgccaaacggatcgattcttccgttcatcatgtcactcgggctgtttatatccgccttcggctttatgtaccggacggaatttgcctgggggctgcctgtcattctgatcgggttagggatcacgttatttatgatgcttctccggtctgtaattgatgaccacgggtaccatattcataaagaagatctgatggatgatgacgaca

SEQ ID NO: 15 - DNA, 1334 bp, Bacillus licheniformis
gtgagcatcaaagctgaagaaattagcactctcataaaacagcaaattgaaaactatcagtctgaaatagaagttcacgacgtaggtacggtaattcaggtcggtgacggtatcgcacgcgtacacggccttgataactgtatggcaggtgagcttgtcgaattttcaaacggtgtgctgggcttagctcagaaccttgaagaatcaaatgtaggtatcgttattttgggaccttacaaagacatccgtgaaggtgacgaagttaaaagaaccggccggatcatggaagtccctgtcggcgaagagctgctcggccgcgttgtcaacccgctcggccagcctgttgacggaatgggcccggttctcacaagcaaaacccgtccgatcgaaagcccggctcctggagttatggatcgtaaatccgtacacgagccgcttcaaacggggatcaaatcaatcgatgctttaattccgatcggccgcggccagcgtgagctgattatcggtgaccgtcaaacgggtaaaacgtcgattgcgatcgatacaattctgaatcagaaagaccaggatatgatttgtatctatgtcgcgatcggtcagaaagaatcgacagtccgcggcgttgtcgaaacgcttcgcaaacacggcgcccttgactatacgatcgttgtgacggcttccgcttcacagcctgcccctctattgtacctcgcgccgtatgcaggggttgcgatgggagaggaattcatgtacaacggcaagcacgtgctggttgtgtatgacgacctttcaaaacaggctaccgcatatcgtgaactgtccttgcttcttcgccgtcctcctggtcgtgaagcattccctggggatgtattctatcttcactcccgtttgcttgaacgcgctgcaaaattgagcgacgccaaaggcggaggatctttaacggcacttccgttcgttgaaacgcaagcaggcgacatttcggcgtacattccgacaaacgtcatttcgatcactgacggacaaatcttcctgcagtctgatttgttcttctctggcgtgcgtcctgcggtcaacccgggattgtctgtatcccgtgtcggcgggtccgcgcaaatcaaagcgatgaagaaagttgccggtacgctgcgccttgatttggcatcataccgtgagcttgaagcattcgcacaattcggctcagatttggataaagcgacacaggcgaagctgaatcgcggtgcccgtacggttgaagtacttaaacaggatctgcacaaaccgcttcgcgttgaaaagcaggttgcgattctctatgctctgacagaggcttcctt

SEQ ID NO: 16 - DNA, 1864 bp, Bacillus licheniformis
atggaagatagacaaaatcaagatttcaaagtaaagattcaacgtttcggaagctatttgagcggaatgatcatgccgaatatcggtgcatttatcgcatgggggatcattaccgcattgtttattccgacgggatggatgccgaatgaagcgcttgcttcattggttgatccaatgatcaaatttttgctgccgctcttgattggatacacgggcggtaagatggtgtacgatcaccgcggaggcgtcgtcggtgcgactgcagcgatcggcgttatcgtcggcgcggacattccgatgttcctcggcgcgatgatcatggggccgctgggcggctacctgatgaaactgacggacaggcttttcaaagataaggtccgttccggatttgaaatgctgatcaacaactttacagccggaattctcggcttcattctggcggtgctcggctttcttgcaatcggtccggtggtgctcggcttaaacaaaacattggcggccggcgtggaagtgatcgtcaatgcgaatctgcttccgctcgcaagtatttttgtagagcctgcgaaagttcttttccttaacaatgcgatcaaccacggtattttgagcccgattggtattgagcaggccgcccagacaggaaaatcaattttattccttttagaggcgaacccaggccctggtctcgggattcttttagcttacatgattttcggaagaggcacatcaaagcagaccgctccgggcgctgcagtgatccatttcctaggcggtattcacgaaatttatttcccttacattctgatgaaaccgctgttaatcctggctgcaatagcgggcggagcgagcggtgtgctgacgttttccatctttaatgcggggcttgcggctgttccttcacctggaagtattattgcggtgctggcgatgacgccgaaaggcaaccacatcggcgtgatccttggtgttctcgtcgcagcagtcgtttcattcattgtagcttctttgattttgaaaacgtctaaagccggcgaagaagatttgacggccgcggcggaaaaaatgcagcaaatgaaaggcaagaagagccaggccgtttctgcattgacttcggctgacgaagcggaagaatcagcggctccgtacgaaaatgtcagcaagatcatcttcgcgtgtgatgccggaatgggctccagtgcgatgggggcatcaattttgaaaaacaaagtcaaaaaagcagaactcgatatcgacgtatccaatacatcgatcaataatctgccggaagatgccgatatcgtcatcacgcataaagacttaacggaacgcgcaaaagcgaagcttccaagcgccagacacatatcggtggaaaacttccttaacagtccaaaatacgacgaactgatcaatcagcttaaaaagtaaagtttgagaacccgtgagcctgaaaatcaggctcacacaacatgtatgaaagagagtgatttcccaatgaaaccagtacttgcaaaagaaaacattcatctcaatcaatctgccgcaacgcaggaagaagcgatcagactggccggaaaggcgctggttgacgccggctatgttaccgcggattatatcgagaaaatgttggagagggaaggcctcacttccacttacatggggaacgcaatcgccattccgcatggtacggaagacagcaagcaggatgttcttcattccggaatatccgttatccagcttccggaaggtgtcgaatacggcgatggcaatattgctaaagtgatctttggcattgccggaaaaaatgatgagcatttggagattttgtcaaagattgcgattgtctgctcagaagcggacaatgtcg

SEQ ID NO: 17 - DNA, 1632 bp, Bacillus licheniformis
atgatgaaaatgtggcagcagatatacgatccgtttggaaatctgtttatcagcgcttttgccgccatactgccgattcttttctttcttcttgcactgaccgtgttgaagatgaaaggaatcattgcgtcatttttgacgctggcggtcagctttattgtagcggtgttcttctttcacatgccggctgcgaaagctgtctccgccgttttacttggaattgctaacggcctttggccgatcggatatattgtcctgatggctgtatggctttacaaaatttctgtcaaaaccggaaagtttaaagtgatcagagcgagcattgccggaatttcgtccgaccagcggcttcagctattgctgatcgggttcagttttaacgcctttttggaaggtgcggcaggcttcggtgtgccgattgcgatcagcgccgttcttcttgtcgagcttggttttaaacctttgaaagcggcatccctatgtttaatagcgaatgcggcatccggagcctttggagccatcggaattccggttatcacaggagcgcagatgggaggcttaacaccggttgagctttccagaacgctcgctttgatgctgccggtcatcgctttctttgtcccgttcctgctcgttttcatattggacgggtttaaaggaataagggaaacgctgccggctcttctcgtattaagcggaagctatacggcggtgcagactttaacaatgattagtttggggccggagcttgccgacattttggccgctttaatcagcatgggagcgctggcgctgtttttgaaaaagtggcagccgcgccacatatacagggaaaccgggaatgaacatgtgcccgctgaaaaatatcgtgcagcagacattatgaacgcttggtcaccgttttatattttgaccgccgtcattgcggtgtggagcctgcccggttttaaggggctttttcaggaaggcggattcctgaagcaaacgacaattttattcaacatgccttttcttcaccgggaagtgctgaaaacgccgccgatatctccggaacaggcaccgcttgatgctgtgatgaagcttgacttcatttcagcgacgggtacggcgatcctgatcgcggtgatcatcacgattgtgatgagccgaaacatcagtttccgcggaggactttccagtctgaaagagacggtcaaggaactgtggcttcccgttctcaccatttgctttgtgatgggttttgcaaacttggccaattatgccggattgagttcaaccatcggactggcgctcgccaaagcgggggatatctttccgttcgtcagtcccgtattgggctggatcggtgtctttatcacaggttcagtcgtcagcaacaacgcattattcggccacctgcaagcagtcaccggagcgcaaatcgggacaagttcggctttgctgcttgccgcaaataccgcgggaggcgtgatggccaagctgatctcaccgcagtcgattgcgattgcaacagccgcggttaaagagacagggcaggaatcaaagcttttcagccaaaccgttaaatacagcctggttctgcttttcatcatttgcatttggacgtttgcgctatcaaagcttggcatataa

SEQ ID NO: 18 - DNA, 1385 bp, Bacillus licheniformis
gtggactacagaattgaaaaagatacgatgggtgaagtcaaggttcccgcggataagttttggggagcccaaacccaaagaagcaaggagaactttaaaatcggttccgagaaaatgccgcaggaaattgtgtatgcgtttgcaatcttgaaaagaagcgctgcgattgccaatgaaaagcttggaaatcttgaggcggaaaaaaaggaagcgattgtttccgtatgcgatgatattttagaaggaaagtatgacagccattttccgctggtcgtctggcagaccggcagcggaacacagagcaacatgaatatgaatgaagttgtggcaaacaggggaacggcttatttgcaggaaaaaggatcaagcctgaaaatccacccgaatgatgatgtcaaccgcagccaaagctctaacgacacattcccgacagctatgcacgtggcagctgtcctcgcgattcacgataaactgattccggcgattgaccggttgagaagcacgctgcatgaaaaagctgaagctttcaaagacattgtcaaaatcggccgcactcatttgcaggatgcgacaccgctgacattgggacaggaaatcagcggctgggtatacatgctggaccgctctaaagagatgattcttgaagctgctgaaaaaatccgcgatcttgccatcggcggaactgccgtcggaacaggcattaatgcccaccctgaattcggcagcaccgttgccgaagagatcagcgctctgaccgggcagacattcaaaagctcgcctaataagtttcatgcgctgacaagccatgatgaactgacacacgtgcatggggcgcttaaagcgcttgcggcagatctcatgaaaatcgccaatgatgtcagatggcttgcgagcggacctcgctgcggaatcggcgagctgcttatcccggaaaatgagccgggaagctcgatcatgcctggaaaagtaaaccctacgcaaagcgaagcgctgacaatggtcgcatcccagatcatggggaatgacgcaacgatcggctttgccgcgagccaggggaactttgaactgaacgtctttaaacctgtgattatttacaacttcctccaatccgttcagcttcttgccgacggcatgaattcattccatgacaagtgtgctgtaggaatcgaacctaatcgggaaacaattgagaagaacctgaccaactctctcatgctggttacggctctaaacccgcatatcggatacgaaaatgctgcgaaaatcgcgaagctggctcataaagaggggctgacgctgaaagaagcggctctcaagctgaaccttttgacagaggagcagttcgacgaagttgttaaacctgaagaaatggtgaaaccgaaagc

SEQ ID NO: 19 - DNA, 1416 bp, Bacillus licheniformis
tagccgaggtcggcaaagagcgggcgatcgtctatgaaaacgggccgcacgttacaacgccgaaatggatgctgcttccgatgcataagggagggactttcggcaaattcagcacttcaatcggactgagggtgtacgactttttggcaggcgtcaaaaaagctgagcggaggagcatgctgactgccgaagaaacgcttcaaaaagagccgctcgtgaaaaagaacggcctgaagggcggcggctattatgtcgaataccggacggatgatgccagattgacgatcgaagtcatgaaagaagccgttaaattcggagccgaggccgtcaattatgcaaaagtaagcgattttatatatgaaaacggcaaggtcaccggcgtggtcattgaagacgtcttcacgaaaaaaacgtaccgcgtctacgcgaaaaaaattgtcaatgccgcggggccgtgggtcgaccgtctgcgggaaaaagaccattcaaaagaaggcaaacaccttcagcatacaaaaggcgtgcatcttgtttttgatcaatcggtctttcctttaaaacaagccgtttattttgatacgcctgacggccgcatggtgttcgccattccgagagacggaaaggcatatgtcggcacaacagacaccgtctacaacgagaatttggaacaccctcgaatgacgacagcagacagggattatgtcatcaatgcaatcaactatatgttccctgaacttggaatcaaagccgaagatgtcgaatcaagctgggctggcctcagaccgctgattcatgaagaaggaaaagacccgtccgagatttcccgaaaagatgagatctggacttctgaatccggactgatcacgatcgccggcggaaagctgacaggctacagaaaaatggctgagcatatcgtcgatcttgtcagagaccgattaaaagaagagggcgacagagacttcgggccttgcagaacaaaaacgatgccgatttcaggcggccatatcggcggctccaaaaatctggaggcttttattcaagcgaaagcagccgaagggattgaggccggactgtccgaagagacggccaaacaaatcgccgcacgatacggttcgaacgcacaccgcctgtttgatcgtattccatcgctgaaagatgaagcagcaaaacgccgcatccctgtccatgtactaacagaaatggattacgggatcgaggaagaaatggcagccgtcccggcagacttcttcgtccgcagaaccggtgcgctgttctttgacatcaattgggtccgcacttacaaagagagccttacggactacatgagcgagaagctgaactgggatggcgaaacgaaggcccggcatgtcaaggcattggaaggactactacacgatgctgttgtcccgctggaaa

SEQ ID NO: 20 - DNA, 1959 bp, Bacillus licheniformis
agacgccttctctgggtgtcacgcaagccctaatgacccacccgaacgtttccctgatcctcgcaacaggaggcgcaggcatggtgaaatccgcttacagctccggaaaaccggcccttggcgtcggacctggaaacgttccgtgctacatcgagaagtctgccaacctgaagcaagccgtcaatgatctgatcttatccaaaacatttgacaacggcatgatttgcgcatcagagcaggccgtcatcatagacaaaggcatctactcagacgtcaaagccgaaatgacaagaaacaactgctatttcttaaataaaaccgaaaaatcaaaggtcgaaaaattggtcatcaatgaaaatacttgcgcggtaaacgctgatatcgtcggcatgccggcattcaaaattgctgaaatggccggtatcaaagtgccgcaagatacaaaaatcctcatcgccgaattagaaggtgtaggtccggatgacccgctgtccagagaaaaactgagccctgttttagcgtgctacaaagtcagcgggcttgaagaaggattaaaacgcgccgaagagatgctggcgttcgggggaaccggccactcggcggtgattcatacgaacgatcaagaagccgttaaagaattcggcttaaggatgaaggccggccggatcattgtcaatgcaccgtcgtcacaaggagcgatcggcgacatttacaacgcctatatgccttctttaacgctcggctgcggcacatatggcgggaactccgtctcgtcaaacgtaggggccgttcatttaatcaacacgaaaaaagtggcgaaaaggaatgtcaatatgcagtggtttaaagtgcctccaaaaatctattttgaaaaacacgcaacccaatatttagcgaaaatgcctgacatctcaaaagcgtttattgtgactgatccgggaatggtgaaactcggatatgtagaccgcgcccttcactacttaagaaggcgcccggattacgttcattgcgaaattttttctgatgtcgagcctgatccttcaatcgaaacggtgatgaacggcgtcgacatgatggccaaattccagccggatgtcatcatcgccctcggcggaggttcggcaatggatgccgcaaaaggaatgtggatgttctacgagcaccctgatgctgaattctttggcttaaagcaaaaatttctggacatccgcaagcgcatcgtcaaatacccgaaactgggaggaaaagcaaaattcgtcgcaatcccgacgacatcaggcacaggttctgaagtcacttcattctctgtcattacagacaaagaaacgaatacaaagtacccgctggccgattatgaattaacaccggatgtcgcgatcattgacccgcaatttgtcatgaccgtgccgaaacatatcacggccgacacaggaatggacgtattgacacacgcaattgaatcatacgtatcgtgcatggccaacgactatactgacggcttggccatgaaggccatccagctgatcttcgaatatctgccaagagcatacaaaaacggcagcgacgagctggcccgcgaaaaagtgcataatgcatcaacgattgccggaatggcattttccaatgccttcctcggcatcaaccacagcttagcccataagcttggcgccgagtttcagatcgctcatggacgggcaaacgccatccttctgccgcacgtgatccgctataatgcagcgaagccgaaaaagttcacggcatttcctaaatacagccacttcatagccgaccagcgctacgcggagattgccagaacgctcggcctgcctgcaaaaacaactgcagaaggtgttgaaagcctcatccaggagatcatctcgcttgccaaagagcttaaaattccgatgagcattaaacaaaacggcgtggatgccgccgcattcgaaagcaaagtagatc

SEQ ID NO: 21 - DNA, 1294 bp, Bacillus licheniformis
gtgttagcaattttaggttttttcatgatgcttgtgtttatggtattgatcatgacaaaacggctttctgttctgacggcattagtcttgacaccgatagtgtttgcgctgatcgccggattcggattcagcgatgtcggcgacatgatgatttcggggattcagcaagtcgcgccaaccgccgttatgattatgtttgcaattttatatttcgggattatgattgatactggcctgtttgacccaatggtcacaaaaatattaaaaatggtcaaaggcgatccgttaaaaatcgtcgtcggcactgcggtgctcacgatgctggtcgcattggacggagacggatcaacaacatatatgattacaacgagcgcgatgctcccgctctatttgctgcttggcatccgcccgattatattagcgggaatcgcaggagtcggcatggggattatgaatacgattccatggggaggcgcaacaccgcgggcagcgagtgcgctcggggttgacccggctgaattgaccggcccgatgatacctgtcatcgtaagcggcatgctttgtatgatcggagttgcgtatatgctcggaaaagcggagcgaaaacgcctcggcgtgattgaactcaaacatccggctggtgccaatgaaacggccgccgctgcggaggatgagtggaagcgtccgaagctttggtggttcaacttattgttgacgctttcattgatagggcttctcatatcaggaaaagtaagcttgaccgttctgtttattatcgcgttctgcatcgcattgattgtcaattatccaaacctcgatcatcagagacagcgaatttcggcgcattcgagcaatgtattggctatcggttcaatgatatttgccgcaggggtctttaccggaatactaacaggcacaaaaatggtagatgaaatggcgatttcgcttgcgtctatgattcctgaacaaatgggcggctttattccgatgatagtagccttaacaagcggcattttcacttttctgatgccgaatgacgcttatttttacggagtgctcccgattttatcagaaaccgctgtcgcatacggtgttaataaggtcgaaattgcaagagcctccatcatcggccagccgattcacatgctgagcccgcttgtgccttcaacacatttgcttgttgggcttgtcggggtttccatcgacgatcatcaaaaatttgcgataatgtgggcggtgctcgctgtcatcgtgatgacaggatgcgcgcttctcatcggatccatatcaattt

SEQ ID NO: 22 - DNA, 1269 bp, Bacillus licheniformis
ttgtggcacaaggcgaaaaaattacagtctccggcggagtattaaacgttccaaacaacccggtcatcccgtttattgaaggggacggaacaggtcctgatatttggagagcggcttccagggttcttgaagcggctgtggagaaagcgtataacggcgaaaagaaaatcacttggaaagaagtctacgccggggaaaaagcgtacaacaaaaccggcgaatggcttccggaagaaacgcttgatacgatccgcgaatacctgatcgcgattaaaggtcctttaacaactcctgtaggcgggggaatccgctcattaaacgtagcgctcagacaagagcttgacttgtttacatgcctgcgtcctgtccgctatttcacaggcgttccttcaccggttaagcgccctgaagatacggacatggtcatcttccgtgagaatactgaagatatctacgccggcatcgagtacgcgaaaggctctgaagaagtgcaaaagctgatttcattcctgaaaaacgagcttggcgttaacaaaatccgcttccctgaaacatcgggcatcggcatcaagccggtttctgaagaaggaacatcaaggcttgtcagagctgcgatcgagtatgcgatcgagcacggccgcaaatctgtgacgctcgtccataaaggaaacatcatgaaattcacggaaggcgcctttaaaaactggggctatgaagtggctgaaaaagaattcggcgataaagtattcacttgggccgaatacgaccgcatcgctgaaaaagacggcaaagacgctgcaaacaaagcgcaaagcgaagctgaagctgccggcaaaatcatcatcaaagacagcatcgccgacatcttcctgcagcagattctgacacgtcctgccgagtttgacgttgtggcgacaatgaacctgaacggggactacatttcagatgcgctggctgcccaagtcggcggaatcggcatcgcacctggagcaaacatcaactatgagacaggacatgccatctttgaggcgacacatggtacagcgcctaaatacgccggcctcgacaaagtaaacccgtcttcagtcatcctatccggcgtgctgcttcttgagcatttgggctggaatgaggcggccgaccttgtcattaaatcaatggagaaaacaatcgcatccaaagtcgtcacatacgatttcgctcgtttgatggacggcgcgactgaagtcaaatgctctgaattcggtgatgagcttatcaaaaacatgt

SEQ ID NO: 23 - DNA, 1518 bp, Bacillus licheniformis
agaagcgaagcaaaaacagggcgtacatcatcgtcattgatccccgcgaaacggcaacggccaagatcgccgacctgcatttgaaaatcaagccgggaacagacgccgcgctcgcaaacggaatgctgaaaatcatcattgaagaacagctgacagacggagcttttatcagagatagagctgaagggtttgaagaggtcaagcgccatgtagcatctttatcgcttgaagacatttcggccaaaaccgggatacaaatcgagcagatcaaaaaagccgcggtaaaattcgcccgcgaggagacgggaatgctgttcacggcaagaggggttgaacagcagactgacggaacggctgctgtaagaaatttactgaatattctaatatcaacggggaaaatcggcaaatatgcttgcggctacggcgccgtcaccgggcaaggaaacgggcagggggcgcgggagcacgggcagaaagcagaccagctgccaggttaccgttcgattgaaaatgaagccgaccgcgcctatattgcggatgtttggggcataaaagctgaagatcttccgggaaaaggcgtatccgcttatgaaatgatgaagaaagttcatgaaggcgaaattacaggaatgtttttaatgtgttcaaaccctgttgtatccagcccgaccgccggctttgtcaaatccgctttgggtaaattaaagttttttgccgccgttgatttgtttctttctgaaacggcaatactcgcggatgtcgttctcccagcatcatcctatctcgaggacgaaggaacgatgaccaatctggaaggcagagtgacattaagggaagcctcaaagccgtgtcccggtgaagcgaggcatgactggcaaattatttgcgatatcgctaaagcgcttggaaaaggccgctatttttcatatcgatcggcagaggatgtttttaatgaattgagaaaagcgagccgcggcggaattgccgactattcgggcatcacctatgaacgtctgagaaaggaaggcggcattttatggccctgtccagaagaggggcaccctggaacacagcgcctgtttgaatcatccttctcccacccggacaaaaaagcaagaatgtgcgtcgtcccgaacgaaccaaaggtcaaaaaagatgtaccgactgaggagtatccccttattctgacgaccggaagggtgatgtctcactatttaaccggggtacagacgagaaggagcgctgcgctcaaggcgagacactttgaatcatttatggaaatccatccgaaaacggcggaaaagtacaatattggcgaccgggtgctggtcagggtggaatcaaaaagaggcagcatcatcgtcaggagcaaatggtcggaagccatcaggccggataccgtttttgtaccgatacattgggcggattcgcaaaatgtgaacgatttgatagcggaaacgctcgatccgtcctgcagcatgccgggatttaaggtttgctccgtgaaaattcgtccgt

SEQ ID NO: 24 - DNA, 1395 bp, Bacillus licheniformis
atgaccagcatgctagaagtatataatcctgcgactggagaaaaaatcaaatcggttccccagcaatccgcaaaggaagtcgaagaagctgtcgtacgctcgcatgaggcatttcaaaaatggtcgaaaacatcggctgcagaacgagcgggcttgctgaaaaaatggtttgatttaattgtggagcagaaggacgagctggcaaaattgattacgcttgaaaacggcaagccgtacgctgaagcgcagggcgaagtcttatatagcgcaggctatatcgaatggtatgcggaggaagcgaagcgcatctacggaagaacggttcccgcctctgtgacgaacaagcgcatcatcgtcacacgccagggagtcggacctgttgcggcgattaccccgtggaattttccggcggcgatgatcacgagaaaagcggggccggctttggcggcgggctgtacctttatcatcaagccggcgcctgatacgcctttaacggcgcttgagctcgtccgtctcgggcacgaagcgggcattccgaaagacgtccttcaatgtgtgatcggcgacggacaagagatcggctctatttttacaagccatccgctgatccgcaagattacgttcaccgggtcaacacctgtcggcaaacatttaatgaaaaacagcgccgagacggtgaagcatgtgtcaatggagctcggcggccatgccccgctgatcgttgatgaagatgccaacattgacctcgccgttaagcagacgatgctttcgaaatacaggaatgccggacaaacgtgcgtctgtgcaaaccgtctgatcgttcatgaatcggttaaggatgaatttgcagaaaaactccgcgcggaagttgccaagctgaaagtcgggaacggactcgaagaaggtgtatcaatcgggccgatcatcaataaaaacggcttccaaaaaatcgtcgatcaaatcaatgacgcggtgaataaaggggcgaaagttctcatcggcgccgaatatgaaagcgatgatgagaaatcatgctactttgtccatccgacagtgctgacggatgttgatccttcaatgacgatcatgcatgaggaaacattcggccccgttgcgccgattacgtcttttaaaacgctggacgaagcggtcaagctcgccaatgatacgccttacggtttagcggcatacttctttacggaaaactaccgccgcggcatctatttatccgaaaaccttgattacggcattctcggctggaatgacggcggaccgtcaaccgttcaggcgcctttcggcggcatgaaggaaagcggtatcggacgcgaaagcggactggaaggcatcgagccgtatttggaaacaaaatatttgtccatcggtttggatgaataa

SEQ ID NO: 25 - DNA, 1411 bp, Bacillus licheniformis
atgatttcctcacaagtgagatccaagctgattgagattgtcggctctgccaattatgacgattcgaacgccggacggctcgtctattcctatgatgcgacaccacagtttcaatcgatgcctgacgcggtcattgccccgcgcagcaaggaagaagtatcgcgaatcgtgaaaatctgcaacacgcaccgcattccgattgtgccgagaggttcaggtacaaacctatgtgccggcacatgcccgactgaaggggggattgtcctcctgtttaagcatatgaatcaaattttagaaatcgatgaagaaaatttaacgataaccgtccagcccggtgtgatcacacttgacttaattcacgccgctgaagaaaaaggattattttatccgcccgatccgagctcaatgaagatctcgacaatcggcgggaatattaacgaaaactcaggcggcctccgcggcttgaaatacggagtgacccgcgattatgtcatggcgctggaaatcgttcttgcaaacggggacatcatccgcaccggcggcaagctggccaaagatgttgccggctatgatttgacgcgtctgttcgtcggttctgaaggaacgctcggcgtcatcactgaagcaacattaaaactcatcccggcacccgaaacaaaaaaaaccgtcctcgctctctatcaagatatcgactctgcagcacaaactgtttcaaatatcattgcacataaaatcattccgacgacactcgaatttctcgaccaacctacgattcaggtgatcgaagacttcgcgaaaatcggccttcccgtccatgccaaagcggttctcctgatcgaacaggacggcaccgaagatgcagttcgccgtgatatcgccgtgattgaagagatttgcaaaaaaggaaatgctgtgtccgttcaaactgcgcaaacagaagctgaagcggaaaatcttcgggaggcccgccgcaccgccctttcggctttagcgcggttaaagccgacgaccattctggaggatgctacggtaccgcgttctgaaattgctgaaatggtaaaagcgattaattcgatcgccgaaaagcaccaaatatcgatttgtacattcgggcacgcaggcgacggcaaccttcatccgacctgtacgacagatgtcagaaacagtgaagaaatgaaacgggtcgaacaggcttttgaagacatctttaaaaaagcggttgaactgggaggaacaattaccggagaacatggggtcggcgaaatgaaagccccctatttggaactgaagctgggcaatgcgggaatcgccgccatgaaggcggtaaaacaggcattggatccaaacaacatcatgaatcccgggaagatatttgcgaaagactcccgcaagcgagtggtggtgacaagat

SEQ ID NO: 26 - DNA, 1249 bp, Bacillus licheniformis
ttgaaaaaatttatcgcttatcaaattttgatcgcactcgccattggagcagttatcggacatttcttccctgatttcggaatggcgctgcgccccgtcggagacggatttatccgtctgattaaaatgatcgtcgttccaatcgttttttctacaattgtcatcggagcggccggaagcggaagcatgaaaaaaatgggcagcctcggcatcaagacgattatttggtttgaagtgattacgacgttcgtgctcggactcgggctgcttttggctaatgtgttaaagcccggcgtcggccttgacctttcccatttggccaaaaaggatatcgacgaactctcgggctacacggaaaaagtggtcgatattaaacaaatgatcctcgatatcattcctaccaacatcgttgacgtcatggccagaaatgatttgctcgccgtgatcttctttgcgatattgttcggcgttgcagctgccgggatcggcaaagcctcggaacctgtcatgaagttttttgaatctgttgccaacatcatgttcaagctgacgcagatggtgatggtcacagcgcctatcggcgtgcttgctcttatggccgcatccgtcgggcaatacggcatcgagctcctgcttcctatgttaaaattagtcggcactgtttttctcggactgtttctcgttctttttgttttatttccgatcgtcggtcttgtttttaaaattaaatacttcgaagtcctgaaaatgatttgggatttgtttctgatcgcgttctccacgacgagcacagaaacagtcttgccgcagctgatggaccgcatggagaaatacggctgcccaaaacgggtcgtttccttcgtggttccttcaggcttatctctgaattgcgacggctccagcctatatttatcggtcgcctgtatctttttggcgcaggctttcaatatagacatgagcatttcccagcaattgctcatgatgctcgtgctagtgatgacaagcaaagggatcgccgccgtgccatctggctcgctcgtcgtccttctggctaccgccaacgcagtcggccttcccgctgaaggagtcgcgattatcgcgggagtggaccgcgtgatggacatggcgcgaacaggcgtgaacgtgccgggtcatgctgtcgcctgcatcgttgtttctaaatgggaaaaaagcttccggtataataagcgctttgtgcttgaaaaacaataccggacggaaagcttat

SEQ ID NO: 27 - DNA, 1488 bp, Bacillus licheniformis
atgagttcattaacgatgcaggtcagtaagaagctggagtcatttttgcagggaacaaagaagctctatattaacggggaatttgtagccagcgcctcaaacaaaacgtttgagaccccaaacccggcgactggtgaaacgctcgccacgttatatgaagagggtcccgaggatgtggacaaagctgtaaaagctgcgcgggaagcctttgaccgcggtgagtggcggacgatgaaccctgccgaaagaagccggctgatgtacaaactcgccgatctgatggaggaacataaaacggaactggctcagcttgaaacgctggataacggaaagccgatcagcgaaacgaccgcaggcgatattccgctgtcaattgaacatatgcgctattatgcgggctgggcgacgaaaataaccggacagacaattcctgttaacggaccttattttaactatacacggcatgagcctgtcggagttgtcgggcaaattatcccttggaacttcccgcttctgatggctatgtggaaaatgggagccgcccttgcagccggatgtacggttgtcttaaaacaggctgaacaaacgccgctttccgctctgtatttagctgagctgatcgatgaggcaggcttcccgaaaggcgtcatcaacatcatccctggctttggggagacggccggagaagctctgaccgaccatgcccttgtcgacaaactggcattcacagggtcaactgaaatcggcaaaaagataatggagaaagcggccaaatcggtcaaacgtgttacccttgagctcggcggaaagtcgccgaatatcatcctccctgacgccgacctgaagaaagcgattccaggcgcactaaccggcgttatgttcaaccagggccaagtttgctgtgcgggatcgcgcgttttcatccataaagaccaatatgacaaagtcgttgatgaaatggccgcttattcaaaatcgctccgccaaggtgcgggccttcatgaagacacgcaaatgggaccgcttgtcagcaaagaacagcatgaacgcgtcctctcgtatattgaaaaaggacgccaggagggtgcgaaaatcgcggccggcggaacatgcccttatgaacagggatactttgtttctccgactgtattcacaaatgtcgaggatgagatgacaatagcaaaagaagaaatcttcggtcctgttttggcggcgattccttatgaaacggttgatgaagtcatcgaacgggccaatcgcagcgaatacggcctcgctgcgggcgtatggacggaaaatttgaaaaacgcccactatatcgccgaccgtctgcaagccggtaccgtttgggtcaactgctataatgcttttgacgccgcatccccattcggcggctacaaacagtctggactcggacgtgaaatgggctcatacgctctggataactatacagaggttaagagcgtctggattcatacaggcgaataa

SEQ ID NO: 28 - DNA, 1164 bp, Bacillus licheniformis
atggataactttacatattggaatcccacaaagctgatattcggccggggagaagttgaaaagctggcagaagaggtgaaacaatacggccgcaatgtcctgctcgtatacggcggaggcagcattaagcgaaacggtttatacgatcaagtcatttcaatccttgaaaaggcgggcgcgaccgtccatgaactgcccggcgtcgaaccgaatccgcgtgttgccactgtgaataaaggagttgcgatctgcaaagagaacgatattgactttcttttggcagtcggcggcggaagcgtcattgattgtacgaaagcaattgctgccggagcgaaatacgacggcgatgcgtgggatattgtgacgaaaaaacatattccggctgatgcgctgccgtttggaacagttttaacgttagcagcaacaggctctgaaatgaactcgggatctgtgatcacaaattgggaaaccaatgaaaaatacggctggggaagcccgctcgtattccctaaattttcaattcttgatccggtcaacacgtttaccgtcccgaaagaccacacgatttacggcattgtcgacatgatgtcccacgtgtttgagcaatattttcaccataccgaaaataccccttatcaggaccggatgtgcgaatccctgcttaaaacggtaattgaaacagctcctaagctcattgaagacctagaaaactatgagctgcgtgaaacgattctgtatacaggcaccattgcgctgaacggcatgctatcaatgggcgcacgcggagactgggcaacgcacaatatcgagcacgctgtttcagccgtatacgatattccgcatgcgggagggcttgcgattctgttcccgaattggatgaagcacacgctttccgagaacgtcggccgctttaaacagcttgccgtccgtgtttttgacgtagatgaaacaggaaaaaccgatcgcgaagtggcgcttgttggaatcgagaaactgtctgaattctggaccagccttggcgcgccaaatcgtcttgccgattatgacattacagatgagaagcttgatctcattgccgacaaagcgatggcaaacggcgaattcggccgctttaaaacgctgaataaagacgatgttctgtctattttgaaggcttctttataa

SEQ ID NO: 29 - DNA, 1179 bp, Bacillus licheniformis
atgtcaaaacatatcgtcattttaggcgctggttacggcggattactgtctgctctaacagttcgcaaacactacacaaaagaagaagcaaaagtcacagtggttaaccaatatccgacacatcaaatcatcacggaattgcaccgccttgctgcgggcaacgtgtcagaacaggcagttgcgatgccgcttgcaaagcttttcaaaggaaaagacatcgatcttaaaatcgccaaagtcaactctttctcagttgacaaaaaagaagtcgctctttctgacggctctaccctgacatatgacgcacttgtcgtcggtcttggttctgtcactgcttacttcggcattccgggacttgaagaaaacagcatggtgctcaaatctgcaaacgatgcaaacaaaatcttcaagcatgttgaagagcgcgtgcgcgaatacgcgaaaacgaaaaacgaagctgatgctacgatcttaatcggcggcggcggactaacaggcgtcgagcttgtcggtgaactcgccgatatcatgccgagccttgcgagaagctacggtgtcgatccgacagaaatcaagctgaagcttgttgaagccggtccgaaaatcctgccggttcttccggatgagctgatcgaacgtgcgacaaagagccttgaaaaacgcggcgttgaattcttgacaggactgcctgtcacaaatgtagaaggaaacgttgttgatttgaaagacggacaaaaaattgttacaaatacatttgtctggaccggcggtgttcaaggcaatccgctgatcggcgaatcaggtcttgaagtcaaccgcggacgcgcaactgtaaacgacttccttcaatctacatcacatgaagacgtgtttgttgcaggggacagcgccgttgtcttcggtccggatggccgtccgtaccctccgacagctcaaatcgcatggcaaatgggcgagctgatcggctacaacctgtatgcatacttagaaaacaaatcaatggcgacgttcagccctgtcaactcaggtacgcttgcaagcctgggccgcaaagacgcagttgccgttatcggcgcgaacagcacatctcttaaaggcctgcctgcttcattgatgaaagaagcgagcaacgtccgctacctgagccacataaaaggtctgttcagcctggcttattaa

SEQ ID NO: 30 - DNA, 1293 bp, Bacillus licheniformis
agaaaataaaaatattttccataagctgatcaactggaaaatcggcgtgattccgtttccgctatatattgcgcttgcgctgattgtttttctggcagcttactttaatgaattgccgaatgacatgctcggcggtttcgcggtcattatgattctcggcatttttctcggggatgtcggacagcgcattccgattttaaaagatatcggcggacctgccattctatcgctgtttgttccttcgttcttagtctttttcaaagtgcttaaccctgcatctatggaagcggttacaactttgatgaaaacgtcaaatttcttgtatttctacatcgcatgtttagtcgcgggaagtattttaggaatgcatcgcacggttctgattcaaggttttatgagaatgttcgttccgttgttggccgggacgatcgcagcggttgccgccggtattctcgtcggtctgttatttggctacagcccttatgaagctttcttctttattattgtaccgattattgccggaggcatcggcgaaggcatcctgccgctgtcactcgcctactcgcaaattttgggacagtccaccgatgtatttgtttcacagctcattccggccgctattatcggaaacgtcgttgccatcatctcagccggactgatgaaaaagcttggggaaaagcgtcctgaactgaacggtaacggcagactcgttaaatcgaaaaaagacgatgaaattttcaaccaaaaagaagaggagccgaaaatcgacttgaaattaatgggtgccggcgttttaatcgcatgttccttcttcattttcggcggtttggtctccaagttcatcgcgattccgggagcgatcctgatgatcatcgcagcggctgccgtaaaatatgcaaagcttctgcctgcaagcatggaaaaaggcgctcaccagctttacaagttcatgtcatcaagcttcacttggccgctgatggtcgggctcggcattctttatatccctcttgatgatgtggcgtctgttatttccctgcgcttcatcgccgtctgcgcttcagtcgtcattgccatggtgacatcaggctactttgtcggaaaattaatgaacatgtaccctgttgaatcagcgatcgtcacaggctgtcacagcggtctcggcggcacgggggacgtggccattctttcggcttcaggccggatgggtctgatgccgtttgcgcaaatctcaacgcgtctcggcggggcatccaccgtcattatggcgaccgttttactgaggttcttcacctc

SEQ ID NO: 31 - DNA, 1307 bp, Bacillus licheniformis
atgaatggcaacaatattattcggaatttgatgctggaaatcccttcagcacccggaaaccttggaaaggtgacaacggcgatcggccttgccggcggtgatatcggagagattgaaacgatcaaggtagggccgaattatacgatgcggaacattacggttcaagttgagcatgaagaacagctcaccgagattcttgaagtgatccgcaacttaaaagaaggcatccatcttcataccgtttcagatgacgtgctggctgcacatgaaggcggcaaaatccgcatgaaaagcaagatgccgattcgctcgcttgctgatctgcgtcgggtgtatacgccgggtgtcgcgaacgtgtgcgagctcattaaagaagagccgcaaaaagcgaatatttataccggaatcggcaattcggttgcaattgtaacggacggcacggccatccttggcttgggagacatagggccagttgctggaatgcctgttatggaagggaaagccgctcttttcgaccagcttgcggatatcagcggggttccgattctgctcgacacgaatgatcctgatgaaatcgtaaggacggttaaaaacatcgcgcccggctttagcggcattttgcttgaagacatcggttcaccgcattgttttgaaattgaagagcgcctgaaaaacgacctgaatattccggtcatgcatgacgaccagcacggtacggcggttgtgacgctggcggccgccatttcagcagccaagagtgcaggggtggatctgaagcaggcccatgtcggccaaatcggcctgggcgcggcgggtgtcgcgatctgcaggatgtttatggcatatggagtaaaacgtgttgtcggaacggataaatcgcttgaggcgatggcgcgtttagagaactatggcggccatgcggctgaaagcatcgaagaattgatggaaagctgcgatatcgtcgttgcgacaaccggtgttccgggattgatcaataagaaatgggttcgggaaggccaggtgattttggctctgtccaatccgaagccggagattgagcctgaggatgcgctcgaggccggggcagcctacgctgcagacggacggtctgtcaacaatgtgctggggttcccaggtattttcaggggcgtgttaaatgccggagccgattcgatcagccacccgatgctggttgcggccgctgaagcgatcgcatcctgcacaagacaaggcgatcttgtgcctcatccgctgaaccctgaagttcacgagattgtggccaaagcagtcgaaagggtcgcactttc

SEQ ID NO: 32 - DNA, 1464 bp, Bacillus licheniformis
tgagtcaaacacttttcattgacggaaagtgggtgggcgccaaaaaaggcgagactcgccaaattatcaatccttacaatcaagagcatattgaaaccgtcagtgaaggagacagagaagacgctgttagggcgattgctgcagcgcgccgcgcatttgacgacggcgagtgggcgaatacgccgggtcttgaacgaggcaacatcgtattaaagatcgccgaactgatcagacgcgaccacgaagagctggcagaacttgaatcgcttgataccggcaagacgattgaagaaagcagagccgatatggatgatattgcaaacgtatttcaatattatgcagggcttgcggataaagacggcggagaagtcatttcttcaccgatccccgattctaaaagcaaaattgtcagggagccggtcggtgtctgcgggcagatcacaccgtggaactatccgctcctgcaggcaagctggaaaatcgctccggctttggcggcgggcaacacgatcgttgtcaaaccaagtgaaatcacaccgctgacaaccattaagatcttcaagctgatggaagaagccggtgtgcctgaaggggtggccaaccttgttctcggccccggggcgactgtcggcgatgaacttgccagaaataaagacgtcgacttaatttccttcaccggcggaattgaaaccggaaagaaaatcatgcaggctgcaagtacgaatgtgaaaaaaattgcgcttgagcttggcgggaaaaatccgaatattgtgtttaaagacgcagattttgacgtagcggttgaccaggcgctgaatgcggtatttttccacgcaggacaggtttgctctgcgggcgctcgtcttctcgttgaagagtccattcaagatgagtttgtcgcagagcttgtcaagcgtgcgaaaaaaatcaagcttggcaacggatttcacgaggagacacagagcggtccgcttatttcagctgaacaccgcagcaaagttgaaaaatatgtggaaatcggcttgcaagaaggcgccaagctggaaacaggcggaaaacgtccggaggaccctgaacttgcaaatggcttcttctatctgccgacaatcttctcgagctgtacatcagatatgagaatcgttaaggaagaagtattcggtccggtattaacagttgaaacatttaaaacagaagaagaggttgtctcacttgcgaacgatacgatttacggccttgccggcgccgtttggtcaaaagacatcgaaaaagcggagcgcgtcgcttccaaactgcgcatgggaaccgtctggatcaatgacttccacccttatttcgcacaagcgccttggggaggttacaagcagtcaggcatcggccgcgagcttggccgcatgggccttgaagaatacacagaagtgaagcatgtctaccgcaatacgaaaccggcggctgtcaattggttta

SEQ ID NO: 33 - DNA, 1143 bp, Bacillus licheniformis
cctgattgccgtcggcgctcttatcggcacatggatagccggcggtgttgtgccgactttgatttattacgggcttgagtttatccacccgagcatattcctgcttgccacgctcattatttgttcgatcacatctgttgccacaggtacgtcttgggggactgtaggaacggccgggatcgccatgatggcaatcggggaagggctggggcttccgcttccgcttgtagccggagccgtgctgtccggagcctactttggagataaattatcgccgctttccgatagtacggtgcttgcgtcatccctttcaaaggtcgaagtgattacccatgtcagagcgatgctgtacttgtcgattcccgcctatttaatcacggcggtcctgttcaccatcaccggctttatgtatggaagccgaaatgttgatttggaaaaagttgaatttttgaaagcttctttgcagaacacgtttgatattcacatttggatgcttgttccggctgttgtcgtcatcgttctattggcgatgagaaagccatctgtgccgacgatcgcgatcggcgcacttttgggcgcgatctgggctgcggtcttccaaggcatggactttgcggatgcgatcggcacagcatacaacggcttttccattgacaccgggatcaaatttatggacgagctcttaaatcgcggaggaatagagggcatgctcggttcggtcgtcgtcatcattctcggtctgggctttggcggcctcttggagcacttaggcgttctaaaagtgatcgtctccaagttccagcaaaagctgacttctgccggcaacgtcacattctcgacgattatcgtcgccttcttggcaaatgtgttcggctgcgcgatgtatgtctcgctcattttaacaccgaaaattatggaaaaaagctatgacaagctcggaattgaccggagggtgctgtccagaaacgcggaagtcggcggtacgatgacgtcgggcatggtgccgtggtcggacaacggcatatatatggcggggattctcggcgtctcgaccttctcttatgtgccgttcatgtggctgagctttgtttcaatcggccttgcgattttgtacggatacacaggtaaatttatttggtacac

SEQ ID NO: 34 - DNA, 1281 bp, Bacillus licheniformis
atggcggaaattaaagtacctgaattagcggaatcaatttcagaaggaacgatagcccaatggctgaaacaaccgggagattatgtagagcaaggggaattcctgcttgagctggagactgataaagtcaacgtggaattgacggcagagcagtccggcgttcttcaggaagtgctgaaagattccggtgacacggttcaggtcggcgaaataatcggaacgatttcagaaggcgaaggagaaggaggcaaatcaacggctccgcaagctgacgctcaagaaagcgccggcgcttcggaagagaaagcagcctcgtctgaaaagacagccgaacctcgcgaaggtgcgagcgatgaggcggatacagccaaaacaagaactatcgcttctccggctgcccgaaagctcgcccgggaaaaaggcatcgatttatcggaaatccctaccggtgatccgctcggaagggtcagaaaacaggatgttgaatcttatcaaaagaacgagcagccgccaaaagctcagcctgaaccaaaacgcgcaacacaggcgccggccgctaaacaaaccgaagatgctggtaaacctgtagagcgtcaaagaatgtcccgccggagacagacgatcgccaaacgcctcgttgaagttcagcacaccgccgctatgctgacgacattcaacgaagtggacatgacggcggtcatgaacttaaggaagcgccgaaaagatcaattcctggagcagcatgacgtgaagctcggattcatgtcattctttacaaaagctgttgtcgccgcgctgaaaaaatatccgctcctcaacgcggaaattcaaggcgacgagcttgtgatcaaaaaattctatgacatcggaatcgctgttgctgcgccggatggcctcgtcgtaccggtcgtgcgcgatgcggaccgcaaaacctttgccgatattgaaagggatatcggagagcttgcgaagaaagcgagaaacaacaaattgtcgctcaacgagcttcaaggcgggtcctttacgatcacaaacggaggaacgttcggttcattgttatcgactccgattttgaacagcccgcaagttggtattttgggcatgcacaaaatccagctgcgtcctgtagcaattgatgaagagcgctttgaaaaccgcccgatgatgtacattgcattatcgtatgaccaccggatcgtcgacggaaaagaagcggtcggcttcctggttacgattaaaaatctgcttgaagatcctgaacagcttctgttggaaggttaa

SEQ ID NO: 35 - DNA, 1218 bp, Bacillus licheniformis
cagtcggtgttgtcaccgggatttcacaagaatttcagttcggaatgaactggtcggagtactcccgctttgtcggtgatgtattcggcgctccgctcgcggtgaaagcgctgctcgctttctttatggaatcgacgtttatcggtttgtggatcttcggctgggaccgccttccgaagaagattcatttgctgtccatttggcttgtttcgcttggcacgatcatgtcggcgttttggattctagcggccaactcgtttatgcaggagcctgtcggatttgcgatcaaaaacggacgcgcggaaatgaccgatttttttgcgattattaaaaacccgcagctatgggttgaatttccgcacgtcattttcggtgcgcttgccactggggcgtttttcattgccggtgtcagcgcgtataaaatgctgaaaaaacaggaattgctcttttttaaaaaatcctttcaaatcgcgatgattgtggcgcttgtttccgggggcggcgttgcgttcagcggacatgagcaggcacagcatctgatgaagagccagccgatgaaaatggctgccagcgaagcgctttgggatgacagcggcgatccggctgcatggacggtgcttgcgaacattgacacggacaagcaggaaaacaaatccgagctcagcatcccgtatgcgctcagctatttggcttataaacaattcagcggcgatgtgcccggaatgaagacactgcaaaagcaatatgaagaaaaatacggagaaggaaattatattccgccggtgaaaacgacattctggagtttcagaatcatggccggatcaggacttttaatgatcgttgccgctttgaccggtctttatctcagcttccgcaaaagactcgaaacaagcaaatggttcttgcggacaatggtggctttgatcgcctttccattcattgcaaatacggcggggtggatcatgactgaaatcggacgccagccgtggacggtgttcggtattttgacaacggcgcagtccgtgtcgccgaacgtatcagcgggaatgctgctgttctctgtcatcgcgtttacagcgatttatcttgtgctggcgctcgttcttgtctacttgtttgtgcgggagattaaaaaaggggctgcacaccatgaccaccatcatgatgattccgtatcgacagacccgtttgatcaggaggtttaccatggtatctctt

SEQ ID NO: 36 - DNA, 1157 bp, Bacillus licheniformis
atgaatatccatgagtaccaagggaaagaagtactcagaaaatacggagtggctgttccggaaggtaaagtggcatttacagcagatgaagcggtcaaagcagcggaagcgctgtccagctcggtttatgtcgtgaaagctcaaattcacgccggcggacgcggtaaagctggcggggttaaaattgcaaaatcaaaagaagaagtcaaagcctatgcggaagaattgttgggaaagacgcttgtcactcaccagacgggtcccgacggccaacaaataaaacgcttacttattgaagaaggctgcgatatcaaaaaagaatactatgtcggcctagttctcgacagggcgacttcacgcatcgtgctgatggcctctgaagaaggcggcacggaaattgaagaagtcgctgaaaaaacaccggaaaaaatcgtcaaagaagtgatcgatccggctgtcggactgcagagctaccaggcgagaaaaatcgccttcgccatcaatattccgaaagagcttgtcggccaggccgttaagtttatgatggggctgtacaaggcgtttactgaaaaagactgttccattgctgaaatcaatccgctcgtcgtcacaggggacggaaaagtcatggcccttgacgccaagctgaactttgacagcaatgcgctatacagacaaaaagacatcttggagtacagagatctcgatgaagaagatccgaaggaaatcgaagcatccaagtatgatttaagctatatttcgctcgatggaaacatcggctgcatggtcaacggagcggggcttgcgatgtcgaccatggacattatcaagcactacggaggggaaccggccaacttccttgacgttggaggcggcgcgacagccgaaaaggtaacggaagcgttcaagatcattttgtctgatcaaaacgtcaaagggatctttgtcaatattttcggcggcatcatgaaatgcgacgtcattgcagaaggcgttgttaagcgacaaaacaagtcggtctgacattgccgcttgtcgttcgcccttgaaggccacccaatgtcgatctcggcaagaagatcctcgatgattcaggactcaatattaccgtctgcggaatcaatggctgacggcgcgcagaaaatcgtatccttagt

SEQ ID NO: 37 - DNA, 1125 bp, Bacillus licheniformis
atgagtatgacagcaacacgcggccttgaaggggtagtcgccactacatcatcagtaagttcaattattgatgatactcttacatatgtagggtataacatcgatgatttgacagaaaaagctagctttgaagaagttgtttatctgctttggcatttaaagctgccgaacaaagaggagcttgccgagcttaaaaaacagctttctgaaaatgccggtatccccaaagaagtcattgaccatttcaaatcctacccgaatggaaaagtccacccgatggcagctcttcggacagccgtttctttactcgggctgtttgacgaagaagcagatcaaatggatgcggaagcaaactacagaaaagcggtgcgtctccaagcgaagatgcctgcgcttgtcgctgctttttcaagaatccgcaaagggcttgagccgattgagccgaatccggaactcggctttgcagccaactttctctacatgctgaatggaaaagaaccttcacctgtcgaagtggaagcgtttgacaaagctttgatccttcatgcggatcatgagctgaacgcatctacgttcacagccagagtatgcgtcgcgacgctttcagacgtttactcagggataacggccgcaatcggagccttgaaaggtccgcttcacggcggagcaaacgaagcagttatgaaaatgctttcagagattggcgaggttgaaaacgtagattcatatattcacgccaagcttgaaaagaaagaaaagatcatggggttcggccaccgcgtataccgccagggcgatccccgcgcaaaacatttgaaggaaatgagcaggcgtttgacgaatttaacgggtgaaagcaaatggtatgagatttcagagcggactgaggaaatcgtcacgtctcagaaaaagctgccgccaaacgtagacttttattctgcgtcggtttatcatagcttaggaatcgaccatgatctgtttacgccgatttttgcgatcagcagggtatcaggctggctcgctcacattcttgaacagtatgaaaataaccgcctgattcgtccgcgggctgactacaccggccctgacatgcagaggttcattccgattgaagaaagaagctga

SEQ ID NO: 38 - DNA, 1246 bp, Bacillus licheniformis
  misc_feature (1)...(1246): n = A,T,C or G
atggtagtagnagatttccctattgaaacagatactcttgtcattggtgcgggacctggcggctatgtagctgccatccgcgctgctcagcttggacaaaaagtaacaatcgtcgaaaaaggcaatcttggaggcgtatgtctgaatgtcggatgtatcccttcaaaagcgcttatcaatgcaggccaccgctatgagaatgcgaagcattctgaagagatggggatcactgctgaaaacgtaaaagttgactttacaaaggttcaagaatggaaagcctctgtcgttaataagcttaccggcggtgttgaaggccttctgaaaggaaacaaagtcgacatcgtaaaaggcgaagcatactttgtagacagcaattctgtacgcgtgatggatgagaactcagctcagacttacacgttcaaaaatgcgatcattgcaacaggttctcgccctatcgaattgccaaacttcaaatatagcgaccgcgtactgaattcaacaggcgcacttgcactgaaagaaattcctaagaagctcgttgtcatcggcggcggctacatcggaacagagctcggtactgcatatgcaaacttcggtactgaagttgtcattcttgaaggcggagaagaaatccttccaggatttgagaagcaaatgagctctcttgtgaaacgcaacctgaagaaaaaaggcaacgttgaaatccatacaaaagcaatggctaaaggcgtagaagaaaaagctgacggcgtaaccgttacgttcgaagtgaaaggcgaagagcaaacgatcgatgcggactacgtacttgtcactgtcggccgcgttgcaaacacggacgagctcggacttgaacaagtcggcgtcgaaatgacggaccgcggcatcatcaaaacggacaaacaatgccgtacaaacattccgaacatctatgcgatcggtgacatcatcgaaggtcctccgcttgcgcataaagcttcttatgaaggtaaaattgctgctgaagcgattgccggagaagctgcggaaatcgactatcttggaattcctgcggtcgtattctctgagcctgaacttgcatctgtaggctacactgaagcacaggctaaagaagaaggtctttcagtgactgcagccaaattcccgtttgcagcaaacggacgtgcgctgtcattaaacgaaactgacggtttccttaaacttgtaacacgcaaagaagacggcttagtcatcggtgcacaaatcg

SEQ ID NO: 39 - DNA, 1431 bp, Bacillus licheniformis
aaaaaatgatgaaccatatcgacggggaatgggtcaattctctaggtgcggaatcggaagaagtcgtcaatcctgcaaacggaaacgtcatcgcttatgcgcctctatctgtgagagcggatgtagatcgtgccgtgcaggctgccaagcacgcttatcagacctggtcgcttgtgcccgtccccaatcgggcaaggcttttatacaagtatttacagcttctccaggagcaaaaagaacaattggcagacattattacgacggaaaacggcaaaacgttaaaagacgcccgcggcgaagtgcagcggggaatcgaagttgttgagcttgcgacagccacacctactttaatgatgggagaatccctgcccgcgatagccgggggcatcgacggatcgatttggcgctatcctttgggagtcgtcgccggcattacgccgtttaactttccaatgatggttcccctgtggatgtttccgctcgccatcgcctgcggaaacacgttcgtcctgaaaccttcggaacggactcctattcttgccgggaagcttgttgagctgttctatgaagccgggtttccaaaaggtgtgttaaacctcgtccatggaggaaaggatgttgtaaacggaatattggagaacgatgatattaaagccgtctccttcgttggttcagaaccggtcgcaaaatatgtgtatcaaacgggcacagccaacgggaaacgcgttcaggcgctggccggcgctaaaaaccatgcgattgttatgccggattgccatcttgaaaagactgttcaaggcatcatcggtgcggcattcggcagcagcggggaacgctgtatggcctgctccgttgcggcggtcgttgatgacatcgccgatgacttcatggaaatgctcgtctctgaaacacggaagctgaagacaggagacggcagatccgaggatcactttgtcggcccgctgatccgcgaagtccataaacaacgcgtccttgactatatcgacagcggtataaaagaaggggccgcactcgccgtagacggacgcaatccggatgttcgagaaggatactttgtgggagccacgattttcgatcatgtgacaccagagatgaaaatctggcaggacgaaatctttgcaccggtcttgagcgtcgtccgtgtacaagatcttgacgaggggatcgagctcgccaatcaatccaagtttgccaacggcgctgtcatctacacatcgagcgggaaaagcgcccagcagttccgcgacaaaatcgatgccggaatgatcggcgtcaatgtcaacgtcccggctccgatggcgttcttctccttcgcagggaacaaagcctctttctatggagatcttgggacaaacggaaaggacggcgtccagttttacacgcgtaaaaaggtcgtcaccgaacgctggt

SEQ ID NO: 40 - DNA, 1208 bp, Bacillus licheniformis
  misc_feature (1)...(1208): n = A,T,C or G
ttgaataagccaanaagtagtagtattaggtgcaggttatggtggattaatgaccgtancgagacttgtaaaaaaatcggcatcaatgaagcgaatattacgcttgtcaacaagcacaattaccattatgagacgacctggatgcacgaggcgagcgcaggtacgcttcatcatgacagatgccgctatcagattaaagacgtcatcaatacatcccgtgtcaatttcgttcaggatacggtaaagaaaatcgataaagaaggaaagaaagtcgtccttgaaacaggagagcttagttacgactatcttgtcgtggcgctcggctccgtccctgaaactttcggaatttcgggattgaaagagcatgctttctctatttcaaacatcaattcgtcccgccagcttcgcgagcacattgaatatcagttcgcgacgtataacacagaagccgagaagcgcccggaacgcctgacgatcgttgtcgggggagctggttttacaggcattgaatttttaggtgaaatggccaaccgcattcctgagctgtgccgcgaatacgatatcgaccgccagcaggttcgtttaatttgcgtggaagccgcgccgtctgttctcccgggctttgaaccggagcttgtcgattatgcggtcaactacctcgaaggaaaaggcgttgaattcaaaatcggcacggccgtgaaagaatgcacgcctgacggaatcatcgtcggaaaagacgatcagaccgaagaaatcaaagcaggcactgtcgtatgggccgcaggcgtccgcggcaacccgatcattgaggaatccggctttgaaaacatgcgcggccgtgtgaaggttaaacctgacctgcgcgttgaaggccatgatgatatatttgttatcggagactgctctttaatcataaatgaagaaaccgaaaggccttatccgccgactgcgcagatttccatgcagcaaggcgaaacgtgcgcaaacaatctggccgcactgattcacggcaaagaaacggaaacgttctcatttgataacaaaggctctgtcgcttctctcggcgaacacgatgcaatcggcgtcgcattcggcagaaagatgacgggaacgacggcgtccatgatgaaaaaaatcatcgacaaccgctcgcttttcatgatcggcgggccgggacttgttctgaaaaaaggcaagtttaaattttt

SEQ ID NO: 41 - DNA, 1125 bp, Bacillus licheniformis
gccgcgttatcccggtcgtactggatgtcggaacgaataatgaaaaactgctaaacgatccgctctatatcggaaaccgtcatccgcgtgtagaaggcgagcgctatgaacaatttatcgacgcttatgtcgaaacagcattgaagcttttccctaacgcgcttctacactgggaagatttcggaaataaaaatgcccgcaatatcatgagtaaatataaccataaaattgcaacatttaatgatgatattcaaggaacaggggctatcacgctggctgcgattttagcagctgtcaaaaagaccggcacgtctttgaaagaccaccgggtcgtcatcttcggacctggttctgctggtataggaatcgctgaccaaatccgcgacaccatggtgcttgaagggctttcagaagaagaagccaaccgtgcattctggacagtcgattacagaggattattaacgacaggcatggatcaaatcatggatttccaagaaccgtatttgcgcgatacggaagaagtgaaagattggaaacgcaatgaaaagggagagatttcctttgaggaagtcatccgtcaagtgaagcctacgatcctgattggtacatcaggtgttgccggcgcctttagtgaagaaatcatcaaagagatggcggctcatactgagcgtcctgtgattctgccgatgtcaaatccgacacatctggccgaagctgttcctgaagacttgttcaaatggacggacggaaaagcgcttgtggcgacgggaagcccgtttgaagctgttgagtacaatggcgtgaaacacgaaatcggacaatccaataacgcttttgtattccctggattaggcctgggtacaatcgttgcgaaagcgaaagtcatcacaaacggcatgtttgctgcatctgccaacgcggtcgcgaacatggtggatcatgaaaagccgggtgcaggtcttctgccgaaaatcgacgacctgcaagacgtatccgttcaagtggcgatcgacgttgtaaaagctgccattaaagacggcgtggcccaagttcagcctgaagatgtcgaaaaggctgtccgcgaagccatgtggcgtccggagtataaaacaattgttgcaaaac

SEQ ID NO: 42 - DNA, 1650 bp, Bacillus licheniformis
cgattttaaggacatcgcgcgccgagggtgtgcggtttaaagacgggacgaagatcagcgccgatctcgtcgtcatggctgccggtgtcagaccgaatatcgaactggccaaggcgagcggtatttcaaccaacagggcgatcatcgtcagcgactatatggagacaaatgttccaaatgtctacgccgtcggtgaatgcgcggagcataacggaacggtctacggcttagtcaagccactgtatgagcaggggaaagtgctggccaaacatatttgcggcctcgaatgttccggttatcagggctccgttcagtccgcggctttaaaaatgtccggaatcgacgtcttttcggcagggaaaatcacagaggacgactcgacgacggctattaaacttttagacgaagcggccggagtctataaaaaagcggtctttcaaggggataaaatggccggcgtcattttatacggagacaccagcggcagccaaaggctgttggaaagcatcatcaaacaaagggatattaccgttgtcaaaaaagagctgtttcaatcggaggaagacagttcagtcgcttctatggcggttcgtgaaacgatctgccaatgcaacgcggtttcaaaaggcatgatcatggaagcgatacagacgcacggtttaaagacggccgaggaggtcaaacgctgtacaaaagcttccgggtcatgcggcggctgcaggccgttggtcgaggaactgctcctccataccgccgaacatgatggtcacatatctgcggcggaacaaccgatgtgcgcctgcacttcattcacggaagatgaagtcgtgaacgaaatacagatgagaaatctttcttccgttcacgaagtcatctcggcgctcggctggaaaaatagcagcggatgccggatttgcgtgcccgcgcttcactactatttaaaaatgatccgtccggacatcgcctatgaggagcacgaagaggagacggatgccatcatcccgcaaatgtacggaggccggacgaatgccgaagagctgaagcgcattgcaggagtgattgaaaaatatcaaattcaagaggtgtacatgacacaccatcagagattaaagcttgccggcatcaagccggagcatatagagcgcgtgaaagaagaactcggcatgccgtattgcctgccgcaacagcagcggatcgccgcggttaaaacgtgcccatgcggatcaccgcagattcaaacattggcagcagacttggaaaaagcagcagaatccctcctcattccggccaaggtctccattggggtgtcgggctgtttggacgattgcgtgtacgcttcagttcatgacatcggacttctcaaagtaaacggaggatgggagatttatgcgggcggccaaggaggacagcatgcttccccgggagagctgctttcagtagccgactcggcggaggaagcgggtgaactcatgaaaggcctgcttcaatattaccgcgaaacagcaaactatcttgagaagatcgggcattggattgaacgcgccggcatcattcatatccgggaagttttatttgacaacggacttcgcggccagctgttcgaacggcttgaaaaagaaaagcggctggctcagcaagaaatgataaaag

SEQ ID NO: 43 - DNA, 1047 bp, Bacillus licheniformis
ggaaaaacgtattctcgtcatcaatccgggatctacatctacaaagatcggcgtttttcatgatgaccgttcgattttcgaaaaatcaatccgtcatgacgaggctgagctacagcaatatcagaccattattgatcaatattcgttcagaaaacaggcgatactcgaaaccctgcatgaacagggaatcaatatttctaaattggatgccgtttgcgccaggggagggctgcttcggccgattgaaggcggcacttacgaagtcaatgatgcgatgattgtcgatttgaaaaacggctatgcggggcagcatgcatcaaatctcgggggcatcatcgccagggagattgccgacgggttaaatattcccgcttttatcgtcgaccccgttgttgtggatgaaatggctcctatcgcaaaaatttccggcaccccggctattgaaaggcgcagcatttttcacgcgctcaaccaaaaagcagttgcaaggaaagcggcttggcagtttgggaagcgttatgaagatatgaaaatgatcatcacccacatgggaggcggcattacgatcggcgtccattgccgcggccgggtgatcgacgtcaacaacggcctccacggggaaggtccgctcagtccagagcgggccggaaccattcctgcgggtgatctgatcgatatgtgcttttccggcgaatatacgaaagacgagctgatgaaaatgcttgtcggcggcggagggcttgccggctatctcggcacgacggatgcggtaaaagttgagaaaatgatcaaggaaggcgatcaaaaagctgcgctcatctatgaagcgatggcttatcaaatcgccaaagaaatcggggcggccagcgccgtcttaaaaggcgaagtcgatgtcattattttgacaggaggactggcatatggaaaatcgtttatttcctcgatcagacaatacatagactggatttcggatgtcgtcgtctttccaggagaaaatgaacttcaagcattggctgaaggtgcatttcgcgtattgaacggcgaaga

SEQ ID NO: 44 - DNA, 1003 bp, Bacillus licheniformis
atgtcagaacagcatttcaaaaatacgaagtattccgtattaaatctgtctcctatcgtacaaggcggaaatgcggaacaatcttttaaacaatctatggatttggcgcagcatgccgaaaaatgggggtaccacaggttctggctggctgagcaccataatatcgaaggtgttgcaagctcggccacctctgttttgatcggctatatcgccggaggtactaagaaaatgcgcatcggctcgggagggattatgctgccgaaccattccccgctcgtcatcgccgaacagttcggaacgcttgaatccctttatcccggcagaatcgatttaggacttggacgcgctccgggcactgatcaattaacagcgcgcgcattaagaagaaacataagcagcggggaggattttcccgagcagcttgaagaactgcggcaatattttaagccgtcgggcaatgtaagaaatcatgtgcgcgccataccgggagaagggcttgatgtgccgatttggcttctcggttcaagcggattcagcgcccggcttgccggggagctcggtttgccgtttgcatttgcggctcatttttcgcccgccaatacgctgcctgccttggaactgtatcggagttcgtttaagcccggcgtcttgaaggagccttatgcgatggtcggggttaccgttatcgcagccgatacggatgcgaaagcgcagcgcctggcaacgtcgcactatcagaagtttttggatcttgtccgcggcgctccgacacagcttaagccgcctgtagatgatatggaacagatttggacgccgcgcgaaaaagcgatggtgaacgagcagctcagctcaacgatcatcggcgggccggacagtgtgaaagaaaagcttgaagagttcatccggacgactcaggcgaacgagatcatgatcaattcagaaacatttgaccatgctgacagacttcgctcgttcgaaatcattgcagatgtatggaaaaacg

SEQ ID NO: 45 - DNA, 989 bp, Bacillus licheniformis
atgggcaataaccgtcatgaagcagtgggattaacagatgaacaagcaatcgacatgtacaaaaccatgcttttagccagaaaactcgatgagcggatgtggctcttaaaccgttcaggcaaaattccttttgtcatctcttgtcaaggacaggaagcagcccaggtcggagcggctttcgctttagaccgggagaacgattatgtgcttccgtattacagagatatgggcgttgtgcttgcttttggaatgacggcaaaagatttaatgctgtcggcgtttgcaaaagccgaggatccgaattcaggaggaaagcagatgccaagccacttcggccaaaagaaaaaccggatcgtcacgggctcttcgccggtgaccacgcaagttccgcatgcggtgggcgtagcgcttgccggaaggcttgacaagaaagacattgcaacttttgtgacgttcggcgaaggctcttcaaaccaaggggacttccatgaaggggcaaactttgccgccgtgcataagcttcccgtcatttttatgtgtgaaaacaataaatacgcgatctcggttccttatgaaaagcaggtagcttgcgaaaacatttccgaccgcgccgtcggttacggcatgcctggcgtgaccgttgacggaaatgatccgcttgaagtctacaaagctgttaaagaagcaagggaacgggccggaagaggcgaagggccgacattaatcgaaacgatatcataccggctgaccccgcactccagcgatgatgacgaccgaagctacagagagcgcgaagaggtggcggaggcgaagaaaaatgatccgcttaacaaattcgcacaatacttaaaagaagcaggtcttctggacgaccagtctgagaagcaaatatcggatgagatcacaaaaatcgtcaatgaagcaacagattatgctgaacatgcaccttatgcagatccggaagatgcgctgcggcatgtttatgcgga

SEQ ID NO: 46 - DNA, 1240 bp, Bacillus licheniformis
gtggcatttgaatttaaacttccggatatcggggaaggaatccacgaaggcgaaatcgtgaaatggttcgtcaagccaaacgacgaggtaaacgaagatgacgttttggcagaggtacaaaacgataaagcagttgtagaaattccttcacctgttaaaggaaaagtattagaattaaaagttgaagagggaacagtcgcaaccgttgggcagacgatcatcacatttgatgcaccaggttacgaagatcttcaattcaaaggcgacgaatcaggcgaagcgaaagcggaagaagctgaaaaacaagaaactgatgcacctgcagaagcagcggaagcaaacgagcaagcggatgcagatccgaataagcgcgtcattgcaatgccatctgttcgcaagtatgcccgcgaaaaaggcgttgatatcgtgaatgtttcaggttccggcaaaaacggccgcgttctgaaagaagatatcgacagcttcttaaacggaggaactgccggagacgctaaggctgctcaagctgaagagaaagcagaacctgctgcacagcaacctgcagctgcggttcaagtgcctgaaggcgaattccctgaaactcgcgagaaaatgagcggaatccgcaaagccattgcaaaagctatggtcaactcaaaacataccgctccacacgttacattaatggacgaagtcgatgtgacaaaccttgtcgctcaccgcaagcagtttaaacaagttgcggctgatcaaggaattaagctgacttacctgccttacgtggtaaaagctttgacatcagctctgaaaaaatatccagtcctgaatacatcaattgacgacaatacagatgaagtgattcagaagcactactacaacatcggtattgcggcagacactgaaaaaggcctgcttgtgccggttgttaaaaatgcggaccgcaaagcgatttttgagatttcaaacgaaatcaacgagcttgcgacaaaagcacgcgaaggcaaacttgctcctgctgaaatgaaaggcgcttcttgcacaattacgaatatcggctctgccggcggtcaatggttcacaccggttatcaaccatccggaagttgcgatccttggaatcggccgcatcgctgagaaagctgtcgttcgtgacggcgaaatcgtcgctgcacctgttctggctctttctctaagctttgaccaccgtatgatcgacggcgcaactgcacaaaacgcgttaa

SEQ ID NO: 47 - DNA, 936 bp, Bacillus licheniformis
atgaaaaaagttaaagttggcaaatcagacttgcacgtatttccgattggtttgggaaccaatgctgtcggaggacataacctttatccgaatctcaatgaagaaacgggaaaagaattggtgcgggaagcaataagaaacggcgtcacttttttagataccgcctacatatacggcatcggccgttccgaggaattaatcggcgaagtccttaaagaattcaaccgcgaagatgtcgtgattgcaacaaaagccgcccataagaaagaaggagacgattttgtctttgacaactctcccgcatttttgaaaaagtccgtcgaagaaagcctgaagcggctgcaaactgactacatcgaccttttctatatccattttcctgatgaaaatacgccgaaagacgaagcggttcaggcgctccatgaactgaagcaggaaggcaaaatcagagcaatcggtgtatccaacttttctcttgagcagctgaaagaagcgaacaaagacggattggtggatgtgctccaaggcgaatacaacctgctgaacagggaagctgagacgacattcttcccgtatacacaggagcataacatctcatttgttccttacttcccgctcgtctccggattgctcgccggaaaatacagcgaagatacaacgttcccggaaggcgacctgagaagagaaatggaaaacttccaaggcgaacgcttcaaagaaaacattagaaaagtgaaccagcttgcgccgatcgcggaaaaacataatgtcgacatcgcccatatcgtcttggcctggtacttggcgcggcctgaaatcgacgtgttgatcccgggcgccaaacgcgctgatcagctgatcgacaacctcaaaacggcagaagtcaatctgtctcaagaggacattgatttcatcgaccggctgtttgcccgctaa

SEQ ID NO: 48 - DNA, 893 bp, Bacillus licheniformis
atgccagttatgtcatatatagatgctgtcactttggctttgaaagaagaaatggaaaaggatccccgcgtctttgttttaggggaggatgtcggcaaaaaaggcggtgtattcaaggcgacagccggtctttacgaccagttcggcgaagagcgggtgatggacacgcctttggcggaatccgcaattgccggcgtcggaatcggggccgccatgtacgggatgagaccagtcgctgaaatgcagtttgctgattttattatgccggctgtcaaccagattatttcggaagcggcaaaaatccgctaccgctccaacaatgactggaactgtccgatcgtcatccgcgcaccttacggcggaggcgtgcacggcgcgctgtaccattcacagtcggttgaagccgtgtttgccaatcagcccggcctgaaaatcgtcatgccttcgacgccttatgatgtcaaagggcttttgaaagcggccatccgcgatgacgaccctgtgctgttcttcgaacataaacgggcataccggctgatcaagggcgaagtgccgagtgacgactatgtgctgccgatcggaaaggcggacgtgaagcgggaaggcgaagacattaccgtcatcacatacggattgtgcgtccatttcgcccttcaggctgccgaacggcttgccaaagacgggatttccgcacatatccttgatttaagaacggtatatccgctcgatcaggaagcgattattgaagcggcttccaaaacgggcaaagtgcttttgatgaccgaagatacgaaggaaggcagcattatgagtgaagtggccgcgatcatttcagagcattgcctgttcgatttggatgcgccgattaagcggttggcgggccctgatgtccc

SEQ ID NO: 49 - DNA, 900 bp, Bacillus licheniformis
aggggcaaggggagaaagccgaaaacggcgaccttctcttcggtacgatcgattcttggctgatctggaaaatgtccggcggaaaagcgcatgtgacagattattcaaacgcctcaagaacattgatgttcaacatctatgacctaaaatgggatgatgaacttctcgatattctcggcgtgccgaaatcgatgcttccggaagtcaagccttcatcgcatgtatacgctgaaacggtcgattatcatttcttcggcaaaaacattccgattgcaggtgcagccggcgaccagcaggcagcattgttcgggcaggcttgctttgaagaaggaatggttaagaacacgtatggaacaggctgctttatgctgatgaacaccggcgagaaagcgattaaatcagagcacggcctgctgacgacaatcgcttggggcatcgacggaaaggtggaatatgcgctggaaggcagcgtcttcgtcgcgggttccgctattcaatggctgcgtgatgggctgagaatgtttaaagacgccaaagaaagtgaaaaatacgctgtaagagcagaatctgccgatggtgtttatgtggtccctgcatttgtaggtttaggcacgccttattgggacagcgatgtccgcggcgctgtattcggactgacccggggtacgacgaaagagcattttatcagagcaacgcttgaagcgcttgcctatcaaacgaaagacgtgctggacgcaatgaaggaagactccgggatcccggttaaaacgctgagagtcgacggcggagctgtcaaaaacaacttcctgatggattttcagggcgacattttagatgtccctgtagaacgtcctgaaatcaatgaaacaacagcgcttgggttcagccttttaacgggcc

SEQ ID NO: 50 - DNA, 1068 bp, Bacillus licheniformis
atgttaaagaaatggcgtctgatgtcgctgttcactattttggcgcttgttttagcagggtgcggagaaccgtttatatcaacgctgcagccggcgggcgaggtggctgatcagcagtatttcctaatgattctcagcacgctgatcatggttgttgttgtagtagtggtaagtttcattttcgtatttgtcatcgtcaagtacagaagatctaagctcggtgatgaccacatcccgaaacaggttgaaggaaaccgcaatttagaaattttatggactgttattccgattatcctccttcttatcctggttgttcctgttgtcgcacagacctttgatcttgctgatacgaaaccgatggataagaaaaacagggatccggagaagacgctcgtcgtcaacgtgcgggcgaacctttactggtgggaattcgaatatcctgactacggcgtgattacgagccaggagctggtcgtgccgaccgatgaacgcatttacttcaagctgaaagcttccgatgtcaaacattcattctggattccttctgtcgggggcaaggttgatacgaacacagacaatgaaaacaagttctacttaacgattgattcaaaacgggcggaaaaagccggagactatttctacgggaaatgcgccgagctctgcggaccttcccacgctttaatggactttaaagttaaagcggtttcgaaggatgagttcaagaaatggatgagcgatatggaaaacaataaagcggaagcgaaaaccgatctcgctgttgaaggagaaaaggtgttcaaagagaaaaactgcctgagctgtcatgcgaccgattcaaaagaccaaagggcggaagcggccagaacggctccgaacctcgcgacttttggagacaggtcgacgatcgccggcgtgaaggaattcaacgatgaaaacttgaaagcgtggctcaaggatcctgaaagcataaaaccgggcaacaaaatgaccggcacataccctgatttgagcgacaaggaacttgatgcactgactgaatatttaaaggggttaaaaaccgaagactaa

SEQ ID NO: 51 - DNA, 906 bp, Bacillus licheniformis
atgagtgtatttattaataaagacacaaaagtcattgttcaggggataacgggttcaaccgctttgtttcacacaaagcagatgcttgaatacggaacgaaaattgtcggcggagtcacaccgggcaaaggcggaacagaggtcgaaggggtgcctgtgttcaatacggtcgaagaggctgtaaagcagaccggggcaaatgcgtctgtcatttacgttcctgcggcttttgcggccgatgcgattatggaagcgacagatgctgagcttgatcttgtcatctgcattactgagcatattccggtgcttgatatggtaaaagtcaaaaggtatatggaaggcaagaaaacgagactcatcggtccgaactgcccgggagtcattacgcctgaggaatgcaaaatcgggatcatgcccggatatatccataaaaaaggccatgtcggcgttgtgtcgcgttcaggaacccttacatatgaagcggttcatcagctttccgaagcaggagtcggccagtcgacagcagtgggcatcggcggagaccccgtcaacggcacaaacttcatcgatgtgctgaaggcttttaatgaagatcctgatacacatgcggtgatcatgatcggcgaaatcggcggaacagctgaagaggaagcggctgaatgggtgaaagccaacatgaccaaacctgtcgtcggtttcatcggaggaaagacagcgcctccgggcaagcgcatggggcatgcgggcgccatcatttccggaggaaaaggcacggcggacgaaaagatcaaaacgatgaatgcctgcggaatcgaagtggctgaaacgccttctgtcatgggagaaacattgattaaagtgctgaaggaaaaaggtctttacgaaacgtgtaaaacacacggatga

SEQ ID NO: 52 - DNA, 1008 bp, Bacillus licheniformis
tcgaaaactattcacaccatggagtttaaaaggagttacactaaaaaaccggattgtcatgtcgccgatgtgcatgtattcctcccatgaaaaggatggaaaagtgcagcctttccacatgacccactacatctcccgcgccgtcggacaagtcggactaatcatggtagaagctaccgccgtcactccgcagggaagaatctctgaccaggatctgggcatatgggatgacgcgcatattgacggacttgctgcattgacgtcacaaatcaagacgtacggcagcaaaacggcgattcagttggcgcacgccggaagaaaagccgaggtcgaaggtacaatctacggaccttcagcgattcctttcgacgaaaattcgcgaacgcctgttgaaatgacaaaagaggacataaaagaaaccgttcaggctttcaaaaaaggagctgaacgcgcgaaatccgccggctttgacatcatcgagattcatggagcccacggatacttgatcaacgaatttttatcaccgctttccaacaaacgcgaggatgaatacggaggttcaccggaaaaccgctacaggctgcttcgcgaagtcatcgacgctgtaaaagaagtctgggccggaccattattcgtacgcgtttcagcttcagactacaaaacaaaaggccttgatgtcgccgattatgtcggtttcgccaaatggatgaaggaacagggcgttgatttgatcgatgtcagctccggtgctgttgtgcctgctgatatcaacgtcttcccaggctaccaagtcggcttcgccgatacaattcgcgctcaagccgagattcagacaggagctgtcggattgatcactagtggccttcaagctgaggaaatcctccaaaatggacgcgctgatctcattttcgttgcacgggagctgctgagagatccatactggccgaaaaccgctgccaaacagttgaacacaaaaattgaagggcctgttcagtacgacagagcctg

SEQ ID NO: 53 - DNA, 1011 bp, Bacillus licheniformis
caccaactgaattacagaaaactcaaacttctttatttgttcaactccggccatggtagtcggaagcattttaggaatgaaaagagaaacgctggtcagggcgttcattaaaatttttattcctctgattgcagggaccattgctgcagcggcagtcggtctggcggtcggtacaatgctcggcctcggatttcagcatacgctgctgtacattgtaattccgatcatggccggaggggttggcgagggagctattccgctgtccatcggctattcggaaatcatgcacatgtcacaaggggaagcttttgcacttgtcattccttccataatgttcggaagcttaagcgccgtcattttgtccggaattttaaatgtaatcgggaagaaaaagcctgaattgacaggcaacggaaaagttgaccgttttgatagcggggacgcacagccgctcgaaagccgcgacaaagacaaagaaagcctttttaatctttcccactttgcgtcaggaggcattctcgccgtctcattatatttggtcggtatgctttcacatgacttgttcggatttccagcacccgtcatgatgcttctgctggctgttgccctgaaactgtttcgtctggctccggcgaatttggaaaacggcgcctacggcgtgtcgcgcttcttttcaactgctgtgacatatccgctgctttttgccattggcgtctccatgacaccgtgggacaagctgatcgcagcttttaatatcgccaatattattacgatcgtatccgtcgtggtcacgatgatagccgtcggcttttttgcagggaagtggctgaatatgtacccgatcgaaaccgcgatcatcaatgcttgccattccggccagggaggcaccggcgacatcgcaattctcagcgccgcagagcgcctcgagcttatgccgtttgcccaggtttccacaagaatcggcggagcgataaccgttacgctgaccctcgtgctgctagccccgtttta

SEQ ID NO: 54 - DNA, 993 bp, Bacillus licheniformis
ttcgttctttttatctgtaaaatcagttgcgccccgcgcttggcgccgggaacggcgttgttttaaagccgcatgatgaaacaccgatttgcggcggcacgctgattgcaaagatttttgaagaagccggtcttccgaagggactgctgaatgtcgtggtcacagatatcggggaaatcggcgacagcttcgttgagcatccgattccgcgaatcatctcgtttaccggttcaacgaaggtcggcagctatatcgggcagctggcgatcaaacatttcaaaaaaccgctgcttgaactcggcggaaacagcgccttgatcgttctcgaggatgccgatttggaatacgccgtcaatgccgcgactttcagccgcttcacacatcaagggcaaatctgcatgtcggccaaccggattcttgttcaaaaagaagtgtatccggaatttttaaagctgttcagccaaaaagtatccgggcttaaaacgggcgatccgctggaccctgaaaccgttatcggccctgttattaatgaacgccaagctgaacatttaagaaaatcgattgaaaaaggcatcgaagaaggcgccacaccgcttctgaaaggcgatattaaaggcaatctcgtcgagccgacgattcttgcggatgtcacgcctgatatgtctgtcgccaaggaagagctgttcggtccggttgtatgcgtcatgccgtttgagaccgaagcagacgcggttgagatcgcgaatgacacgcctttcggactgagcggagccgtacacacgggaaatgtggagagcggcgttgccatcgcaaagcaaatcgagacgggcatgatccatgtcaatgacacgacgatcaacgatgagccgcatgtcgctttcggcggtgaaaagcaatcggggatcggaaggctgaacggagagtggagccttgacgaatttacgacattaaaatggatttccgtccagcaccaaaaaaggagttttccatatt

SEQ ID NO: 55 - DNA, 984 bp, Bacillus licheniformis
atggacatgagcaaaaaagttatcgtattgggagagttcagagacggttcgttgaggaatgtgactttcgaagcgatagccgcaggaaaaacggttgccgaagggggagaggtgatcggcgtactgttcggtgaaagcgtttcaagtcatgcggcagaactgatccattacggcgctgacagagtgcttacagccgaaaacccgctcttgaaaaactatacgtctgacggctatgttcaagccttgttgccgatcatagaacgcgagaatccggacgtcatcattttcggacatacgtcaatgggaaaagacttgtcgccgaagctttcagcccgtatgggaacagggctgatatcggatgccgtcgatgtcgaagtggccggcggcaacatcgtgtttacaaggccgatttactcgggcaaagcgtttgaacggatcatttccgaagatgaaacgatttttgcaacgatcagaccgaataatatcgccccgcttgacaaagatgagacgcggacaggagcggtcgaaagcatcgaagcagatattcgggacatcagaacggtcatcaaggacattgtcaaaaaaacgtccgaaggcgtcgatttgtctgaagcgaaaattatcgtagccggcggtcgcggcgtcaaaagcgaggaaggctttaaaccgctgcaggagctcgccgatgtattgggcggggcggtcggcgcttcaaggggagcctgtgacgcagactactgcgactattcgcttcaaatcggccagaccggcaaagttgtgacacctgacttatatattgcctgcggcatttcaggagcgattcagcacctcgcagggatgtcaaacagcaaaatcatcgttgccatcaacaaagatccggaagctgatatatttaaaattgccgactacgggatcgtcggcgacttatttgaaatcgttccgctgctcacggaggaatttaaaaagctgagcgtcagcacatga

SEQ ID NO: 56 - DNA, 822 bp, Bacillus licheniformis
gaaagaagcgaaataaagtatctgtcatcggagcgggttttacaggtgcaacaactgcgtttttaacggctcaaaaagaattggctgatgtcgtgctagtcgacattccgcagcttgaaaaccctacaaaagggaaagcgctcgatatgctggaagcgagccctgtccaaggatttgacgcgaatattacaggaacggcaaactatgaagatacggctggttcagatatcgtcgtcatcacggcggggatcgcaagaaagccgggaatgagccgggacgacctcgtggctacaaatgaaaagatcatgaggagcgtaacgaaggaagttgttaaatactcacctgattgtatcatcatcgttctgacaaaccctgtagatgcgatgacatacgccgtctataaagaatcgggcttcccgaaagagcgggtcatcggccagtcgggaattttggatacggcaagattcagaacgtttgtcgctcaggagctcaacctttccgtcaaagacattacaggttttgtactgggcggacacggggacgatatggttccgctcgttcgctactcttatgcaggcggcattccgcttgaaacgcttcttccgaaagaccggatcgatgcgattgttgaaagaacgagaaaaggcgggggagaaattgtcaacctgttaggaaacggaagcgcgtactatgcgcctgccgcttccctgacagaaatggttgaagcaatcttaaaagaccagcgccgcgtgctgccgaccattgcctaccttgaaggcgaatacggctatgaaggcatttatctcggcgttccgacgatat

SEQ ID NO: 57 - DNA, 948 bp, Bacillus licheniformis
  misc_feature (1)...(948): n = A,T,C or G
atttcntggaagagaatattccggcatagtggaaactttgtgccgngtgatatgcgaacgcgtgaaatatntgatgtgtgcgtcagacaaaagccggcatcaacggcgaaaacatgtttatatcgatctatcccacaaagatccgaaggaattggacatcaagctgggcggaatcattgaaatttatgaaaaattcatgggtgacgatccgcgcaagctgccgatgaaattcttccctgaggttcactactcaatgggcggactttgggtcgactacgatcagatgaccaacattcctggactgtttgccgcgggagaatgcgactattcgatgcacggcggaaaccgcctgggagcgaactcgctcttgtcagccatttacggcggcatggtggcaggtccgaaagccgttgaatacattcaaggtctcgaaacatccgcagaagatctgtcttcttccgttttcgatgcatacgtcaaaaaggaagaagaaaagtgggctgacataatgaaaatggacggcaatgaaaatgcttatgtccttcataaagagctcggcgaatggatgacagacaacgtgacggtcgtgcgctacaatgacaagctgctgaaaacggatgaaaaaatccaagagcttgccgagcgctaccgaaacatcaatatcaacgatacggcaaaatggagcaaccagggcgccgtattcacgcgccagctgcacaacatgctgcaattggcacgggtgatcacgctcggtgcatacaaccggaatgagagccgcggcgcccattataaaccggatttccctgaacgtaatgacgaggaatggctgaaaacaacaatggcgaaacatgcaggcgattttgaagccccgaaattccattatgaggatgtcgatgtttcattaatcgcaccgcgtaaacgggattactcgaagaaaaaggtggcgaa

SEQ ID NO: 58 - DNA, 1005 bp, Bacillus licheniformis
caagaaaaacgtttacagtacaaggcaaaacgtacagctattattctttaaaagcattagaggatcaaggaatcggaaacgtatcaaaacttccttattccattaaagttttgctcgaatccgttcttcgtcaagtagacgggagagtcattactgaggaacacgttgaaaacttggcaaaatggggcactgccgaattaaaagatattgacgttcctttcaaaccatcccgcgttattttgcaggactttaccggcgttccagccgttgtagaccttgcttcattaagaaaagcgatggcttcagtcggcggagatccggataaaatcaatcctgaaataccggtagaccttgtcatcgaccactccgtacaagttgacaaagcgggtacggaagatgcattgaccgttaatatggaccttgaattccaacgaaatgcagagcgttacaaatttttaagctgggctaagaaagcgtttaataactatcaagctgttccccctgctacaggtattgttcaccaggtgaaccttgagtatttggcaaacgttgtccatgcagtggaagaagacggcgagattgtcacttatcctgacacgcttgtcggtactgactcccatacaacgatgatcaacggaatcggcgttctcggctggggcgtcggcggaattgaagctgaagcaggcatgctcggccagccttcatatttccctgtacctgaagtaatcggtgcgaagcttgtcggaaagctgccgaacggtacgacagcgacggaccttgcgcttaaagtgacacaggtgctgcgtgaaaaaggcgtagtcggaaagttcgtcgaattcttcggtccgggtgttgcggaactaccgcttgcagaccgtgcgacaatcgcaaatatggctcctgaatacggcgcgacttgcggtttcttccctgttgatgaggaagcattggaatacatgcgtttaacaggccgtgatgaagaacatatcaatgtggtgaaagaat

SEQ ID NO: 59 - DNA, 800 bp, Bacillus licheniformis
atggctgcaaaaacgaaaaaagcaatcgttgatagcaaaaagcaattcgatgccattaaaaagcagttcgaaacgtttcaaattttgaatgaagaaggcgaagtcgttaatgaagcggcaatgccggatctatctgatgatcaattaaaagaattaatgcgccgcatggtgtatacacgcattttggatcagcgttctatttctttgaacagacaaggccgccttggcttctacgcgccgactgccggtcaggaagcttctcaaattgctacgcatttcgcgcttgaaaaagaagacttcgttcttccgggctaccgtgatgttccgcagctgatctggcacggacttccgctttatcaagcattcttgttctctcgcggacacttccgcggcaaccaaatgcctgacgatgtcaatgcgctttcaccgcaaattattattggtgcgcaatacatccaaacggctggcgttgcactcggcttgaaaaaacgcggcaaacaggctgtggcgatcacctatactggagacggcggtgcttcccaaggtgacttctacgaaggaatcaactttgccggtgcgtataaagctccagctattttcgttgttcaaaacaaccgctatgcgatttcaacacctgttgaaaagcaatcagcagctcaaacaatcgcccaaaaagctgcggctgcaggtatcgtcggcgttcaagtagacggaatggatgcccttgctgtatacgctgcgacacgcgaagcacgcgagcgcgctgtaaacggcgaaggccctaccctgatcgaaacgct

SEQ ID NO: 60 - DNA, 933 bp, Bacillus licheniformis
gcacagaactgaaaaatgacgaaaatgtcttagttttcggagaagacgtcggtgttaacggcggcgtgttccgtgcgactgaaggattgcaaaaagagtttggtgaggatcgcgtatttgacactcctcttgctgaatctggtatcggcggccttgcactcggcttaggcttacaaggcttccgtcctgtaatggaaattcaatttttcggctttgtgtatgaagtgatggactctgtttccggacaaatggcacggatgcgctaccgttccggcggtcgctggaattctccggtgacaatccgttctccgttcggcggcggtgttcatacgcctgaacttcacgcggacagcttggaaggactcgttgcacagcagcctggacttaaagtcgttattccttcaactccgtacgatgctaaaggacttttaatctctgcgatccgcgataacgatccggttgtcttccttgagcacatgaaactttaccgttcattccgccaggaagttcctgaagaggaatacacaattgaaatcggcaaagccgatgtgaaacgcgaaggaaaagacctttccatcatcacatacggagcgatggttcacgagtcattaaaagcggcggaagagcttgaaaaagaaggcgtatctgctgaggttgtcgaccttcgcacagtcagcccgcttgacattgacacgatcatcgcgtctgtagaaaaaacaggccgcgcaatcgtcgttcaagaggcgcaaaaacaggctggagtagctgcaaacgttgttgccgaaatcaacgaccgcgcgattttgagcctcgaagctccagtgcttcgcgtcactgctcctgatactgtattcgcattctctcaagctgaaagcgtatggcttccaaaccataaagacgtgcttgaaactgcgaaaaaagtattggaatttt

SEQ ID NO: 61 - DNA, 1077 bp, Bacillus licheniformis
aattcggattagccacacaaattttcctcgggctgattttaggtgttgcagcaggagcgatttggttcggaaatcctgcggttgcaacgtatctgcagcccgtcggcgatttgttcttaagattaatcaaaatgattgtgattcctattgtcgtttcaagcttgattgtcggggttgcgggggccggcagcggcaaaaaggtcggcaggctcggctttcggacgatcctttactttgaaatcattacgacttttgcgattgtgctcggacttctcctcggaaacatcattcagcctgggcacggcgtaaacttttctggtgctgaaaaacaggatatcagccaatatgtagaaacagaaaaagaagcaagcaccaaatctgtcgcagacacgttcctgcacattgtgccgacaaactttttccagtcgctcgctgaaggcgatctgcttgcgatcatttgcttcactgttctgttcgcactcggggtgtctgccataggcgaaaaaggcaagcctgtgctctcctttttcgaggcaacgtctcaagccatgttccacgtcgtcaacatcgttatgaaattcgcgccgttcggcgtttttgctttaattggcgtgacggtttcaaaatttggtttttcttcgcttttatcattgggaaagctcgttttacttgtctacctggctcttgctttcttcttgatcgttatctttgggatcgtcggcaagctttgcggtatcaatatatttaaatttttggcttttttgaaagatgagcttcttcttgcgtacagtacatcaagctctgaaaccgtgcttccgcgcgtcatggaaaagatggagaaaatcggctgcccgaaaggcatcgtgtcgtttgtcattccgatcggctatacatttaaccttgacggctctgtcctgtatcaagcgatcgcggcgctgtttctggcgcaggtctacggcatcgatctatccattggacagcagctcacgttaatccttgttctgatggtcacttctaaaggtatggctgccgtttccggcacatctttcgtcgttcttcttgcgactttgggcacga

SEQ ID NO: 62 - DNA, 910 bp, Bacillus licheniformis
  misc_feature (1)...(910): n = A,T,C or G
atgacaaaagtatcgattttgggagccggaagctggggaacagccttggcgctcgttttggcggacaaccagtacgatgtgtgcatatggggccatcgtgaagaactgattcagcaaatcaatgaacatcatgaaaacaaagattatctgccgggtgtcaaactttctgaaaacgtgcgtgccacaacagatcttgaagctgcagtggctgatgtcaagacgatcattgtcgccgttccgacaaaagcgatccgcgaagttttggcacaggctgtttccttcatcaaccaaaaggcgatttttgtacatgtttcaaaaggaattgagcctgacacactgcttcgaatttctgaaatgatgaaagaagaaattccggctgaattaagggaggacatcgtcgttctgtccggaccgagccatgcggaagaagtcggtttaaggcatccgacgacagtaacggtatctgccgacagcagcattgaatcggcccaggcgatccaggatatgtttatgaaccagaatttccgcgtgtatacgaatccggatatgatcggcgtagagatcggcggcgcgctgaaaaacgtcattgcgcttgccgcgggcattacagacggtttgggatacggagataatgcgaaagccgcgctgattacaaggggcttggcagaaatcgcccggctcggcacaaaaatgggcggaaatccgctgacattctcgggtcttactggaatcggggacttgatcgtcacctgcacaagcgtccattcacgaaattggcgagccggtaatatgctgggtaaaggcttcaagctggatgaagttctggaagaaatggggatggtcgtcgagggggtccgcacgacaaaagccgcttatcagctttcaaagaaatttgntgtaaaaatgccgg

SEQ ID NO: 63 - DNA, 752 bp, Bacillus licheniformis
atgagtgaaaataagacaatcaagtttatcatcactcgtcaggatacatcggattctaatccttaccaggaagagtttgaaattccataccgtccgaatatgaacgtgatttccgctttgatggaaatcagaaggaacccggtgaatgcaaagggagaaaaaacgtcgccgattgcttgggatatgaactgtctcgaggaagtgtgcggcgcttgctccatggtgatcaacggcaagccgagacagtcctgtacagcgctgatcgaccagcttgagcagccgatccgccttgaaccgatgaaaacattcccggttgtccgcgaccttcaagtggatcggagccgcatgtttgattcgttaaagaaagtcaaagcatgggtgccgatcgacggcacatatgatctcggaccgggaccgagaatgcctgaaagaagacgtcagtgggcttatgagctgtcaaaatgcatgacttgcggcgtgtgtcttgaagcttgtccgaacgtgaacgataaaacaaactttatgggacctgcaccgctctcgcaagttcgcttattcaacacccatccgacgggagcgatgaacaaatctgaacggcttgaagcgattatgggagacggcggactggccgaatgcggcaactcgcaaaactgcgtgcagtcgtgtccgaaaggcatcccgctcacaacctcaatcgctgcattaaacagggatacgaccgttcaggcgtttaaaaacttcttcggaagcga

SEQ ID NO: 64 - DNA, 1077 bp, Bacillus licheniformis
actctgcaagtcggagacgtcatctgcaaagtcgaaacaaataagaagcgaaaccggaggctgaggcgtttccaagccagatcaagaggaagcggagccggccaaaccggaggcgaaagatacatctcagaaaaaacgttattccccggcggtgctgagacttgccggagagcacaacatcgatttggagcaggtggaaggtacaggcgccggcggacggatcacaagaaaagacatccagcgcatcattgcttccggagctgttcctcaaactgatgcagcgccggaaaaacagccgggtgcaaatgccgcgggagcgattgaacctgatcaaaaaccggcgcaagccgcacctcaagctgcaccgcctcaaagtgcggccggagacgttgagattcctgtaactggaatccgcaatgcgattgcgaccaacatggtcagaagcaagcatgaaatccctcatgcctggacgatgatggaagtggatgtcacaggtcttgtgagctaccgcaacaaaataaaaaacgaattcaagaaaaaagaaggcttcagcctgacctttttcgcgttttttgtcaaagcagtcgcacaggcgctgaaggaattcccgcaaatgaacagcatgtgggccggagataaaatcattcagaaaaaagacatcaacatctcaattgcagtagcgactgaagatgcgttatatgttcctgtcatcaagcatgccgatgaaaaaacgattaaaggcatcgcaagggaaatctccgaactggctcataaggtcagaagcggcaagctgaccagcggggatatgagcggaggtacgtttacggtcaataataccggttcgtttggatcggttcagtcgatggggatcatcaaccatccgcaggctgccatcctgcaggttgaatcgatcgtcaagcgtcccgtcgtcatggagcacggcatgatcgcggtcagggatatggtgaacctatgcttatccctcgatcacagagtgcttgacggcctcatttgcggcagattccttgcccgtgtgaaagagattcttgaacagatcgatgatcatacgtccatcta

SEQ ID NO: 65 - DNA, 900 bp, Bacillus licheniformis
tttttattgggcggctgccagtcaaatcgcggtattggatcctaaaggaccggttgcttcgcagcaaagagatcttattctattatcgattggatttatgctgtttatcgtagcggtcgtatttgtcctttttactgtgatgattgtgaaataccgtgagcgtaaagacagaaagtctccttacagcccggaagtagaaggcaatacatttttagaaatcgtctggacagtggttccgattttaattgttattgcgctgtcagtgccgacagttcaaacaatttattctctagaagaggctccaaaagcatcaaaggacaaggaacctttggtcgtatatgctacatctgtcgattggaaatgggtattcagctatccggaacaggatatcgaaacggtcaactatttgaatatcccgacagacagaccgatcttgtttaaaatctcatctgccgactctatggcatctctgtggattccgcagcttggcgggcaaaaatacgccatgtccggaatggaaatggagcaatatttacaggcagaccatgagggtacttataaaggccgaaatgcaaacttcacaggcgaaggttttgcagaacaaaagtttaatgtcaatgcggtatctgaaagcaagtttaatgactgggtgaagaaaacgcagaaagaagctcccaagctgacgaaaacccagtacgatgaactgatgcttcctcagcatgcggacgaaatgacgttctcatctacacacctgaagtacgttaatcacggaaatgatgcggaatacgccattaaagcgcgcgaaagactgggctataaaccgttgtctccgcactctaaatcagatccgtttgaaaacgtaaagacaaacaaagatcaaaaacaatctgaagaccaaga

SEQ ID NO: 66 - DNA, 747 bp, Bacillus licheniformis
atgaagggatggaagaccttgttcaggctttcgttgaacgccgcaaaggcaaagcgacggaagagcaggcccgccaaatccttttagacgaaaactactttggaacgatgcttgtttataaagggcttgccgacggccttgtcagcggtgcggctcattcaacagcggatacggttcgcccggcgctgcaaattattaaaacaaaagaaggcgtgaagaaaacatcaggcgtctttatcatggcgcgcggcgatgagcagtacgtattcgcagactgtgcgatcaacattgcgcctgacagccaggaccttgcggaaatcgcaatcgaaagtgcgaacacagcgaaaatgttcgacatcgaacctcgtgtcgccatgctcagcttttcaacaaaaggttcggcaaaatcagacgaaactgaaaaagtagccaacgcggttgcaatcgcaaaagaaaaagcgcctgagcttacacttgacggcgaattccaatttgacgcggcattcgttccgtctgtcgctgagaaaaaagcgccggactccgtcattaaaggagatgcaaacgtatttgttttcccaagccttgaagcggggaatatcggctataaaatcgctcagcgcctcggcaactttgaagcggtcggtccgattctgcaagggctgaacatgcctgtaaacgacctgtccagagggtgcaacgctgaggacgtttataatcttgcgctgattacggcggctcaagctctgt

SEQ ID NO: 67 - DNA, 1011 bp, Bacillus licheniformis
ccatgccctgctcccctgacagaaacgtcagaccgggcttgatgatatcacatttgttcacgtcagccttccggaaacggaattgtcacaagttgatacttcaaccaaaataggcgaactgtttttaagttcgcctatttttatcaatgcgatgacaggcggaggcgggaaggcgacgtttgagatcaacagggctttggcgagggcggctgcacaaacaggcataccggtcgctgtcggctcgcaaatgtccgctttgaaagatcccgatgagcgaccttcatacgagatcgtcagaaaagaaaatatgaaggggcttgtattcgccaatttggggagcgaagcgacagtggaacaggccaagcgggcggtcgacatgattgaagccgatatgcttcaaattcacctcaatgtgattcaggaaatcgtcatgcctgaaggcgaccgcaattttacaggacgcctgcgccggattgaagacatctgccggagtgtcagcgtaccagtcgccgtaaaagaggttggctttgggatgagcagggataccgcggcccggctttttaacgtcggcgttcaggcgatcgatgtcggcggtttcgggggaacgaatttttcgaaaatcgaaaatttgcgcagggataaagcagttgagtttttcgatcaatggggcatatcgacagcagccagcctggccgaagtcagttcgatatccggcgatcggccgattatcgcatccggcggcatacaagatgcccttgatttggccaaatcgatagcgctgggcgcgtctgcggctgggatggcaggctattttctcaaggtgctgacagcttcgggagaagaggcgttagccgccgaaatcgagagcctgatagaagatttcaaaagaattatgaccgtcttgggttgcaggacgattgaacagttgaaaaaagcgccgctcgtcatcaagggcgatacatatcattggctgaaagcgaggggtgttgacccctttgtttacagcatgcg

SEQ ID NO: 68 - DNA, 1092 bp, Bacillus licheniformis
tgctcgttgtaccgattgttttcttttctctgactttaggggtagcaggacttggagatccaaagaaattgggcagaatcggtgccaaaacgatttctttctttttaataactactgcaattgccattattatcggacttgttttagcgttggtcatcaaacctggaacgatcggaacatatgatacaagcgctgcggaatattcagcccagaaagcgccaagcatttctgacacgcttttgaatatcattccgacaaacccggttcaggcaatggctgaaggaaatatgctgcaaatcattgctttctccattttggtcggtctcggaattacgatgctgggcaaaaaagcggacgctcttctcaaagtggttgaacagggtaacgatctgatgatgtacctggtcaatcttgtcatgaagttcgcgccgtacggtacgttcggcttgattgccggggcaatcggaagccagggctgggacgccattaaagcaatggggctttatatgatcgtcgttattctggcgctgttcattcataccatcgtcacatacggcgcagcgattgcgcttctggcaaagcggaacccgctcacattctttaaagatttttcagaggttatgcttgttgccttcagtacgtccagcagcaacgcgacgcttccggtttcgatggatgtcgctcaaagaaagctgaaagttccagagccgatctcaagctttgtccagccgctcggagctacgatcaacatggacggaacggcgatcatgcaaagggtgggcacagtttttatcgctcaggtgtacggcaatgacctgtcgctcacacagctgttgatggttgttctcacggcagtgcttgccagcatcggaacagcgggtgttccgggtgtcggactcattatgctcgccatggttcttcaaacagttggccttccagttgagggaattgcgctaatattgggaattgaccgacttctggacatgattcgtacggctgtcaatacaacaggcgatgcagcatgtgcggtcatcgtcaccgagacggaaaagaaacacggcaaaatcgaagcccctcatagtgaagtgtccg

SEQ ID NO: 69 - DNA, 731 bp, Bacillus licheniformis
atgtccaaaattattgcaatcaatgctggaagctcatcactgaaatttcaactgttcgaaatgcccagcgaaaaagtattaacaaaaggccttgttgagcgaatcgggctggataacggcatcttcacgatttccgtcaacgacgaaaaaaagactgaaacaacagatattccggatcattccgtagctgtaaaaatgctgctggataaactgacaaaattcggcattatcaaggatttaaatgaaatcgacggaatcggtcaccgcgtcgtacacggcggcgaaaagttcagcgactccgttttattgacggatgaaatgatccatgagatcgaagagatttcagagcttgcaccgcttcataacccggccaatattgtcggaattaaagcgtttaaagaagttcttccgaatgttcctgccgtggccgtttttgatacggcattccatcaaacgatgccggaacaatcttatctgtacagtctgccatatgaatattatgagaaattcggcatccgtaaatacggtttccatggtacatctcataaatatgtgactgaacgcgcggcagagctgcttggccgtccgattgaagaacttcgcctgatttcctgccaccttggaaacggagcgagcatcgcagctgttgaaggcggcaaatcaatcgatacatcaatgggcttcacaccgcttgcaggtgtagcgatgggtacgcgttcaggtaacatcga

SEQ ID NO: 70 - DNA, 850 bp, Bacillus licheniformis
atgacgacagctgacgaaagaaaggtcattgaacagcagtttaaacaaagaatggatgaggaagagctgctgaattgcatgcgctgcggcttctgtctgccgtcatgccccacctacatcgaatccggttttcaagaaagccattctccgcgcggacgcatcgcgctcatgaaagcggtcgtcgatgggacgatcgagcctgatgaggatgtcgaacggtcactcgagctttgcctcggctgccgcgcgtgtgaacctgtttgtccgtcaggcgtaaactacggacgcttgcttgaagaagcgagagatattattcagcagaacaaaaagcacgcctttccggttaaagtgcttcgccgcgcagtattcaaagggcttttcccccatccaaacagaatcagggcgctgaccggaatgctcggcttgtatcagcgttccggcatgcaaaacgtgattcgcaaatccggcttgctccggcttttgccggaccacctcgcgaagatggaggcggttttgccgaaggttcctaatatgaaacagctgaaaaaacggccgcacctgctccctgcgatcggggagagaaaaaaacgggccgcctttttctcaggctgtctcatggatacgctgtttttggatacgaatatggcaaccattgagctgctgcggctggctggctgcgagatcataattcccgaacagcagacctgctgcggcgccctccacggacacagcagcgaaaagtctgaggccatcctgctcgcaaaacgaaatattcaggcattcgaggattcaaacgcggactttatcataacaaatgcaggcggatgcggagcttttttaaaggaatata

SEQ ID NO: 71 - DNA, 1092 bp, Bacillus licheniformis
ttttatctgtatttattccgttttatttgatcatcatcatgagcggtttcaaaagggctttggaagtgctgccggccattctcgtgtcgggcgtctcttttgccgttacacagtatgtaagctcaaacttcctggggcctgagctcccggatattttgtcagctatcgtatcgcttatcgctctcgctgtattcttaaaattttggaaaccgaaaacgacattcagattctcacaagaaaaggaaatggccgctgcagcggaggcgcagcagcttgaacatcaaaaggcctcatactcggcggggcagattttcaaggcatggacaccgtttttgctgctcacggcaatggtctccatctggggaattccatctgtcaaacaggccttgacgggccattatgaaggttcaaatccattgctgctgttcataaatgatatcggcggcaggctgacgtttgcacccggcgtgccttttttgcacaatcaaattctcgatggttccggaaaaccgcttgaggctctttacaaacttgatctcgctggatcggcaggtacggcgatcctgattgccgccgtactgacaaagtttgtcacaggcatgccttggaaagaatggggcgccgtatttacagattcgctgaaggaactcggcaagccgatattaacgatcgcttccgtcgtcggttttgcctatgtcaccaattcttcgggcatgagcacaacactgggcatgtcccttgcgatgaccggttcaatgttcgcattctttttctcccgttctcggctggctcggtgtgtttataaccggttcagatacgtcggccaatttgctgttcggaagcctgcaaaaaatgacggcacagtcagtcggaatggagccggtgcctgtctgtggcggccaactcttcaggcggcgtcacaggaaaaatgatctctccgcagtcgattgcggtcgcctgcgcagccgtcggactggcaggaaaggaatccgacgttgcttcgctttacactgaaacacagtctgtttcttcttttcctcgtttgcatgatcactttcctgcagcatcatctgttttcgtggatgatcccgt

SEQ ID NO: 72 - DNA, 1050 bp, Bacillus licheniformis
atgcgcgtatctaagcaggagctgtttcatttaatcaaacagaagctgatcaaagctggattaaacgaaggagccgcacacgatgtttcagatgtattgacattcgccgatcatagagggatccattcccatggtgcagtacgtgtggaatactatgccgaacgaatcgcaaaaggcggtattacagcaaacccaaactacacatttgaacaaacaggacctgcatccgccgtctttagcggagataatggcccaggtcaccaagcagcaaaacaagcgatggaaaaagcaatcgaaatggcaaaaaattcaggtgttgctgttgtaggcatgaagaatatttcgcatagtggtgcattgggttactttgttgaaatggcagcagaacaggacatggttgctttaagcatgtgccaatcagatccaatggtcgtaccgtttggaggaacagaaccatactttggcaccaatccaattgcttttagcgcaccatcggctgatgaacgcatgatcacatttgatatggcgacaactgttcaggcatggggaaaagtattggatgcaagaagtaaaaatgaatcgatcccggaaacatgggcagtagatgcagccggtgcaccaacaacgaatgcaagagatgtccatgcacttgtgccaattgccggtccaaaaggttatggattgatgatgatggtggatgtcttatcaggcagccttcttggagtacctcatggcgtacatgtatcttccatgtatcaagacctgacaaaaggccgagatttagggcaaattcatattgtgatcaaccctgcatacttcacagatttaactgcttttaaacaacagatttcgacgatgcttgatgaattaaaagcacaaccggcagcagaaggctatggggaaatttattatccgggtgagcgcggtaaattaagaagtgcaaaatatgataaagaaggaattgaaattgtagacgatatttataactacctcgtttcaggcgatgttcattacaatcgttatcatggaaagaatagatttgcagaataa

SEQ ID NO: 73 - DNA, 747 bp, Bacillus licheniformis
atatgatgactgcaaagaagctgatattgtctgcgtatgcgccggagcgaaccaaaagccgggtgaaacccgccttgatctagtcgaaaagaacttgaaaatttttaaaggaatcatcggagaagtcatggccagcggttttgacggcatcttcctcgtcgctacaaaccctgtcgacatcttgacttatgcgacttggaaattcagcggccttccaaaagaacgcgtcatcggaagcggcacaacgcttgacactgcccgtttccgctacttgctcagcgagtatttcggtgtcgctgcccacaatgcgcacggctatatcattggtgaacacggagatacggagctgcctgtctggagccatgcgaatatcggcggagttcccgtcagcgacttgctgaaaagaaatgagaaatacaaagcggaagatctagatgaactgtttgacaatgtaaaaaacgccgcttaccacattattgagaaaaaaggcgcgacatactacggagttgccatgagcctcgcacgtattacgaaagcgatttatcgaaatgaagaagcaattttgaccgtgagcgctcatcttgatggtgaatttggagaaaatgatgtttatatcggagttccggcggttgtcggccgatgcggagcgagggaaattgttgagctcgatctgaacgaaaaggaaaaacaattcaagcatcgcgcaggtgtgttaaaagcaattttaaaaccgcattttgaactgca

SEQ ID NO: 74 - DNA, 837 bp, Bacillus licheniformis
cgacggaagctgaactcagcagattcaatgagctgctcgcttcatttcgtgtgcttccagaagcatgcgagcgattgatccgcagtcttccggccgaattagacgatatggcggttctgcgcacggccgtctcttcattcggggacatatcgtttgcgttcaagccgacaatggagcaggccctcaggctgattgcggccgtcccgtcaattatcgcgttcagaaagaggctggctgatggagaagagcctgttcagccgctggatgagctaggttttgtggaaaattatttttacatgctgaaaggaaagcgtccgacagaagctcagaaaaaagcgcttgaaacgtacatgattcttgcgatggaacatggcatgaacgcttcaaccttttcggcaagggttacggtgtctacggaatccgatcttgtttctgccgtcacatctgcacttggcacgatgaaaggacctttgcacggcggagcgccgtctgcggtgacggatatgctggaaggcatcggggaaaaacagcacgctgaaagctatataagagaaaagcttgaaaaaggcgagagactgatgggatttggacaccgcgtctataaaacgcatgatccgagagcgaaggctttaagggtgaaagccgaggaaattgccgggggcgacagggatatcgaccttgctcttcatgttgaaaatacggcgatccgccttttggaagaatacaagccgggccgcaagctttatacgaatgtcgaattttacgcagccgctgtgatgaaggcgatcgattttgatgccgcattgttcacccctactttttcggcaacgagaatgg

SEQ ID NO: 75 - DNA, 792 bp, Bacillus licheniformis
  misc_feature (1)...(792): n = A,T,C or G
tctatttggagcggggacggccggaatcggcaatgctgagcaaattcgcgccgcactcgttcaagagggagtgtcggaagaggaatcataccgccgtttttggtgtgttgatcggaacggtttgctgacagatgatatgaacgacttgcaggacattcaacaaccgtatgcaaggcctgctgacgaggtaaaagacttcagccggaacggcccgggggatgcaattgatctgctcgaggtggttaaaagagtgcagcctaccattttgattggaacctcgacggtatcgggcgcatttacagaggaaattgtaaaagaaatggcaaagcatgtgaaacggccggctatattcccgatgtccaatccgacgccgttatctgaagcaaggcctgaagatttgatcaattggacggaagggcgggcgctcgtcgccacaggaagcccgtttgcgcctgtggaatacagcggcacccgttatgcgatcggccaggcgaataatgcctttgtattccccggccttgggctcggaacgctcgtatcaaaagcaagactgattacggacaacatgttttacgccagcgcggctgcgatcgcgggtatggttgatacgggccggcccggcgccgcgcttcttncggaagttgaggatntgcgcacggtttccgcaaccgtggcaacggctgtcatcaaagcagccatagaagacggagttgcagaaaacgagccggacgatgtgattcaggcggggcaggatgcgatgtggcattcggtctaccggccgattcgcgccat

SEQ ID NO: 76 - DNA, 792 bp, Bacillus licheniformis
atggggaaaaacatcacaacaagccgaaaaattttccgttatgataatggagagctggtgcagcaagaagatcagatggcgacggaattccccctgactgtcatggtgaacggcgaggaatttgtcacgcttgtttgctcgccggacagcctggaagaactggtgatcggatttctcgcatctgaaggggtgatccgatttaaaaatgagattaaaaggtttacaatagatgaaagcctcgggttcgcatatgtcgaccttgtcagcacaaaaaagctgcagctgaaggattacacaaagcgggtgatcggctcctgctgcggaaaagggaggcatttttatttccagcaggacgtcaaaaccgcaaaaacagcgattgacggcgtgaccattacgccagagaactgtttgaagctgatgcgcgacatgcagaaaagcagcaagctttttcaccatacggggggcgttcataatgccgctttgtgcagcacagacaagctgattgcagtcagatctgatatcggaaggcataatgcgcttgataaattgtacggatattgtttgcttcatcaggttcctgtgcgcgataagctgatcgtattcagcggcagaatttcttcggaagtgctgcttaaagccgcgaaaatcggggtttccgcggtcatttccaagtcggcgccgaccgagctggccattcagatggcagaggagctgaatatcatgacgattggttttgcgagaaaccggtcattcaatgtatacacgcatcacgagcgaattcagttttcataa

SEQ ID NO: 77 - DNA, 988 bp, Bacillus licheniformis
atggggtatcaggcgagtgatgtacgctatgaaaatatgaaatacaacctctgcgggcattcaggattaaaactgcctgctttgtctttagggctttggcacaatttcggagaagcggcttccttgcaaaatgccaaagcgctgttaagaaaagcatttgacctgggtatcacccactttgacttggcgaataattacggtccgccgcccggttctgccgaagaaacattcggaaaagcgctgaaaaccgattttgccggctaccgcgatgaaatggtcatcagcacgaaagccggctatacgatgtggcccggaccatacggcgattggggatcaaaaaagtatctcgtggcgagccttgatcaaagtttaaaacgaatgggcatcgattatgtcgatatattttattcacaccgccctgacccccatacaccgctggaagagacgatgggagcgctcgcccacatcgtcaggcaaggaaaagctttatatgtcggtttgtcgaactacagtgctgaacagaccgaaaaggcggctgatattttgcaagaatacgggattccgctcctcatccatcagcccaaatattcaatgttccacagagaaccggaaaaaggcctgctgcaagtgctgcagaaaaaaggagccggggcgatcgcgtttacacctcttgcccaagggcttttaacaacgaaatatttgacagggattcccgccgggtcaagagccgctgatgcgaacagtccgtttttgcaggccgagggcatcacagaagacgtgctcggcaaggtccgcaagctgaatcaagtggctgccgaacgcggccagtctcttccgcaaatggcgatagcctggctattaaaagacccgcgcgtcacctcggtgctgatcggcgcgagcaaaaccgaacagatcgaagaaaatgccgcggcgcttaagtccgctcgattctcagctgaagaactcgacacaattgataaaattcttt

SEQ ID NO: 78 - DNA, 804 bp, Bacillus licheniformis
ggcttgccagcaccgctccagaaatcatgatcgcacacattgcggcaaagacggcgaatattcgcgtcggttcgggcggcgttctgctgccccaatacagtccctttaaagtggctgaaaactttcggcagcttgaagccctttatcccgggagaattgacctggggatcggccgctctccgggaggcacaactaaaacgaggctggcgctgacagacggggttcataaaagcctgcacgaattcccgagacagttacaagacttggttagctttctgactgattccgtgccttccggacatgattacttcggaattaaagcctcccctttgacggattcgcccccggaggtgtggcttttaggcctgggagaaaacagcgcaaaattggccggtagcatgggagcgggatacgtattcggccatttcatctctcccgcgagaggaaagaacgcctttcaatcataccgtgaaagctttcggccttcccctttctttaaacgcccccaatcattggccgccgttttcgtcgtttgtgcggagtccgatgaaaaagccgaggagctctgcttgagccaagatttatggcttctccgggttgaaaaagggctggacagccttgtcccaagcattgaagaggcgaaatcggccgcttacacagctgccgataaaaagaagcttgcccaaaaccgcagccgtatggtgatcgggtctcctcaaacagtcaaaagaaaactgctcgagctttctgaacgatatcaaacagatgagtttatgattttaactaacgtctaccggtttgaag

SEQ ID NO: 79 - DNA, 668 bp, Bacillus licheniformis
atgatcgaacaaatactgtgggtcatcctcccctacattgtcatcaccatttttatcggagggcatatttaccgctatcaacatgatcaatttggctggacggccaaatctagcgagatgctcgaaaagaaaaaacttgcgcttggcagcagccttttccactggggaatcttttttgtcatcggcggacatgtgatgggaattttaattccggaaagcctttatgaggcgctcggcgtttcagagcatatgtaccataagatcgcgatcggcttcggactgcctgcaggcatcgccgcgctgtcagggcttctcatattgacctaccgccgattcacggacaaacggattcgaaaaacgagctctgccggcgatttaatcacccttgtcgctttgttattcgtgatgaccactgggcttgcggcaaccttcttaaacatcgattcaaaaggattcgactacaggacaacaatcggcccgtggtttcgcaacattttcttattcaagccggatgccgggcttatggcgagcgtgcccctctggtttaagcttcacatcatcatgggctacgtcattttcatcgtctggccgttcactcggctcgtccacgtattcagcatgccgctaaaatatttgacaagaagctatgttgtttaccggaaacgggc

SEQ ID NO: 80 - DNA, 795 bp, Bacillus licheniformis
cagagaagatccgtataggatccggcggcgtcatgcttccgcattacagcgcctacaaggtggcggaaaacttccgcgtcttggaaggactagcgcccggcaggattgatctaggtgtcggacgtgctccgggagggatgccgatcgcttcaatggcccttcaaaatggaggaagacggatggctgaccaatatccagaacaaattcaggacctcgtcacatatttatacgatcaagccgatgaacatcaccgctttcccaacttgaccgcaacgccgaacatcgccacagcgcccgctgtttggctgctcggctcctcaggggaaagcgcaaggcttgccgcccaaacaggggcatcatatacatttgctcaatttattaacggtgaaggcggagaagaggcggccagactgtacaaagagaggttcgaaccttctgtattaggggaacagccaaatgtgatcgttgccgtatttgtgatttgcgctgagacagaagagaaagcggagaaccttgccaaaagcttggatttttctttattggccaatgaacaggggatggtgaccgaaggctttccatcattggaaacggccctgtcctatcaatattctccttatgaaagaaagagagtggaagacaatcgaaaacggatggtcatcggaacgccgcagcaggtaaaggaacagctgcttgaactggccggcgcttacggaacggacgaaatcatggcggtgacgatcacccacgattttcaagacagattggattcataccggctgctggccgaagcgtttc

SEQ ID NO: 81 - DNA, 1077 bp, Bacillus licheniformis
atcaaaacggaaaagcctcagggcttttgccgctgtttttatttgtttgtttattcgttggatcaggcttgatcacaggcgacttttacagcctgccaatcgtggccgcggcgcttgcggcatcggttgtctcactggcgatgaacaggaaggagaagctcagccaaaagacggagtggtttgcgaagggcgccgggcaccccgacataatgatcatggtgatgatctttattttggccggagcgttttcatcagccgcaaaggcgatgggggccgtcgaatcaaccgttaatctcgcgctttcatttgtaccggggcagtttatggttgccggtttatttatcatcgctgcgtttatctctgtgtcgatgggcacgtcaaccggaacgattgctgcgctcgctccgatcgcagcggggattagcgctgaaatcggcgttccggcggcatattcggttgctgcggttgtggggggcgcgatgttcggcgataacttatcatttatttccgatacgaccattgccgctgtccgcactcaaaagacgaaaatgtcggacaagtttaaaacgaatttcctgatcgttctgcctgccgcggttgccacggtcattctgctgatggtgttctcagccggagggcatcccggagcacaagccgggacttacagctgggtgaaggtgctgccgtatctcggggttctgatatttgcccttctcggatttaatgttatggccgttattttcggcggcatcgtattagccggggtaatcggaatttccgacggaagcctgacgcttcatacgtatttgacggcgataaccgaaggcatcggcgggatgtctgaactgatcattttatcgcttctgattggcggaatggcggaaatgatgaagcgaaacggcgggatcgcgtttctccttcaatttgtatcgcggagaatccgttcaaaaaaaggagctgaagcgggcattgccggccttgtcagcgcggcaaacctggcgacgggccaacatacgattgccatcattacagcggggccgctggcaaaagatttatctgacaagtacggaatcgacc

SEQ ID NO: 82 - DNA, 966 bp, Bacillus licheniformis
ccttatttctaccttccaaaatcgaaaaccacctggaagcaaggctgtggaacgacgtatttgtttatgcgcaaaacgacttgcgcattccgcagggcacgattaaagcgacggttctcgttgaaacgatcctggcggcctttgaaatggatgaaatcctctacgaattgaaggaacattcagccgggcttaactgcggcaggtgggattatattttcagctttattaagaaattcaggaacagggatgaagtcattcttccagatcgctcagccgtgacgatgacagttcccaacatgagagcctactccctcttggcgattcaaacgtgtcataaacgcaacgtccatgcgattgggggaatggcggcgcaaattcccgctaaagacaaacctgagatcaatgaagccgcatttgccaaaatccgcgaagataaggaacgtgaagtaaaagacggccatgacggaacatggatcgcgcatcccggcatgattcaaacggcgctcgatgtattcaatcagcatatgccgtcggcgaaccagattcatagaaagcggaaagacgtaaaggtcgaggaaaaagacttgctggaagtaccgaaaggcagaattacagaagcaggcgtccgtaccaatatcagcgccggcatccgctatttagcttcatggctgtcgggcagaggcgccgctccgatcgaccacttaatggaggacgctgcaacggcggagatttccagagcccagctgtggcaatggattcgccatccgaaaggagttcttgacgatggccggaaagtcaccgcggaaatggtcaagatgatgaaagagaaagaaatgcagaaaatcatcgatgaagcaggcgtggaacattttcggagcggccggtttgaaaagccgggacagttatttgaacagctgattttggatgatgaattcgcggagtttctaacgataccggcttatgaaa

SEQ ID NO: 83 - DNA, 765 bp, Bacillus licheniformis
ctacgccattatgcccaaaaatggacgaaggcgcagcccgtgttgctagggtcaccataccgaccggaaccatgccggcaagcagctagccctgctctggccgggattcatggaagggatcggaaaagtcatgtcccttccatttcaaaatgaaatctacgccttttttattgaggctgtatttatgtccattaatgtttacgcagccgatcggctgactccacttatgagaattacagccgtcatttttatcgttatcggagcagccgcatcggccatcttgataacaaatgtgcacgcttttcagggaacgccagaaggcttcaaaattgtaaacggtgaaattacggatgttcagccgtggacggcgttcttcaacaaaagctttgtggccacagcaggacatgttgtcgtctccgcttttatgacaggtgcgtttattattgcgacgatagccgcctacaaaatgctccgaaaccgcggcgatgatagagtctacgcccttcataggaaagcgctgctgctcgggctgattgtcggaggagcgttttctctggtcacggctctgagcgggcacgaatccgcacagctacttcaccgctaccagcctgaaaaactggcgggcgcagaagggctgtttgaaacccagtcccatgctcctcttgcgatcggcggatttactgatgaaaagacgcaatcggtgaaatgggcgattgagattccgtgggctttaagctttttggccgacaaccgctgtgacaccgt

SEQ ID NO: 84 - DNA, 1122 bp, Bacillus licheniformis
tcattgatagtgaagggggaattaccatgtcaaaatcagtaaaatcagtcacatcacctaaaaaatttattacaggaaaacgactgctggagaacttgaacgactacattgaagattttggcgacaacgcatatatcatttgcgatgaattcattttggaacgcgctcaaaaagaagcggggaattcgattcagaaagccggcaatcaagccgtttttgaaaaattcaattacgaatgcacacaggaagaaatcgatcgcaaccgggagcttgcacgcaatgcaggcgctaatatcatcgttgggatcggaggcggtaaaacgcttgataccgcaaaagccaccgcttattacgagaagctgccggttgtgattttcccgacaattgcttctacggatgctccatgtacggcccttgccgtcatttataaacacgacggatcgtttgaccgctatctgtttttgccgacgaacccagatgtcgttcttgcggactctgagattttggcatccgcgccgccgcgctttttcgcagccggtatcggtgacgccttggcgacgtattttgaagcgcgtgcctgctttaaagcaaacggcgataacctcgtgctgatgaagccttcaacaactggattgggacttgcccgtctttgctatgatacgctgttggaaaacggtgtgaaagcgatgcaggcggttaagcacggcgtttccacacgagcggtcgaagatacaatcgaggcgaccatctatttaagcggcgtcggtgccgaatcaggcggtcttgccgccgcacacgcgatccacaacggaatgacagccgttccttctctgcacagggctcagcacggcgaaaaagtcacgttcggccttttggcgcagcttgttcttgaaaacgcgccggccgaagaattggagaccgttattgactttatcaaaggcgtcggtcttccgttgacattaaaagacctcggagtcgacgaatttgtcgaagaagaatggcgccaagtcgctcaaagcgcttgcgcggaaggcgacacaatgggcaacatgccgttcccagtcacccctgacgacgtctacaatgcgatcgtcgccgccaacgcgattgcagaatcttatc

SEQ ID NO: 85 - DNA, 1437 bp, Bacillus licheniformis
ccgaaccagaggagggaaagtcatggcaactgaatacgatctcgtgattcttggagggggcacaggcggctatgtggccgccatcagagcctcgcagctggggctgaaaacagccgtcgttgaaaagcagaagctcggcggcacgtgccttcataaaggctgcatcccgtcgaaggcgctccttagaagcgcggaagtatacaggacagcaaaaaaggcggacgaattcggagtggtcattcctgaagtcggactgcggttttctcaagttcaaagcagaaaacaaaaaataattgaccagctgcacaacggtgtcaaacacttgatgaaaaaaggaaagatcgatgtttacgaaggaatcggacggattctcgggccgtcgattttttccccgatgcctgggacggtttccgttgagatggcgaacggggatgaaaatgagatgctcataccgaaaaacgtcatcatcgctacaggctcaaggcccaggtcgctgccagggcttgagcttgacggagaaaacgttctgtcatcagacgaagcgcttgaacttgagcagcttccggcttccatgctgatcgtcggaggaggtgtcatcgggatcgagtgggcttccatgctgaacgatttcggtgttgatgtcaccgtcattgagtatgcagaccggattttgccgactgaagatgccgatatttctagggaaatgcaggcgcagctcgcgaaaaaaggcatcacaatgatcacgggagcaaaagtgctgcccgacacattggagaaaggcgatgcggtcagcattcaagcggaaaaagacggagaaaaacaatcctattccgctgagaaaatgctcgtatcggtcggaaggcaggcaaatattgagggtatcggtctggaaaacacggatatccaggtggaaaacggctttatcgtgacaaacagcatgtaccagacaaaagaatcccacatctatgcgataggagatgtgatcggcggccttcagcttgcacatgtagcttctcacgaagggattacggccgttgagcatattgctggtgaaaacccgcacgccatcgattattcgcttgtttcaaaatgcatctattcaagccctgaagccgcatcggtcggcttgacagagggtgaggcgaaggcgcaggggaaaagcgttaaagtaggcaaatttccgtttcaggcgattggcaaagcgctcgtgtacggtgagacggacggctttgtcaaaatcgtcgccgatcgcgaaacagatgacattttgggcgttcacatgatcggcccgcatgtgacagacatgatatctgaagccggtctggcaaaggtgcttgacgccaccccgtgggaagtcggtcaaacgatccacccgcatccgacgctgtcggaggcgatcggagaagccgcccttgccgtggatggaaaagcgattca

SEQ ID NO: 86 - DNA, 857 bp, Bacillus licheniformis
atggaattaggcatcagcacctttgtagaaacgacccctgatatcaaaaccggaaaagtcatcagccatgcggagcggctgcgcgaagtagtggaggagatcgtccttgccgatcaggtgggcttggatgtattcggagttggagagcatcatcgtcaagattacgcagcttcttctcctgccgtcgtcctggccgcagcagcttcacagacgaagcgcatcagattaacgagcgcggtcaccgtgctgtcgtcggctgatcccgtccgtgtttttcaggattttgcgacgctcgacgggatttcaaacggcagggcggaaatcatggcgggcagggggtctttcatcgaatcctttccgctgtttggatatgatttagacgattatgatgagctctttgaagaaaagcttgatttgctgctcgaactgcaaaagtcggaaagggtcacatggagcggcaagcatcgcccggctattcacaatacaggcgtttacccgcgtcccgtgcagaagccgctgcctgtatggatcggaagcggcggaaaccaggaatccgtcgttcgcgccggcctgctcggcctgccgctggttctcgcgatcatcggcgggagtccgcagcactttgccccgcttgttgagctttattacaaagcagcggaacatgcagggcatgacgcctcaaagctgattgtcgcttcccattcccacggctttatcgcggaggataccgagacggccgccgatcgttttttcccttccacccagcaggccatgaatacgctcgcaagagagcggggctgggggccgtacagccggtcgagcttcgatgcagccagaagctttgaaggggcgctcta

SEQ ID NO: 87 - DNA, 750 bp, Bacillus licheniformis
atgaataaaacgattgaaactattttaaatcaccgttcgatcaggtcttttacagatcggctcctgaccgaagaagaggttcgcctgcttgtggagagcgctcaaagcgcatcgacgtcaagctatattcaagcatattcaatcatcggtgtcaccgatccggacaagaagcgcaagcttgcggaattggccgggaaccagccatatgttgaaaaaaacggccatctgtttgtattttgcgcagatctttacaggcatgacaaaatcgctcggaaaaagggtgtagatattacagcttctcttgaagggacggaaacctttatggtcagcgtcatcgatgcagcgcttgccgctcaaaatatgtcaatagcggccgaatcaatgggcctcggcatctgctatatcggtgggattcgcaacaatttgaacgaagtctccgagcttcttgaaacacctgaatacgttcttccgctgttcgggcttgtcgtcggccagccggccaacccttcggccaaaaaaccgcgtctgccgcttgatcacatttatcatgaaaatgtctatcaagcggatgatgccgagtttgaaaagcatttgtccgcatatgacgaaacgatttcaaactattatcaaaagcggacggacggcaaacggtctgacaaatggacagaccagatcaccggcagcctcaaaaagccgccgcgtgcgtatatgaatgaattcgttaaaggaaaaggtttgaacaaaaggtaa

SEQ ID NO: 88 - DNA, 677 bp, Bacillus licheniformis
gtacaaatacatcaaacccttatgtcttaatcggtgcgggcctcgtcgccaaaaaagcggttgaactgggattgaaagtaccgaactatgtgaaaacatctctcgctccgggttcaaaagtcgtaacaggctacttggttaattcaggcctgctgccgtatatgcgcgagcttggatttaacatcgtcggctacggctgtacgacatgtatcgggaactccggaccgcttgcgcctgaaatcgaaaaagcggttgccgaaaacgacctgctgattacgtctgtcctttccggtaaccgtaactttgaaggccggattcatccgcttgtcaaaggaaactacttggcgtctccgcctctagtcgtggcctatgcattggcaggtacggtagatatcgacctgaaaaacgaaccgatcggcgtcggcaaagacggtcaaaatgtgtacttcaacgatatttggccgacgatggacgaaatcaattccgtcgtgaagcaaaccgttactcctgagctgttcagaaaagaatacgagcgcgtgtttgatgacaatgaacgctggaatgcgattgaaacaacggatgaagccctgtataaatgggatgaagagtccacttacattcagaacccgccattctttgaaaacatgtcagttgagccaggtacagttgaaccgctt

SEQ ID NO: 89 - DNA, 627 bp, Bacillus licheniformis
ctttgagcctgatgagaggatcgaagaccaatgcggctcatgcaacaagtgcatcgaggcatgcccgaccggcgcgctcgtcaagcctgggcagctcaactcccagcgctgcatcgcttttcagacgcagacaaagggttttctgcctgacgagttccgtacgaaaatcggaaacaggatctacggctgtgatacgtgccagatggtatgcccgaaaaataaaggggtcgattttcatctgcatcctgaaatggagccggaccctgagattgccaagccgcttttaaagccgcttctgacgatgtcgaatcgcgaattcaaagaaaagttcggccacgtggccggctcatggagaggcaaaaagccgattcagagaaatgcgattatcgcacttgcccattttaaagaaacggacgctctccctgaactgattgagctgatgcacaaagatccgcggccggtcatcaggggaaccgccgcatgggctgtcggaaagatcggcggagcggatgtgatgagtgaattggagcgcgcgctcgcgcacgagcaggatgaagacgcaaaagctgaaattcaaaaaggcatcggcctgttaaaagaaacgagtgcgactaattgagggctgtc

SEQ ID NO: 90 - DNA, 781 bp, Bacillus licheniformis
atgggggaatgtgcgatgctgaaagaaaaacaactcgcagaaagctgggagcatgatgaacgctggaaagggatcacaaggccgtatgaggcggcagacgtcattcggctgaggggcacgctcgagattgaatacacgattgcaaggcgcggcgccgaaaagctgtggaagcttctccatacagaggatttcgtcccggcgctgggcgctttgaccggaaaccaagccatgcagcaagtaaaggccggattgaaagcgatttatttaagcggctggcaggtggctgccgatgcaaatatgtcagggagcatgtatcctgaccaaagcctttatccggcaaacagcgtcccggaagtcgtcaaaaaaatcaaccgcacgctgcagcgcgccgatcaaatccaccatatggaaggaaaggaagacatcgattggtttgctccgattgtggccgacgctgaagcgggcttcggcgggcagctgaatgtgttcgagctgatgaaaagtatgattgaagccggcgccgcgggagttcactttgaagaccagctgtcgtctgagaaaaagtgcgggcatttgggcggaaaagtgctgcttccgacgcaaacagcggtacgtaatttgattgccgcgcgcctcgccgcagacgtgatgggagtcccgaccattcttattgcccgcacggacgcgaatgcggcagacctgatcacaagcgacgtcgattcatatgatgcaccgtttttgacgggagagcgaacagcggaagggttcttcaaaacaaagc

SEQ ID NO: 91 - DNA, 864 bp, Bacillus licheniformis
cgcttacagtcgaaaaaatcgcgatcggcgacaatgctgttgagcaagagctgcccgctttcgtgaaatcggcttcctataaaaaagccgctgtcatttatgatgaaacaaccggacggttagccggcaagcggattgcctctcttcttgaggaaacggctgaaacggttccggtgctgctggaagctaatgaagcgggcgatgtgacggcggatgagcaaacattggtgagtgcattgatcggtgtaccgattgatgcggatgtactaattgcggccggagcgggcacgattcacgacatcgtcaggttttgcgcctatcagcgcggcattccgtttatttcagttcctacggctccgtcggttgacggttttacttcagccggcgcaccgctgattttaaaaggaaagaaacagacggttcaaacgacagcgccgatcgcgctttttgccgatttggagctcttgtgtcaagcgccgcagaacatggtagccgcaggttttggcgatatgctcggcaaggtgacgtcgcttgcggattgggagatttcccgcttgcttgccggcgagccgtattgtccggccgccagccggctcacgagggaagcgcttgatcaatgtcttgaccgaaaagatgacatcgccgccaagatgcgggatgggattgagaaattgatggaatcgctgatcctttctggcctagtcatgctggttctcgaccattcaaggccggcttccggcggcgagcaccatctttcccactaccttgaaatgaaagcgctggagaacaataagcggcaagtgctccacggtgctaaagtcggctgcagcgcgattatgctgactgacatttaccgatctctta

SEQ ID NO: 92 - DNA, 771 bp, Bacillus licheniformis
  misc_feature (1)...(771): n = A,T,C or G
gatgccccgctcttttgatacgattttgcttttctttttcatgggccgttctttaacggcggcaccggcttcaaccgaaaacattcaagcgatcataaacggaatagaaggcatggtcaacatcagcgtcttcacgcttctgtcgcctctgcttgtgattgtacttgctgtcagacggacgcccgtcattccgtcgcttgcagcagggatcgtttccgccggaatttttgccgcgctgattcagcctgacgccggcatttcatcgtttttgtcagcgatgcagaatggcccggttttctcagccgatactgaagccgttgaaaagattttaaatcgcggcggccttcaatcgatgatgggctctgtttctctcatcatcatcgcattcgcgctcggcggtctcatggaaaagatcggcatgattacaagcctgcttgaaggcgtaatcaagggcattcatacgaaaggccggcttgtgttctcaaccgtttcatcaagcatcggcatgaacctggcgacaggagaacagtatttatcgatcttgattcccggtcagtcctttaaaaagctgtatgacaagcttggaaaagaccggaagcatttgtcgagatcacttgaagacggagggacattaattaatccgatgatcccatggngagtcagcggcgcgttcatgtncacagcgctcggcgttcccgtcatggaatatttgccgtgtgtgtttttcctttatttatcgccgctctttgcgattttgttgggttttcgcaa

SEQ ID NO: 93 - DNA, 735 bp, Bacillus licheniformis
caaccggtacatacaccggccgctcgccaaaagacaaattcattgtggaagaagcgagcacaaaggacaaaatcgattggggcgcagtaaaccagccgatttcagaagccgcctttgaccggctgtacgcaaaagtgctcggctatttaaaggaacgcgatgaattgtatgtatttgaagggtttgcaggagcagacgaaaaataccggcttccgattactgttgtcaacgagttcgcctggcacaacctgtttgcaagacagttgttcatcagacctgaagaacatgataaaaaacctgaagaacagccgtttacgattctttcagctccgcatttcaaagccgatccgctcgttgacggaaccagatctgaaacgtttatcatcgtgtcgtttgagaagcggacgatcttaatcggaggcaccgaatatgccggagagatgaaaaaatcgattttttctattatgaattttcttctgcctgaacaaaacattctaccgatgcactgttcggcaaacattggcgaggaaggcggaactgctctcttcttcggattgtcaggtacaggcaaaacgacgctttccgccgatccgaagcggaagctgatcggcgacgacgaacacggctggtccagcacaggcgttttcaacattgaaggaggctggctacgccaaatgcattaacttaagcgaagaaaaagaaccgcagattttacatgcgatccgcttcggttcc

SEQ ID NO: 94 - DNA, 1047 bp, Bacillus licheniformis
cccgacagcaaaccggcggacagccgaaagctttggcttttactgtgctgcaggcggctgaaaacatcgaccggctcgaagacctgctgccggttgtcaagcagatcggacataaacacaaaagtttgcatgtgaaaccagagcactatcctattgtcggtcagcaccttttggaagcaattgaaatcgtgctcggcgaagctgcgacagaggacattctccaggcatgggcagaagcctatgaagagatcgcccgtgtatttattgaagtcgaaaaacaaatgtatgaggaagacaaaaagcaggatggaaattgggaagggtttaaaccgtttgtcatcatggataaacgagtcgaatccgatacgataacctccttttatttgaagcccgccgatggaacggctttgcccgctttcagccccggacagtacgtatctgtctgcattaaaattccgggcgaaccatatttcttaacaaggcagtacagcttgtcagatgcttggaataaagactactaccgcatttcagtcaaattggaagcggaggaaggccaaccggtgggaaaggtatcaagctatctgcatgagaacatggaaatcggcggcagcttggaagtgagcgctcccgccggagatttcacactttccgaaggaacggatcgtccggtttatttcattagcgccggatcaggcatcacgcctgtcatgagcatggtgcaaacgttggctcaaaaagaaagccgccgcgagatcacattcgtgcatgccgcgaaaactgaacggcatcacgctttcaaggaagaaacggagaagctgctcggcgccaatccggcgaaccgtctcctgttcgtctacagcagaggtgctgaagcgacggaagagcatactgtaaaaggccgggtgaatgaagagcttttgaaatcggtcgtgatagatccaaatggcgaattttatgtatgcggtccgctttcatttatgaaaagcgtgattgaaggattgcaaaaccttggcgtttcgatggaaaacatccgctatgagagctttg

SEQ ID NO: 95 - DNA, 555 bp, Bacillus licheniformis
gcaatattatcggcagcacaatggatcttaaagtcggcagagactttctcgcccttggcataaccctgctgatgtacatatttgttgccaacatgctcggccttccgttttccataacagtaggccacgaattatggtggaaatcccctacggccgatccggcggttactttaaccctcgccgtcatggtagtaggcctcactcattactacggagtgaaaaggaaagggttgggggagtataccaaagatttcttcagaccaattccatatttagtgccgctcaaaatcattgaagaatttgcgaacacattaacattgggattgcgtctttacggtaatattttcgccggcgaaattctgctcggccttcttgccggactggcaaccaacttctattctcaaagcattttcctggggctggttggaaccattggagcggttgtgccgatgatcgtatggcaggcgttcagcttgttcgtaggtacaatccaggcattcatcttcacgatgttaacaatggtttacatgtctcacaaagtaagtcatgaacact

SEQ ID NO: 96 - DNA, 875 bp, Bacillus licheniformis
atgaaaagactagtccgcagcatcttccttataacggccgcaatcgctgcttttggttttggattcagcgggcatgcggaggcggcaagccattcccagccgcagctcaatccgaacaagctactaaatgtcgcgcaccgcggcgcatcggggcatgctcccgagcacacgcttttggcttataagcttggacaaaaaatgaaaggcgattacatagaaatcgatcttcaaatgacaaaagacggccacttggtcgccatgcacgatgagacattggatcgtacgactaatggtacgggttttgtcaaagactatacgctgaaagaaatcaaagagcttgatgcaggctcctggtttaacgaagcatatcctgagcgggcaaaaccggagtacgccgggctgaaagtgcccacccttgaagaaatcatccaaacattcgggagaagcgcgcgctactatatcgaaacaaaatcaccggaagactatgatcatatggaagaaaagctcctggacatcctgaagcaatacaaattgaccggagcagacattcattcaagcaaagtcatcattcaatcttttagtcctgaaagcttaaaaatcattcataacgctaatccaaacattccgctagtgcaattattatggtacgacaaacctgctgccattactgacgccgaattaaaacaatatcaatcttacagcgtcggactcggcatgaactttgaccgcattggccgggcatacgtgcaaaagattcgacgcaccggcatgctggtccatccttatactgtgaataaaaaagaagatatgaagcggctgctcgattggggagcgaccggaatgttcaccaactttccggaccggctgcgcgatgt

SEQ ID NO: 97 - DNA, 606 bp, Bacillus licheniformis
aaatgaacaagtgatcgagacgcggttaagaggatttgaagtccttgcgactcccctgttgaacaaaggggttgccttccctccggaggaaagggatgctctcggcttgacaggattgcttcctcccaaggtgctgacgcttgaagaacaggcaaaacgggcgtataaacagttccaatcacagcctgatgatttgagcaaaaacgtctatttaacggcgcttcatgatcgaaatgaagtgctgttctacaggcttctgaacgaccatatgacagaaatgctgccgattgtctataccccgactgtcggaacggcaatacagcaatacagccatgaatacagaaagccgcgggggctgtttttgtcggttaatgaccctgaaggcatgaaaacggcatttgaaaatctggccgctaaaagaagccggatcgatttgatcgtggccactgatgctgaaggaattctcggaatcggggattggggagtcggcggcatcgccatttcgatcggaaagcttgctgtttatactgcagctgcgggcatcgatcctaacagggtcctgccagtagtcattgatgcggggacgaaccaggaaaggcttctgaa

SEQ ID NO: 98 - DNA, 661 bp, Bacillus licheniformis
atgaatgaagtattgaaaacattgaaagaccatagatcaatccgcagctatacagatgagcccgtgagccctgaacagctggacgacattattcaagccgttcaagccgcgccgaattccattaacggccagcaggtcaccgtgattacggttcaggatgaggaacggaaaaagaaaattgccgaactggccggcggacaggtctggatcgagcaggcccctgttttccttttgttctgcgcggacttcaaccgtgcgaaaatcgcccttgagaaaaacggcgaaacgcttgcgatcacagacggaatggaatccgtgcttgtcggagctgtcgacgcaggcatcgccctcgggacggccacagcagccgctgaatcgatgggacttggcactgtgccgatcggcgcggtccgcggccgtgcagaagagttgatcaaactgctcaatattcctgaatacgtcttccctgtcgcaggacttgtcgtcggccatccggcggaccgctccgccaaaaagccgcgcctcccggcaacaggcggtaaggcacaaggaaacgtatcaacctgatttaaaaccgctgatccgacgcgtacgatgaaagaaatatccgaatacatgacaaaacggactaacggacaggaaacaagaaactggtctcagg

SEQ ID NO: 99 - DNA, 1186 bp, Bacillus licheniformis
atgttatacacaattataaaagaaaacacctatcaagattctatcgtgttaatgcttttatcaaacaagttatctgcaatagatggtataaacaaagtttctatcatgatgggaacaccagctaacaaagacatttttaaatcttcgggtttgggcacagatgaattggaaaaagcaaacccaaatgatatcgtcatcgttatagatacaaaccaagaagaaaaggtatcggaagtgaaagaagaagtagaagcagctttaaaaggagactctgcttcacaagacagagctaaagaccaagaagcacataactggaagcgtgcaatggagcttgcgaacaaccctaatctggcattgatctccattcctggtcagtatgcagcaatggaagcggaaaatgcattgaatgaagggttacatgtatttctattcagcgacaatgtatctaaagaagatgaggttaagttgaaacaaaaggcgcatgaaaaaggattattagtcatgggaccagactgcggtactggaattattcacggcgtgccactggcatttacaaatatcgtgaataaaggagatattggcgttgtgggtgcatcaggtacagggattcaggaagtgacatgcatcattgaccgtcttggtaaaggtgtaacaaacgcaattggtacaggtggtcgggatttatcaacagaggttggtgctaccatggttttagatagtatcaaagcattaaatcaagatccacaagtaaaagtgattacagtaatttctaaaccgcctgcaaaggaagtgcagcaaaaagtattaaatgtgttaagaaatattgaaaaaccggttgttacgttatttttaggagataaaccaacttatcaggaagaaaatatttatcatgcgtatacacttgaagaagcagcggttgtatctgttcaattatccaatggcgacaaaccgaattttaaaccgacagtggctgaaaatgtaaacgtgtcgttaaaagattcacaagttggtattaaaggttattactcgggcggcaccttggcatctgaagcagctgtgttagtgaaagaggcattcaaagaagaagtacctgaagagaagaaaggtgcctatattctaaaaacaaaacatcatgaaattattgacttaggcgatgatatttatacccaggggaatgccacacccg

SEQ ID NO: 100 - DNA, 851 bp, Bacillus licheniformis
ttggcctcattacgggatattaaatccaggattgcttcaaataaaaaaatgagtcaaattacgaaagcccaggaaatggtttctgcttcaaagctgaaccgggctgaaaacaaagcgaaatcgtttgttccttatatggaaaaaatgcaggaagtcgttgccgatatcgcagtcggatacaccggcaaacacccgatgatgtcaagccgcccagtgaagcggaccgggtaccttgtcatcacagctgaccgcggcttggcgggggcgttcaatgcaaacgtactccgcaaagcgtatcaaaggattcaggaacgccatcaatccaaagatgagtatgcggtcatcgcggtcggaagaatggggcgcgatttctttaaaaagcgcggaattcctgtcatttctgaaatgacggggatcagggacgaagtgacgttttcagaaatcaaagatttggcgaacagcacggtgcaaatgtatattgacgaaacctttgatgaactgtatctgttctacaaccattttgtcagcgcgatttcccaggaggtaacggagaaaaagctgctgcctttgacagatattgcgcctaacaagaaaaagacgtcatttgagtttgaaccggatgaagaagagattctggaagtgctccttccccagtatgcggaaagcttgatttttggcgcgcttcttgacagcaaagcgagcgaacatgctgcgagaatgacggcgatgagaaatgcgacagacaatgcaaaagagattatcgccgatcttgaactgtcatacaaccgtgcccgtcaggcatccatcacgcaggaaattacggaaattgtcggcggtgcagctgctttaga

SEQ ID NO: 101 - DNA, 1668 bp, Bacillus licheniformis
aaacggaatcgtcggcgggggatttcctttggcctgcggagcagctctcactgcaaagtataaaaagactaaaaatgtaagcgtttgcttttttggcgacggcgccaacaaccaggggacatttcacgaagggatcaaccttgccgccatctggaagctccctgtcatatttgtcgccgaaaacaacgggtatggcgaagcgactccgttttcctatgcgtcaagctgcgagtcgatcgcagatcgtgcggccgcttatgggattccgggcgttcgcgttgatggaaaagatgcggccgcggtcttccaggctgcgggccgggcgatagagcgtgccaaaaacggagaaggaccgacgctcattgagtgtatgacataccggaactacggccattttgaaggagatgcccagcgctacaaaacaaatgaagaaaaagcggtgcatcaggaagaaaaagatgccattgccgtgttcaaaagcgaactgctggcaaaagggctgatgagtgaagaagagcagtcgcggattgaaaaagaagttgaagaagcggtcgaggaagcggtcgcattcagcgaaaaaagcgcttatccggaagaaaccgaactgctgacggatgtatatgtatcctattaattcatgaagggggaaggaaacatgacgagggaaatcagcatgtcagccgcattgaatgaagcgatcaaacttgcgatgagaagggacgatcacgtcattttaatgggggaagatgtcgcaggaggagcgaatgtcgatcatctgcaggatgatgaagcatggggcggtgtgctcggcgtcacgaaagggattgttcaggaatttggacgggagcgcgtccttgatacgccgatcagtgaagcggggtacatcggcgcagccatggctgctgcttcaaccggtttaaggccgatcgcggaattgatgtttaacgattttatcggaacatgtttggaccaggtgctgaaccagggagcgaaattccgctacatgtttggcggcaaagcggaagttccgattacgatccggacgacccacggcgccggctttagggcggccgcccagcattcgcaaagcttgtatgccctatttacaagcattcccggactgaaagtgattgtgccgtcgaccccgtacgacgcaaaaggattattgctcgctgcgattgaagatcaggacccggttatcttttttgaagacaaaacgctgtacaacatgacaggcgatgtgccggaagaatattacacgcttccaatcggaaaagcagatatcaagcggaaaggcgccgatgtaacgattgttgcaatcggcaaacaggttcatacggcgcttcaagcggcggaacagctctcagcgcggggaatcgaagccgaaatccttgatccgcgaagcctttcgccgcttgatgaagaggccgtccttgcatccgtagaaaaaacaaacaggcttgtgatcgtcgatgaggccaatccgagatgcagcatcgccgcggatatcgcatcattggcggcagataaaggatttgattcgcttgacgcaccggttaaaaaggtgacggctccgcatacgccggtgccattttcaccgcctcttgaagacctgtatttgccgacgccggaaaaagtcgtgaacaccgtgcttgagatgctcggaga

SEQ ID NO: 102 - DNA, 2220 bp, Bacillus licheniformis
gccggatcccacgaaagaacggattaaaatttctccggctgcgcgcaaaattgcgcaaagcgcaaatatagacatcaaaacgctgaagggcacaggccccggggggagaattacgaaagcggatgtgttgcaggcgcttcccggccggccgaacaagcaggcggctaaggctgaagctgaagagcggccgccggcaagcccgatgaggaaaacgatagccgcaagaatgacggaaagcctgcaaaacagcgcccagctgacgattacgatgaaggcggacatcacgaaattaacagtcctgcaaaaacagcttaatgaaaccgctcaatcaagatacgatacgaagctgacgatcactgattttgccgccagggcagctgttttttcgcttttggatcatccggccatgaacagtgtttatcaagacggaaggcttgcgacctttgagcatgttcatttaggagtggcggccgctttggacgaaggcctggccgttcccgtcatccgccatgccgagcggctcccgctgatcgaattggccaagaaaatcaaatggtacgccaaaaaagcgcgggaaggccggcttctacacgatgaaatagaaggatcgacatttacgattacaaacctcggcgcatatggtgtcgagcactttaccccgatcttgaatccgccggaaaccgggatactcggagtcggccaaatgtattcggcacccgtttatcaagacggagaactgacaaagggcgccattctgccgctcagtctgacttttgatcaccgcgcgcttgatggtgcgcctgctgcagcattcctttcagatgtgaaaaactatttggaagatccggcatcaattcttttatagagagaaggtggatagactgtgacacttgcaattataggagggggacctgcgggttacgtggcggcgattacagcggccaaaaatagcagagaagtcatcctgattgaagatggttccctcggaggaacgtgtttaaatgaaggatgcataccgaccaaagcgcttcttgaaagcgcagatatgttcgagaaaataaaatccgccggcgcattcggaatcgggctgtcaggcgaaagcccgacggttcagtgggaggccgtccaaagccgtaagagagagatcattcagcggctcgccgggggtattgaatatttgatgaataaaaataaaatcaaggttctgcaaggaaaagcatcgtttttgtccgaacacgacatacttgttgaaaaggacggaaaacaggaggtcatcaatgccgggcatgtgattatagcggcaggggcagcacctgccgcactgccttttgcgtcttttgacgggagctggatcatccacagcggagatgccatgtcattgccgtccatccctgaaacgatttttattatcggcggaggaatcatcggctgtgaatttgccagtatatacagcaggctgggagcgaacgtgatcatagccgagcaggcggaacagattctgcctgaggaagatccggatattgccgcctttcttcgcacaagtctcgaggagtccggcgtccgtgttttcacatctgtacaagtggagcgtcttgatcctgccaggcagcgcgtctttctgaaaaatggcgatgacagctttaatattcaagctgatcgatgtctcgtcgccgtcggccgaaagccgaggactgatgatctgaagcttgaccatatcggagtccaatatgacaggaaagggattcatgtcaaccagcatatgcagacaaacatcccgcatatttatgcgtgcggggatatcacaggcggggttcagctggcgcatgccgcttttcacgaaggaaccgtcgccgcatcccatgcctcaggcagagacatgaaggtcaacagtgacattattccgcgctgcatctatacttcgcctgaaatcgcaagcgtcggcttaaatgaaaaaaaggcgagggagcgctacagggatgttcgtatcggagagtttccgttttcttcaaacggaaaagcgcttattttgaatgaaactgccggcaaggtcaaaatcatcatagagccggagtatcaggaaattgtcggggtttcgatcgtgggtccgggagcaaccgaactgatcggccaggcagccgtaatgttgcatgcagagctgacggcagacgcaatggagcacttcatcgcggcccatccgactctttcggaaacgattcacga

SEQ ID NO: 103 - DNA, 414 bp, Bacillus licheniformis
agtgggaaaactatgaccgtgtggtcattggtgcttctattcgctatggtcactaccattcagcgttccaggaatttgtcaaaaaacatgcgacgcggctgaattcgatgccgagcgccttttactccgtgaatctggtggcgcgcaaaccggagaagcgtactccacagaccaacagctacgcgcgcaagtttctgatgaactcgcaatggcgtcccgatcgctgcgcggtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaat

SEQ ID NO: 104 - DNA, 609 bp, Bacillus licheniformis
aagggggaatgtcccgacagctgtgctattaaaagccgttttgaataaagagtacgggcttcgttcctcgcacgtgctgtcacatgtagcagcatttgaagtcagcgggtttgagaggctgatttatgtaacagatgcggcgatgaatatcagccccaagcttgatgagctgaagcagattttagaaaacgcagtcggcgtggcgaggtcggtcggcgtgcaaatgccgaaagtcgcttgtcttgccgcagtggaaacagtgaatcccgcgatggaagcgacattgaatgcagctgccttgacgcagatgaatcatcggggccaaatcaaaaactgcgttgttgacgggcctcttgcattggataacgcgatatcgccgcttgccgcccggcataaaaacatttccgggatcgtagcaggcgaggccgatatcctgcttgttccttcaattgaaacaggcaatgtcctttataaatcattgattcattttgcgggtgcaaaagtgggagccattttagcaggggcaaaagcacccatcgccttgacaagcagggccgattccgcagaaaacaagttgtattcgattgctttggcgctgtgtacgtctga

SEQ ID NO: 105 - DNA, 885 bp, Bacillus licheniformis
tttgaatcggctgcctctgattccaaacaaatttggaaaatgaaggaggaccgccatgatccagtttgactttgagtattacagcccccaatctgcgcaggaagcggtaaagctctttcaaagcctggagcgggaggggaaaaagccggcgtattgttccggcggaacagaacagttgatgctcggacggatgaatgtgatccatacaaatgccgtcatcgatattaaagatatacctgagtgcaggactttgcaatttgaacggcatcaccttgctttaggctcggcgctaacactgacggagatcacggaaaacggcggctttccgctgttgagcaaagcggcgagagaggtggccgaccatacggcgcgcaataagattacgcttggcggcaatatttgcgggcagatcttttaccgcgaagcggtgctgccttttttattaaccgacagcaaagtggtgacagttggagacaaggggaaaaagcgctatctgattcacgacgtatttgatcagcagctgaagctgagcaagggagaaatcctcatttcgcttttgattgaagaacgctatcttcatcagccttttgcaagcataaaagtgaggcagcgatgggatacgggatatcctttggcaacgatttcggctctcgaaatagacggacgcgtccgctgtgcattcagcggtgtctgctcttatccgtttcgctccgctgaagtggaatctgcgttgaatgacgaggcactccctgttggtcaaagggtggaagaggcgatcaaccgcctgcccggtcctgtattggacgatgcgcaaggttccgcagagtaccgcacgtttgtcatcaaacatactctgtttgacattctcggcatgctgaaaaagga

SEQ ID NO: 106 - DNA, 682 bp, Bacillus licheniformis
atggggaaacaaaggcttgttttaataggaaacggcatggcaggggttcgcacggccgaagagatttcactacacggcgggagccggtttgagatcgtcatcatcggcagcgaaccacacccgggctataaccggattctgctgtcttctgtccttcagggagaaacggattggaacgatgtgatgacaaaaagccggagctggtatgaagaaaacgggattaccctttatacaggggaaacggctgtcgcaatcgatacggttaatcaaacggtggcgacagatcaaaaccgcgaaatcgcttatgacaaactgatcattgcgacgggctcttccccgtttatcctcccggttcatggtgcagacaaagaaggggtatatggttttagaacaatagacgattgccgggcattcataaacgcatcaaagcgatttaaaaaagcggccgtcatcggcgggggaatattgggccttgaggcggcgcggggattggcaaacctcgggatgaaggttgatgtggttcaccactcttcctccatcatgcagactcagcttgatccgccggcttctgccatgctccagaaagagctggagcgtcaagggatccattttcttttggagaaagatacagaggcgattttaggaacatcgcgcgccgagggtgtgcggttaaagacgggac

SEQ ID NO: 107 - DNA, 471 bp, Bacillus licheniformis
aggcggttatacaacgtattggccgaccggagaagtgatgtccatttatgatgcctgcatgaagtataaagaagacggcacaggtctggtcgtcattgccggaaaagactacggaatgggttcttcccgcgactgggcggcaaaaggaacaaatctgctcggcatcaaaaccgtcattgcagaaagctttgaaagaattcacagaagcaaccttgtgctgatgggcgttcttccgctgcaatttaaagagggagaaaacgctgaaacgctcggtttgaccgggaaagaaacaattgaagtagacgtgagtgagtcggtgcgcccgcgcgatctcgtccaagtcaaagcgattgccgaagacggcacggtcaagtcgtttgaagctgttgtccgctttgacagcgaagtggaaatcgattattaccgtcacggcggaatcctgcaaatggtgctccgcaataaaatgaaaca

SEQ ID NO: 108 - DNA, 1500 bp, Bacillus licheniformis
gaggatgtttgcagaatatgaatgttcaaactccatcggaaaaactcgtaaaaccttttgactgtcagcactacataaacggcaggtactttccttcagagaaaggcagcacgtttgacaacatcaatccggctacacaggaaattatcggaagcgttgcggaaggaggcaaaaaagaggtcgatcttgcagtcgcggcagccaggcgtgcattaaacggacgctggaaaaacatgaccgctgacgaaaggattcggatcatcagaaaggtcggcgacatcatacttgagcgtaaagacgaactggcgaggcttgagacattggatacgggaaaaccgctttcgctctcaagcactttggatattccacgtgccgctttcaactttcatttctttgcggattttatgagaggagccggaacggaagcttatcaaactgacgatcttgcaatcaattatgcgattcgccgtccggtcggcgtcgtcgggctgatcaatccgtggaacttgccgcttcttttgctgacgtggaaattggcgccttgcctggcggcgggaaatacagccgttatcaaaccggctgaactgacgccgatgacagccacccttctcggggaaatctgccatgatgcagggatgcctgacggagtcgtttaatatcgtccacggatttggaccagattccgccggtgctgcgctttctgagcatcccgatgtcgatgcgatatctttcaccggagaaacgacaaccggcaaagtcattatggaagctgcttcgaaaacattaaagaaactttcctttgaattgggagggaagaacccgaaacattatttttgccgatgccgacatggatgaagccgtcagcacctcattgaaatcgagtttccgtcaaccagggggaagtatgtatgagcggctcccgcatctatgtcgagagggaagcgtatgacgaatttctgaactagttcgttgagcacacgaaaaagctcaaagtcggcgatctttttgatccggacacgaatatcggcgctttgatttcttctgaacacacagagcgtgtgatgaactacatcgaattggccaaacgggaaggcggcaatattttaaccggaggaaaacgccatgaaggacaggaatccggctgctttcttgaaccgacgattatcaccggactttcacgcaattccaggctcatcaaagaagaaatcttcggtccggtcgtaacggtgattccgttcgacgatgaggaggaagtgattgcacaggctaacgacacacattacgggttaagcgcgaccttatggacgaacgacctccgccgggcgcaccgcgtagccgggcaaatcgaatcgggcatggtgtgggtcaacagctggtttctccgcgatcttcggacgccgtttggcggcatgaaacagagcggactcggacgagaaggaggcattcacagcctcgaattcttcagcgaattaaccaatatttgcatcaagctgtaaaagg

SEQ ID NO: 109 - DNA, 867 bp, Bacillus licheniformis
cagaagttaagaaactatattatgggagaatgggtttgaagcaaacccgccaatatgaagatgtagtcaatccagcgacgaaagaagtgctgtgccaagtgccgatttcgacgcgagaggatatagaatacgcagcgcaaacagcggctgaagcgtttaaaacatggtcaaaagtggctgttcggcgccgggcaagaattctatttaactttcagcagcttttaactcagcataaagaggagcttgcccacctcatcacgattgaaaacggaaaaaacacgaaagaagcgttgggtgaagttggacgcggcatcgagaatgtcgagtttgcagctggagcgccttcactgatgatgggagattcacttgctacaattgcaaccgatgttgaagcggcgaactaccggtacccgatcggagtcgtcggcggaattgcaccatttaacttcccgatgatggtaccatgctggatgttcccaatggccattgcgttaggaaacacatttattctgaagccttccgaacggacgccgcttttgacggaaaagctagttgaactgtttgaaaaagccggacttccaaaaggggtcttcaatgtggtatacggcgcacatgatgtagtaaacggcattctcgaacacccggaaattaaagcgatttcattcgtcggttcaaaaccggtcggagaatatgtctataaaaaaggaagcgaaaatctgaaacgcgttcaatcgctgacaggcgctaaaaaccacaccatcgttctgaacgatgccaaccttgaagatacggtaacaaatattatcggcgctgctttcggatctgccggcgaacgctgcatggcatgcgcagtattaacggttgaat

SEQ ID NO: 110 - DNA, 540 bp, Bacillus licheniformis
agcttaatgaaatatttgaaattgtaaaattggctccctctgcttttaatttgcagcatacaaactatattgcggtgttggataaagaaaagaagaacatgttgcatgaagcagctaatggccaatacaagatcctaagctcgtcggcagtcatcatcgttttgggtgacaaaaaggcctttcatcaagcaaaagaaatctacgaaggtttaaaactgctcggagtacttaataaacaagaatatgatgatatggttcacgatacggtttctttctatcaatccagaggagaagcatttcaaagggatgaagccatcaggaatggctcattatcttctatgctctttatgatggctgctaaagaaaaaggttgggatacttgtcccatgattggctttgatcctcaaaaggtaaaagaggtattgaatataaatgagcaatatgaggtcgtcatgatgatcacccttgggaaggaaaaattagaaagcagaaaaccgcggggatttagaaaacctgtaaatgaatttgtaacctatatct

SEQ ID NO: 111 - DNA, 582 bp, Bacillus licheniformis
  misc_feature (1)...(582): n = A,T,C or G
aataacagctgaaagcaaccaatattgcaaaccgctatctttctccgacctgggaagtaaccaatgttttcatcgtcggaatcgtcgtagcccttttcagctttttcccgggcggcacttttgtgctggggactgtgcttttgattcccggcagcatcattttattgcttttggcgattcgaagcggatttttggtcttctcccacgctgcaaaagattatgaaagggcgctgactaacgtttcagggatcagcggctttatcattccggctgttttaatccttgtcttgcctgtgacacacggcaatttcgtataccaggtagacggaagccaccaattggactttgtcaatttgtttttaagccctcatgcctattcttttatgggcttcgccattttcagtacgctgtttctgtcttcactgctgctggctgatttttcaaatgtagccggagaaaaagacgcgtatcaggtctaccgccgaaacgctttaattaccgggccgctcgcactgctcatgtcgttcagcatcatgatgacccatgagacggaagccagctggctntatacactaaatgatg

SEQ ID NO: 112 - DNA, 447 bp, Bacillus licheniformis
atgtcttttaatgtgaacttggatacactgtatcgccaggtgattatggatcactataaaaacccgagaaataaaggggttttgaatgacagcatcgtcgttgacatgaacaacccgacatgcggtgaccggatcaggctgacgatgaagataacggacggtaaagtagaagatgcaaaatttgaaggcgaaggatgctcaatctcaatggcttctgcgtctatgatgacacaggcgatcaaagggaaagacgtggagaccgcccttcaaatgtcacggatcttttcagatatgatgcagggcaaagactacgacgattcgattgatttaggagatattgaagctctgcaaggcgtttcaaaatttccggcccgaattaaatgcgcaacattgtcatggaaagccctcgaaaaaggcgtttccaaagaaaacagcgataacgaataa

SEQ ID NO: 113 - DNA, 471 bp, Bacillus licheniformis
tggcgtatgcgccgtatgccgatttgatctggtgtgaaacgtctgagccgaatattgaagaagcccgccggtttgcacaggcgatccatgaaaaattcccgggcaaactgctcgcctacaactgttccccttcgttcaactggaaggccaaactggatgacaacacgatcttgaacttccagaaacagctcagtgaaatgggctataaatttcaatttgtcacactggcgggcttccacgccttaaatcacggcatgtttgaattggcccgccaatataagcaccgcggaatggcggcgtactctgatctgcagcaggccgagtttgccagcgaagtccacggctatacggcgacaaggcatcagcgcgaagtcggaacgagctactttgatgaagtcgcccaggttgtgacaggcgggacttcatcaaccactgcactgaagggatcgactgaagcggaacagtttcaat

SEQ ID NO: 114 - DNA, 1149 bp, Bacillus licheniformis
aaacgtatttcaactttatcaacggccgctgggtgaaggctgaatcgggcgggatggaacagagcttgaatccggcagatacacgggatatcgtcgggcttgtgcaaaaatcttcgattgaggatgtagaccgggcagttgaagcggccaagcaggccaaaaaggcgtggagaaagctgtcgggcgcggagcgcggtcaattcctttacaaggccgctgacatcatggaacagcgcctcgatgaaattgccgaatgtgcgacgcgtgaaatgggcaaaacactgcctgaagcaaaaggcgaaacagcgcggggaatcgcgattctcagatactatgccggagaggggctgcggaaaacaggtgatgtgattccgtcgaccgattcatccgcttttatgtacacagacagggtgccgctcggcgtcgtcggcgtcatctcaccgtggaatttccctgttgccatcccgatttggaaaatggcgcctgctcttatttatggaaatacggttgtcattaagccggctacggaaaccgcagtcacctgccttaaggttatatcgtgctttgaagaagcagggattccctcaggcgtggtcaattctgtgacaggacctggatcatcggccggccaaaggcttgccgagcacccggatgtgaacggaattacgttcacaggatcgaatcaaacaggaaaaatcatcggccggacggcgtttgaaagaggggcgaagtaccagcttgagatgggcggcaaaaacccggtgatcgtagcggatgacgccgaccttgatattgcggttgaagcggtcatcagcggagcgttcaggtcaacagggccaaaagtgtacagcgacaagccgcgtcatcgtcttaaatggtgttatgaccgttttaaagaaaagctgcttcaacagacaaaagagattacaatcggcgacagcttaaaagaagatgtctggatggggccgattgcgaacaaacagcagcttgacaactgcctgtcctatattgcaaaaggaaagcaagaaggcgcggacctcattttcggcggtgagaggctggcagatggaaaatacgaaaacggctattatatcaggccggccatttttgacaacgtcacttccggcatgacgattgcccaggagaaat

SEQ ID NO: 115 - DNA, 713 bp, Bacillus licheniformis
atgaaagtatcactgtttatcacgtgtttggttgacatgtttcagtcaaatgtcggaaaagcgactgttgaactgctggagcggctcggatgtgaagtggattttcccgaagggcagatctgctgcggccagcctgcgtacaacagcggctatgtcaaagattccaaaaaagcgatgagacggatgattgagacgtttgaatcagctgaatacgtcgtcagcccttcaggatcgtgcgcttttatgttcaaagagtacccgcaccttttccgggatgaaccggcctgggcggaaaaagcgcagcggctggctgacaaaacgtatgagctgaccgattttatcgtcaacgtattgaagattgaggacgtcggggcgacactcgagaaaaaggcgacttatcatacgtcatgccatatgacaaggcttttgggagtcacggacgcgccgatgaagctgcttcggcatgtgaagggactggagttcacgccgctgccgcgcaaacacgactgctgcggattcgggggcactttctcggtgaagatgtcgcaaatatccgaacagatggtcgatgagaaagtggcgtgtgtcgaagaaacagccgccgacgtgttaatcggggcggactgcggctgcttgatgaatatcggcgggcggatcgggagaaagaacaagccgattgaagtcatgcatatcgcagaagtgctgcacagcag

SEQ ID NO: 116 - DNA, 1137 bp, Bacillus licheniformis
atcattttcgaacggccgcccgaattgaggctggtccacattcactcaatttgctcggcgattacttagatcaaattggattgaatcagattcgttcggtgtttattttaactcagccgtcgatcgtctctctcggctatgcagaccaaattaaagaagggcttgcaaagaaaggcatctcaagtgaagtcaacacggatatacagcctgagccgacggagcaaaatatcgaacaggtttttcagcttttttctgaaggaggccatgacgcgattttgggaattggcggaggcagtgtgcttgatgcggctaaaatcctctctgttctgaaaacaaatgaaaaaccgatttctgctttgattggcacgaatctcgttgaaaagcccggcgttccgcttgtgctgattccgacaacatccggaacagggtcagaagtgacgccgaatgcgattgtaacgttccctgagaaagaattaaagattggtatagtcagtccctatctgctgccgtcgcttgtgattttagatccagttttgacgaccggacttccaaaggcaatcacagctgcaaccggaatggatgcatttacacacgcactcgaatcctatatttccaacaaagcaaatccattcagcgacatgtttgcgcttgaatctatgagactgatttcctccagcattcagcaggcctaccatcatggagataacctggaggcgagagaaaaaatgctcattggcgccatgtatggcggaatggccttgacaagcgcaggaacagcggcggttcatgcgatggcttaccctctagggggaaaatacaagatttcgcacggtgtggccaattcaatgctgcttccgcatgtaacggccttcaacgcggatcatgtaactgaccgcctttcggacgtggccggcgtaattggaatcgagccaaaaggttcgaagtccagccaagcagagcgggttatacgaaaaattgaatagtggaccgccgatttaaatattccgcaaaatttaaagacattcggggtatcaaaagaggatgtgccatcgcttgctgaggcggctgccgacgtcaaaaggctcatggataacaatccaaagccgatgtctgttgcggagattgaagctgtctatt

SEQ ID NO: 117 - DNA, 456 bp, Bacillus licheniformis
ctttagacaatttggccgacaaccgctttgacaccgtcgtaaaagggctgaatgactttccaagggatgagtggcctcccctgttcattcataccttatttaacggcatggtttttatcggcagccttttgattgtttatgccgctgtgggttttatttggagaaaagtcatgaaaaaagaccgctttccccgctggatgctggccgtgttcataaccggcggcccgctcgcattgctcgcaatcgaacttggctgggtattcgcttgcaccggaaggcagccttgggtcatttaccatatgcagaaaacgtcggaagtagtgaccacctccggctcgatcggcatattgtttcttttgttctttatcgtctatatcattttaggagcagcggtggtgttcgtattgcaatattactttaaacgccatcctgttgaagaggacttaaaaagcagct

SEQ ID NO: 118 - DNA, 420 bp, Bacillus licheniformis
atttatttcacttcattaacattttaagaaagaaggtaattagtgtgaacaacatgagaagaacgaaggaaggacatttggagacttctttgcggggtaaagacgttctttccattccaacgctaaataaaggtgttgcattttctcttgaagaaagaaagaacctcggtctagaagggcttctgccgccgactgttctcagccttgatcagcaggcagaacgggcttacgaacaattttcccgtcaacctgacagacttcgccaaaacgtatatttgaacgatctgcaaaacagaaacgaagtgcttttctataaattattgcaaaaccacctgcgtgaaatgcttccggttgtctatacgcctactgtcggcgaagcgattcaggaatacagccacgaataccgcagaccgcacgggc

SEQ ID NO: 119 - DNA, 1209 bp, Bacillus licheniformis
atgactttaaatatgaaagtagaagcgatgaacaaattccacacgtttgaaatccctaccgtcattaagcacggaatcggagccgttaaacatgtgggggaagaagtgaaaaagcttggcgtttcaaaagcgctgcttgtcacagaccctggcatctacaaagccggtgtaacaaacccggtcgttgtatcccttcaggaagcaggcgtagaagttgccgtctttaataaagtcgagccgaatccgcctgtccgtcttgtcgctgaaggttccaaactgtatgctgaagaaaactgcgacggccttgtcgcggtcggcggcggaagctcaatggatacggcgaaagcgatcggagttgaagccactcatgaaggctcagtccttgactatgaagcggcagaaggaaaaaagccgcttgaaaaccggattcctccgcttacaacgatcccgacgactgccggaaccggctcagaagttacacaatgggcggttatcacagatgaagagcgcgaatttaaattcaatacgggcggcccgctgattgctgctcatttgacaattatcgatcctgaattgcatgtatcaatgcctccgcacgtaacagcgatgaccggcgttgacgctttggctcatgccatcgagtgctatacgatgaaatttgcccagccgattactgacgcggtggcccttcttgcgatcgaatacggcgcacattacatccgcagagcgtttgccgatggagaagatcttgaagcgagatacggcatggcgcaggcggccatgcttgcaggcctttcttacggaagcgaatccgcaggcgctgctcacgcgatgagccagacgctcggagggatcatccctgtcgcgcacggccaatgtgtggcggcgatgatgggccctgtaatggaatacaactggaaaggctaccctgaaaaatttgcccgcattgcaaaagcgttcggaattgacacaagcggcatgtctgcagttgaagcggctaaagctgcggtgaactggatgtatcagcttgtggaagacttagagattcctagtcttgaagagcaaggcgtatcacctgacatgatcgaccgcctttcaaaagaagcgatgaaagatccgcaaacggtcggtaaccctagagacctgaacgaaaaagcgtacaattggatttacaaacgctgcttcaatttaaccccgaaaactgtctga

SEQ ID NO: 120 - DNA, 551 bp, Bacillus licheniformis
atgacgaaaatatttgcacacagaggggcttcaggcacttttcccgaaaatacaatggcggcgtttaagcatgcggcggccattggtgccgacggcatcgaattggatgttcaaatggcaaaagacggacgtcttgttgtcattcatgatgaaaagcttgacaggacgacttcactgaaagggtatgtgaaagatcttacatatgaggaaataaaacatggagacgcaagccaccgttttgccgaaaaaaccggttctgtccctgtgccgacccttgaagaagtgtttgagtgggcggcagatgctgaatttcttcttaatgttgaattgaaaaacagcattatccgctatgaagggatggaagaaaaagtgatgtcgatgattgaagcgtacgaccttcaagaccggatcattctttcatcattcaatcatgaaagccttgcgttatgccacagactgaatccaagtattgaattggctgcgctttacatggatgtcatctacaagccggaggaatacattgagatgattccggcttcaggatttcatcc

SEQ ID NO: 121 - DNA, 624 bp, Bacillus licheniformis
ctacacgggaaaaaactagagcggcttacccgattgacgcgattgacaacatcgtcaagccgagcatcgcagcgcacccgcagaccatcgtatttttgaccgcagatgctttcggcgtgcttcctccgatcagcaagttaacgaaagaacaagccatgtatcatttcctgagcggatatacaagcaagctcgccggcaccgaacgcgggatcaccactcctgaagccacattctcgacctgcttcggttcaccgttcctcccgcttccggcacatgtgtacgctgaaatgctcggaagaaaaatcgatgagcacggggtcggcgtctttctcgtcaatacaggctggaccggcggcggatacggaaccggggaaagaatgagcctcgcatatacgagagcgatggttcaggccgcaatagaaggagaactggataaagccgaaatgaggactgaccgcattttcggacttcattcacctgtccacgttccgggtgtgcctgatcaagtgcttgacccggccaaaacttggacagatgaaaacgaatacgaggaaaaagcgatccacctggcgaaagcattcaaacagaatttcaaaaagttctccaatacggaaaacatcgaaa

SEQ ID NO: 122 - DNA, 1257 bp, Bacillus licheniformis
ccgccatgcgttcccacattaaacgaagcttacgttcaattgaagaaacgctcgaacgttcatactaatccgccgaacagccaatgccattctcacagcacgtttttgacacaaatgttaaaaaacgaataagaggtggaaaaatgggcaaacaaggtgtatttaaaccgggattagaaggcgttattgctggagaaacgaacatttctttcttagatacggaagcggaacaaatcgtcattaaaggctatgatttaatcgaacttgcagaacaaaaaacatatcttgacctcgtctatcttctccttcaagataagctgccagatccaatggaattgaaaggaattgaaagcgctttaaaaagtgcgtatgaactgcccggcggaatctatactattctgaagtcgcttccgaataatacccatccgatggatgcgctccgaaccgggatttccgctttagcaggatatgatcccgaattgaatgacagatctcaagcagcaaacagaagcaaagcgctgcgcttgatcgcacaggttccgaatattaccgccaacagctaccgcatccttcaccagaaaaacgtcatcacgcctgacaaacagctttcattcagccagaactttttatatatgctgacggaaaaagaaccgactccccaagaaacagccgtctttgatcagacattaatgctttacagcgagcacgaaatgccgaactccacatttgccgcaagagtcatcgcatcgacaaacacagatatatacggtgctttcacaggcgctgcagcatcgctaaaaggacatttgcacggcggtgcgaatgaagcggtcatgtacatgctgctcgaaggagaaacaaaatcgggcttctgcaagctgattgaacataagttaagcagaaaagaaaaaatcatgggctttgggcaccgcgtctatatgagaaaaatggacccgcgcgcagccttgctgaaaaaggcgctctattcgctttctcataaaaccggcagacaggatttatatgagatgtgcgatgccggcgaaaagctgatgcgcgaagaaaaaggcctgtatccgaacctcgactactatgcggctccagtctattacctgctcggcataccgatcgatctctatactccgatatttttcgcggcacggtcggtcggtcttagcgcgcatgtcattgaacagcatgaagacaacaggctgttccgcccgagagttcactatacgggaccgcgtcatcttcatccat

SEQ ID NO: 123 - DNA, 536 bp, Bacillus licheniformis
atggatggaacagacaaacaaaccgtttttgccgctctttcttacctcctctcctaccctgatgaagagtggagaaaagaacgttccgaatggcagcagatcatcggcgaaatcgagcatgaagcgctgaaaggacatctgcttgccttcttggaaagcgcggcttcctattcgtctgaggaattgattgaaacatacgtatatacgtttgatttcggcaaaaaaacaaacctttatgtcacctatttcaactccggcgaacaaagggagcgcggtattgaattgctgcagctgaaagatctgtatcagcagtccggttttcagccgacagataaagagctgccggattatctgccgctcatgcttgaatttgccgcagttgcggatcaagaaaaagctgctgctgttttccaaaaatacgcagcaaacctggaagaattgagatcgcagctttcagagaatgaaagcatctatacaccgttattggacggattaatgctgatcttagaggaaattggtgttgaaaggaatgtaca

SEQ ID NO: 124 - DNA, 1167 bp, Bacillus licheniformis
atgccagcgaattatcaatttcggacagccggtcatatcgttgcaggtgaacattccatccgccggctgaaagatcatgtgcgaacgattgtaccgaaggcggacagggcgctgattattacccagccgtcgatcgtcaagctcggcgcgatcggagaggtacaggctcagcttacagagatcggcattcagtcagatgtttgcacagccatattgccggaaccgaccgtacaaaatattgaagacgtatttagaggcatccgtgagaaacgatacgacattctcatcggaatcggcggaggcagcgttttggacggaacgaaaatattgtccgtgctgcaaacgaattcaaaaaaggtcgaggagctgctcgggacagatttggtcgaaaagccgggaatcccgaccgtgctgattccgagtacttcggggacgggcgcagaggtgacgccgaacgcgatcgttacgcttccagaagaggaattgaaagtcggcatcgtcagtccgcttcttttgccgaaacttgtcattcttgacccggtcatcacccttggattgccaaaaccgattacggcggctaccggaatggatgcattcactcattcgcttgaatcgttcatttcgacgaaagcaaacccgatcagcgatatgttcgctttagaatccatcagattgatttcggcaagtattgtggaagcatatgaaaacggttcatcgatacaagcgagagaaaacatgctgctcggttcgacgtatggcggaatggcgctgacggctgccggtactgctgccgttcacgccctcgcctatccgcttggggggaaataccgaatttcccacggtgtcgccaattcgatgctccttccgcatgtgatggagtttaatatggatgccattacagaacggctgtctcttgcggcagaaacaatgggaatcgttgcatctgatttgaccgccgaacaagcggctgaggccgttgtgcagaaaataagagagtggacggagcggctgaatattcctcaggatttaaaagcgttcggcgtaaccgcaagcgacgtggacgatttagccgactcagcttcaaaagtgacgcgcctgcttcataacaatccgaaaccgctcagtctggaaaatataaaagacatctatcgaaaactaatcaactaa

SEQ ID NO: 125 - DNA, 1008 bp, Bacillus licheniformis
ggcagctaatgaaagataaattagtgaaagcaggtttacctgaagaacaagcggataaaacagctgatttactcatttttgcagatgaacgaggtgttcactcacatggtgcagtaagaatgcaatactattccgaacgtgcattaaaaggtggatataacctgaaaccaaacttaagcttcgaaaaaacgggccctgcatcggggatttatcacggagataatgcattagggcattatgtgagttatcaagcaatgaaaaaggcaatcgaattagcaaaaacatcagggatcggtgttgtcggtgttaaagaaatgggacacagcggtgctattggttattatgcacatcaagcagcattagaaggtatggcggcattaacagtatgtcaatctgatcccatggtcgtgccatttggcggcaccgaaccatactttggcaccaactcaattgcttttagtgcgcctagaaaagacggtagtccaatcctttttgatatggcaacaacggtacaagcctgggggaaaatcttagatgcaagaagtaaaaacaaatctatcccagactcatgggcagtggataaaaatggagcgccaacaacagacccgtttaaggtaaatgcattattaccaatggctgggcctaaaggatacgggttagcgatgatggttgatattttatcggggagtttgctcggcttgccatttggcaagcatgtcacttctatgtataaagatttatcggagtaccgtcgattagggcagcttcatctcgtaatcaatcctgaatactttggtgggaaggagcaattcctcgaaaaaatatctcaaatggttgaagaattacatgacaacccacctgctgaaggatttaacaaagtgtattatcccggtgaaattcaaatagatgtgatgaaacagtataaaaaaacaggtatcccagttacaaaggaaattttagattatttagagtcagacaaaatttactaatcatgtaatgaagggggaa

SEQ ID NO: 126 - DNA, 444 bp, Bacillus licheniformis
aagtgcaggagctcagtaccagcagctttaagccggtctatgaaatgtcaggactttccccatcaatatgacaaagtgacgcgcctcgtccttcaagcggcaaagtttcgattgacatcagcgaccatttcaataaaatggaaggtgaaaaggattggctgcacattgcacgggttgaagagctgtatcctttccctgcaaagcatattaaagcgatcttcagcaaacttccgaatttggaggagatcgtctgggtacaggaagaaccgcaaaatatgggcgcatggaactatatcgagccttatttaagagaggtagctccaaaggacgtgaaggtccgctatattggcagaagaagacgttcaagtccggcagaaggggatccgacggttcataaaaaggaacaggaacgcattgtatctgatagcttgactcgcaaaaatt

SEQ ID NO: 127 - DNA, 1026 bp, Bacillus licheniformis
gtccaaaccaatacgtttgcagagaggggatcgtgaaagaactgccgtcatttgcgaatgcattcgaacgtcctgtcatcatttcaggggttaaatcgtttaaagcttttacacgttatacgacacctccagccgattggaaagtcgttcagcatacgggctgcagttccctaaataagattaaaaaagcagcagaggaagcagaatcagcagacgtcatcataggaataggcgggggaaccgtcttagatacagcgaaggcagccgccgatttgctgaacattgaagtcatgacgattccgacgatcccgggaacatgtgcggcaagcacgccgttaagcgtcatctatgacgatgaaggtaacttttcgggcgtccaatatcagaagcgctccagctatttgacactggtcgatccgctgctgcttctctcttcaccggtcgcttatgtgaaaagcggaatcggcgatacgcttgcgaaatggtatgaggcagaagcgatcatcagaaatacggccgattcgctttctatcatggttcagacagggctgaggcagtctgtctatattcgggatattttgttgacagaaagcctgaaagccatagagagccttgaaaaaggcgaatcctccccagctttcacaaatgtcctcgaagcggtcattgcgctggcaggcacagtaggcggatatgcgggccgctacggcagaatggccggggcccatgccattcacaacggcttgacgttcatccccgaaacccatcgtgtgctgcacggccaaaaggtagcctacgggatactggtgcagcttgctttagaagggcggacagatgaaatagccgaactgattcccttttatgaagggctcggttttccgagaagacttagcgatttgggcattttagaaaatattgaagcggccaaacggatcatcgccgcccatgccgcgcgtccggatgaatctttatgtttgatgggatcttttcatgaagcggatgtgattgcggcgatagagtcgcttgaat

SEQ ID NO: 128 - DNA, 1134 bp, Bacillus licheniformis
atggctgtcgaagtggtcatgccgaaattggggatgtcgatgaaagaaggtacggtttccgtctggaataaaaaagtcggggaagccgttgaaaaaggagaaagcattgccagcatcaattccgaaaaaatcgaaatggaaatcgaatctccggcaaacggaaccgtgttggacatccaagtatctgaaggagagggagtgccgccgggaaccgtcatctgccgcatcggaaatgaaaacgaacaaacgcaggagagccaaacaaaacagccggatcccacgaaagaacggattaaaatttctccggctgcgcgcaaaattgcgcaaagcgcaaatatagacatcaaaacgctgaagggcacaggccccggggggagaattacgaaagcggatgtgttgcaggcgcttcccggccggccgaacaagcaggcggctaaggctgaagctgaagagcggccgccggcaagcccgatgaggaaaacgatagccgcaagaatgacggaaagcctgcaaaacagcgcccagctgacgattacgatgaaggcggacatcacgaaattaacagtcctgcaaaaacagcttaatgaaaccgctcaatcaagatacgatacgaagctgacgatcactgattttgccgccagggcagctgttttttcgcttttggatcatccggccatgaacagtgtttatcaagacggaaggcttgcgacctttgagcatgttcatttaggagtggcggccgctttggacgaaggcctggccgttcccgtcatccgccatgccgagcggctcccgctgatcgaattggccaagaaaatcaaatggtacgccaaaaaagcgcgggaaggccggcttctacacgatgaaatagaaggatcgacatttacgattacaaacctcggcgcatatggtgtcgagcactttaccccgatcttgaatccgccggaaaccgggatactcggagtcggccaaatgtattcggcacccgtttatcaagacggagaactgacaaagggcgccattctgccgctcagtctgacttttgatcaccgcgcgcttgatggtgcgcctgctgcagcattcctttcagatgtgaaaaactatttggaagatccggcatcaattcttttatag

SEQ ID NO: 129 - DNA, 546 bp, Bacillus licheniformis
ttcgcgattgcgtcagaaatagaagaacgattcgaaagtttaaacaggatccggtgccgaaggaagtggtgctggaactcttggaagatgcgatttatgctccgaaccacaagctgacagaaccgtggcgattcatttatatcgggacggaaaacgggaaaaagaagcatgccgacaatttaaaagcggcgtttaaagagctcaagccgaatatgcaggaagaacaaatcaataagttcagggagcatattctcagcgttccggcttttctcttcgttattatgaaagaagacgaaaacgaacgggtcagacgggatgattttgcagccgtcagctgtttaatccaaaatctgcagctgctcgcttgggaaaaaggcatcggcatggtatggaaaagcggggaagttctctctcatgaaacactgcacaggttaatgggactgaagcgcgatgagcaggtagcagctctcttgcagatcggatatcctgcggaaattcctgaagcgaagcacaggacgccggccgcacagctttttaccgaattaa

SEQ ID NO: 130 - DNA, 450 bp, Bacillus licheniformis
aaagatgactccgcaatggcgggaacgggcagcatctttcacaggaaaattgaaagacttttcttccgtcttgttggaactgaacttcgatcagcaatcccttgaactgccggagcaaatcgtcacataccaagattcgtgccatttgcgaaatgtcatgaaaacgtccgctgagccgagacgccttattcgcagcatcaagggcattgaattcaaggaaatgaaaaatgccgaaagctgctgtggatcagccggcatttataacattgtcgaatccgaaatgtcgatgaaaattctcgatactaaaatggaagcagcagcagcgacccgggccgctacgatcgttacggctaatcccggatgtctgctgcaaatgaagctcggcattgaacgagcaggacttacagaccgagtgagagccgttcatctggcggatttattactggaagc

SEQ ID NO: 131 - DNA, 631 bp, Bacillus licheniformis
ttgatgttatcttcattgatcggggtttccatcgggtcagcgctgtttgcaccgaatgcgggtgcacaagagccggcggtgaagcctaaaaaagtggatgtcattgcacacagaggcgcttcgggatatgcgccggaaaacacgatggctgcttttgataaagcgcttcagatgaaagcagattatatcgagctggatgttcaaatgtccaaagacggggagcttgtcatcattcacgatacgaccgtaaaccgtacgacagatattgactcagtgctgccggttgccgtaaaggatttgacgcttgccgagctgcgcaagcttgatgccggcagcttcttcggtccgcagttcgcaggagagcgcattccgacatttgaagaagtgcttgaccggtataaagggaaggtcggaatgctgatcgaattgaaagagcctgcacgctatccgggaatcgaaggaaaagtgtcagcagcattgaaagagcggagaatggataagcctaaaaacggaaaaatcattgtacaatcgtttgattttaactctgtctataaaattcatcagctgcttccatcgatgccgacaggtgtcttgacgtcaaaagcggcggacttaacagatgcaaagcttt

SEQ ID NO: 132 - DNA, 462 bp, Bacillus licheniformis
aacctccatcgaaacgaccgttaccgagcaaaagcaatattttttaagcggggcaacactagctgttgaaaatcgtctggaacagctcaacattctaaaagatgctgtaaaaaagaatgaacggaacatacttgaggcccttcagaaagatcttaataaatcagagcacgaagcctatatgacggaaataggcattgtactggaagaaatccgcttcatcagcagacgattaaaaaaatgggccaaaccgaaaaaggccaaaacggccgtttcgcacatcggttcaaaaagcatcgtcattcctgagccttacggcacggttctgatcatcgcgccatggaactatccgtttcagcttgccgtctcgcccctgatcggcgcacttgctgcggggaataccgccgtcatcaaaccgtctgagcttgctcccgccgtatcaaccgttatagccgagtatgcatc

SEQ ID NO: 133 - DNA, 486 bp, Bacillus licheniformis
tacaatggcaatcgaagaaaagaacatgaaacaaaagcaaaatgcctcaaacatgattgatcagctagtcgaaaaaggcctaaaggcattggaagaattccgcagctttgatcaggagcagattgatgagatcgtcaaacagatggcgcttgccggccttgatcagcacatgcctctcgccaaacttgccgtcgaagaaacgaagcgcggcgtttatgaagataaaatcattaaaaacatgtttgccacagagtatgtctaccatcatatcaaatacgataaaacagtgggcatcatcaatgaaaacgaacacgacggagtcattgaaatcgcggagcctgtcggtgtcatcgccggcgtgacgccggtgaccaaccctacttccaccaccatgttcaagtccctgatatcaattaaaacaagaaatccaatcgtgtttgctttccatccatccgcccaaaaatgcagccgcgaagcggcgagaat

SEQ ID NO: 134 - DNA, 354 bp, Bacillus licheniformis
tataccgacgataacaaagctgacggtaaacggcgaagatgtggaagcggaacgcgacccggagggcgatcttgaagtgatccaaacatcgcttccaatcgtagcgactgcacagcaggggttgaacgagccgcgttatccgtctcttccgggaatcatgaaggcaaagaaaaagcctctcgaggagcttgagcttgatgatctcgacatcgacgaagaagacgtggctgcgaaaacaaaaacgatcgaacggttcctgcctccgaaaaaagaagccgggaaaatccttgaaggggagccggagcagcaggcggcagaacttgtatcactgctgagaagcgaagcaaaggtcgt

SEQ ID NO: 135 - DNA, 583 bp, Bacillus licheniformis
atgaaaaaacaatacgagtctttattcaccccgtttacttttaaaaacggaatccaattgaaaaataggatcatcatgccgccaatggggcattcatcctcattgccgggaggattcatttctgacgacgaactggtctattatgccgcgcgggcgacagaagtcgggatggtcatcacatctgcgacaaccgtacagcccggaaccggatttccaggcatccccggagctgagaacgatgatcaaatccctggactaacccggcttgcagccactttaaagaaacacggagcaaaagcaatcctccagctcttccatcctggagccaaaggtatagagcggacggtcagcgccagcgccgtcgctccgaatcaaccgaatgcaccggtgccgagggcgctgtctgagcaagaaattcaagaccttatccattctttcggccagacggcgcgaagagcgatagaagccgggtttgacggagtcgaaattcacggcgcaaacgggtttctcatccatcagttcttctctccttattacaaccggcgcaatgacggctggggcggcactttagagaaacggatga

SEQ ID NO: 136 - DNA, 993 bp, Bacillus licheniformis
ggtttatattagtcgctgtgctgttcatcggttttttctttcttgagggctttgatttcggcgtcggaatggcgacgcggtttctcgggcgcaacgatcttgaacggagggtgatgatcaatacgatcggtcctttctgggatgcaaatgaagtctggctgctgaccgggggaggcgcgattttcgccgcttttccgaactggtatgccacgatgttcagcggatattacattccgtttgtctttgttcttcttgcattgatcggccgcggggtcgcgtttgaatttagaggaaaagtcgaaaccgcaaaatggaagaatacatgggattgggtcgtatttttcggcagcattctgccgccgtttttgttcggtgtattgtttgcgagcatcctgcgcggcatgccgattgatgccgatatgaatctgcacgccggttttaccgattatgtgaacgtctattccgtgacagggggagtcgccgttacgcttctctgcctgctgcacggcctgatctttattacattgagaacggaagccgatttgcgcgaccgggcaagacagctggccaaaaaagtcgtattcgccgttttggcggcgcttgttgcctttgttgcattatccatttttgaaacggacttgttcacgggcagggggcatgtgacgataccgcttgcggctctgattgtcgtttgctatgtgctgtcgatcgtgtttatgaaacaaaaacgcgacggctggacatttgccatgacgggcgcagggatcgctcttacagtggcgacgattttcactgcgctgttcccgcgcgtcatgatcagctcggtgaaaagcgcatatgacttaaccgtttataatgcttcatcaggcgactattctttaaaggttatgacgatcgtcgcgctggcactgcttccgttcgtgctgggctatcagatctggagctactatgtttttagaaaacgggtcagcagcaaggagccaatgatttatt

SEQ ID NO: 137 - DNA, 854 bp, Bacillus licheniformis
atgttttttgacgatttttcctatcagcagtatgagcattcactgaaaaccgcatttcaacatgttaaagttgaagccgttctgctgccgtccaatctggacatacaggagcttttgaagcgggcattttcgatcgggaattgcgatgtcattattgccatgggcggcgggtatgttgtggactgcggaaaatacatcgccttttccaagcggaccccgttcatcagcattccgacgtcggcatccaatgacgggtttgcgagcagcaattgctcgcttcaggtcgaaggaaaaaaaacaaccgttccggcaagggttccctacggaatcatagctgatttgagcattattcaaaaagcgccggattgctttattttggcggggatcggagatttgatgtccaatattacggccctttatgattgggagtttgaggagcggcacggggtcggcgatgtaaatgcgtttgcgtcgatgctcagcaagaaagcggtcaacagctttgtccgtacgccgatgcaggatattaaacagccgatcttcttaaaagagcttgtcagttctttgacaatgggcggcatcgctacggaaatcagcggaaacagcgcgccgatcagcggttctgagcacctgatatcccacgccttggacaaaatttcgaaaaaaccgcagatgcacggcattcaagtcggggtagccacctacatcatggcccatgtacaggatcaccgggctgagcggattgaaaaggtgtttacgagaacgggctttttccaatatgtcaaaacgctgaatctgaacaaagatgagtttcgcgaggcgatcaatttgtcgcacactgtcaagcccaaccg

SEQ ID NO: 138 - DNA, 345 bp, Bacillus licheniformis
agcaagagattcttgacgcattccaatttagacatgcgacaaaagaatttgatccggacagaaagatatcagatgaggattttcagttcattttaaaagcgggcagactgtcgccaagctcggtcggcctcgaaccgtggcaatttgtcgtcgtccaaaataaagagctgcgtgaaaaactgcgtcaagtctcatggggtgcacaggggcagcttccgacagccagccatttcgttttgctgctcggacgcacggctaaggaaatgcgacgtgattccggctatgttgcagatcaattaaagcatgtgaaaaaaatgccggaggacatcattgaaaatatgctga

SEQ ID NO: 139 - DNA, 690 bp, Bacillus licheniformis
ttatcgcacatcgcggagcctcggcttacgccccagaaaatacgtttgccgcttttgaaaaagcggtggagctcggggctgattttatcgaactcgacatacagattacaaaggatggaaaacttgccgtcatccacgatgacaaggttgacagaacgacgaacggtaccggtttcgttcgcgagtatacgatgaatgagctcgaacagctggatgcaggaagctggttcggccctgaatatcaaggcgaaaaaatcccttcacttgaagctgttctgaggaagtatcacaataagacgggccttctcatcgaaatcaagtcgtccaaaacccagcccggaatcgaaaaagcggccggacaactgatcagccggtatggccgttcaatgaacacaattgtccagtcgtttgacgccggcgccatgagggcgtttcatcacatgtatccttcgattcagactgccgttttgatcaggccgagatttggattgctgccgcgcggccggctgcggcaaatcgcttcgtttgcccaatacgtcagcctgaaagctacgatgatcagcccttttctgatcaaatcgattcacagctgtgatttgaaggcgctggcttggacggtcaacgggcagaaaacgggaagccgcctcaaaagctggaaaatcgatgggatcattaccgactacccggatt

SEQ ID NO: 140 - DNA, 387 bp, Bacillus licheniformis
tcgtctggaacgcggggaatacagccgaatcaatcgttcgggatctcgatgtggaaaaagatccgcaagggcgcgtcgtcctgacgccgcaccataacctgccgggagacgaacacgtttatgttgtcggcgactgtgcaagcctgcctcacgcgccgagcgcacagctggccgaagcccaggcggaacaaatcgtccaagtgcttgaactgcgctggaaaggcgaacctcttcctgaaacaatgccgaaattcaagctgaaaggcgtcctcgggtcgctcggcaaaaaagccggtttcggtttagttgctgaacggccgttgatcggcagagtgcctcgcctgctgaaatccggcttgctttggatgtataagcatcataacgggt

SEQ ID NO: 141 - DNA, 270 bp, Bacillus licheniformis
cggacaaatcaacggcgcttatcaaaacagcggatttgcaagagacgccgcgtttacaaacgcatctacagcagccatgcagctgatgatcgcagccaaagcaatgggctatgacacatgcgcaatgggcggctttgacaagaaagcatttgtgaaagaattcaacatcgatgaacgctatgtaccggttatgctgatttcggtcggaaagccggtcaaacgtgcgcacaaaagcaatcgtttcgatgtgtctgacgtatctacatggct

SEQ ID NO: 142 - DNA, 273 bp, Bacillus licheniformis
atgcttcaatacagaatcattgtagacggacgcgttcagggcgtgggatttcgctattttgttcaaatggaagcagataaacacaaattgacaggctgggttcgaaaccgcgacgacggcacagttgaaatccgcgccgagggacttgaggaaagcctgaagcaatttttaaaagcaattcaaaaaggaagtccattctcaaaagtaacggatgtaaaagtggaagaaaccaaagaattggacggattccaaaagtttaatatcagctattga

SEQ ID NO: 143 - DNA, 405 bp, Bacillus licheniformis
cacacaaaagtcagcgtttacgattcccgttacgctgagacaagtcagaaaaacgggggcaagccaaaaagtggctgacttcgccgttccgctcctggccaacattcatttgtcaggaagcacaattacactgacaagctgtgcaatgggcgtgatgattctaaacggtcaaacgccgactttttcggtcatgatgccgttcattttaatgcttggcgtcacaatggtcgcagcgcccggtgcaccaggcggtgccgtcatggccgctgccggattgttgcagtcgatgctcggctttaatgaaactagcgtatcgttgatgatcgctctttaccttgcccaggacagcttgggcacagcaacgaacgtaacaggagacggcgctctcaccatgctgattcacag

SEQ ID NO: 144 - DNA, 256 bp, Bacillus licheniformis
atgagtaaagtacttatttttggccacaaaaatccggatacggatacgatttgttcagcgattgcatatgccgaattaaaaaaggagctcggcatggacgcagagcctgtccgcctcggcgaaatcaacggcgaaaccgaatacgcgcttaagaaattcaatgcagaagtaccccgccttgtgaacactgtcgcgaatgaaacagacagcgtgattttggttgaccataatgagcgccagcagagcgtcgatgact

SEQ ID NO: 145 - DNA, 389 bp, Bacillus licheniformis
atgaagaccttaaaagtcaatatcgttactcccgacggcccagtatacgatgcggatatagaaatggtaagcgttagagcagagagcggtgagcttggtattttacccggccatattccgacggttgctccgctaaaaattgctgcagtccgtctgaaaaaagacggtcaaactgagctggttgccgtcagcggggggatagtggaagtccgccctgaccatgtcaccattctggcccagacggcggaaacatctgaacaaattgacaaagaacgcgccttggccgcaaaacggcgtgccgaggaacgtttgcaaaagcaaactccagatgttgacattattcgggcagagcttgctttaaaacgcgcgattaaccggttggatgttgc

SEQ ID NO: 146 - DNA, 624 bp, Bacillus licheniformis
atgcatacagaagagaaattgacggctgaaaccttcccggcttctcctgaaaaagctacgttagaaggaaaaaataaatttatcggcttttggctatttctcgggggagagacggttcttttcgcgtctctcttcgcaacataccttgcgctgaagaattcgaatgcaggggggccgaaaacgaccgagatgttcgacatggggctggtctttcttgcgacaatgctccttttgacgagcagtttgacgagcgtgtatgcgatgtatcatatgaaaaacttcgcttttaaaaagatgcaggtttggctcggaatcaccgttctgctcggtgcaggctttctggcgcttgaaatatatgagttcacgcattacattcacgaatatgggttcaccattcaaagctcggctctcggctccgctttttatacgcttgtcggcacacacggagcacacgttaccttcgggcttctctggattctttctttgatgatcagaaatgcgggccgcggattaagcctttacaacgcgccgaagttttttgtcgcaagcctctactggcattttatcgacgttgtctgggtgtttatctttaccgttgtatacttgatggggatggtgggataa

SEQ ID NO: 147 - DNA, 615 bp, Bacillus licheniformis
atggaacatgcagaacacagcaattctaacgctcctatggaataccgttctgaaatcggaaggttgaatatccttggcttttggatttttcttggagcggagattgctttattctctacgttatttgcgacctatgctgttcttcataacagaacagcgggaggcgtactgccggcagaactgttcgacgcgaagctcgttttaatcatgacgttcctgctgttaacgagcagtttcacatgcggcattgcagtgcatgaaatgcgccgcggcagtttgaaaggcgtgatgatctggatgatcattaccctgttgctcggtgctggctttgtcagctatgagctttatgagttcaatcattatgtacacgaaggtgccactttatcgacaagtgcttactggtcagcattctttgttctattgggaacccacggactgcacgtatcgattggtatcttctggattatcggcatattgcttcagacgaaaaagcgcggcctcaccccgcaaacgtctgctaagctgtttatctcaagtttgtattggcacttcttagacgtggtatggatcttcatctttaccggtgtctatttgatagggttggtgaatgtataa

SEQ ID NO: 148 - DNA, 201 bp, Bacillus licheniformis
aatggtagtcgaaggcgtccgcacgacgaaagcggcttatcagctttcgaagaaatatgatgttataatgccgattacagaagctatccatcaggtcatattcaacgaacaaaaagtggaaaccgctggtgaatgtttaatggcgagagggaaaacccacgagatggaggatttggtaaatacgtttgaaaatcaagtgaa

SEQ ID NO: 149 - DNA, 424 bp, Bacillus licheniformis
ttgtctaaagcattgattgcatatgccagcatgtccggcaacacggaggatatcgctatgatcattaaagatacattgcgagagtacggttttgatgtcaccattcaggaaatggatgatgtcgataccgactcattggctgaatatgatcttcttttaatcggcacctacacatggggggacggggatcttccttatgaagcggaatcgttttacgaagaggtctcttcgcttgaccttaaaggaaagaaagcggcatgcttcggatccggcgattatgcatacccccgattttgcgaagcggtcaacacgttttacaccatgcttgaacgaaccggcgccgacctttatcaagagacactgaaaatagagcttgctcctgaaacagatgaagatgccgagtgctgcaaggaatttgccgaag

SEQ ID NO: 150 - DNA, 221 bp, Bacillus licheniformis
atggggaaagttttgctggtttatgcaagcatgtctggaaatacagaggcgatggccgatttaatcgagaagggccttcttgagggcggggccgaagtggaccgtcatgaagcgatggatgtagatgcggcgctctttaacgattatcagcacatgatatttggcgcctatacttggggcgacggagaacttccggatgagtttttggatatttacgacga

SEQ ID NO: 151 - DNA, 218 bp, Bacillus licheniformis
atggcgacatgggatttaagtaatatgaaacatcatatttttatctgcaacggcagcagctgcaatcgggccggagctgaggaactgactcaagtgattcggcaagaaatctcggaccgggagcttgatgatttcattcatacaacgcgcacgcggtgtaatggaaggtgtcaagataagtgcgtggccatccattacccgagaggaacttggtatag

SEQ ID NO: 152 - DNA, 229 bp, Bacillus licheniformis
atgaacatttatgtcttaatgaagcgcacgtttgatacagaggagaaaattcagatcgaacaaggggaaatcaacacggacggagcggaattcatcatcaatccgtacgatgagtacgccattgaagaagcgctccagttgaaagagaagcacggcggtgaaattacggtcgtgacagtcggcgaggcagaagatgaaaaataaatcagggcggatgtgccagatgggg

SEQ ID NO: 153 - DNA, 555 bp, Bacillus licheniformis
atgagccaatcagctgtctccaaacgctacgcagccgctctgtttgacattgcccttgaatccaagctggtcaatgaaatagaagaagagctgaccgtcgttaagaagatatttattgagcataaagacctcaatgccgttctgggtcatcctaaagtgcccgctgaaaagaaaaagcagattttaaaagactcgttcggatccgtttcgactgcagtcttacatacgctttatcttctcgttgaccgcagccgcacgtcaatcgtcccggatctcgcggacgaatatgtcaaaatggcgaaccggttccgcgggacggaagatgcgatcgtatactctgtaaaaccgctcagcgaagaggaaatttcctctttttctcaagtgtttgcaaaagaagcaggcgccgcttcactgcgcgtcagaaacgaagtgaatccggatctgatcggcggtgtgaaaatccgcatcgggaaccgcatttatgacggcagtgtaagaggaaagcttgaccggatagaacgtcaattagcaggcgaaaatcgaaagaaggggtga

SEQ ID NO: 154 - DNA, 402 bp, Bacillus licheniformis
actggaagagctgtatcggtccgtcattatggatcatgcaagatacaggcgaaattttcgaaaaatcgataaacacggcgtgtattacgtccattacaaaaatccaacatgcggtgatgtgatgactttgtttatcgacattaaaaatgaaaagatcgaagacgcagcttttatcggagatgggtgcagcatcagcatggcttcctcatcaatcatgactgaactgataaaaggaaagacgttaaaagaagccgggttaatgcgtgaagcgatggaaaatatgatcagaaaaggagaagagccggaagaggatctgctgggagatgccgtttccctgattggcgtccatccgttgcgggcccgtcataactgtgccctgatgccttggcaggcgctcgatcg

SEQ ID NO: 155 - DNA, 205 bp, Bacillus licheniformis
atgagtttaatagcagctgcaatcgcaattggattaagtgcacttggtgcaggtattggtaacggacttatcgtatcgcgtacagtagaaggaatcgctcgtcagcctgaagctggaaaagattgagaacccttatgttcatcggggtaacattgggttgaggccctttcgattatcgctgttgttatcgcgttcttagcgtttt

SEQ ID NO: 156 - DNA, 315 bp, Bacillus licheniformis
agcgaagaagctcattgaggagcagcaggcgcttttgaaagaagcacgcgaagaatcccagtctctgattgaaaacgcgaaaaaactgggtgaacagcaaaaggatgaaatcatcaaggctgcgcgccaggaagcagaacgcatgaaagaatcagccagaagcgagatcgtcaaagaaagagaccaggctgtcaccgcgctgcgcgagcaggttgcatcattgtctgtgatgatcgcttctaaagtaatcgaaaaagagctggacgaacaagcccaggaaaaattgatccaagactatcttaaagaagtaggaga

SEQ ID NO: 157 - DNA, 153 bp, Bacillus licheniformis
cactgtcaattctggatgaagctctggaactcggcatcaattacttggatactgccgacctgtacgattttggacgcaacgaacaaattgtcggtgaagcgatcaaatcaaggcgccaagatgtcatcctcgccacaaaagcgggaaaccgct

SEQ ID NO: 158 - DNA, 300 bp, Bacillus licheniformis
gagtaaaaaagataggaggttttttcatatggaagaggcactgacaaaggaaaaagcagtgtggatgtatcaaaaaatgctggaaatccgctatttcgaagatcaggttcatcagctgtttgctaaaggaatactgccgggttttgtccatctttacgccggagaagaagcggtcgctgcgggcgtctgcgctcatctgaatgatgaagacaccatcacgagcacacatcgcggccatgggcactgcattgcaaaagggtgcgacttgaaaggcatgatggccgagatatacggaaaatc

SEQ ID NO: 159 - DNA, 168 bp, Bacillus licheniformis
tgtgcttgatattccgttttgggaagcggctctcggcatcggcatcaccgctctcacgattgtgattctcgccgtcatcggggcgagggtgtataaaggcggcgtgctcatgtacacaagcggcggcggattgaaaaatatcaaacaggcgcttcgtctgtcaaaaga

SEQ ID NO: 160 - DNA, 135 bp, Bacillus licheniformis
tcatccggatattgtcggcgctcagacgttgacgcgctgttttgccatacacgtgtttttcctgccagccgctctgttcggactgatgggtgcacaaaaaatcatgattcgcaaacaaggaatttctgggccgct

SEQ ID NO: 161 - DNA, 399 bp, Bacillus licheniformis
atgacgatctggaaggacgaaatttctgctcctgtactatcggtcatccgtgtgaagaacttgaaagaagcggttgagatcgccaaccagtccgaatttgcaaacggcgcatgcttgttcacatctaattcgaatgcgatccgctatttccgtgaaaacattgatgcgcggaatgctcggcatcaacctgggtgtaccggctccgatggcatatcttcccgttctccggatggaagtcttcgttctttggtacattgcatgccaacggaaaagacagcgtcgatttctatacgcgcaaaaaggtcgtcactgcaagatatccggcgcctgacttcaattaattgtgaaaaaaccgggcggtgcggttcccgcgctgttcggatcatgtttcaagtttga

SEQ ID NO: 162 - DNA, 158 bp, Bacillus licheniformis
atgaaaaggggaaaagggatgaagtttgtcggtgattcacggatcccggcggaaagaaaaccgaatattccaaaagattattccgaatttccagggaaacgaagctttgccgaatttcctgctgaaagaatggatgtcggagcgttttccttgtcgtt

SEQ ID NO: 163 - DNA, 330 bp, Bacillus licheniformis
atggtgaataacgaaaacagagggaatcccaaaacagatcttgcctaccgcaaaaagaaaaacgcggaggacatgagatatcaggttatttcattcggtttgatgatcggcctgaccattgtcgcttttttaacggtcgcctcagatgccggcgtatggtttacggtgccgtttattctgctgctcgccgtcattcaggttgcgtttcagctgtattactttatgcatatgagtcagcgggggcatgaagcgccgactttgttcctttattcgggcgttttggtcgcttttgttaccgtgttggcttttgtaacgctaatctggtggtaa

SEQ ID NO: 164 - DNA, 294 bp, Bacillus licheniformis
atgaaaatgaagctgtttactctgtttatggctgtttcttttgtgctggctgcctgcggcggcaataacaacgaaagcaaagagaaaaatacaggcgggcaagcaactgcaaccgacggggaagagatttaccagcaaaactgcacaggctgccatggtaaggatttggccgggcggttccgctccgagtttgaaggaagttggcggcaagtattaggaaagcgaaataagggacatgatagtcaacggccgcgccggaatgcctggcaatcttgtagacgaaaaagaagctga

SEQ ID NO: 165 - DNA, 225 bp, Bacillus licheniformis
atgctgccattcacagatgaaatcgaagcggggctcatttgcggtaacgccgaaagcgcccgtgtcaaactgcaagcgccattcggaggcgttaaacaatcggacctcgattcacgggaacagggggaaggcacccaaggattttttacaaccggggaaaaccggttttggaaaaccgaaagtaagtcgtttcggtcccaaatgaataaggggaaatatctttga

SEQ ID NO: 166 - DNA, 210 bp, Bacillus licheniformis
atgaaacgcgtgctgatgggcgttcatccctttcatgcacagccgcccctttgtcgtcggattgtcttttccgaccgccgtgtatttttttcttgtcacaatcgtctgttcaatgagctgcattttgcactgcatgctgcaaaatggacattgggtgtcatacgttttttcggattgcacttctttttgctttgtgcgaaagtactttag

SEQ ID NO: 167 - DNA, 1411 bp, Bacillus licheniformis; identical to SEQ ID NO: 25

SEQ ID NO: 168 - DNA, 942 bp, Bacillus licheniformis
  misc_feature (1)...(942): n = A,T,C or G
nccggtcccaaaagaaatcgaagagatgctcgctgaacattgcgaatatgaaatttggacttcgcgcgagcgtattcccagaacgaccctgctcgagaaaatcaaggaagcggacggccttttgacctcaggaacaaaaattgaccgtgaattattatccaatgcactgaagttaaaaatcgtcagcaacaattccgtcggctatgacaactttgatattgaagcaatgaaagaaaaatcggtcatcggcacccatacgccatatattcttgacgacacagtcgcagaccttgctttcggtctgatcctttcctcagctcggcgaatcgccgagctcgaccgctacgtccgcgagggaaaatggaccaaatcagaggacgatgaaagcttgttcggatctgatgtccatcaccggacgctcggcatcatcggaatgggacgaatcggcgaacaagtcgccaaacgggcggccttgggttttgatatggaagtgctctattacagccgcagccgcaaacccgatacagagaaaaaaaccggcgcggtttatacgggctttcatgagctgttggagcgctcggatttcattgttctggtcacaccgctcacggatgagacataccgcctcatcggcgaagcagaattcaaaaaaatgaaaccgtcgtccattttcatcaacatctcccgcggtaaaacagttgacgaacaagcgttgattcaagcgctgaaagaaggatggattaaaggagccggacttgatgtatttgaaaaagagccgattgaaaaagacaatccgctcctaagcctttccaatgtaacccttgttccccacattggatcatccacccatgtcacacacgtcaacatgctgaaaagcgccgttcaaaacctgattgacggtcttcagggcaaacggccaaaagatatagtcaaagaactgag

SEQ ID NO: 169 - DNA, 1032 bp, Bacillus licheniformis
gttaacattttcggattttttcgatatgcttagagtggaagctactcttagaaaggaacgaggcagcatggacaaaccgtttgtatatgtgacgagaaaattacctgaagaacagctttctgcgttaaaagaagaagcccatattgaaatgtgggaaaaggaagaagaaccgtgtccgcgcgccattctgaaagaaaaagcaaaaaaggcgcacggactgttgacgatgctttccgacacgattgatgaggagcttttaaaaggcgcgccgcatttaaaagtcgtggccaacttggcggtaggctatgacaacatcgatgtggaggctgcgcaaaagcatcgcgtcatctgctgcaacacgcctggcgtgctgacagagtcaacggcagatttgacgtttgctctgctgatggcatccgcccgcagaatcgtcgaagcgagcgactggattagacaagggaagtggacgggctggggtcctctgcttttggccggtgcggatgtccatcataaaacgatcggcattgtcgggatggggagcatcggacaagccgtcgcccggcgtgcgaaaggcttcggcatgaaaattttatatcataaccgcacccgcaatccagatgcagaagcagaactgggcgcatcctatctgcccttcgatgaactgcttgaacaggcggattttgttgtctgcctgacacctctgactcatgaaacgaagcatctgtttaaccgcagcgcttttaaaaagatgaagcgctccgctatttttatcaatgtctcaagaggacaggttgtcaatgaagacgatttatatgaagcgctggtcgaaaaagatattgccggcgcaggactcgacgtctttgcggaagaacctgtgcaaaaggatcacccgctcgtcagcctgccgcaagtcaccgcgctgcctcacatcggcagcgccgccgtcgaaacgagagaagccatgatgaggctttgtgcggaaaatattgcgcttgtcctgagaggaaagcaggcaaagaccgagatttgacg

SEQ ID NO: 170 - DNA, 2247 bp, Bacillus licheniformis
acaaatgacggcggatggcggaacattaaaggctgtactggaatggattccgtcctttgggattaactttaccgcgtacgttgacggactcggattgctattcgcccttctgattacagggatcgggtctttggttgtcctttacagcatctattatctgtctaaagaaagagagcagctcggaccattttacgtttatctgctcatgttcatgggggcaatgctcggcgttgttctcgttgataacgtcattgtactttatttgttttgggaattgaccagcatatcgtcttttctgctcatcggctattggtacaagcgggaaaaatcaagatacggcgcgacaaaatcgatgcttatcaccatattcggcggtctttccatgcttggaggcttcattcttctttacacgatcacaggttcattctcgattagagaaatgatcaaccaggttgatttaatttcggggcacggctttttcatcccggctctcgtgctggtgttaatcggagccttcactaaatctgcgcagttccctttttacatctggcttccggacgcaatggaagcaccaacgcctgtaagtgcttacctgcactccgccacgatggtaaaagcgggaatttatatcgttgcaagattcacccctgtgttcgctttttcaggggaatggttttggatcgtgtctctcacggggattgtcacgcttttctggggttcgttcaacgccgtcaagcagactgatctgaaatcgatacttgcattttctacggtcagccagctcggaatgatcatgtcgatgcttggcgtcggagcggccgcactgcattttcagcattttgaatactacatggttgcagtaatcgccgctatctttcacttgattaaccatgcgactttcaaaggcagcttattcatggcagtcggaatcatcgaccatgaaacaggtacgagagatatccgcaagctcggcggccttatgacgatcatgccgattacgtttacgattacgctcatcggcgcgttttcaatggccggactgcctccgttcaacggctttttgagcaaggaaatgttcttcaccagcatgctcaggattacgaactttaacttgtataacgctgacacatggggttttctctttcctgtgctggcttggatcggaagcgtgtttacattcatttactgcatggttctcttatttaaaaccttcgggggaaaatatcagcctgaaaagcttgaaaaacaagcgcatgaggctccaatcggcatgctgatttcgccgattgtcctcgtatctctcgtggtgatttttttctttttcccgaacattctgtcatacagcatcattgaacctgctgcagcgtcgattatgccgacccttttggacggtgacgaaaaattcaaggttcatatttacatgtggcacggcttttcgactgagctctatatgacgatcggcgtcgttgctctcggagttctcgcctatttgaccttgtcaaaatggcggaaggtctacggcctcttcccggaaacactgacgctgaacaagttgtacgacagctcgctgtcagggcttgaaaaaggctccaacaagattacaagaacgtatatgacagggtttctccgcgactatcttgtttatgtttttgtcttctttatcgtgatcatcggcggatcgctcgctgttaccgggggcttttcatacgatgtgaaaggcaatgcttcaatcggcgtctatgagctcgttctgtcagccgtaatgattgccgcaacctttaccaccgtttttgcaaggtcaagactgacggcgattatcggactcggcgtcatcggctacacgctcgcgctgttctttgtcattttcagggcgccggatctcgcgctgacgcagctgatcatcgaaaccatttcagtcgcattgttcctgctgtgcttctatcatttgccgaagctcagatttaagccgaaatcggctaggttcagggtcacaaatgcgcttgtatcggtcggcgtcggaactgttgtgacgctgctcgcactttcagcaaacagccagcgctcgcttgaaagcattgcatcgtattttattgaaaacagctataaactcgcaggcggccacaatatcgtcaacgtaatattggtcgacttcaggggatttgatacattgtttgaaattaccgtacttgtcattgccgctttaggaatatacggcatgatcaggctcagattggagaaaggagggga

SEQ ID NO: 171 - DNA, 1412 bp, Bacillus licheniformis
atgaataatcttgtaattctgccaatactgattcctttaatggccgcaattctgcttatctttatgaacaggtcgatcgtgctgatgcgtgcattcagcgccatatcttccattgcggcgatcgctgcggccgccgttcttgtgcagacagtctatacggacggaatccagaccttgtatctcggcgggtggaagcctccgttcggaatcagccttgtcgctgatcaatttgccagccttctggcgttaacgacagccattatcggatttctgacggttctttattcgtttcgctccatcggcgaaaaacgcgagcgtttcttttattatcccgccgtccagttcctgcttgccggagttagcggcgctttcttgaccggggacttgtttaacctgttcgtattttttgaggtgcttctgatggcttcgtatgtgctgatcgtcatcggcggcacgaagattcagctgcgggagtctctgaagtacatcgtctttaacattatttcttccgccctctttgtcatcggagtcgcttatttatatgcggttacgggcacattaaacatggcggatctgagcgtccggatcagcgaatcagggcaaaccgggctgatcacggtcatcgctgttttatttttgatcgtcttcggtttaaaaggcggcatcttcccgctgtatttctggatgcctggttcctattatgcgccgccagccgctgtttccgcactgtttggcgcacttctgaccaaagtcggcctgtacgcgatcacaagggtgtttacattaattttcacccaagacgccgcttttactcatcaattaatggtctggcttgcggcgcttacgatcatcttcggggtcatcggctcgatcgcctactgggatgttcaaaaaatcatcatctacaatattgtcactgcggtcggcgtcatcttgttcggcatcgccgccaatacgccggcttcaatcgaaggatctgtctactatttgattcatgacatgatcattaaaggagcgctgtttatgcttggcggagcgctttttgccctgacagggacaaacaacctgaaaaaaatgagcggcctgatcaaaaaccatcccgtgctcggctggatgtttatgatttcagccgtttcattggcaggtgttcctcctttcagcggattcatcggcaagctgaaaattgcagaaggcggctttttaagcggcgaattcgtgattacgctgctgatgcttttatccagcctgctcgtcttgtattccgtcatgaaaatatttatcaacggcttctggggggatgaacaggaagatgctccggccaaaaggcagctaaaaggctacatgtatccggcagcggtactgctctttctgtcgcttgccatcggactcggaaccgagcttatcgctccgta

SEQ ID NO: 172 - DNA, 1500 bp, Bacillus licheniformis
tagattctttattttggctgaaaatatttttcgcgtcgcttgcgctttgtttgttcagcgcactgctcgtcctgaatcgaaaggttccattggcatatgtacggattcatgccaaaatcatcgccctgcctccgcttgccgcgctggcagcattgataacggcaaatcccgggcaggctgaagcttcttggcgcttggattcgcttgcttggctgatcgccttgtttgtcttgactatcggcttcatcgtccagcgctactctgtccggtatttattcggcgaccgctcctaccgtaaattttttgtgctgctgacgcttacgacaggaggagcttcatgcgcctggctgaacgatgatcttcgctggctccttttatgctgggggatcacgctgctcggcttgactgcgctaatcggcttaaacagcgcgtggcaggcggcgaaaaatgccgctttgtatgcgggccggatctttgcgctcagctggctggcgatagcagctgccgctctttggctgtctctttcgacgggacactggcgattatcatccgccatagcggaagaaagccttgtacagctcagctcatgggagaaaaccgggatcggcctcctcgtcattttaacggtgatgattcctgcggcacagtggccgtttcatcgttggctgctcgattcagcaatcgctccgactcccgtttccgcagtcatgcacgccggacttgtaaatgtaggcggcgtcatgctgactcgttttgcaccgatgttcagcggtgatgtactgcagcttattctgcttgtacccgccgtcctttccgtcttgctcggaacgggcatgatgatcgtccaaacggactacaagcggcagctcgcagcttcaacggtcgcgcagatgggttttatgctcgtccaatgcgcattaggggcctatattgcggctgttattcacctcattttgcacggcctgttcaaagccgcccttttcctgcaagccggatcagcggtgcgccgttatgaatcgttcgcatctaaaccgggcagaccggctcttttttggaacatgataggcggcgtctttgctcttgctctcgtcatcggaatctgggcctcagctacggacgatggctatcaattgatcagcgcccttgttttaggctgggcactgttcattgcttggaggcagcttgtcacagccaattacggacgcgtcacacgaattgccggacttttcattttaacaggggcttcactcgcgttcgccatcattcattccgttttacacgggctcctgaaggatgctgttgtacagggggctgagccgcctgcaatggcggccgttttgacggcagtcgttttgttagccggcagtgcggccggcgcgttgatcgttcggcagcgctttgcatggtccggcgcactttatttacgtcttgtgaaaacgggtgaaccccatttcgaatcggtcgaagaacggccgaattatcttgaccaatatcttactc

SEQ ID NO: 173 - DNA, 803 bp, Bacillus licheniformis
atgattgccagtccaattaatccatcagatttgcttccaattagaggagcctattctcatagaattaagctgccggctgttgcaggatatgatggtgtggggattgtcatagatcagggcaaagatgtatcaccatcattgattggaaaaagggtcctccctgtaagaggagagggaacttggcaacaatatgtaaccacaaaagctgattatgctatagaacttcctccatcaataagtgataacgacgccagtcaactgtatattaatccattaacagcctggctaatttgtacggaatcattgcgtgttcagccgaatgaaattgttttaatgaatggcggaggtacatctattgcaggtttgtttgcgcaaatttccaaaatactgggattccgtttaattgtcatgacaagaaacagccgcaagatagaaaaacttcaaaaactcggggcatggagagccatcgacgcttccaaaggttctatatatgaaaagatttctgatggttgcgacatcggtgttgaccatgcaattgactctgtgggaggagaaagcggcgaactgctggcgagggcattaaaacctgaagggacgtttgtcagttatggtctattgtcaggtataccaaacgattggcgaaagctacacgatgtataccatgtgtcaccgcaattattcgccttaagactttggaatgagagacattctgtttctgaataccgcaatcgcttctcagaggtgattaagcttgttgagagcggaaggggatcctctaggcgacctgcttcaatgcttctact

SEQ ID NO: 174 - DNA, 3313 bp, Bacillus licheniformis
atgttcctcaaacgtttagacgtgataggatttaaatcgtttgcagaacgaatttctgtagattttgtaaaaggcgtgacagccgtcgtcggcccgaacggcagcggaaaaagcaacatcaccgacgcgatccgctgggtgctcggtgaacagtccgccaaatcgctcaggggcggcaagatggaagatatcatttttgccggcagcgactcgcggaaaaagctgaaccttgccgaagtgacgctgacgcttgacaacgatgaccgctttttgccgatcgattttcacgaagtcagtgtgacgagaagagtctacagatcgggggaaagcgaatttctcatcaacaaccagccgtgccgcctgaaagatatcatcgatctttttatggattcagggcttggaaaagaagcgttttccatcatcagccaaggcaaagtcgaagagattttaagcagcaaggctgaagagcggagaagcatcttcgaagaagcggccggcgtattaaaatacaaaacgagaaagaaaaaagccgaaaacaagctgtttgagacacaggacaatttgaaccgggtcgaagacatcctccacgagctcgagggacaggtggagccgctgaaagtgcaggcatcgatcgccaaagactaccttgaaaagaaggatgagcttgaaaaaatcgaaatcgcgttaacggcgtatgacatcgaagagcttcacggaaaatgggaagcccttcagcaaaaagtcgaaaaggcgaaagacgaagaaatgtcctcttctgcggccatccaggcaaaagaagccaaaatcgaagaggcaagagacaaaattcaagcgctcgacgaatcggtcgatgagcttcagcaagtgctgcttttgacaagcgaggaactggagaagcttgaaggccggaaagaagtgctgaaggaacgcaaaaaaaacgccacgcaaaacagagctcagcttgaagaagcgatcgtccagcgcagtgaaaaagagcgaaccctgaaagagaaaatcgccgcgcagaagcttgtgtttgaaaagctcgagactgaagcaaaagagcttgcccgacaggtgaaagaaaaaaatcaggctttatccggatacagcgaaaatgtagaggaagaaatcgaacagctgaaaagcgattatttcgagctgttgaacgaacaggcttccgtccgcaacgagcttcaatttcttgaagaccaaatgacccaatctgcggcacagcagaaacggctcgcacaaaacaatgaaaaatatttaagcgagcggaaggaaatcgccgaccaaaagatgaaaaccgaacacgaattcagcctcgtggacgagcgtcttcacagccagattcaagcattcagggacgcgcaaaaaagctatgaacagaaaaaaagccagtacgaaaaaaaggaatccgccctttaccaggcttatcaatacgttcagcaggcgcgctctaaaaaggaaatgcttgaagcgatgcaggaggacttttcggggttttatcaaggcgtcaaagaagtattaaaggccaagagcgagcttccgggaattcgcggcgcgattgcagagctgttaaagacggacgagcggtatgaaacagcgatcgaaatcgcgctcggcgcaacagcacagcatgttgtcacagaagatgaagacgccgccagacgggcgattcaatatttgaaaaagcattcgttcggaagggcgaccttcctcccgctttccgtcatcaaagagcgccgcatccagccgagagacatcgagacggcgaaagaaaacccgtcgttcatcggcatcgccagcgagcttgtttcatttgatccggcctaccggagcgtcgtgcaaaatctgctcggcaccgtgctgatcaccgagcatttaaagggcgccaacgaccttgccaagcggctcggccacagataccggatcgtcacccttgaaggggatgtcgtcaatccgggcggttccatgacgggaggagctgtcaagaaaaaaagcagctcgcttctgggacgaaacagggaactggaagcccagacaaaacgcctcgccgagatggaagaaaaaaccgaattgctcgaaaaagaagtgaaagccctgaagcagaccattcaggagcttgatgccaagctacagtcacttcgggaggacggagaacgcctaagatccgagcagcaggaaatcaaaggccgtctgtacgaactcgaaatcgccgagaaaaacgtcaacagccatttggagctctatgaccaggaaaaatcggctctgcttgaaggggacgaagacaagaagtggcgtaaagaagagcttgaagaaaagctcgcatcgatcgccggcgagctgcagcgccttgattccgaaatcgaagccatgacggagcggaaacagacgcagacctcgacgaaagaagcgttgcaaagcgagctgaccgatttgaaagtggtgctggcgaaaaccgaacagtcgtgtgcaaacgaacgggaaaagctcgcaaggcttgaagaagagtatgccgagaatgcggaagcgctcaaggtggccgaagaggatctttctttcttaacgacagagatgtcctccaattcttccggtgaggaaaaacttgaagaagctgcgaaaaagaagctgaacgataaaaataaaaccgcagagctcatcgcctcaagaagagaacagcggatgaagctgcaaaaaggccttgaaaccgaagagctcgaactgaaagaaatgaagcgccagtataagcagatggccggtctcttaaaagatgaagaagtcaagctcggccgcatggaagtcgagctcgacaacctgctctctttcctgcgggaagagtacggcctttcatttgaaggggcaagggaaaaatatcctttggagctttcccctgaagaagcgaggaagcgcgtcaagctgatcaagcttgcgatcgaagagctgggaacggtgaaccttggcagcattgaggaattcgaaagggtcaatgaacgctacctcttcctttcagagcagaaagacgacctgctcgaagcgaaaaatacgctctttaaggtcatcgaggaaatggatgaggaaatgacgaagcgttttgcggaaacatttgcgcagatcagctcccattttgaagacgtcttccgggcgctgttcggcggcggaagagccgagctcaagctgacagatccgaatgacctgctccaatcgggcgtcgatattatcgcccagcctccgggcaaaaagctgcagaacctgagcctgctttccggcggggaacgggccttgacggcgatcgcgctccgtttcgcac

SEQ ID NO: 175 - DNA, 1744 bp, Bacillus licheniformis
atgacgctgattacgtcaaccgtgcagtacttccgcgacaaaaatcagcgtaaaaaaagagaagaaaaaagagagcgggtctataccctttaccttgaaaacaaaaagaaagagctgcatgaacttgcagaaagacaaaagttcgtacttgatttccattttcctacatttgagagaatgaaatatttaacaaaggagatcagcggacgaatttgggaaaaatcgattgaaagcgccgattttctgcaaatccgccttggaacgggaaatgttgcatcttcgtaccaaatcaatttgaacggcggagatttggccaaccgcgatacagaccatctccttgaacaaacgcaaaaaatggaagaggtctacagagagctgaaaaatgcgccgatcactgtgaatcttgccgaaggcccgatgggcgtcgtcggaaaattgtccgtcgtcaaaaatgaaattcatcagcttgtcggccagctcgcatttttccacagctatcatgacttgcgctttgtctttatttttgacgaagccgagtatcaagaatgggaatggatgaagtggctcccgcattttcagatgcctcatatttatgcgaaagggtttatttacaacgaacagacgagagatcagctcctttcaagcatatatgagattttgagagaacgggatttagatgaaaacaaaaagaagactttgtttaagccgcactttgtgtttatcatcacaaatcagcagctcatcgcagaacacgtcattttagaatatttggaaggcaagcagaaacacctcggagtgtcgacaatcgtggcggcagagacaaaagaaagcctgtccgaaaacattcatacccttgttcgttatattactgaacaggaaggcgacattctgatcaagcaaaagaaagccgtccagatcccgtttcagctggatcaccacaacagggaagacaacgaacagttttcccggacgctgagaacgcttgaccaccagacgggcatgacgaattcgattcctgataccgtatcgtttctcgaactgttccaagtgaaggaagtcgatgacatcggcatcgaacaaaaatggatgacaagcgaatcggccaaatctttggccgtgccgatcggctataaaggaaaagacgacattgtttatttaaaccttcacgaaaaggcgcacggcccccacgggctgcttgccggaacgaccggttcgggtaaaagtgaatttttgcagacttatattttgtctttggcagttcactttcacccgcatgaagtcgcatttttgctaatcgactacaaagggggcggaatggcgcagccgttccggaacattccgcatttgctcggaacgattactaacattgaaggcagcaagaacttcagcaaccgggcgcttgcgtccattaagagcgagctgaagaaaaggcagcggctctttgatcagtacaaagtgaaccatatcaacgactatacaaagctttacaaacagaaaaaagcgaaaacggcgatgccgcaccttttcttaatttcagacgaatttgccgagctgaaaagcgaagaaccggaatttatccgcgagcttgtcagtgcggcaaggatcgggcgaagcctcggggtgcacttaatcttggcgacgcaaaaaccgggcggcatcatcgatgaccagatttggagcaactccagattcaaggtcgccttgaaggtgcaggatgcgaatgacagtaaagagatcctcaaaa

SEQ ID NO: 176 - DNA, 1398 bp, Bacillus licheniformis
aaggcgcaaaaacgcttgtcttaacgattaaccttgatatggttgctttcatgccatgtaacccgtctgtcggcggacctgcaaaaggaatcgtcgtccgcgaaattgacgcgctcggcggggaaatggctaaaaatattgataaaacgcatatccaaatgaggcttttaaatacaggaaaaggacctgccgttcgggcgcttcgggctcaggctgataaattccaatatcagcatgaaatgaaaaagacacttgagaatgaaccgaatttgaccatgctgcaaggaatggtcgaacgccttcttattgaagacggggaatgccggggcgttataacccagacaggggcggagtaccgttctaagaccgttgttctgacgacggggacatttttgagagggaaaatcattcttggcgatctgtcatactccagcggaccgaacaaccagcagccgtccatcaagctgtctgaacatcttgaagagctcggctttgacctcgtccgttttaaaacagggacgccgccgcgggtcaacagtcattcaattgactacagcaaaacggaaatccagcccggtgatgaagtgccgcgggccttttcgtatgagacggtggaatatattacagaccagcttccatgctggctcacatatacaagtccggaaacgcacgaaatcattgacaacaatttgcatcgttcaccgatgtactccggcatgatcaaaggaacgggaccgagatattgcccgtctattgaagacaaggtcgtccgctttaacgacaagccgagacaccaaatctttcttgagcctgaagggcgcaacacccaggaagtctatgtccagggattgtcgacaagccttccagaagatgtgcagcgaaaaatgctttcaactattcccggccttgagaatgtgcaaatgatgcgggcggggtatgcgattgaatatgatgcgatcgtaccgacacagctgtggccgacattggaaacgaaaaaaattccgggactcttcacagccggacagattaacggaacatcaggctatgaagaagcggccggacagggaattatggccggtatcaatgcgggccggaaagcgcttggcaaagaagaggtcattctcagccgctcagacgcttatatcggcgtattgatcgacgaccttgtgacaaaaggaacaaacgaaccataccgcctgctgacttcgcgtgcagagtacaggctgctcctgcgtcacgacaatgcagacttgcgcctgaccgagatcggctatcagatcggcttgatttctgaagaaagatatcaaaagtttcaagagaaaaaagcggccattgaagcagagaaaaaacgccttcattctgttattatcaaaccgacaaagaaatcaggaatatatc

SEQ ID NO: 177 - DNA, 2925 bp, Bacillus licheniformis
ggtgaatatacatgcgatacatatatacggatacggtaaattcgccaatcagacattccgcctgtctccttcaaatctgcatttgatctacggactcaatgaagccgggaaaacgacgctcatgtcgtttattgaaagcgtgctgttcggttttccgaagacgaaacggtacgagccgaaaacgggcgtcatttacggggggatgcttgaggtcggacaccctgatttcggccaaatccgaatcgaacggacggccggaaagcccgagcgggtcaccgtttacttggaagacggcagcacgaagccggaaggttttttaaatgagctgctgtcaggcatcgacaggcagctgtataaagcgatctactcatttgacgtgttcggccttcaggaaatccataaattcaaccgcgacaaaatcggccgttttctgctgttttcaagtctgttcggctctgatgcgatttccaagctggatgccggcctcgtgaaaaagcaggaagagctgtttaaaccgaacggaaggaagccggagctgaaccaggagcttgatcggttaaaaaggctttctgaagatttgaaaaaggcgaaagcgcgggaaggcggctattaccgtctcttaaacgaaaaaaaaggcgctgaggcgtcgataaaggaaagcggacaactgctcaaagatcttgagcatctcgtcttacaaatcgagcaggccattgagattctgccggcggccgcggaaatgcgccagctaaaagagcagctcgcatccctcggcggctcagaagaaagccgtttccccgaaggcggacttttcgagctcgaaaagctcgaatcccacctgcatccaaaagcggctcagctgaaggcgctggaagaaaaaaagcgcggtttggaacagcgcgccgccgcttttgcaccggctgaagacttcctcgagcacgaagccgaagcggaagagcttttaacggcgtatccgttttaccagtcgtataccgaaaaaatcgcgtctttgactgaacagcttcaccagataaacggacgggttcaagcggggcttgaccgcctgcaaatcgaggaatacgatatcctcaatgcggacaccacgtatgaatacgagtggaaactgcaggaaaccgttcaggcatacatagagctgcgcgaactgaagcggtcgctcgacgagcggtttgagcaggcgagggctgatctggaggaagcggaacaggcccatgccgctctcagcaatgaagtgatgcccgatgatgtccgaaaacaaaaggaagaaacccttggccgccttgcgtccgccggcggtcatgccggaaggcgggaagagctgatccttcagctgtcctatctgaagcaagaacaaaaagttcggatgaaaagaagaaggaccgcttttgcgggagcgctttgcgctgcttttgcggcagcttttgcggcgctctttttcaaggagtggttcccgggcgctttgctcgcgccgattttgctgatatttgccgcttttattttaaaaaagcctgagccttccgcggcggcggcttttattcaaaaacagctggatgatattgaccacagcggttcaaaaggcggagtaagcgacagcgctttaagggaggagctgtggaaggacgaccaaacccggcagctccttatcgccaaacaagctgagctcagacagaaagaagcggaatatgaaagagcgattcaaaaattcgaagagtgggaaaaggatatccgtccgtatcaggagaagaccgagcgctatttaaaagagctgaatctttcaattgacccgtcatttttagctgatgcgtacgctttgattaaggaactcagagaggaaattttgaaaaagcgggatatcgagaaggaactgagccgccttcatgctaaaaaagcatcctttgaagcgggattgagaaagcttgtcacatccctcagccttgcgggcggaagcgtccaagagcaggtgtttcagctgaaaagcgagcttgagtcccaaaaagagaaacttcgtcaaaaacaggaagcagacgtgtctttaaagcatgcggccgaacaaatcaaagagctggcgaaagaggtggaatacttccaatctcaaattgccgaactctttcaaaaagcaggggcggacggccgtgagatgttcgtcggactggcgaagcgcgatcaagccagaaaagaactaacggctaggctcgggcagctcaaaagagagctcggcagacaggacgagaaggccgttatgctcgcctcaggccactctctggcagaactgaaaggaaagctggccgagactcaggaaaaaagagcgcgcatagaaaagcagctgacagaagaaaggcagacggcggctaatttccatgcagagctcgccagacttgaggaatcaggagcggtatcggagcttgcctatcagaccgggatgcaaaaagagcgggtcgccgaattggccaaaaagtgggcagccgtcaagctgatccggcaggcggtccaaaacaagatagatgaacataagaaggttcggcttccgaagctgttacagacggctgaaacattactgaacccattgactgccggacaatacgaaaaaatttatttttctgaaacagatgattccatgatggtcatgcggaaagacggagctcttttttgcgcacacgaactgtctcaggcgacttgtgaacagctctatttagcgatccgattcgctctggccctctcccatcaaaagaatgtcaaattgccgttccagctggatgacagctttgtccacttcgaccaagagaggtttaaacaagtgctgaacattttaaaaaagctttcaggcgaagatcagcaaatcttgtattttacgtgtcatgaacatgtaagagaagctttccgcgatgaagatgtgattctgctgccttc

SEQ ID NO: 178 - DNA, 1453 bp, Bacillus licheniformis
atggcaaaaagaaaacgaaaatcaacaaagaaacaaaaacaaggaaaaaaacggatccatcttaaatttgaattgtacggattaatctgtatcgccatctcgattattgcggttttgcagcttggcgtagcagggcaaacgttcatttacatgttccgctttttcgccggtgaatggttcatcctttgccttctcggcctctttttaacgggcttgtctttattttggaaaaagaaaacacccagttttttgacgaggagaaaagcgggcctttactgcatcattgcaagcatgctgcttctttcacatgtccagctgtttcagcatttgaccgaaaggggaatggttcagtctccgagcgtgatccaaaatacgtgggagctgtttctgatggatgtaaaaggcgagacaggatcgcctgatcttggaggcggaatgattggagcccttttattcgcggcgtcatattttctgtttgcatctgcaggatctaaaatcatcgccgtcttcctgatcttgatcggccttcttttgattacggatcggtcgcttcaggagacgctgatcaaatggatgaccccggtcgcctccttcatgaaaaaccagtggcaggcctttttagcagatcttaaacaattgaaaaacagctcgccgaaaaagaaatccggaaaaaaacaaaagacgcagagaaaaccgaaagtgtctgaagagcctgtacaagaagcggaccttgatccagatccggttattcaatcagaaccgattatttcaagcttttccgaccgtgatgaaaagcccgaagttcaagcttacgaagctccggcggctcctgctgaacctcctgctgagcccgaaatcggtgaggaaatgcaggcctccggcgcgcccgaaatcacgtttacagagctagaaaacaaggattaccagcttccgtcgattcaattgctggatgatccgaagcacacagggcagcaggcggataaaaagaatatttacgacaatgccaggaagctggaaaggacgtttcaaagcttcggagttaaggcgaaagtcacccaggttcatctcggcccggccgtcacgaaatatgaagtctatcctgatgtgggcgtcaaagtcagcaaaattgtcaacttaagtgacgacttggctttagcgctcgcggccaaggatatccgcatcgaagccccgatccccggaaaatcggcgattggaatcgaagtgccgaatgcggaagtggcgatggtttccttgaaagaagtgcttgaatcgaaactgaatgaccggccggatgcaaagctgatgatcggcctcggccggaacatttccggagaagcggtattggcagagctgaacaaaatgccccaccttcttgttgcaggagcgaccggaagcgggaaaagcgtctgtgtcaacgggatcattacaagcattttgatgagggcaaagcccc

SEQ ID NO: 179 - DNA, 1097 bp, Bacillus licheniformis
ttgcaaacaaaaaaaacgtcaccggattttttgctggttatcattacgctattgcttttaacaatcggactgattatggtatacagcgccagtgcagtatgggcgacttacaaatacgacgactcctttttctttgcgaaacggcagcttttgtttgccggcatcggggtcatcgccatgtttttcatcatgaacgtcgactactggacgtggaggacttatgcgaaaatactgatcattgtatgtttctttctgctcatcatcgtcctggttcccgggatcggcatggaacggaacgggtcgaggagctggatcggagtcggcgctttcagcattcagccgtccgagtttatgaaactcgcgatgatcgcatttttggccaagtttttatctgaaaagcaaaagaatattacgtcgtttagaaaaggctttgtgccggcgctgggcattgtcttttcagcttttctgatcatcatgatgcagcctgacctcggaacaggaaccgtgatggtcggcacatgcatcattatgatctttgtcgcgggggcgagaatttcgcacttcgtttttctcggcctgatcggactgagcggttttgtcggccttgtgctgtcggcgccgtaccggatcaaaaggatcacttcatacttgaacccttgggaggaccctttaggaagcggctttcaaatcattcagtctctttatgcggtggggcccggcgggctgttcggcctcggcctcggccagagcaggcaaaagtttttctatctgcctgagccgcagacagattttatttttgcgattttatcagaggagctcggctttatcggcggatcgctgattcttttgctcttcagcgttctattatggagaggcatcagaatcgcgctcggtgcgcccgatttatacggcagttttgtcgccgtcggcgtcatttcgatgatagcgattcaggttatgatcaatatcggagtcgtgactggtttgattcctgttacaggcattacgcttccgtttttaagctatggcggttcatcactgaccttgatgctcatggcggtcggcgtgctgctgaatgtcagcaggtattctagata

SEQ ID NO: 180 - DNA, 1134 bp, Bacillus licheniformis
atgttagagtttgaaacaaatatagacggcttagcatcgattaaagtaataggagtaggtggcggcggtaacaatgccgtcaatcggatgatcgaaaatgacgttcagggagtcgagtttatcgcagtcaacacggatgctcaggctctcaacctgtcaaaagcggaaacgaaaatgcagatcggtgcgaagctgacgcgcgggctcggcgccggagccaatccggaagtgggcaaaaaagccgcagaggaaagcaaagaacaaattgaagaagcgctgaaaggtgcagatatggtgttcgtcacagccggaatgggcggcggaacaggaacgggcgcggcacctgtcatcgcacaaatcgcaaaagatctgggcgcattgactgtcggcgttgtcacaaggccgtttacctttgaaggaagaaaaagacagcttcaggctgcaggcggtatttcagcaatgaaggaagccgtcgacaccctgatcgtcattccgaatgaccgtcttcttgaaatcgtcgataaaaacacaccgatgcttgaagcgttccgtgaagcggacaacgttctccgccaaggtgttcagggcatttcagacctgatcgcaacgcctggactgatcaaccttgactttgccgatgtcaaaacgatcatgtccaacaaaggttctgcactgatgggtatcggtgtagcgacaggcgaaaaccgcgctgcggaagccgctaaaaaagctgtttccagcccgctgcttgaaacggcgattgacggcgcccaaggcgtgctgatgaacattacaggcggcaccaacttaagcctatacgaagttcaggaagcggcggacatcgttgcagctgcatctgaccaggacgtcaacatgatctttggatctgtcatcaatgaaaacttaaaagacgagatcgtcgttacggtgatcgcgactggatttatcgaacaggatcaagattcatcaaagccgcagagacctttaaaccaaggcttaaaacagcatcatcagcctgctccgaaacgggagccgaagcgcgaggagccaagcatgccgcatcgcagcccatcacagcctgccgaggatacgcttgacatcccgactttcttaagaaaccgcaataaacgctaa

SEQ ID NO: 181 - DNA, 1417 bp, Bacillus licheniformis
ttgtgaaaagtattgaagatttcatgaaaaaatacgaactgtcatttgatggagtgacgctgattgcaggtgtctccggcggacctgattcgatggcgcttttgcatgctctgcaccatacggttcccgcttctgcaacgctgattgccgcacacgtcgatcatatgttcagaggcgaagagtccgagcgtgatatgcggttcgttcaggactactgcgaggcggaaggcatacaatgcgaggcggtgcaaatcgatgtcctggcatttgccgctgaaaacaatctgaataaacaggctgctgcgagagaatgccggtatgcgttttttcaagagttaatgaaaaggcaccgggccgaatacctggttctgggtcatcatggagatgatcaggtggagacgatgctgatgaagatggcaaaaggcactgtcggaatcgggcttgccggaattcagccaaagcgccgttttgacagcggctggctgctcaggccgtttctgaagctgtcaaaggatgatcttttggcttactgcaaagagaatcgaataccgtttagaaccgatccgagcaacagtgaggatgattacaccaggaaccggttcaggcaccatgttctcccttttctgaagaaagagtcggaagatgtccataaaaggtttcaatccgtcagtgaattcctgacagaagacgaattatacttacaggcattaacgaaagacaaaatgaatacagtaatcacaagcaagtcaagttcaggcgtggaaatcagcatcgaacgacttcttgcgctccctatgcctttacaaagaaggggagttcatctaatattaaactatctttatgaaaacgttccatcagcgttttcagcccatcatattcaagtgtttctggattggatttcacaagacggaccatccggttcccttgattttccgaatgggttaaaagtcgcaaaatcttatcatacatgtttgtttacatttcagcgtttacaatgtgaaaatgtttcctatcattatgaaataagcggggcaggcgaagaagaactgatacttcccggcggctcctcccttcatgtgagcggacccggttcaacccggaagctgcaaggaaatgatgtttttgcaacaagtcccaagcaggttcagtttcccctttacgtacggacaaggcaaaacggagaccgagtcaaacttaaagggatgaacggctcaaaaaaggttaaagatatatttattgatgaaaaagtgcctctttcaaaaagagacagctggcccattgtaacagacgcggttggaaacattatctggatacctggtctgaaaaaaaccatttttgaggaacttgatgttacaaacaacgatcgcattgtattacaatatagacagcatgaaaagtgtagggggctagcaaagaa

SEQ ID NO: 182 - DNA, 1124 bp, Bacillus licheniformis
atgaacaacaatgaactttacgtcagtctagacatcggtacgtccaatattaaagtgatcgtcggtgaaatgtcagacgattctcttaacattatcggagtcggaaatgttccctcagaggggctgaaaaaaggatcaatcgttgatatagatgaaacggttcattctataaaaaaagcgtttgaacaagcagaaagaatgataggttttccgctgacccacgcgatcgtcggggttaatgggaactacatccatattcaagatacgaacggtgttgtggctgtctcaagcgagaataaagaaatccacgttgaagacgtgcgccgggtgatggaggccgctcaagtcgtttccatcccgcctgaacagctgatcgtcgatgtgattccgagacagtttatcgttgacggaagaggcgatattacagatccgaaaaagatgctcggcgtccgccttgaagtggaaggatcgctgatcacgggctctaaaacgattttacataacctgctccgctgtgtggaaagagcgggaattgaaataacggatatttgccttcagccgctggctgccggatctgtcgctttatcaaaggacgaaaaaaacctcggagtggctttaatcgacatcgggggaggatcaacaacggttgccgtatttgaggacggccaccttcttgcgacccgtgtcataccactgggaggagaaaacatcaccaaggatatttcaatcggattgcgcacctccacggacgaagctgagcgggtgaaaaagcagtttggacatgctttctacgaagaagcgtcggaagaggaaacatttgaagtcgccgtgatcgggacggaccaaaagcagacctttactcagcgggaagtggcagacattatagaagccaggcttgaagaaatctttttattcgtggcagaggaactgcggaacatgggaataaaagaattgccgggaggctttgtgcttacagggggacaggctggaatgccgggggtcctcagcctcgcacaggatgttcttcaaaataacgtcagagtggctagcccgaattatatcggtgtaagagaacctcaatacatgacaggagtcggcctcatccaattcgcttaccgcaacgc

SEQ ID NO: 183 - DNA, 1011 bp, Bacillus licheniformis
atgtttggaattggtgcgagagaccttggaatagatttaggaacggcgaatacgcttgtttttgtgaaaggtaaaggaattgtcgtcagggagccttctgtcgttgcactgcaaacagacacaaagcagattgtcgcagtcggaaatgatgcgaaaaacatgatcggacgtacgcccggcaatgtcgttgccctccgcccgatgaaggatggcgtaatcgctgattatgaaacaacagcgacaatgatgaagcattatattagcaaagcagttaaaaacaaaggcttatttgcgagaaagccgtatgtcatggtctgtgtcccgtcgggaattacggccgtcgagcagcgtgcggttatcgacgccacgcgccaggccggagcgagagatgcatatccgattgaagaaccgtttgcagcggcgatcggtgcaaaccttcctgtttgggagccgactggaagcatggtggtcgacatcggaggcggaacgaccgaagtcgcgattatttccctcggcggcatcgtcacatcccagtctatccgcgttgccggagatgaaatggatgaagcaatcattacttatattagaaaaacatataacttgatgatcggtgaccggactgcagaagcgatcaaacttgaaatcggttctgccgaagcttctgaaaacggagaaagcatggagatccgcggccgcgatcttttaacaggcctgccgaaaacgattgaaatcactgaaaaagaaattacagcggctcttcgcgacactgtgaccgccattgtcgatgccgtaaaaaatacgcttgaaaaaactccgcctgaactcgcggctgatattatggaccgcggaatcgtccttacgggaggcggcgcactgctgcgccacctggacaaagtcatcagcgaagaaacgaaaatgccggttttaattgcggaagaccctcttgactgtgtagcgatcggaacaggcaaagctctcgagcaaattcatctatttaaaggcaaaaattaa

SEQ ID NO: 184 - DNA, 1008 bp, Bacillus licheniformis
atgtttcaaacaaccgagatcggaattgatctaggcacagctaacatattggtttacagcaaaaacaaaggaatcattttaaatgagccttccgtcgtcgccgtggacacggaaacaaagagcgtattggcggtcggcacagaagccaaaaacatgatcggaaaaacgccgggaaaaatcgtcgcggtcaggccgatgaaagacggagtcatcgccgattatgacatgacgacagacctcttgaagcagattatgaaaaaagccggaaagaacatcggctttacgttcagaaagccgagcgtcgtcgtctgcacgccgtccggctcaaccgctgttgaaaggcgcgcgatcagcgatgctgtcaaaaactgcggagccaaacaagtccatttgatagaggagcctgtcgccgccgccatcggcgcagatctgcctgtcgatgaacctgtcgcaaacgttgtcgtcgatatcggcggcggcacgacagaagtggcgatcatttcattcggaggcgttgtctcgtgccactcgatccggatcggcggtgatcagcttgatgaagacatcgtgtcattcgtcagaaaaaaatacaacctgctgattggtgaacggacggccgaagaagtcaaaattgagatcggctacgcattgattgaccatgagacgaaaacgatggaagtcagaggacgcgaccttgttacaggcctgccgaaaacgattaccctggaatcgaaagaaattcagaaggcgatgcgcgaatcgctcctgcatattatcgaagccatcagagcgacgctagaagactgtcctccggagctgagcggagacattgtcgaccggggcgtgattttgaccggaggaggcgcgcttttgaacggcatcaaagaatggctgtcacaggaaatcgttgtgcccgtgcatgttgctgcaaatccgcttgaatctgtcgctatcggaacgggtcgttctctcgaagtgatcgataaattgcaaaaagcggctaaataa

SEQ ID NO: 185 - DNA, 1057 bp, Bacillus licheniformis
atgttgcgagaagacgatgtaaaaaagatagtcggcgatttggacgagccatttcttcacaagccgctcagagagctggatgccgtaaaagaaattaaaataaaacccgaaaaacggcacgtcagcgtaaaggtggcgctcgcaaaaacgggatctgccgaacaaatgcagcttcagcaggaaatcgtcatacggttgaaagaagccggtgcagagacggtcggcctgcgttttgaggagctgcccgaagaagtcgtaatgagttatcaagagtctgccaaagggcaggatcaatctctgctgaatagtgaaaaacagcctgtgtttttagctgtggcaagcggcaaaggcggcgtcggcaagtcgacggtgtcggtcaatttggctgtgtccctggcgcgaatcggaaagaaagtcggattaatcgacgccgatatttacggtttcagtgttccggatatgatgggaatcactgtacggccgacgatcgaaggagaaaaggtcgtgccggttgaaagattcggggtcaaagtgatttcgatgggattctttgtagaagacaatgcccctgtcatttggagaggccccatgcttggaaaaatgctgaataacttcttccatgaggttgaatggggggatgtcgattatattatcttagacctgccgccgggaacaggcgatgtagcgcttgatgttcactcaatgcttccaagctgcaaagaggtgatcgtgtcgacgccgcaccctactgccgcgtttgtcgctgcaagagcgggcgcgatggccttgaagaccgatcatgaaatcgtggggatcgttgaaaatatggcttattacgaaagcgtcaaaacaggcgagaaagaatatgtattcggcaaaggcggaggcgaaaagctcgcagaggaactaggcgttccaattctgggcaaaattccgctgaagcagccggattgggatgacagcgaatttgcgccgtccgtttatgatgaaagccacccgaccggcgccatttatttggatatcgccaaaaaaatcgacgaaagcattggcgcaaaag

SEQ ID NO: 186 - DNA, 927 bp, Bacillus licheniformis
ttgtcttaatgaaccatagtcgttgctcttgacaaaaacatgggaaagtgctcgctgtcggtgaagaagcaaggagaatggtaggacgtacacctgggaatattgttgcgatacgtccattaaaagacggcgtcattgccgattttgaagtaacagaagccatgctgaagcatttcattaacaagctgaatgtaaaaggtcttttctcaaagccgcgcatgctgatttgctgcccgacaaatattacttctgtggagcagaaggccattagagaagctgccgaaaaaagcggcggaaagcatgtatatttggaggaagaacctaaggtggccgcaatcggagcgggaatggatattttccagccaagcggaaacatggtagttgatatcggcggtggaacgacagatatcgcagtcatctcaatgggcgatattgtcaccgcctcttctattaaaatggctggggacaagtttgatcttgaaatcttgaactacatcaaacgcgagtacaagctgctcataggcgaacggacagccgaagatattaagattaaagtcgcaactgttttcccagacgcacgtcacgaggaaatttccatccgcggccgcgacatggtcacaggattgccgagaaccattacggtaacgagcaaagaggtggaggaagcgctgcgcgaatctgtatctgtcattgtacaggctgccaagcaggtgctcgaaagaacgccgcctgagctgtcagccgacattatcgacagaggcgttatcattacaggaggcggcgcattgttaaacggtcttgaccagcttcttgccgaagagctgaaagtgcctgttctcgttgctgaaaatccgatggattgtgtggcagtcggtacgggtgtcatgcttgataacatggacaagcttcccaagcgcaaactgagct

SEQ ID NO: 187 - DNA, 840 bp, Bacillus licheniformis
ttgtttgcagcaactcgcttcgggcgaattcattaacgaatgctgtcggtgtataaaggaagaaatgcgggttcttgactcggccatcatcgctgctgctgacgaatgttctgttcctgccggcggtgcgcttgccgtagacaggcatgaatttgccgcaaacgttaccgaaaaagtaaagaatcatccgaatgtgaccgtgcttcatgaagaagtcacggaaataccggaaggaccgacaatcattgcgacaggaccgctgacatcagaagcgctttccgcaaagctccgggagctgacaggcgaggactatctatacttttatgacgcggctgcgccgattgttgaaaaagacagccttgacatggataaagtctatttgaaatcccgctatgacaaaggggaggcagcgtatttgaactgtccgatgacagaagaagagtttgacaggttttatgacgcccttgtgtctgcggaaaccgttccattgaaagaatttgaaaaggaaatcttctttgaaggctgtatgccgattgaagtcatggcgaagcgcggcaaaaaaaccatgctgttcggcccgatgaagcctgtcggacttgaagacccaaaaacaggaaagcgtccgtacgccgttgtgcagctgcgccaagatgatgcagccggcacgctttacaatatcgtcggttttcaaacccacctcaaatggggcgaccaaaaagaagtgctccgcctcattccgggactggaacaggcagaaatcgtccgctacggcgtgatgcacagaaatacgttcatcaactcgccgagtctgttaaaagcgacctaccagtttaaaaagcg

SEQ ID NO: 188 - DNA, 1013 bp, Bacillus licheniformis
ttgaaacagctcataattgtactagcaggaatctgcacgctgattttactcataccaacactgcttgtcctcccttttcacgggggaccgggggcaattaaaacagagaaacacgctcagcaacacgaggaaaaaaagaaagtcaccttaaaagagtctcccgtttcaattccggtctacagaacggctgaccggaaagttgaagacattccgcttgaagagtatgtcatcggtgtcgttgcctcggaaatgccggcagattttgatatcgaagctttaaaagcacaagcgctggcagcccgcacatacattgtgaggcaaatggtgtcagagcaagctgtacagtcgccgaaaggctcgctggtcgatgatacgcagatgttccaggtgtataaaaacaaagaggagctccgcaggctgtggaagaaggattacgattggaaaatcaaaaaggtgaccgaagctgtagccagtacgcaaggcaaaattttaacctatgagcataagcctattgatgcttcgttcttctcgacgagcaacgggtacaccgagaatgccggagcttattggacaagtgatattccgtacctgcaaagcgtgaaaagctcctgggacacaaaatcgccgaaattcctgaaccataaaacgtttactgtcgctgaatttgaacaaaagctcggtgtcaagctgcccggttcaaacagcatcggagagatcaccgaaagaacgccgggaaaacgcgtagcgactgccgtcatcaatggaaagaagcttgagggaagagatattcgcgaaaagctcggcctcaaatcggcagactttgattggaaacgcgacgggaatcagattacagtcacgacaaggggatttggacatggagtgggaatgagccaatacggtgcgcattatatggcgaaagacggcaagaaagcataagacatcgtcaagtattattacaaaggaacagccgtatccaatgcagatgaatttttaaataaatacatggcgaaaaa

SEQ ID NO: 189 - DNA, 756 bp, Bacillus licheniformis
tggagcttgctccgtataataatattcctcatctcgtcagtcctgtcatcacagatgcaaaagcggcaaccgccgcattaaaatgggttgtcgaggaaatggaacggcgctatgaattatttgctcattccggtgttcgggaaattgagcgttttaatgaaaaagtccgggaacagaacatgggtgaaaaacttccttatcttgttgtcgtgattgatgaacttgccgatttaatgatggtcgctccgaatgaagtggaagagagcatctgccgaatcgcacaaaaagcaagagcgtgcggcatccatcttctgattgcgacgcagcggccttcagttgatgtcattaccggcttgattaaagccaatatcccaacaagaatagcgttttctgtttcaagcgctgtcgattcaagaacaattatcgatatggcgggagctgaaaagcttcttggaaaaggggatatgctgttcttggagaatggttcaggcaaaccggtccgcctgcaaggcaactttgtgtccgaccgggagattgatcgtgtcgtttcacatgtcagacggcagcaggagccgaactatttatttgaacaggaacaattggtcagacaaaatccggccggatttgaccacgatgaactgtttcttgaagcgtgcgaatttgccgtggaacaaaacagcgccagcacttcaagcctgcagcggcgcttccgcatcggctataacagagctgccagattaatcgatatgatggaaa

SEQ ID NO: 190 - DNA, 889 bp, Bacillus licheniformis
atgattagaactctcggacggcatttgcgcgagagcttaaaatctctcgggagaaacgcgtggatgactttcgcatccatcagtgctgtaacagttacacttatcttggtcggcgtgttcatggtcatcatgctgaacgtatacaatatgacattaaaagccgaacaagaagtcgaagtcaaagtgctggttgacttaacggccaaccaggatcaaaaaaatacattggaaaaagaaataaagaaaataccggaaatcagcagtgtcaaatactcatctaaagatgaagaactcaaaaacctgaaagacagctttggggaagacgggaaattctttgcgatgttcgagcaggaaaacccgctgaacgatgcatttgtcgtaaaaacaaaagaccctcaagacacaccgaaagctgccaagaagcttgagaagctgaccaatgtctataaggtgacatacggacaggagcaggtagaccgcttgtttaaaatcagcaatgtcgccaaagtcatcgggattgcattggtcatcggcctgctgtttacggcgatgtttttaatttctaatacgatcaaaattacgatttttgcgagacgcaaagaaatcgagattatgaaacttgtaggtgcgacaaactggttcattcgctggccatttttcattgaaggtttgctcttgggtgtatgcggttctatcattccgatcgctattttgctcggaacgtatcatcatgccgttcagtggatcgctccgaaagttcaaggcactttcatacagctcttgccgtacaatccgttcgtcttccagatttcagcgatcctggtgctgatcggagccgttatcggtgtatggggaagcttgatgtcgattcgcaaattcttaaaagttt

SEQ ID NO: 191 - DNA, 834 bp, Bacillus licheniformis
  misc_feature (1)...(834): n = A,T,C or G
gattaccagatttgctcgctcccgtcgtgacagacccgaaaaaagcatcgcaggctttgaaganagtcgtcaacgaaatggagcggcgctacgaattgttttctcacacgggaacgagaaatatcgaagggtataacgactatattaaacggatgaatgccgcagaagaagcaaagcagccggagcttccatacatcattgtgattgtggacgagcttgccgacctgatgatggtcgcttcctctgatgttgaagactcgatcacaaggctttcgcaaatggccagggcggcgggcatccacctgatcattgcgacgcagaggccttcggtcgatgttatcacaggggtcattaaagccaacattccgtcaaggatcgctttcagcgtatcgtctcagaccgactccaggacgattcttgatatgggaggcgctgaaaaacttctcggcagaggggacatgctgtttctccctgtcggcgccaataaaccgctccgcgttcaaggtgcctttctgtcagacgaagaagttgaaaaagttgtcgatcacgtcatcagccagcaaaaagcccaataccaagaagaaatgattccagaagagacgcaggaaacggtcagcgaagtgacagacgacctttatgacgaagcggtcgcacttgtggtcagcatgcagacggcttctgtatccatgctgcaaaggagattccgcatcggctatacaagagcggcgcggcttatcgatgccatggaagagcggggaatcgtcggcccatatgaaggatcaaaaccccgtgaagttctcttgtcaaaagagcaatacgaagaactctcttctt

SEQ ID NO: 192 - DNA, 1150 bp, Bacillus licheniformis
atgttcaagatgaaaagaaagcatatcaacattgacatcagtctgctgctcattctattttgtttgtttatcatcagcctgctggccgtttacagcgggtcgggccagtatgaaacacaggaccctttttattttgccaaacggcaggtcttttggtatcttgtcgggtttggcgtcatggcgggaacggcctacatcgactatgagctgcttgaacgattggcgcttcgtttatttgtgggagccgtttttcttctgattctcgttcatttttttggaacttacaaaaacggttcgcaaaggtggatcagcttcggggtcatcgaaatccagccttcagaatttatgaagatcattttgattcttctgctggcttcgatactcaatcaatttcagcataaaaggttctccttcgccgagagcatcattccgacgggaaaaatcatgatgtacacggtgattccgtttttctttatattggttcagccagatttagggtccgcattggtgattttatcgatcgcattcacgttgatgctggtctcggggatttcgggcaggatgatcgtgtccctgtcacttggattcatggcattggttgcctttttgacgtatttgcacaatcattactttgagatattttcaaagattattaagcctcaccagcttgaccggatatatggctggctcagtcctcatgaacatgcctctacatatggataccagctgacgcaggcgttattggggatcggatcaggccagctgtcagggagcggctttactcaaggaatccaagttcagggagggaaaattccggaggctcatactgattttattttcgccgtgattggtgaggaattcggttttttgggtgccgtaacattagtctgtctgtattttctgatgatctacagaatcatcaggattgcgctttcgtccaacagtctgttcggtctttatatatgtgcgggggttgcagggttgattgtattccaagtgttccaaaatatcgggatgacgatcgggttaatgccgatcacggggctcgctcttccgtttatcagctatggcggcagcgcgctgttgaccaacatgatcgctttaggtctcgttttcagtgtgaatatcagatctaaacattacatgtttg

SEQ ID NO: 193 - DNA, 1990 bp, Bacillus licheniformis
atgagctggtttaataaaatgttcagcctgtttttaggcgatgatgaagataatgaaaaacaaaaaaagcacatagacgaatttgaggcggattcatcttcagaggacgaagagatgccgcaaataaccgacgcaaaagtcgtatatgaatatccaaaagggaaattccgctttccggttatacctgatcaaaacacgcggccgcgggaaaaggacgacagccgcgaacaaaggacccgccgcccggcgagccgatattcagcttctcagccgaaacccggcaattcatatcattatgaagagaaagcggcggcgaaaaaaccttttaggccgtccgtcatcccatcaccggtttacggctttcatgagcagaaaagagccaagccggaaaatcatacatatcgtgcaaaaaaacaaactgaagcgcgtgtcacgctgtttaacgaagaaattgaaaaagagcagaagtctgcagaacataagcagccggtacgagaagaagcttccgtgcaaactgaaaagaacggccgtccgctgatcaaaagcgagagccgcaatcctgcattgcgcgccgaattcgaagatgtcccgcaggcatccacggagattccaaaagaaacggaaatccgtccagagcgaatgacagaaggcgcgggactcgcagaggaaaaagcgctgcggcatgaatccgaacgaacagaagcacctgtgtcagtgcatattccggaagaaacggaagtccgtccagagcgaatgacagaaggcgcgggactcgcagaggaaaaagcgctgcgaaatgaagctgtagaagagaccgcctccgcatcacaaaacataacggaggaagacgcaatccccgctgagcaaacaccggaacaaatcgaaaagcttttggataagattgaggaaaccggagaagagatggtactggcagaggacgcagaagccgccacggaagaacaagggaagacttacggttcgggcaaaacgcatcccgacccggaagcttcagttccggaagagccgcacactcatggccgcgcctctgaaataaccgtccagagcgatgaatcttcccataggacagattcaaacaccccggctgacgctcttgaagaaacaagcggaagccgccagactggctggagacaagagcaggcgtcatgttcaccggaaacggcagcgccaagcgcgggtgaacccgaaagcaggcaagagaaccgggagactacaaggataaacgaggatcggccggaagctccgcggaagcgggaagcaggagccgctccgggatcgaagaaaggctctgttccgtttaatgtcatgatgtttgcctcagataaacaaaaagaaaaagcgcctcaagggtatcagttcccgaatatgtctttgcttgatgtgccgccggcgcaaaagcaggatgatcaggactggatacacgagcagcgggagctgttggacgtcacgcttgagaacttcaatgttaaagcaaatgtcgttcatgtcacccaagggccttctgtgacaagatttgaagttcatcctgaacccggagtgaaagtcaacaaaattacaaatctgtcagatgatattaaactcagcctgtcagcgaaagatattcggatcgaggcaccgatcccgggaaaaaatacgatcggaattgaagtgccgaatctgcacagcaaaatggtttatttacgcgaaatgatcagaagttcggaatttagaacgaatccgtctcctctgacagcagctctcggactcgacatatccggaaagcccgtcgtggctgatctgaaaaaaatgccccacggtttgattgccggggctacgggatcaggaaaaagcgtatgcatcaacacgatcttagtaagcctgctgtttaaagcgtcgcctagggatgtaaagcttctgcttatcgatcctaagatggtggagcttgctccgtataataatattcctcatctcgtcagtccgggcgagctcagaa

SEQ ID NO: 194 - DNA, 870 bp, Bacillus licheniformis
ggatcaggcagaaagcctacgaaggcggatggggcagcgctttgccgaaccgcccgccgctatcgctcatccaaaagcgaaaacgctcgctgtcatgagcggaaaaggaggcgtcgggaagtcgaatgtatcgctgaatacggctctcgccattctggaaaaaggaaagagcgtgctgttgatcgatcttgatgtcggtatggggaacattgatattctgatcggccggcaatcgctctacacggtgatggacctcctccagcaaaaaatgccgtttgagcgcgccttgtcagccggcccgcgaggccttcaatacatttcgggcggaaccgggctggatgcaatgttcgaattgaacagggaaaactgggcgttttttctgaaggaattgacgcgggctttgacaagcttcgactatgtcatatttgacatgggagcggggctgtcaaaagatcagctgcctttcgtcctgtcagcggatgaaattctggtcgtcaccacgccggagccgacatccatcatggacgcatacagcgcgatcaagcatttggcattaaccggacgcgatcttcagctgaaagtcgttgtcaatcgctgtacaacccaaaaagacggaatttctgcttttctccgcctttccaacacggtaaacgcttttttgcagcaaaagcttgcatatgcagggccgattcctgaggatcccctggtctcaagagccgttgtggagcagcagccgtttctgataaagaatccgcgttccaagccgagcagggcggtttacctgctggccgaatcgctgcttcataacggcagaacggaaatgggcgaaaaccggtcctttatcgaaaaattatcttcattcctgaggag

SEQ ID NO: 195 - DNA, 609 bp, Bacillus licheniformis
tctctatatatcccggggaatttgtttatgttgtaggaccgagcggagcaggaaaatcaaccttcattaaaatgatttaccgcgaagaaaagccttccaaagggaagattgtcataaacaataaaaatttggcgcagctcaaagaaaaagagattccttttatcagaaggaaaatcggcgttgtattccaagactttaaactgctgccgaagctgacggtgtttgaaaatgttgcatttgctttagaggtcatcggggagcgcccagaggtgatcagaaaaaaagtgcttgaagtgcttgatcttgtccagctgaagcacaaagcaaggcaatttcctgatcagctgtccggaggagaacagcaacgggtttcaattgcgcggtcaatcgtcaacgaccctgatgtcgtgatcgctgacgagccgacgggaaaccttgaccctgagacgtcttgggaaatcatgaagacgctcgaagagatcaacaaccgcggaacaacagtcgttatggcgactcataacaaagaaatcgtaaacaccatgaagaaacgggtcatcgcaatcgaagacggggtcattgtgcgtgatgaagctagaggggagtatggtt

SEQ ID NO: 196 - DNA, 491 bp, Bacillus licheniformis
atgcctttgacgccaaatgacattcataataaaacatttacgaaagcgttccgcggctatgatgaagatgaagtgaacgaattcctggcccaggtgaggaaggattatgagatcattctgcgcaaaaaaaatgagcttgaaacaaaggtgaacgagcttgacgagcgtctcggccatttttcgaccatcgaagagacgttgaataaatcgatccttgtcgcacaggaagcggcagaagacgtaaagcgcaattccgagaaagaagcgaagctcatcatccgtgaagctgagaaaaacgctgatcggatcattaatgagtctctttcaaaatcgagaaagatcgcgatggaaatcgaagagctgaaaaagcagtcaaaagtgttcagaacccgtttccaaatgctgatcgaagcgcagcttgacctgttgaaaaacgatgactgggatcatttgcttgaatacgaagtagacgcagtaatggatgaaaagga

SEQ ID NO: 197 - DNA, 913 bp, Bacillus licheniformis
atgattctttcccatctaaagaaacttgattatgtattgattgccgcggttctgtttttatctgcgtttggcttgctgatggtatacagcgccggctaccccctcggatatatgaagtatcatgatggcagctatttttttatgaagcagctgcaatggctgctcatcggtttggcctttttttcggctgccgccattttcccatacaaagcttacagcaaactcattcggtttttggtgaagctttcttttttaatgctgattctcgttttgctgccgggaatcgggatggagaaaaacaattcccaaaggtggattcaattcggttcgctcatgattcagccgtctgaggctgtgaagcttgtgatggttatttatttcgcctatgtgtatgcaaaaaagcagaaatacatcgccgatttcggaaagggcgtcatgccgccgctgctgattttggcggctgtgttttttttgattttaaaacagcctgacttgggcaccgccgtttccatcctgttaagctgcggagcggttctgttgtgcgccggcctcagaatgcggcacttgctgcttctcggaacaatggcaggggctggcatcgcatattttgcaataacagcgccgtaccggttaaaaaggctgacatcgttcagcgatccttttcaaaatgaaaacggagacggctaccagttgatcaattcctaccttgccattgattcgggcgggttatgggggaatggattggggaacagcgttcaaaagctgggatatcttcccgaagcccatacggactttatcatggcggtcatcactgaagaactcggcggtatcgggctggcggtgatcatgtgggcatacctgttgatcatgttcagaggggttcggatcgctgtgggaatcgatgatccgtttg

SEQ ID NO: 198 - DNA, 744 bp, Bacillus licheniformis
aattattgcgatcacaaaccaaaaaggtggcgttggtaaaacgacaacctctgttaacctgggagcttgcttagcttacatcgggaaaagggttttgttagtcgacatagacccgcaaggaaacgcaacaagcggtatcggcgttgaaaaggctgatgttgatcaatgtgtgtacgatatattagtagatgatgcagatgtgaaagatgtcatcaaaacaacatccgtagaaaacttggatgtcattcctgcaacgatccagcttgcgggggcggaaattgaacttgttccgaccatctcccgagaagtccggctgaaaagggctttggaatcggtcaaacaaaactatgatttcatgattattgactgcccgccgtcattagggctgcttacaatcaatgcgcttacggcttccgattccgtcgtgattccggtccagtgcgagtattatgcgctggaagggctgagccagctgctcaactctgtccggctcgtgcaaaaacatttaaatacggatctgatgatcgacggcgtattgctgacaatgcttgatgcaagaacgaatttaggcatacaggtcatcgaagaagtgaaaaagtacttccgcgataaagtatacaaaacggttatcccccggaatgtccggctcagtgaagcgccgagtcatggaaagccgatcattttatatgatccccgttccagaggagcggaagtctatttagaattagcaaaggaagtggctgc

SEQ ID NO: 199 - DNA, 1410 bp, Bacillus licheniformis
atgaaaaaatacgaactgtcatttgatggagtgacgctgattgcaggtgtctccggcggacctgattcgatggcgcttttgcatgctctgcaccatacggttcccgcttctgcaacgctgattgccgcacacgtcgatcatatgttcagaggcgaagagtccgagcgtgatatgcggttcgttcaggactactgcgaggcggaaggcatacaatgcgaggcggtgcaaatcgatgtcctggcatttgccgctgaaaacaatctgaataaacaggctgctgcgagagaatgccggtatgcgttttttcaagagttaatgaaaaggcaccgggccgaatacctggttctgggtcatcatggagatgatcaggtggagacgatgctgatgaagatggcaaaaggcactgtcggaatcgggcttgccggaattcagccaaagcgccgttttgacagcggctggctgctcaggccgtttctgaagctgtcaaaggatgatcttttggcttactgcaaagagaatcgaataccgtttagaaccgatccgagcaacagtgaggatgattacaccaggaaccggttcaggcaccatgttctcccttttctgaagaaagagtcggaagatgtccataaaaggtttcaatccgtcagtgaattcctgacagaagacgaattatacttacaggcattaacgaaagacaaaatgaatacagtaatcacaagcaagtcaagttcaggcgtggaaatcagcatcgaacgacttcttgcgctccctatgcctttacaaagaaggggagttcatctaatattaaactatctttatgaaaacgttccatcagcgttttcagcccatcatattcaagtgtttctggattggatttcacaagacggaccatccggttcccttgattttccgaatgggttaaaagtcgcaaaatcttatcatacatgtttgtttacatttcagcgtttacaatgtgaaaatgtttcctatcattatgaaataagcggggcaggcgaagaagaactgatacttcccggcggctcctcccttcatgtgagcggacccggttcaacccggaagctgcaaggaaatgatgtttttgcaacaagtcccaagcaggttcagtttcccctttacgtacggacaaggcaaaacggagaccgagtcaaacttaaagggatgaacggctcaaaaaaggttaaagatatatttattgatgaaaaagtgcctctttcaaaaagagacagctggcccattgtaacagacgcggttggaaacattatctggatacctggtctgaaaaaaaccatttttgaggaacttgatgttacaaacaacgatcgcattgtattacaatatagacagcatgaaaagtgtagggggctagcaaagaatgaaacaggatattga

SEQ ID NO: 200 - DNA, 566 bp, Bacillus licheniformis
atgacccgacagctcatattggcttcacaatcaccccgcagaaaggaactcctcgatctcctgcagattccgtacagcatcgttacgagcaatgcggaagaaaaattaattcgaaacttttcaccagcagaaaacgtcaaatggttggcggaacaaaaagtgcgtgcagtagccgaacaatatcctgatgccgtcgtgcttggcgccgacaccattgtttattatgacggagcttatttgggcaagcccaaagatgccgaagatgcagaacggatgctgagcatgctttcgggacagacccattcagtgctcaccggcgtctgcattaaggacggcgaaagatgcgaaacattttttgaggaaaccgaagtctctttttggcctcttgaagaaaaggaaatcagcgcttacatcgctacgggagaaccgtttgataaagccggttcatacggaatacaaggaaaaggcgcgctttttgtcaaacagataaaaggagactattatacagttgtgggccttccgatttccaaaacgatgagaatgctgaaaacgtttgatctccactc

SEQ ID NO: 201 - DNA, 441 bp, Bacillus licheniformis
atctgttcatccactccattgaaagtgaagtcatgaccaaagatgaagcaaaccgcttaaaagcggaaagcgaaattatttctgtcgctaagattgtccgttccgggcaagtccttgaaacggagggtgatttgcttctcattggggatgtgaatccgggaggaatggtgaaagccggagggaatattttcatcctcggctcattaagagggattgcccacgccggttttaatggaaataaacgagctgttattgcggcttcggatatgagaccgactcaattgcgtatcaatcatgtgctcaatcgctccccagacaacatccaagaagggaacgacatggaatgtgcttatttagatgaaaatgagaatatggtcattgaccgccttcagcaattagctcatttaagacctagtttaacaaggcttgagggaggaatgt

SEQ ID NO: 202 - DNA, 462 bp, Bacillus licheniformis
  misc_feature (1)...(462): n = A,T,C or G
caatccgagcgaacagaatgccgacgataaaatgcaggtcgaaagggcgcaaatggcgatcggttcagganaagtattcggaaatggtgtaagcgatcttcaagtttagtaacctgaggcgcaaacagactttatttttgcgttcattggcgagagtttcgggtttgtcggatgcacttttgttgtcattatgtttttcttcttaattaaccggcttgtcgtgctcatcgaccgaatacatccgttcagcaggtttgcctcatttttctgtgcgggctttaccgctttaattgtcattcatacctttcaaaatatcggaatgaatatcggcattatgcccgtgaccggcgtcccactgcttttggtcagctatgggggcagctcagtcgtagcaaccttgctcggcttcgcggttgtatacaattcaagctgccagttaacaaagtatcaaagctatatgtt

SEQ ID NO: 203 - DNA, 480 bp, Bacillus licheniformis
ctggcacaaagtggaatacgacaaatgaaacgaactccgcctatttgtctggactgaaaagctggtttattaccaataaatatcctagtgcagaatctattaagattacgaaaatctcaagcctgaccctgagcagcgcaaaaactgccggtcagcggccgaaaacagcagaggtgaagttttcttactttgttaaagaaaaatcaaatggctatgttctatcaaacggaaaactttcttaaaaaacagcgattatttccgtgacgacgactcaattaagatcgatgctgggcggcatgaatatgaagagcacgtatgcttctgtatccagcaatacgaacgcttttactctcagcggtaaaggattcggacacggcatcggcatgagtcagtacggatcaaatgccagagctgctgccgggcacgattacaagaagattttaagtttctactatccaaatacgactctatcaagctatt

SEQ ID NO: 204 - DNA, 279 bp, Bacillus licheniformis
gatccgcaaccacttaatgaaaaacggcgatacgctggatgttgatgaagtcattcagcacttgtcgatcgaactgatcggtattgttgcggatgatgatgaagtgattaaagcttccaataacggggagcctgtcgtcatggacccgaataataaagcttcaatcgcataccggaacatcgcccgccgcgtgctgggcgaatctgtgcctttacagtcgtttgaagaagaaaataaaggcgttttcgcaaagattaaatcatttttcggcgtacgcgc

SEQ ID NO: 205 - DNA, 270 bp, Bacillus licheniformis
ttttccttctcatttaccggcttgtcgtgctaattgataagatacaccggtacaacaagtttgcatcgtttttctgtgttgggtatacggcgctgattgtcatccacacattccaaaatatcggaatgaacgtcgggctgatgccggttacgggcgttccccttctgttcatcagctacggagggagctctgtattgtccgcactgatcggctatgcgatcgtttataacgccagctgccagctgacgaaatataaaggctatatgttta

SEQ ID NO: 206 - DNA, 525 bp, Bacillus licheniformis
  misc_feature (1)...(525): n = A,T,C or G
cgggcctgccggggaggaggcaatcattctgggcttcaaacttggcgatctaattttcgcaacaggaaaaaaaggtccttttgatcgacgcagattaagaaagccgacgatccataaaatttttgagctcgataaccattcaggtgtcacatatgtattaatgaaaaaatcgacgctggaagatgtcgtccagcaaagccaggcggaaatctcncatgtgctgacaagcggtccgattcctccgaatccgtccgagctttggtcgtcgcaggcgatggaggacctgcttgcggaagcgtacgaccaatacgatttagtcatccttgattcgccgccgcttttgccggtcgcagacgcgcaaatattggcgaatcaggtggatggaagcattcttgtcatcctcagcggaaaaacaaagcatgataacgcgatcaagtctcgggacgcgctgaattcttccaaaagcgaactgctcggcgccgtgctgcacgggcggaaagtgaagaaagcgcgccaatataatta

SEQ ID NO: 207 - DNA, 732 bp, Bacillus licheniformis
aggacggctacggcacagaggatgaagtggcgatcgtcacagataccggattaattcctttatcagatgttgatgctgatcgcgctgcgaaaaaagaggctgtgacggaaatttcggcagtcgtcgaacaaattgaacggattcaagcggagatgggaatcgagaagctcccgagcccttggctgccgccgcttgaagaacgcataccgaaaacgcgctatccgtcggaggaagccgatgcctttaactttgcctatatcgatgaacctgaaaagcaaagccaggagccgatcagctaccgcatgatggaagacggcaatatcggcatcgtcggctcgtcaggctacggaaaatccctgacagccacgacgttcatgatgagctttgccgaacagtatacgccggaagaattgcattactacattttcgactttggcaacggaacgctgcttccgcttgcaaggcttccgcacaccgcggattatttcctgatggaccaaacgagaaaaatcgagaaatttatggtccggatcaaggcggaaatcgagcacaggaaaaatctcttccgtgcaaaagaaatcagccatatcaagatgtacaatgcgctgaatgaggaaaagctgccgtttattttcataacggtcgacaactttgacatcattaaagacgaaatgcatgaactcgaaagcgaatttatccagttttcacgagacggccagtcgcttggaattt

SEQ ID NO: 208 - DNA, 364 bp, Bacillus licheniformis
atgaaatcatatgttgccgtttttatcgggggagccatcggatcgctgctgcgctacgcagtcaatctgctcggcggcaccgccgtttttccttggccgacttttattgaaaacacgtccggaagccttctgctcggccttttgacaggcttttttgcggctcgggcaaaaaagccgctcgtccaattatgcttagggacggggttttgcggcgggtatacgacaatgtccgctttttctaaagaaaccgtacttctgctgcaatcggccgctcacatcggagttctgtacttgatggcatcgcttgcctgcggggtatgcttcgcatttttggggatcgtgatcggcaaaaaggtcagcggag

SEQ ID NO: 209 - DNA, 507 bp, Bacillus licheniformis
aagagacaaaggcattaaacgcaaaagagacgaactggagtgaagccccgtattcacagctgatcgaccatgtgattcatacgcaccatgcctacctgtatgaggtgcttcctgaactgtcaggctttgttacaaaagtataccgggttcatggcatccatcatccggagctcgcccaggtccatcaattgttccatcagctgaaaacagaactcgaacatcacctcttccaggaagaggaacatattttcccgaaagtgatggcctatgaagagacgcgatcaatggaccgcttagcagaagcggttcagacgatcgacgtccttgaacaagagcatgaagccgcaggcagcatcctgaaggaactgagaagagtgaccaatgactatacccttcctgaaggggcatgcacaacatatacactgacttacttaaagcttgatgaattggaaacggatctttttcagcacattcacctggaaaacaatattttgttcccgcggcttg

SEQ ID NO: 210 - DNA, 171 bp, Bacillus licheniformis
ccgctttgcccaatacttgaaaaaatacagccatgaaacccagttcatcgtcatcacccaccggaaaggaacaatggaagaagccgatgttctttacggcgtgacgatgcaggaatcaggcgtttccaagctggtctcagtcaagcttgaagaaacaaaagaattagttca

SEQ ID NO: 211 - DNA, 345 bp, Bacillus licheniformis
cctgtccaccggacagaacagtcccaccgcgcttcgccgccatcacattcgtccccgtccagcctccccggaaccggaattcgccccccctgaaccctccacccaaaatcaggccaaccgcccctcacgtcccccctacctctccccaccgcgacccccctcggccaccccccggcacgccctcccccccctcccccccaccccccctccctcccccgctgcctcgcccccccagagcacttcccgcttctccccccccacccccccattcccgccccacgctctccgacgcctcgaccccccgtctcccatgcgcacgtccccccccgatacctcgacacccac

SEQ ID NO: 212 - DNA, 510 bp, Bacillus licheniformis
atggtcaagcaggtgctcgagcatgatcttgatgacgtttgtttttccgcgctgcgtctgacccataatgaggcagtgcttatttttctcaagattaaagtatacgggttcgacagtttcttcatcgagtcccattggaataaggcctctttcaggctgaagcggataatctctcacaaactgtgtgacggaaagctcgagcggcagcatcggcacaggcgccggctttctcatgccttccgagcgttctgcgatcgcctgaatgtcggctttgatcccttcaaacagctcgatatcgttgtccgcttccacaggcataaacatttgtgcgaagtattggttttctttattgataataacgcgtccagggatcggttcaaggctgaattccggccttccgataatcgaatatgcttcagactgatccatcagatagtggacaaccctcgttttcaggttgttcaagagcgactgtctgattgcattgacccttgtcgcggtcaggattaa

SEQ ID NO: 213 - DNA, 477 bp, Bacillus licheniformis
atgaggatcttcattatacaaagtctgccgggcccgcacaacacccctttccccttattccccacacccccgagaacccccccaatgaccgcccacccgcccaatgccccccagaaccctcccgtcccccctataccctctaagaacctccccgaatcctcccccctacccccccctacgccgctccaaacccccccctccctcccgttgaacccgcccaaaactctcgagttcccacctcgcaatccgccctcaactcccgccccgaggacccttccccatatccgccctccccattcctcgcccggttaccccgcccccacagcccccccgccatgcccaccccaatacccctctccgaactcctcccttctatccccttcgcgcaacccccgctcccctacatcctctatccccgaactctcgctactccttcccagttggccacgtccccctcttcacaacaccacaccctaa

SEQ ID NO: 214 - DNA, 318 bp, Bacillus licheniformis
tcgcgggaggaatcgggtccgttttgagattttggctgggcaatgtgctcatggcgatgattccgcgcccccgcattccggtcagcgtgatggtgatcaatattctcggctcattcgctctcggcatattcataagcctcggcattgacaatcaaacggtctctatcgtggtcggaactggatttttcggaggcttcacaacattttcgacgttcagcgttgaagctgttcagcttttggctgcaaagcgggtaaaggcttcagcggtttacatcctgcttacaatggcaggctcaatcggcggattctgggccggca

SEQ ID NO: 215 - DNA, 417 bp, Bacillus licheniformis
atgcctcgtccattcccattcccactgatcatggacgcaaatctaatcctgcccttgtacggcctccacaccgctccgcgcccctgtaccaccaccactaccccgcacaccacccacgctaccgcccctcacgcacatcccaccttcctccaacgctacaatccgccgtgcgctctcccaccttctccacccaacacatatacaatgctacttttcgggtgcttccctggcccccgccatacaccaccccccccgtcacccaccccgcgtcaccttgttctgggccaccacacccgcacactccccccacctccactcccctccacctccttactcgttcacccatcttccctcgccgcccacccccctcaccccttcctcccccacccccctcccaccccccctcccccactttag

SEQ ID NO: 216 - DNA, 246 bp, Bacillus licheniformis
tggaaattcaaattaagtatgaaggatatattgaaaagtccttgcagcaggtcgaaaaactaaagaaaatggaaaataaaaagattcctgacagaatcgactatgacgcgatcaaaggcattgcaacggaagcgcgccaaaaattgaaagaggtcagaccgctgtctgtcgcacaggcctcacggatttccggcgtcaatcctgctgatatttccatactgctcgtttatttagagcagggacgga

SEQ ID NO: 217 - DNA, 168 bp, Bacillus licheniformis
gtacgttgaaataagactggatttttctgctgaaaatcgccggtatcatcattgttccgttcggcttgattttagagcaggatacgggtacagccgggatcgtcgcgtttgtgatccttgtgatggtattcctgtcgggcgtgaactggaaattgtgctctcttatct

SEQ ID NO: 218 - DNA, 273 bp, Bacillus licheniformis
atgggccttgaaaatagaatcatatatgatttggtggatgtcgttgaggaacgatgcaaaatccatcaggcgcttgtgaaagataagcgctttgatgatttgctttatttgctgccggccgctcaaacagcgataagtcggctgttttgcccgacagatgtcaagctgatccagcagctcaaacaagacttcgactacattgtcattgactgccctgcagggattgagcaagttataaaatggcgtctcggccgcaacaagcgattgtcgtga

SEQ ID NO: 219 - DNA, 3825 bp, Bacillus licheniformis
tgcaacacaacgggggaaataatacgctgcgcggcaatatgaactggatgaaagcgagggagcagcagtttgtttctgaagcgttcggtgaagacttgccgaaggttttgccgattctcgatgaaaatggaagcgactcctcgatactggataacgcttttgaattctttgtactggctggaagaaagccggcccatgctgcaatgatgctgattccggagccgtggaacgagaacccgtacatgtcaaaagaaaagaaggcattttacgaatatcacagctctttaatggagccttgggacggcccgactgcgatttcttttacaaacggaaaacagatcggagccattttagaccggaacggactcagacccgctcgctattatgtcactaaagacgactaccttattttttcttccgaagtcggcgtaattgatgtcgaacaggaaaacattttatataaagaccggctggatcccggaaaaatgctgcttgttgatcttgaagaaggacgtattatctccgatgaagaagtcaaatccgaaatcgccggagagtttccgtaccaggaatggctcagtaaagaactggttcatgtctcaaacgacattgaggaaaccgaagaaaaatctgtgcctgatctgctgacccgccagaaagcattcggttttacgtacgaagatattcacaagtatttaattcctgtcattacagaaggcaaagacccgctcggttcaatgggtcacgatgtcccgctggcggtgttgtcagaccgtccgcaatcgctgttcaactattttaaacagctgtttgcacaggttaccaatccgccgattgatgcaatccgcgagcagatcgtcacatcgacattgacatggctcggagcggaaggcgatattctccatccgaacgaaagcagctgccgccggattaaattgtatacaccggtcttgacgaacgcgcagttcaattctttaaaggggcttgtacacaaagatttcaaaagcaagacgattcacacgctctttacagacgacttgaagagcggactcgaagatatgtttaaagaagcggacagagcgatcgccgaaggcgtgacactccttatcttatccgaccgcaaaatggacggtcaaaaagcgccgattcctgcgctgctagccgtcagtgccttgcatcaatatttggtccgtgcaggaaagcgcacaaaagtcagcattatcgcccaatcgggtgaagcgcgcgaagttcatcattttgccgccttgatcggctacggagcggatgccattcatccgtacctcacatatgcgacatacaagcaggcgattgaagacggagcgctctccatcagttatgaagaagctgtaacaaaatacagcaaaagcgtgacagaaggcgtcgtaaaagtgatgtcaaaaatgggtatttccacagtccaaagctacaggggcgcacagatttttgaagcggtcggaatcagcaaggacgtcatagacagctatttcacaggaacggcttcacagctcggcggaatcggtttggacacgattgccgaagaagcgaagcgccgccacagggaagcttatgaagatacattcagtgaaacgcttgattctggtagcgattttcaatggagaaaaggcggggaacaccacgcttttaatccgaaaacgattcacacgctgcaatgggcctgccgcaaaggtgattacagcctgtttaaacaatattcgaaagcggctgatgaagaaagaatcggttttctccgcaacctcttctcgtttgatgaaaaccggaagccgctgccgcttgaagaagtcgaatccgctgaatcaattgtacgccgctttaaaacaggggcgatgtcattcggctctttaagcaaggaagcccatgaagcgctggcgattgcaatgaaccgtctcggaggaaaaagcaacagcggggaaggcggagaagatccggcgcgctttacgcctgacgccaatggtgataaccgccgcagcgcgatcaagcaaatcgcttcaggccgtttcggtgtgaaaagccactatctcgtcaatgccgacgagctgcaaattaagatggcgcagggtgcaaaaccgggggaaggcggacagctccctggcaacaaagtgtatccatgggttgccaatgtacgcggatctacgcctggggtcggcttgatttcaccgccgccgcaccacgatatctactcgattgaagatttggcgcagctgattcatgatttgaaaaacgccaaccgcgatgcacggatcagcgtaaagcttgtcgctaaagccggagtaggcacgattgcagccggagtcgccaaagcgacggccgatgtcatcgtcatcagcggctatgacgggggcactggagcatcaccgaaaacaagtattaagcataccggcctcccatgggagcttggactcgcagaagctcatcaaacactgatgatgaacggtttgcgcgaacgcgtcgtattggaaacagacggaaaattaatgacgggcagagacgttgtcatggctgcgcttttaggagccgaagaattcggttttgcaacggcaccgctcgttgttctcggctgcgtcatgatgagagcctgccatttggatacgtgccctgtcggggtagcgacgcaaaaccctgagcttcgcaaaaagttcatgggcgatccagatcacatcgtgaattacatgctctttgtcgcagaagaagttcgcgaattgatggcccagctcggtttcagaacggttgatgaaatggtgggccgcacggatgtcctgcgtgtcagcgaacgggccaaagcgcattggaaagcgggtcagctcgatttatcaagcctgctttaccagccggaaggcacacgtacattccgtacgccgcaaaaccataaaatcgatgaatcgctcgatgttacgcaaatcttaccggccgtgcagtcagctgttgaaaacggtacgcctgtagaagcgtcttttgaaatccgcaacatcaaccgtgtaacaggagccataaccggaagcgaaatttctaagcgctacggcgaagaaggtctccctgaagatacgattacgctccgattcacaggttcagcggggcaaagctttggagcgttcgtaccaaaaggaatgacgatgtatttgacaggagatgccaatgattacatcggcaaaggtctttcaggcggaaaaatcgccgtcaaagcgcctgacgaattcaaccctgcattccgtgaaaatgttattgtcggaaacgtcgcgttttacggcgctacaagcggagaagcttatattaacggactcgcgggcgaacggtttgccgtcagaaacagcggagtcagcgttgtcgttgaaggcatcggcgaccatggatgcgaatacatgaccggcgggcgcgtcgccattctcggagacgtcggcaaaaactttgccgcaggcatgtcaggcggaatcgcctacgtatacgccgaagacaaaaaagcctttaaacggaaatgcaatcctgaaatgatcgagtttgaaacacttgaagcacctgaggaaatcgctgaactgaaaacgatgatcgaaaaccattacaaatataccgaaagctcaaaagcagcttcgatactggatcattgggaagaggccgtcggtcggtttgtgaaagtgattccgaaagacttcaagcaaatgatagagcggattaaagagcagaaagaagccggcttgtctgatgaagaagcgttgatgtacgcgtttgaagccggtacgaaacaaaagattgaaccatctgcggctgcttcatcaaaagaagcggtggcacagt

SEQ ID NO: 220 - DNA, 2418 bp, Bacillus licheniformis
ctaacatcaatgaccagctgaagaaaaaaatcctcgtccttgacggtgcgatgggaacgatgatccaagacgccggtttgtccgccgcagacttcggaggcgaggcatatgaagggtgcaatgaatttctaagcattacggcgccccatgtcattcagggcatccacgaagcctatctcgaggctaaagccgatatcatcgagaccaatacgttcggagccacccggctcgttctggacgagtacgacctcgggcatcgagcctatgaagtcaacctcgcttcagtcaaactcgccaaagcggccgccgaaaagttttcaactcctgaatggcctagatttgtcgccggtgcgatgggtccgacgacaaaaaccctttccgtcaccggcggcaccacctttgacgaactgatcgataactacgaggaacaggcaagagcgctgatcacggggggagccgacctcttgctcctcgaaacgagccaggatatgctgaacgttaaagccggctttatcggcattagacaagccttcgaaaaaaccggcaaaacccttccgctcatggtgtcaggcacaatcgaaccgatgggcacgacgcttgccggccaggatatcgaatcgttctatatctccctcgagcatatgaaaccggtcagcgtcggtttaaattgcgcgacaggcccggaatttatgacagatcacatcaggaccctttcttccctagcgaggacggccgtcagctgctatccgaatgccggcctccccgatgaggaggggcaataccatgaatcaccgcaatcgctggcgaaaaaaatcaaggcgtttgctgaagaaggctggctgaacattgtcggcggctgctgcggaacgacgcccgcccatattgaagcgctggccgatgaagtagcccttctgcctccgcggacggttccttcgggagcaaagccgcacaccgtctcaggaatcgacggattaatttacgaagaaacaatgcgtcccctttttgtcggtgagcggaccaatgtcatcggctcgagaaaattcaagcggctcatcgccgagcataaatttgaggaagcatccgaaatcgcgagagcccaagtgaaaaacggcgcccatgtcatcgacatctgtctcgcagacccggaccgcgatgaagcggaagatatggaaggctttttaaaaaaagcgatgaaaaaagtaaaagccccgtttgtcatcgactcgacggacaaaacggtaattgaaaaggcgctgaaatactcgcagggaaaagcgatcatcaattcgatcaatcttgaagacggcgaagaacggttcgctgacatccttccgctcgtcaaacagttcggaggcgcactcgtcgtcggcacgatcgatgaagaggggatggcagtcaccgcggcaaaaaagctggccgtcgccgtccggtcgcatcagctgctcaccgaaaaatacggaataccggccagcgatatcatattcgatccgctcgtcttcccggtcggaacgggcgatgaacaatacatcggctcagctaaagaaacgatcgaagggatccgcctcatcaaagagcagctccctgaatgcttaacgattctcggcgtcagcaacgtctcattcggtcttccgcccgtcggccgggaaatcttaaatgctgtattcttgtaccacgcaacacaggctgggctcgattacgcgatcgtcaatacagaaaagcttgagcggtttgcttccattcctaaagaagaagtcgagatggctgaaaaacttctgtttcataccgacgataaaacgctcgcatccttcactgacttctatcgtggaaagaaaaaagcggacaaacagccgaaaacgtccctttccctcgaagagcgcctggccgaatacgtaatcgaaggtacaaaagaaggcttgattcccgatctcgaacaagcgttgaaaaaattcgccaccccgctcgacgtggtcaacggtccgctcatggacggcatggcagaggtcggacggctgtttaacaacaatgagctgatcgtcgctgaagttctgcagtcggcagaggttatgaaagctgccgtttcctttctcgaacaatatatggaaaagaaagacgacagcggcaaaggaaagatcattttggcaaccgttaaaggcgatgtccatgatatcggcaaaaacttagtcgacatcattttaagcaacaacggctacaaggtagtcgatcttgggattaaagtgacaccgcaggagttaattgaggcgatccgcaaagagaaccccgacatcatcggtctgtccggcctgctcgtcaaatcggcgcagcagatggtcgttacggcgaaggatctcgataaagcggatatttccatcccgatcatggtccggcggaacccgcgcctttcaaaaaaatttacgaacc

SEQ ID NO: 221 - DNA, 2100 bp, Bacillus licheniformis
ccgactttgccatttccgacaatgtacttgacacggccgtgatgttcaactggattccagatcgattcagggatataaacgatccgttagatacttatttcgcaatggcgagaggcacgaaagatgctgtatcgagtgaaatgacaaaatggtttaatacaaactaccattatattgtgcctgaatatgaaaaaggtgcacaataccgcgtgacgagaaacaaaccgcttcaagattaccaaagagcaaaagcagcattgggaacagtaacgaagcccgtcatactcggcctttacactttcgtagcccttgcaaaaggctatgaacaacaggatattaaagatatttataaccaaatgacacctctttacatccaggttttgaaagagcttgagcaggaaggcgtcaaatgggtgcaaattgacgagcctgctcttgtgacggcttcacctgaagaagcggctgctgtcaaagaaatctatcagacgattacagaagaagtctctgaactgaacatccttctgcaaacctactttgactcggttgatgcttatgaagagctgatatcgtttcctgtcgcaggaattggtcttgattttgttcatgataaagggaaaaacttcgaacacctgaaagcgcacggttttcctaaagacaaagtccttgccgccggcattttagacggacgcaacatttggaaagccaatctcgaagagcgcctcgacctgacgcttgaactgatccagagagcgggtgttgacgaagtctggattcagccttcaaacagcctgcttcatgtccctgtcgcaaaacacccgggcgaacatcttgccgacgatctcttgaacggtttatctttcgcaaaagagaaacttctggagcttacactgctgaagaacggacttgtttccggaaaagcggccatccaagcggaaatcgatgaagcgcacggacaccttcaagatctcaaacagtacggtgcagcgacaaattcggcctttgccgaagaaagaggcaagctgactgaggaagactttaaacgcccgacagcttttgaagaaaggctgcggattcaaaatgactctctcggacttcccctattgccgacaacaacgatcggcagcttcccgcagacggcggatgtgcggagcgcgcggcaaaaatggcggaaaaaagaatggtccgacgagcagtatgaagcatttattcaggaagaaacaaagaaatggattgatattcaggaagatctcggacttgacgttctcgttcacggagaattcgaacggacagacatggttgagtatttcggcgaaaagctcggaggattcgcctttactaaatacgcctgggttcagtcatacggttcccgctgcgtccggccgccggtcatctacggagatgtcgagtttaaagagccgatgacggtaaaagaaacggtttacgcccaatccttgacctcgaagaaagtcaagggcatgctgacagggcctgttaccattttaaactggtcctttgcccgctatgacctgccgagaaaagagatcgccttccaaatcgcctgcgccctccgcaaagaggttgaagcgcttgaaaaagcaggaattcaaatcattcaggtcgatgaacctgccttgagagaaggcctgccgcttaaagaacgggattgggacgagtatctcaaatgggctgcagaagcgttcagactgtccacttcatctgtggaagatacgacgcaaatccatacgcatatgtgctacagcaactttgaagatatcgtagacgcgatcgaagatcttgacgcagacgtcattacgatcgagcacagcagaagccacggcggatttcttgattatctggaacagcacccttacctgaaagggcttggtcttggcgtatatgatattcacagccctcgcgtcccttccagcgatgaaatgctcacgatcatagaagacgcgctgaaagtctgcccggctgatcgcttctgggtaaaccctgactgcggtttaaaaacgagacagccagaggaaacgatcgcagcgcttaagaatatggttgaagcagccaaacaagcaagaggcaaactggctcagactgttt

SEQ ID NO: 222 - DNA, 1842 bp, Bacillus licheniformis
atgtgtggaataacggggtgggtcgattttaagaagccgcttgtccgagagcagtcaatcatggagaagatgactgatacgctttcgaaaagaggacctgatgatacgaatatttggggaaagcgccatgttttattcggacataaacgcttggcagttgtggatctggaaggcggcagacagccgatgacccgcacacatcaaggatatgattatacgatttgctataatggcgagctctataatacggaggatttgcgaaaagagcttaggcggcgggggcatcaattcaagagccactcagatacagaggttttgcttcattcatacatggaatggaaagaggaatgcatcgacaggctgaacggaatttttgcatttgcggtatgggatgaaaagcgggatcttctttttgcggcacgcgaccggcttggtgttaaaccgttcttttacaccgaacagggctcatcatttttgttcggatctgaaatcaaagccatcctcgctcatcctgaagtgaaagcaaaggtagaccgttcagggctggcagaaattttcggcctcggcccgtcacgatcgccggggagcggtgtttttaaaggagtaaaggagatccgcccggggcatgcgatgattttctcaaaagacggtttaacggtttggcgctactggaatgtgaaaagcgagaagcatacggacagctttgacgaaacggtggaaaatgtgcggtcgctgtttcaggacgccgttacaaggcagcttgtgtctgatgtgccggtatgtacgtttttatctggaggggtcgattcgagcgccattaccgcaacggccgccaagcatttcgagagagaagggaaggcgccccttcatacgttttcgatcgattatgaagacaatgagcaatattttacgtcaagctcatttcagccaaacgccgacggcccgtggattaaaaaaatgtccgatgcattcggaacggttcatcacaattgcgtgatatcccaggaggagctggctgcctatttggaagaagccgtactggttcgggatttgccggggatggctgatgtcgattcttccctgctatggttctgccgcgagattaaaaaagactttgtcgtgagcctttcaggggaatgcgcggacgaaattttcggcggctatccttggttccattcggcagaagatgtgaaaggtttcccatggatgagatcaatggaagaacggatcggacttctgcaggacggctggcagaaaaagctgaacctcagcgaatatgtgaaggcaaaatatgaggaaacagttaaagaaacaccgctgctggaaggagaaacgggtgcggagaaacgaaggagagagctgttttacttaaatatgctctggtttatgacaacgctcttggatcgaaaagacagaatgagcatgggtgcgagcctcgaggtcagggttccgtttgcagatcacaggcttgtcgagtatgtctggaatattccatgggatgtcaaaatgcatggcagccgtgaaaaaggcatcttccgcaaggcgctggaaggcattttgcctgatgaagtgctgtaccgcaaaaaaagcccatatccgaaaacgcaccacccggcctatacgaaagccgtgatacgctggctggagtcattgctggagcaaaaagactcggcgctctatgctttcttagaaaagaaaaaactggagcggctgattgagacggaaggtgcatcatttcaagttccgtggtacggacaattgatgaagggaccgcagctgatcgcccaccttgcccaaatccatacttggtttgaaagttatcgaattgatatcgaggaataa

SEQ ID NO: 223 - DNA, 1407 bp, Bacillus licheniformis
atggcggaagaaaaaaaacttgggctgtttgcgctcatcgcgcttgtcatcggatcgatgatcggcgggggcgccttcaaccttgcaagcgacatggcttcaggggcgggggcgggagccattttaatcggctggatcatcaccggagtcggcatgattgccctggcattctctttccaaaacttgacgacgaaaaggcctgatttagacggcggtattttcacttatgcccgggaaggattcggccatttcatgggctttaacagcggctgggggtactggttcgcagcccttctcggcaatgtcgcatatggaacgctgctgttcagcgcaatcggatatttcatccctgcgtttggagacggacaaaacatcgcatcaattatcggtgcaagcgtgatcctctggtgcgtgcactttttgatcctccgcggtgttcagtccgctgccatgatcaacttaattacgaccatttcaaaacttgtaccgattttcgctttcattatcgccattatctttgtgtttcatcttgatttatttacgaacgatttctggggaaaagggctgtcgctcggttccatcggaacacaggtcaagagcacgatgctggtgaccgtctgggtgtttaccggaattgaaggggccgtcttattttcaagccgggccaagaaatcaagcgatgttggcaaagctactgtcatcggcttgatcagcgtactcgtgatttacgtcatgattacgatgctgtcgctcggcgtcatgaatcagcaaaacttggccgagcttccgaatccttcaatggccgcgatcatggagcatatcgtcggcaaatggggagccgtgctcatcaacctgggattgatcatttccgtattgggcgcctggctggcctggacattattcgcgggcgaactcccgctgatcgcggcacgcgaaggggtcttcccgaaatggttcggcaaagaaaataaaaacggtgcgccgacaaatgcgctgactttgacaaacgccattatccagctgtttttgctgacgtttctcatttcagatgcggcctaccagtttgcattttccttggcttcctcggccatcttgatcccgtatctgttttccgggctttatcagcttaaatacagctggctgcacaaagagcctaaccggggcaaaaatctcatcatcggcatcatcgcaagcatatacggcgtctggctcgtatatgccgcgggacttgattacctgcttttgaccatgattttatacgctcccggcattctcgtattccgggctgtgcgcaaaggaaaagaaggcccagtcttcaataaagccgagcttttgattgccgccctgattcttgtattggccgtgatcgccgtgatcagactggcttcgggaagcatttcaatttaa

SEQ ID NO: 224 - DNA, 1958 bp, Bacillus licheniformis
atgaagcagctgataaccgaaaaagacctcatcaagcttgtatccattaccgatccccagtattcgcccgatggtgcaaaaatcgcctacgtccaaacaaaagtaaacgaaaaacaggactcatatgattcgcatatcatgatctacgaccgcgaaaaacaagcttcggtgcaatggacgtttgggaaaggcagaaaccagcatccccgctggtcgccggacggcaaataccttgcatttacgtccaatcgcgaggaaaccgcacaaatttacgtgataagcgccgccgggggagaagcgagaaaagtgaccgatattccctatgatgtatcacagcctgaatggtcgccggacggcaagtcattgctttgttcagtgaagctgacaaaagaggaaagcgtcgacgatgagaagaaaaccgagattgaagaccacgaaccgctggaagtcgattctttgtcatataaagcagacggccaagggtttaaaaggggaaagtatacgcagcttgtcctcgttcaagtggaaaccggggaaatgaaacagctgaccgatcttgaacgcgaccatttcagccatgcattttcaccgtgcggagatcagattgcattttgcgccaatcaaacggatatgcgtgtgaacgatgtctacttgatgaacctttcgacaggtgatttgaagcgcctcacaggtcaaaacggcattttttcttcactatcgttttctcctgacggcaaacaccttgcatttatcggaaacgagaaagaatatcaaaacgccacgctcgataaagcatggctgtatgatattgaaacaggaaaactaacgtgtctgacggaaatgcttgacgtccatctcagcgatgcggtggcaggagacagccttgtcggaggcgttcttccgaaaccggcctggaccaaagacggaaacggcttttatgtcatcggatctgaccagggttctacaggcatttactacatatcaatcgaaggtcttgcttatccggtccggttggaaaaagagcatgtgaacggattcagcctgcatccggacgaaagtggctttgcggcatccatagccctgcccgtccggccgagcgaactttaccatctccaattgggtgaagaaaaagcggagcgactaacagatgccaaccaagcgtttacggaagaacatatcatatcggaaccggaggagcttcaatttcaggcagcggacggtctgacaattcacggatggctgataaagcccgcccaatatgaaaaaggaaacacgtatccgctcattctggaagtgcacggcggacctcacgccatgtatgcgaatgcttattttcatgaatttcaagtgctggccgcaaagggaagcgccgtcgtatatgttaacccgcggggaagccacggctacggacaggattttgtcaaccgggtgaggggcgactacggcggtggagattttaaggatgtaatggcggctgttgaccacgtgcttgaacattatgatttcgtcgatcaagaaaggctcggcatcaccggaggaagctacgggggctttatgacaaactgggctgtcggccacacgaagcgcttcaaggccgcagtgacacagaggtccatttccaactggatcagtttttacggggtaagcgacatcggctattttttcacagactggcagctcggtgcagacctttttgaagatccaggcaaactgtgggagcattcgccgctcaaatacgcggacaaggtggagacccctcttctcattctgcatggcgaacgggacgacaggtgcccgattgaacaggcggaacagctgttcacggcgctgaaaaaaatggggaaagaagtaaaactcgtcagatttccgaacgcgtcacacgatttatcaagaagcgggcatccgaagcagcggatcaggcggcttgagtatattgcaggctggtttgaagcttatct

SEQ ID NO: 225 - DNA, 1335 bp, Bacillus licheniformis
gtatatcagagacgaaccggcagatctccccgaagtgtccgagcttgatattatgcgccattatacggctttatctaggcgcaaccacggagtggattcgggattttatccgctcggttcgtgcacgatgaagtacaatccgaagattaacgaaaaaatcgcgagaatccctggattttctgcgatccatccgctccaggatgaagcgaccgtgcagggtgcgctggaacttttgtacgacttgagcgagcatttggaagagatcacaggaatggatgaggtcacccttcagccggctgccggcgcgcacggcgagtggaccgggctgatgatgatccgcgcgttccatgaggcaaacggcgatcataaaaggacgaaggttattgttcctgattcggcccacggtacaaatccggcgtctgcgactgttgccggatttgaaacggtcaccgtcaaatcgaatgacgacggccttgttgatctggaagatttaaagcgtgtcgtagacgaagaaactgccgcgttaatgctgaccaatccaaatacgctcggcctttttgaggaaaatattttagaaatggctgaaatcgtccatagtgccggaggaaagctgtactatgacggagcgaacctcaacgccgtactcagcaaagcaaggccgggtgacatgggattcgacgtcgtccatttgaatcttcacaaaacctttacgggaccgcacggaggcggaggacctgggtcaggtcctgtcggcgttaagaaggaattgataccgtatttgccgaagccggtgcttgtgaaaaaagacggacgctatacttttgaccatgaccgtccgcattcgatcggcagggtgaaaccttactacggaaacttcgggatcaatgtgagggcatatacgtacattcgttcaatggggccggacgggctcaaagaagtgacggaaaacgccgttttaaatgcgaattatatgatgagaaagcttgctccttactacgatctgccgtttgaccgacactccaagcacgaatttgtgctgtcgggaaggcgccagaaaaagctgggagtcagaacgcttgacattgcaaagcgccttttggacttcggcttccatccgccgaccatctatttcccgctcaatgtcgaggaatgcatcatgattgaaccgacagaaacagagtcgaaagaaacgctcgatgcgtttatcgatacgatgatccagatcgcaaaagaagcggaggaaacgcctgaagtcgttcaggaagcaccgcatacaaccgttgtgaaacgcatggatgaaacaaaagctgcgcggaagcccgtgctgcgctatga

SEQ ID NO: 226 - DNA, 1394 bp, Bacillus licheniformis
atggaaaacggtctgtttaagccgaaaaggcactggaaggatattgagctttggaaagatgttcccgaggaaaaatggaacgactggatatggcagctgaccaacaccgtcagaacgcttgaagatttgaaaaaagtcgtcaatcttacgaaagaggaagaagaaggggtgcgaatctccacaaagacgatccctttaaatatcacgccgtattacgcctcactgatgaatccggatgatccgcgctgtccgatcagaatgcagtcggtgccgctcgcagaagaaatgcacaaaacaaaatacgaccttgaagatccccttcatgaggatgaagattcgcctgtccccggcttaacccaccgctatccggaccgggttttgtttctcgtcactaatcaatgctcgatgtattgcagatactgtacaaggcggcgtttttccgggcaaatcggcatgggcgtgccgaaaaagcagctcgatcaggcgatcggctatattcgggatacgcctgatgtcagggatgtgctgatatcaggcggggacggcctcctcattaacgaccagatccttgaatatattttgaaaaacctccgcgccattccgcacgtggaaatcattcggatcggcacaagggccccagtcgtcttcccgcagcggattaccgacaagctatgcagcattttgaaaaagtatcatcccgtctggctgaatacgcatttcaacacgagcattgaaatcacgaaggaagcgaaggaagcctgtgagaagctggtcaatgccggggtgccggtcggcaatcaagccgttattttggcaggcattaatgacagcgtttccattatgaaaaagctgatgcatgatttggtgaaaatcagagtccgtccgtattatatttatcaatgcgacttgtctgaaggaatcggccatttccgagcgcctgtatcaaaggggcttgaaatcattgaaggcttgcgcggccacacgagcggctatgcagtgccgacctttgtcgttgacgcgccgggcggaggcgggaaaatcgccatccagccgaattacttgatttcgcaaagccccgataaagtcgtgctccgcaattttgaaggcgtcattacgtcgtatcctgagcctgaaaactatgttccggggagagcggacgactattttgccgaaatcttccctgatgtgatgaaggaaaaagaggagatcggcatatcggcaatctatgcggatcaagctctttcatacacaccggacggcttaaaacggctcgagagaagagaaagctattccaagaggcctgatcatgaaacattgaaaagccgccgggcaaagcgcgatgaattgaaagaaaagaaattccttgcccagcaaaagaaagaaggcgaagctga

SEQ ID NO: 227 - DNA, 1380 bp, Bacillus licheniformis
tgacttggaattgaatgaaaaagcgcttcagcagtatacatcgttccaattcgttccggagcctgagacgctggacaaaaaggtgcaaaaagtagagtcgggccatcagtttaccgtccgcccgggtgaggatattcaatttaaaacatactggaaagttcaattcaagccggttcagacagaagaagacaagcttgttcaggaagtaagagacgcgatctttgattctgtaaaagttcatatgcgaagcgatgtgcctgtaggttccttcctttccgggggcattgactcgtcctttatcgtgtcagtggcgaagcaattccatcccaacttaaagacgttctctgtcggctttgaacatgaaggcttcagcgaagttgacgttgcgaaagaaaccgctgataaggtcggcgtggaaaacttcagcgcgatcatttcccctgaggaatatatgaacgagcttccaaagatcgtctggcatctggatgatcctctggcagaccctgctgcgattcctttgtattttgtcgcgaaggaagcgaagaagcaagttacggttgttttgtcaggagaaggggcagatgagctgttcggcggttacaatatttaccgagagccgctttcattaaagccgtttgagcggatcccgtccccgctgaaaaagatgcttctgcgcgtagcttcagcgatgccggaaggaatgaaagggaaaagctttttaatgaggggctgtactcctcttgaagatagatatatcggcaatgcaaagatttttgaagaaggcatgaaatcaaaacttcttcgccaatatgacagcaacctgtcttactgtgacgtgacaaagccatattttgaagaaagcaggtcctacagcgaaatcaataaaatgcagtatgtcgatatccacacatggctgcgcggcgatattttgctgaaggccgacaaaatgacgatggccaattcgctggagcttcgcgttccgtttttggacaaagtcgtatttgaagcggcttccaaaattcccgaagagctgaaaacgaaaaacggcacgacaaaatatcttcttagaaaagcggcggaaggcatcgttccagaacacgtgctaaaccgcaaaaaactagggttccctgtgccaatccgccactggctgaaaaacgaaatgcatgactgggccgtgaacatcattaaagagagcgagacagatgcatatatccataaagattacgtgcttcagcttcttgaagaccactgcgccaacaaagcggataacagccgcaaaatctggacggttctcatctttatgatctggcacagcattttcgttgaaaaacgctttgtaccggaagagctgaaccatcagccaaaagaggtcattattgt

SEQ ID NO: 228 - DNA, 1369 bp, Bacillus licheniformis
atgaaaaagctgtggggaggccggttccaaaaaacaccggaaaaatgggtcgatgagttcggcgcatcgatccactttgacaaaacgcttgtaaaagaagatatcgcagggtctctcgctcatgcttccatgcttgaaaaatgcggcattttaaccgaagcagaagcggtcaaaataaaggaaggcctgacatcccttttgcacaaagcggaaaaaaacgaactcgatttttcagtcgattgcgaagatattcacctcaacctagaaaaaatgctcattgatgaaatcgggccgctcggcggaaagcttcatacggccagaagccgaaacgaccaggtggcgacggatatgcacctgtatttaaaagggcacactgagcatatcatcgagctgattacggcttttcaacacgttctgatcgaaaaagcggaagaacacgtggagacgatactgccgggatacacccatttgcagcgggcccagccgatctcgttcgcgcatcatttgctggcttatttctggatgctggagcgcgataaagaacgctatcatgattcattcaagcggattaacaagtctcctctcggatgcggggcgctcgccggaacgacgtttccgatcgaccgtgaatattccgcagacctgctcggctttgattcgatatatgaaaacagcctggacggcgtcagcgacagggatttcatccttgaatttttaagcgcgagcagcattctgatgatgcatctgtcaagattctccgaagaaatcattctttggtgctcgcaggaatttaaattcattgagcttgatgacacctacgcgacgggaagcagcatgatgccgcaaaagaaaaacccggacatggcggagctcatccgcgggaaaacaggacgcgtatacggtgatctgatcggactcctcacgattatgaaggggctcccgttagcatacaataaagatttgcaggaagacaaagaaggtatgtttgatactgtgaaaacggtcgaaggaagccttgagatttttgccggcatgattaaaacgatgacagtgaacaaaaatatgatgaaaaaagcaacggagcaggatttttcaaatgcaactgaacttgccgactatctggcgaaaaagggcatgcccttcagagaagcgcacgaagtcgtcggaagacttgtcttcacctgcatcgaaaagggcatttatctcagcggcctgccgtttgaagagttcaaaaaggcaagcgggctgtttgaagaagacgtctacatcgtgctcgacccgcaccatgccgtcgaaaaaagaatgagcgaaggcgggacgggattcaaaaaggtgacagaagccattcaaaaggcgaagcagtgtttga

SEQ ID NO: 229 - DNA, 1365 bp, Bacillus licheniformis
aaacaccaatcgccagaactttcaaagaaaaatgcaaacgagacaccttatcatgctttccttaggaggcgttatcggcacgggccttttcttaagttccggttatacgatctcacaggctggtcctgccggaacgattctagcctacttggccggggctctgatcgtctaccttgtcatgctctgcctcggcgaattatcggtcgccatgcctgtcaccggatcgtttcatatgtacgcctccagattcatcgggccgggcaccggattcaccgtcgcctggctatactggctgacctgggctgtcgcgctcggttcggaatttaccgctgccgggttattaatgcagcgctggttccccgatacttcagtctggatgtggagcgcggtattcgctgcactgattttcgcgctcaatgctgtctcagtgagatttttcgccgaatccgaattttggttttcaagcattaaagtgcttgccattatattgtttattatattaggaggagcggcgatattcggcatcatcccgatacaaaatgcagacgctgcaccgcttctttcaaactttgcaggagaaggcggtctctttccaaacggcttccttccaatttttatggcgatgctctccgtgaattttgcgttttcgggtacggagctgatcggaattgccgccggagaaagcgccgaaccggaaaagaacattccaaaagcgatcaagacaacactctggagactggtgcttttcttcatcggaacgattttcgtgctttcgtgcctcattccggttaaagaagccggtgtgatcaaaagcccatttgtcgacgtctttgaccgcatcggtgttccatatgcggccgacatcatgaactttgtaattctgacggctctgctttccgcggccaactcaggcttgtatgcatgctcccggatgctctggtcactgtcaaaagaaaaaactttgcaccccgtatttcaaaagctgacttcacggggaatcccgttgaacgcgctgatcttcagcatgctcggcggcattctgtcgctgctctccagcgtgtttgcgcctgattccgtctacatcgttcttgtgtcgatttcagggtttgccgttgttgctgtctggatgagcattgcggcttcgcagttcatgttccgcagacgctttttggctgagggaaacaccgcagacgacttaaaataccggacaccgctttatccggccgtaccgattgccgcttttctgctatgcctggcatcctgcattggcattgcctttgatccgaaccaaaggatcgcccttttttgcggtgtgccgtttatggcgttatgctataccatctattatgcaacaaaccgaaaaaa

SEQ ID NO: 230 - DNA, 1343 bp, Bacillus licheniformis
atgaagcaccgttacctgccagctacagatcaggataaaaaggagatgcttgaggcaattggagtcgagagaatcgacgagctattctccgatatacccgaaagcgtcagatttaaaggggaataccaaattaaaaaggcaaagtccgagacggagcttacaaaagagctgacgaaactcgcggctaaaaataaagatacagtgacgtacgcctcttttttgggagcgggcgtatacgatcattaccagcccgtcatcgtggatcacgtgatttcgcggtcggaattttacacggcctacacaccgtatcagccagaaatttctcaaggggagctccaggcgattttcgaatttcaaacgatgatttgcgagctgacgggcatggatatcagcaactcgtcgatgtatgacggaggaacggcgttagccgaagcggcaatgcttgcttcaggacatacaaaaaagaaaaaaatcgtcgtttcggaaaccgtccatcccgaatcgcgcgaggttctaaaaacgtatgcgaaaggacagtacatcgatgtggtagaagtcccttccaaaaacggaacagcggatcttgaggctcttgatgaagccgtctgcgaagatacagcagcagtgatcgtccaatatcccaactttttcgggcgaattgagccgctgaaagacattaaaccgatcgcccataaagggaaaagcatgttcatcgtttccgccaatccgctggctctcgggcttttaacaccgcccggggcgttgggcgctgacatcgttgtcggagatgcccagccgttcggaatccctgctgctttcggcggtccgcactgcggattctttgccgtcacgaaaaaattgatgagaaaagtgcctggccgtctagtcggtcagacggaagatgaaaacgggaaaaggggattcgttctcaccctgcaggcccgcgagcagcatatcagacgggataaagcaacatcaaatatatgctccaaccaggcgctcaacgcgcttgctgcgtcagtcgccatgacggcgctcggaaaaaaaggcgtcaaggaaatcgcatggcagaacctgcaaaaagcggcttacgcaaaagaagcagctaaacgggccggtcttgaagtcgcgtttgaggggccgatgttcaacgagtttgtcatcagactcaatgaacctgtcgaaaaagcgaatgaacgcctgcttgagaaaaatattatcggaggctacgatctcggcgcttcatatccggatttaaaacggcacatgctgatcgccgtgacagagctcagaacaaaagaggaaatcgatacactcatgaatgaattgggggattgccatga

SEQ ID NO: 231 - DNA, 1584 bp, Bacillus licheniformis
atggagaagctgaagatcggttcgaaacaaatggttgtcagtcctcattatctcgcttcgcttgcaggcagcatcatcatggagaagggggggaacgcgtttgacgccgctgttgcagtaagcgcgtgcctagctgttgtctatccgcatatgacaggactcggaggggatgccttttggctgatgtatcacaatggaagcggggagatcaaagggtacaatggcagcgggcggtcggggcggaaagcggaccgggatcagtataaaggagagcgcgccattccggtcaggggcccaaggagtgcgattaccgtgccggggatggtggacagctgggccgaaatactggctgcgtacggccgtctatcgcttcgagaggtgctgaagccggcgattatgtatgcagaaaaggggttcccggtctcgcctgatcaatgtcaaaacacggtgaaaaacgctgaatggctttcctgtatgccgatcactgcagatatttatcttccgggaggaaaaccgccctctccaggtgagcgttttgtgcagaaagagctcgcgcgcactttgacgttgatcgctgagaaaggaagagacaccttttataaaggggaaattgcccaagctttagcagcctatctccaaaacaacgggggcatcttgaaccttgaagatttcgggctgcatcgaggggaatgggtgtctccgctttcctccacatacagaggatatgccatctatcaaatgcctccgaattcacaaggatttaccggtcttatgacattgaacattttggaaaactacgactttggcatgatcgagcacggttctttcgagtattatcatctgcttatcgaagcattgaaattaagtttttccgactgcaacaaagtattgactgacccggaattctcacagattccgcttggacgcctactggacaaagagtatgcccgggagctggccgcaaaaatcggactgccggcgcttcaggcggagagccggccgctcggcagcgatacatcttatgcagcagcagtagatgaagacgggaatgctgtttcgtttattcaaagtttgtatttcgaattcggctcaggtgtgacagctggagataccggcgtcattttgcagaacagaggggcgtttttctcgcttgatcccgaccatgtcaatacgctggagccgggaaaaagaacttttcatacgctgatgcccgccatggcgtttagaggcggcaagccgaaattcctttacggaacgcaagggcaagggggagaaggacagccgcagacgcagacggctcttattacgagaatggtagattacgggatggatccgcaaacagctgttcatgaaccgagatgggtatggggcagaacatggggagagcgggtggaaggtgtaagaatagaaagcagagtggcgcctgaagtgattgcaaaactgcgaaagcatgggcatcatgtaaccgttgtcggtgaatttgacggggtgatgggtcatgccggaatcattgagattgacgatcaaggcttcctgagaggggggagcgatccgagaagcgatggggcagcaatcggcatttaa

SEQ ID NO: 232 - DNA, 1542 bp, Bacillus licheniformis
tagctttcttagttgttgcgttttgcttggcggttggttgctttttcagtccggtgtcgaaagcagaaggagtcatgagcgggggagatggtgataaagtcgccgtcgggaaagacggtatggtggctacggcccatccgcttgcatcaaaaatcggagccgaagttttgaaaaagggcgggaatgccattgatgcagctattgcgatccagtacgcactgaatgtaacagagccgatgatgtctggaatcggcggcggcggtttcatgatggtctacgacggcgagacgaaggaaacgtcgatcatcaacagcagggagcgtgctccggagggagccaagcctgacatgtttttggatgaagacggaaaggtgattccgttttcagaaaggtcgagacacggaaatgcggtcggtgtgccgggaacgctgaaagggcttgaagcagcgcataagaagtggggaacaaagaaaatggaagacttgatttcgccttctataaagcttgcagaggaagggttcccaatcgactcggttttggctgacgcgataaaggatcatcaggacaagctgagcaaaacggccgcaaaggatattttccttccggacggtgaacctttgaaagaaggcgatatccttgtacaaaaggatttggccaaaacgtttaaattgatacggaaagaagggtcaaaagccttttatgatggggaaatcggccgggcgattgcagatgtcgtgcaggatttcgggggttcaatgacacctgatgacctgtcccgctacgaggtcacaacagataagcccatctggggcgagtaccacggctatgatattgcaagcatgcctcctccaagctcaggcggagtgttcatgctgcagatgctgaaattgattgatgattttcatttatcgcaatacgatccaaagtcgtttgaaaaatatcatctgctcgcggaaacgatgcatctctcctatgcggacagggctgcatatgcgggcgatccggaatttgtcgatgttccgctcagagggctgctcgatcccgattatattaaggagcggcaaaagctgatcagccttgattcgatgaaccgcgatgtgaaagagggcgatccgtggaaatatgaggaaggcgagccgaattatgagatcgtgcctcagcctgaagataaaacgatcggggagacgacgcattttaccgtcacggatcagtggggcaatgttgtctcttatacgacaacgattgaacagctttttggaacggggattttagtgcccgggtacggactgtttttgaacaatgaactgaaagattttgatgcgattccaggcggcgccaacgaagtgcagccgaataaaaggccgctttcaagcatgacgccgacgatcgtattcaaagatgaaaaaccggtgctgactgtcggttcccctggcggaacgacgatcattgcttccgttttccagacgatcttgaattattttgagtacggcatgagccttcaggatgcgattgaagagccgaggatctatacgaacagcctcg

SEQ ID NO: 233 - DNA, 1336 bp, Bacillus licheniformis
atggagaaagacatgcagaagctcgagcgcacgatgacatcgcggcatattatgatgatggcattgggcggagcgattggggcaggattatttaaaggaagcagcaaagcgatcgatttggcggggccttcggtcatgatcccctacttgatcggcggcgtgattttgctgtttattatgcaggggctggccgagatggctgtccgaaacagcgaagccagaacattcagggatctggttcaatcgatattagggccgtatgccgcttattttttggactggatatactggaaaatgtgggttctcaatattgcggctgaggctgttgtcgccgcgatgtttttgcagtactggctgccggggctgccgatttgggtgctggcgctgttcgtttcactcgtcattacgagcgtgaatttgctttctgtcaaaagctttgccgagacggaatactggcttgctctcattaaaatcacagtgattgtcgtctttattatatccggatttatcttgttatttttctcttttggacaacattcggctgtcggctttactcatttgacagaccatggcggcttcttcccgaatggcgccggagggctgattacagccatgcttgtcgtgatctattcctacggcggaacggaaattatcggggtgaccctggcggaaaccaaaaatcctgagaaggttgtgcctaaagccgtgcggggaacgttaacgcgcattattgctttttatcttctgccgtttttcgtgatcgtcagcttgattccatggaatcaagtgaacggggtgtcggagagtccctttgtcatggtctttaagatgatcggcgttcccggagcggatcatttgatgaatgcggtcattttactggcggtcatttcttctatgaactcagggctttacggcgcctcccgtattttgtatacacaggcgtcagacggaagaatgccgaaaatcttttcgaggctttctgcgagaaaggtgccggtttattcgattctattatgcacttcgttcttatacttgggcgtattgttttcactatttgccggcagccaaacgtttgaatatttgatggggtctctcggctataccgtccttgtgatctggatgctgattgccgccgcccatttaaaatcgaggaaacggaatcaaacagctggaaacggctactatgtcaaatggttcccttatacgacttgggtggcaatcatttcgctgacagccatactgatcggtgtcatcctgaccacgtcgattgtcattacattggtgacggcggggatctatttgctcattagcgctgcttatttctttaaaggaagaa

SEQ ID NO: 234 - DNA, 1362 bp, Bacillus licheniformis
atgaaagtcgttaaatttggaggcagctcgctcgcatcaggagcccagctagagaaagtatttcaaatcgtcacttccgatccggaaaggagggccgtcgtcgtatcggcacccggaaaacggcatcccgaggatacgaaagtaactgacctgttaatcgaatgcgcccaacagtacctattatcgaaagaagcgaccggcctggttgaggcgattgtcggacggtatgccgatatcgcgctagagctcgggcttgccgatgacgtgatcaaccggatccgggcagacctgcttcagctgctcgaaggtgataaaacaaatccggaacggtttattgatgcgatcaaagctagcggcgaagataacaatgccaaactggtagcggcctacttcaggcaccgtggagttgaagcacattatgtcagtccaaaagacgccgggctgttcgtgacgagcgaacccggcaacgcacaagtgctgcccgagtcctacgacaatctgtttcagctcagacagcaaaagggcatcattatctttcccggcttcttcggattcagccaggaaggagaagtgatgacgttttcgcgcagcggctctgacattacgggctccattttagcgaatggattgaaagccgagttgtatgaaaacttcactgacgttgacgccgtttattctgtcaacccggcgatcgtatccaacccgaaagaaatccgcgagctgacataccgggaaatgagagagctgtcgtatgccggcttttccgtctttcatgatgaagcattgatccctgctttccgggcgcgcataccggttcagatcaaaaatacaaacaacccggacgcagaagggacaagagttgtcgccacacgcgacaacacgaacggacctgtcgtcgggatcgccggcgacagcggattttgcagcatttacatcagcaaatatttgatgaaccgagaaatcggcttcggccgccgcgtcctgcaaatccttgaagatgaagggctgacatatgaacacattccgtccggcattgacgatattacgatcattttaaggcagaatcaaatggatcaagcagcagaaaaacggatgatcaaacggatcaaggaagagttggatgctgatgaagtagcgattgaacacaatattgccctgatcatggtcgtcggcgaagccatgcgccataacgtcggaacgacggcaagagcgtcaaaagcattgtctgaagccggcgtcaacatcgaaatgatcaaccagggctcctcggaagtcagcatgatgttcggcgttaaggaagctcaggaaaaacaagcggtccgcgcattataccaggagtttttcgcaaaagttctcgtttaa

SEQ ID NO: 235 - DNA, 1239 bp, Bacillus licheniformis
aattattcaggatcaccaggataagctgacacaccaagtcggatgccctgttacgattcaaaaagttcttgttaaagataaagataagaagagggatgtcgagctttccaaagacgttctgacgactgaagcctatgatgtcattcaagatccagaagtagatgtcattatcgaggtcatcggggggatcgaggagacgagacgctatttgcttgacgcgcttcaggcgaagaaacacgtcgtgacagcgaataaagatttgatcgccctctatggatcggaactgacggctgccgcgaaagaaaacggctgcgacctttattttgaagcgagcgtcgccggcggaattccgattttgcgaagccttgaagacgggctggcttcagaccggattacgaagatgatgggcatcgtcaatggaacgaccaactttattttaacgaagatgaacaaagaaaacgcgccttatgacgaggtgctgaaagaagcgcaggagctcggcttcgcagaagcagacccgacagctgatgttgaaggtcttgatgccgcgagaaagatggcgattttggccaggctcggtttctcaatgaatgtcgaccttgacgatgtcaaagtgaaaggcatttcccaagtgtctgatgaagacatcaatttcagcaaacggctcggctatacgatgaagctgatcggcatcgctcagcgcgacggacaaaaagtcgaagtgagcgtccagccgacattgctgccggagcatcatccgctgtcttccgtccataatgaattcaatgcggtttacgtatacggcgaagccgtaggggaaacgatgttttacggacctggcgccggaagcatgccgactgcaaccgccgtcgtgtcagatttggtctccgtcatgaaaaacatgcgtcttggcgtgaacggcagcagctttgtcgatccgcagtttgaaaagaagataaaggcgccgtctgaaatctttgcccagcagtttttaagaattcatgtcaaagaccaggttggttcgttttcgaaaatcacatcgattttttcagaaagaggcgtcagctttgaaaagatccttcagcttccgattaaaggccatgacgacctggctgagattgtcattgtgacacatcatacgtcagaagaggattttacggatatcctgcaaaagctgaacgatcttgaggttgttcatcaggtgaaaagcacttatcgagtagaagggaacggttggag

SEQ ID NO: 236 - DNA, 1389 bp, Bacillus licheniformis
ttttcgatatcgcttatattttgaatgagagaagagagcgggtaacggaaaagcttagttccgaacaggaaacattgattcaaggcttgtctgttgacggatatcatgcctggggcgatatgtacgacagcatcgtcgaccaaattcaaattccgtatgaagaagatggcgagacgaaaattctgtctgtcggacaggcgcagaacctgacatctaaacctgacagaaagatccgccgctccgtatcggaaaatttggaccacggctgggaacagcacgctgatttgctcagcagcacgctgaatcacctcgccggtttcagactgaacgtctatgaggcgagaggctgggacaatgtattgaaagaaccgctggacatcaaccgcatgaagcaggaaacccttgatgtcatgtggcaggtcattattgatcataaaaagccgtttgcagactatctttcccggaaggcgtctttgctcggactggataaactgagctggtatgacgtcgaagcgccgatcggttcagcagcaaaggaatattcgtatcaagaggcagccgcttttattaccgggcagtttaaaacgtttggaaaaaagctctcctcctttgctgaaaaggcgctcagagacagatgggttgaagctgaagacaggggaggaaaacgtccgggcggcttttgcgccaattttcctgacagcggggaatcaagaatatttatgacatttgcaggaagccagtcaaacgtttccaccttggcgcatgagcttggccatgcctttcatcaggaatccatgctggacgtcaggccgctgaacagggcgtatgcgatgaatgtggcggaaacggcgtccacctttgcagaaatgatcgtggccgatgcggcgttaaaacaagccggttcagacgaagaaaaaatcgtccttctggaagataaggttcagcggagcgtcgccttttttatgaacattcacgcaaggttcctatttgaaacccgcttctacgatgaacgaaaaaacggcgtcgtatccgccggaaggctgaacgaactgatggaagaagctcagaaagaagcgttttgcggtgcgcttggcgagtatcatccgtatttttgggcatcaaagcttcatttttatattacgtctgttccgttttacaattttccttatacgttcggctacttgttttcgcttggcatttacgcgcaagcgctgaaagagggtgcggcatttgaagaaaaatatattgctctcttaaaagatacagcctccatgtctgttgaagaactggccatgaagcatctcggcgccgatctgacgaagcgggatttctgggaagcggccattcagccggctgtccgagatgcagaagcatttttagcgatgacat

SEQ ID NO: 237 - DNA, 1389 bp, Bacillus licheniformis
atcatgaaaaccgtgaacaatatacactgaaacgaacgatgaaatcccgccatttgtttatgatctcgcttggcggcgtcatcggaaccggcttttttctcggaacaggttatacgattaatgaagccggaccgatcggcgcgattctttcctatttagcgggcggaatgatcatgtattttacgatgctctgccttggggagctcgctgtggcaatgccggtttcaggctcttttcagacgtacgcgacaaaatttatcgggcctgctacagggtttgccgtcggctggatctattggctcggctggtcggttactgttgctttggaatttttgtcagcggggcagctgatgaaaagatggtttcccgatgtcggcgtctggatatggtgcttgattttcgggctgctgcttttttcactcaatgctttatcggcaaaggctttcggggaatcggaattttggctgtccggcatcaaaattatcgtcattcttctgtttattattctcggcggaggcgcgatgttcggactcatcgacttgaaagacggacaggctgcaccgttcttttccaatctgattggagacggaatttttccaaacggattcggcgcgatctttatcacgatgatcaccgtcaactttgcctttcaggggacggagctgatcgggatcgcggcgggggaaagcgaaaatccggaaaaaacggtgccccgctccatcaaacagacggtctggcggacactggtgtttttcggcctgtccgtatttgtactggcgggattgattccatgggaaaaagcgggggttgttgaaagtccgttcgttgtggtatttgaacaaatcggcattccgtatgccgccgatctgatgaactttgttattttaattgctttgttatcggtggcgaattcgggcttgtacgcatcgacgaggatgctttattccctggcgaaagagggaatggccgctcaggctttaagccgggtcaataaaagaggtattccgatgaatgcgctttggatcacgctcggttttgcgggtttgtccctcatctcaagcgtagtcgcagcagaaacgctctacatttggcttttgtctctagccggtttaagcgcgcaagtcggctggatcacgattacggtatcacagctgctatttcgcagacgatatgtcaaagaaggcggaaaggttgaagacttaaaatttaaaacgcctctttatccttatttgccgctgacgggatttattttaaacagcgccgtccttgtgagcctcgcttttgattcagagcagaggatggcattgtactgcgggattttattcatgtcggcctgctactttgtttatcacgtgtttgtgaaaaaacgccaggctcttgatcgacaag

SEQ ID NO: 238 - DNA, 1330 bp, Bacillus licheniformis
ttgtccggacttatcgcagcgtctttattaaagaatgccgggcatagagtgacgattgtggaagcaaatgacagagcgggagggcgtgtttttacttcccgtgcgccctttagcgaagggttgtatttcaatgccgggccgatgcgcatccccgatatccatactttaacgatggaatatattaagaagtttaatctgcctgtcaatgtgtttatcaaccgaacccccatggatattctttacgtcaacggcgtgaaaacccgtcttcatgagtttgaaaaaaatccgggcgttttaaggttccctgttgctccccatgagtagggaaaaacggcagaacagctgatgctttctgctttgcagcctatcctcaattttatcagccaagatccggcgagaaattggcgtattgtttaaaaacaatacagaaacggatcgttaggatcttttctcaacactcatttttcaagcggttccatcgatatgattggtgtgcttttggacatggaagcgtacatgggattgtcccttgtcgaagtattgcgggaatcgattttttttacatcgccgactcgcttctatgagattacatgcggcatggacctgttgacgcaagcttttcttccgcaattaaaggggaatattttattccgtcaaaaattgatgaaaatgtctcaaactaaaaacagtgtaacagcccattgcattcaccagcagtcggcagaacattcagcggtgacaggtgacttcgcgatcgtaacaatacctttttcagcattgcgatttgtggcatttgagccgtttgaatccttttcctaccaaaagcggagagcgattcgggagcttaactatattgcggcgacaaaaataggaatcgaatttaagagcaggttttgggaaagagtcggacagcgcggcggcagatcgattaccgatttgccgattcgcttttcatactaccctagcagcataggaggacacgggcatgctgtcattttagcgagctatacgtgggctgatgaagcgctaatatgggacagtcagcctgaagaagagcggatccgctatacgctgaaaaatttagcgaaaatatatggagatatcgtgtattctgagtttgtatcaggcgcttctttcagctggacgcaaaatcctttttcagccggagcatttacagctttcgaaccagggcaggaattagagttgtatccttatattccgatgcctgaaggaagggtgtatttcgccggggaacacgcttccctcactcatgggtggatgcagggagcgattgaatcgggaatacgggcggcgtatgaagtaaatcagg

SEQ ID NO: 239 - DNA, 1095 bp, Bacillus licheniformis
atggaactatttcgatatatggaacagtatgactacgagcaattggtattttgccaagataaacagtccggtttaaaagcgatcatcgcgattcatgatacgacgctcgggccggctctcggcggcacaagaatgtggacatacgaaagtgaagaagccgcaattgaagatgcgctgcgccttgcgcggggaatgacctacaaaaatgcggcggccggactgaacctcggaggaggcaaaaccgttattatcggagatccgcgcaaagataaaaacgaagaaatgttccgcgctttcggccgctacattcaaggcttgaacggcagatacatcacagccgaagacgtcggtacaaccgttgaagatatggacatcattcatgacgaaaccgatttcgttacaggcatttcacctgctttcggttcatcaggaaatccttctccggtaacagcttacggggtatataaagggatgaaggcggcggcgaaagcggcattcggaacggattcgcttgaaggcaaaaccgttgcggttcaaggcgtcggaaacgtggcctacaacctgtgccggcacctccacgaagaaggcgcgaaactgatcgtgaccgacatcaacaaagaagcagttgaacgtgcagtcgccgaattcggcgcccgcgccgtcgatccggatgatatttattcgcaggaatgcgatatatatgcgccgtgtgccctcggagcgacaatcaacgatgatacgattccgcagctgaaagccaaagtgattgccggggcagccaacaaccagctgaaagaaacccgccacggtgatcaaatccacgacatgggcatcgtttatgccccggactatgtcatcaatgccggcggcgtcatcaatgtcgctgacgagctttacggctataattcggagcgcgcgctgaagaaagtcgaaggcatctacggaaacattgaacgcgtccttgaaatttcgaagcgcgaccgcattccgacatacttggccgcagaccgtctggcggaagaacgaattgagcgcatgcgccaatcgagaagccaatttttgcaaaacggccatcacattttaagcagacgttaa

SEQ ID NO: 240 - DNA, 1253 bp, Bacillus licheniformis
atggagaacatagagagaaaagtgtgcgattggatcgattcgcatgagcaaaaagcgattcgccttttgaaaaaactcgtcggagaaaaaagcacgatgggccgagaatttaacgcccaggccgtcgtcctggagaaattgaggcaattcgaagctgaaatcgatgtctgggagccaagcataaagcagttggaacagcatccgctgtttaaatcagacagaacaagctttaaagaaagcccgaatattgcggctgttaaaaaaggaaagggcggcgggaaatcgctgatcttaaacggacacatcgatgtcgtgcctgaaggaaacagaaaagactgggagacggagccttttcagccggttgtgaagcaggggcggatatacggccgaggcacaactgacatgaaaggcggcaataccgctcttttaatcgcgatggaagcgctggagcaatgcggggttcaactaaaaggagaccttatttttcaaagtgtcgtagacgaggagtgtggcggagccgggacgcttgcggccgtaatgaggggctacaaagcggacggcgctttgattcccgagccgacaaatatgaaaatgtttattaaacagcagggctcaatgtggttcagaatcacggtcaaagggctttctgcgcacggcggcacaagatatgaaggcgtcagcgccatcgaaaaaagcatgcttgtcattcaatcgctccgccagcttgaacaggtcaggaataagagaataacagattctttgtatgacaatatcccgattccggtcccgatcaacatcggcacgatcaacggaggcgcctggccttcgtcggttgccgacacggtgacactggaaggaaggtgcggaatcgctccgaacgaatcccctgaagccgtccagtccgagcttgaaaactggctcaacgatcttcagtaccatgatgaatggtttaagcactatcctgttgatatagaatggttcggcgccatgtggcttcctaacgatttggctgaagaccatgaactgacgaaagtgctgaaatccgcctatcaaaccatcacggcagaggctccgctcatcgaagcttccccgtgggcgacagacggcggaatattgtcgcacgccggaggcacccctgtcatcgtcttcgggccgggagaaacgaaaatggcccaccaggcaaacgaatacattgaaaaagacgccctgatccagtcagccaagatcatcagcctgtttattatgaattggtg

SEQ ID NO: 241 - DNA, 1201 bp, Bacillus licheniformis
atgtattcatatccgaatgaacaaggcaggtttggtgattttggcgggaaattcgtcccggaaacactcatgcagcctttggaagaaatcgaaaaagcgtttcttgaactgaaagacgacccttcatttcaaaaggattatcaaaagcttttaaatgactactcaggcaggccgacggctttgacgttcgcagaccagctcactaagcagctgggcggagcgaagatttacttaaaaagagaagatttaaaccatacaggcgcccacaaaatcaacaatgccctcggccaggcgctcctggccaagaaaatgggaaaaacaaagctcattgctgaaaccggtgcaggccagcacggtgtggcggcggcgactgtcgccgcgaagttcggcttatcatgcatcgtcttcatgggggaggaagatgttgccagacaatcgctgaacgtgttccggatgaagctcttgggagcggaggtcgtcccggtgtcaagcggaaacgggacattaaaagatgctacaaacgaagcgatccgctactgggttcagcattgccaggaccatttttacatgatcggttccgtcgtcgggccgcatccgtatccttatatcgtccgcgaatttcaacggatgatcggcgaagaggcgaaagcgcagttttatcaattggagcaaagcctccccgataaagttgtcgcctgtgtcggaggcggaagcaatgcgatcgggatgttcagcgcgttcattgaagaaactgttgaactgatcggagtcgaagctgcgggaaaaggtgttgacacacctcttcatgcggccacgatcacaaagggtacaaaaggcgtcatccacggttctttgacctacttgattcaagacgagtacggacagatcatcgagccttattccatctcagccggacttgattatccgggagtcggccccgagcacgcccatcttcatcaaacagggcgcgtcacgtatgaatctgtcacagatgatgaagcggtctcggcattaaggctgctgacagagactgagggcattttgccggctattgaatccgcccatgcattggcaaaagcatttgaaatcgctaaagaactgccgagagagaaaagcgttctcgtctgcctttcaggcaggggagacaaagacgtccataccttgatgaaggtgttggaagaagaggtgaatcaagatgttc

SEQ ID NO: 242 - DNA, 1008 bp, Bacillus licheniformis
atgaaccaaacgattaatttaaaaggcagaagctacttagctgaaaaagatttttcagaagaagaaatcctctatttgctcgatctggcccagaaactaaaagaaaaaaaagcacaaggcatcaggcatcgctatttggaaggcaaaaacatcgctttgctgtttgaaaagccttctacaagaacgcgctgcgcttttacgacagcctgtatcgacctcggtgcgcatcccgaatatttgggcaaagacgacattcagctcggcaaaaaagagtcgatcgaagacacggccaaagttctcggccgcatgttcgacggaattgaattccgcggatttgaacacgaaaaagtgatctcactggcagagcattccggtgtgccggtatggaacgggctgaccgatttatggcatccgacgcagatgcttgcggactttatgactgtgaaagaacatacgggacgcgtaaaaggcgtcaagctcacctatatcggcgacggccggaacaatgtcgccaacagcctgctcatcggcggcgcaaaagtcggcatggacgtaagaatctgttcgcctcaagagcttttccctgatcaggacatagttaaaatggcggaagcgttcgctgaagaatccggcggaaaaatcaccgttacaagcgatacagataaagccgtgtccggagccgacgttctgtatacggacgtctgggtatccatgggggaagaagacaagtttgcagaaagaatcaaactgctcaagccttatcaagtgaatatggatctcgtcaagaaaacaggcaacgacaacgtcatcttcctgcactgtctgcctgccttccacgaccttcatacaacctacggacaaaatgtttacgaacagcacggccttaaagaaatggaagtgacggacgaagtgttccgcagcaaacactctaaagtgttcgatgaagctgaaaaccgcatgcacacgattaaagctgtcatggcagcgacgctcggcgatcttgactga

SEQ ID NO: 243 - DNA, 1230 bp, Bacillus licheniformis
catcggttccggcgtgtttatgaagcccggcagcgtgctttcctattccggaaacgcacaaatcgctcttttcgcctggcttctcggcggaatcttgacgcttgccggcgggctgaccatcgctgaactgggcgcacagattccgaaaacaggcggtctttacacatatcttgaagaaatttacggcgagttctggggcttcttatgcggctgggtgcagatcatcatctacggaccggccatcatcggcgcacttggattatatttcggctcgcttgtggccaacttgttttcctgggataaatcctggactgcactcatcggcatcatcaccgtcgcctttttatgcatcgtcaacatcgtcggaacaaaatacggcggagcggttcagacgatcacaacgatcggaaagctgattcccattgtatgtatcattgtgttcggtctatggcagggcgatgaatatattttcagttcggtcacggagagcatcgccagccaaaacttcggggcggcggtattggcgacgctattcgcgtatgacggctggatccttcttgcagcactcggcggagaaatgaagaatccggaaaaagtgcttccgaaagcgatgacaggcggcatactgatcgtcactgcctgctatctgttcattaacttggcgctgcttcacattcttcctgccgatcagattgtcaagctcggcgaaaatgcgacaagcacagccgcgaccatgctgttcgggccgctcggcggcaagctgatatccatcggaattatcgtcagcatcttcggctgcttaaacggaaaggttctgtcttttccgcgcgtgatctttgcgatggctgagaaaaaacagctgcctttctcccgctggatctcgcatgttcatccggcattccatacgccttggatcgcagtcatcgtccagatgattatcgctgtcattttaatgatcatcagcaatcctgaaaagctgtcagaggtttcgatttttatgatttacatcttctatgtcatggcgtttttcgcggtatttattttgcggagacggaagaacggccaaggaagatcttacagcgtgccgctctatccttacctgcctgtagcggcgattctcgggtcattgtttgtccttgtcagcacgctcatcacagacttctacagctgcctgtggtcgatcttgatcggtctcgtcggtctcccggtttatttttggatgaaaaaaag

SEQ ID NO: 244 - DNA, 1228 bp, Bacillus licheniformis
atgaattcgtttactgataaactgagcaaatatgcaaagcttgtggccgaagtcggcgtaaacgttcaaaaaggacagcaagtcgtcatcaacgcgtcaacagaagtacgcgattttgcacggctcctcgtcaaaagcgcctatcaaagaggggcgaaaaacgtgacggtccgctggcaggatgatgaggtcacaaggctgaaatacgagctggctcctgcggaagcctttgaagagttccctgaatgggaagcaaaggggcttgagacgctcgccaaagaaggcgctgcttttatttccattgtctcttcaagtcctgatcttttgaaaggcatcgattccaaaaaaatctccgcacagcagaaagccgcaggaaaagcgatgcatacatacaggcaaatgattcaatcggataaagtcagctggactgtcgtcgcagcgccttcgccggcctgggcgaaaaaagtattccctgaggcagatgaagagacagccgtgcaaaagctatggaatgagattttcaaaacgacccgcgttgaccgtgaagatcccgttcaagcgtggaaagatcacgatcaaaccttgcgcgataaagtaagcgtcttaaacgacaagcattatcacgcccttcattaccaagcaaagggaacagatttgacgatcgagcttcccgagaagcatctgtgggtcggcgccggaagcacaaacgaaaacggcgtcgagttcatggccaatatgccgacagaggaagtattcactgctccgaaaaaagacggggtgaacggcaccgtttcaagcacgaagccgttaagctatggcggcaatttaatcgacggctttacactgacatttaaaaacggacggattacggatgtcaaagctggacaaggcgaagaaattttaaaagagctgatcgaaacggatgagggttcacactacttaggcgaaattgcgcttgttgcccacgattcgccgatttccaagtccaatattctgttttacaacacactgtttgatgaaaatgcctcaaaccacctcgcgatcggcagtgcatacgcattcaacatcgaaggcggaaaacagatgtcgcgcgaggagctggcgaaagaaggattaaacgaaagcatcacacatgttgactttatgatcggttcaggagaaatgaatatagacggaatcactgctgacggaaaaagagagccgatattcagaaacggcaactgggcga

SEQ ID NO: 245 - DNA, 1203 bp, Bacillus licheniformis
atgacggttctatcaaagtccgagaaaattatgaagcaaaccgcacattttggcgcgaataactatcatcctctgccgatcgtgatttctgaagcggaaggcgcgtgggtgaaagatccggaaggcaaccgatacatggatatgctgagcgcttattccgcagtgaatcaagggcacaggcacccgaaaatcatccaggcgttaaaagatcaggcagacaaaatcaccctgacttcgagagcttttcacaatgaccagcttggtcctttttatgaaaaggtcgcttcattaacggggaaggacatggttctgccgatgaacaccggtgcggaagcggttgagtccgcagttaaagcagcgcggcgctgggcttatgatgtaaaaggcgttccggacaatcaggcggaaattatcgcatgtgaaggcaattttcacggccggacgatgctggctgtgtcgctatcttcagaagaagagtataaacgcggtttcggaccgatgcttcccggcatcaagctgattccatacggggatctggaagcgctgaaacaggcgatcacaccgaatacagccgcttttttaattgagccgattcaaggtgaagcgggaattgtcattccgccggaaggctttttgaagcaggctgctgaagtctgcaaagagcgcaatgtcttgtttatcgccgatgaaatacagtcagggcttgcacgtacagggaaaatgttcgcctctgattgggaggacgtcacaccggatatgtacattttaggtaaagcgctcggaggcggcgtgttcccgatatcgtgcattgcagcaaaccgggatgtgcttggcgtgtttaatccgggctcacacggatcgacctttggagggaacccgcttgcatgcgccgtatcgatcgcagctcttgaagtgctggaagacgagcggctcgctgaacggtcgctggagcttggggaatactttaaagaaaagctctcgcaaattgataatcctaaaatcaaagaagtgcgcggcagggggctgttcatcggggtagagctgaccgaggcggcgcgtccgtattgcgagcgcctgaaagaagaagggctgctctgcaaagaaacgcatgagacggtaattcgctttgcacctcctcttgtcatttctcatgaggatctggattgggcgattgaaaagattacccgtgttttgtcgaagtaa

SEQ ID NO: 246 - DNA, 1100 bp, Bacillus licheniformis
atgaggtatttaacagccggtgaatctcacggtccgcagcttacgacaattatcgaaggagtcccagcggggctttatatcacaaaagaagacatcgattacgagcttcaaagacgtcaaaaaggccacggccgcggacgccggatgcaaatcgaaaaagaccaggcgcggatcacaagcggtgtaagacacgggcgttctcttggatcgccgatcgctctcgtcgtcgaaaacaatgactggaaacactggacgaaaatcatgggttcagagccgatcacggctgaagaagaaagcgaaatgaaacgacagatttcaaggccgagaccggggcacgccgatttgaacggcgcgatcaaatacgggcacagagacatgcgcaacgtgcttgaacgttcatctgccagagaaacgaccgtccgtgtagcggcaggagccgtcgccaaaaagatcctttcccagctcggcattcaagtggccggccacgtgctggagatcggcggagtaaaagctgaaaaaacaaattacgaatctatcgaaaacttgaaaaaagtaaccgaagagtcccctgtcagatgctatgacgaagaagcgggcaggaaaatgatggacgcgatcgatgaagcaaaagcaaatggggattcgatcggcggaatcgtcgaggtgatagttgaaggggtgccggtaggagtcggcagctatgtccattacgaccgaaaactcgacagcaagcttgcagccgccgtactgagcatcaatgcttttaaaggggttgaattcggcatcggctttgaagccgcacgcaaaaacggcagtgaagtccatgacgaaatcatctgggacgaagaaaaaggctatacgcgggcaacaaaccgtctcggcggtcttgaaggcggaatgacaacgggaatgccgattgtcgtcagaggtgtgatgaagccgattccaacgttatacaaaccgcttaaaagcgttgatatcgagacaaaagagccgtttacagcgagcatcgagcgttccgactcctgcgctgtccctgccgcagcgtggtggctgaagcggttgttgcatgggaaatcgcaaatgcgatcgtcgagcag

SEQ ID NO: 247 - DNA, 1119 bp, Bacillus licheniformis
atgaataaaaaacgcttgttagaagagtttttagaacttgtgcaaattgattccgagacaaaacatgaagctgaaatctgcaaggtgctgaaagaaaaatttgcggcgcttggaatggatgtcgtggaagatgacacaaagccaaaaaccgggcacggagcaggcaacctcgtgtgcacgcttccgggaacgaaagaagcggacacgatttactttacatcccacatggatacggtcgtacccggaaaaggcgtaaagccggtcattgaagacggatatgtcaaaacagacggcacaacaattttgggagccgacgacaaaacaggccttgcagcgatgctagaagccgtaaaagtgctgaaagaaaaaaacattccgcacggaacgatccaatttatcattacggtcggtgaagaatcggggcttgtcggagcgaaggctctagaccgttcgctgatcaaagccgattacggatatgcgcttgattccgacgggaaggtcggcaatattatcgtggcagcgccgacacaggcgaaaattagagcaactgtctatggaaaaacggctcatgccggtgtagagccggaaaaaggagtctcagcgatcacgatcgcttcaaaagcgattgccaaaatgccgcttggccgcatcgacgaggaaacgacggctaacatcggccgctttgagggcggaacgcaaaccaatatcgtctgcgatcaagtcgacattcttgctgaagcccgttcgcttgttccggaaaaaatggaaaagcagacggaaaaaatgaagcaggcgtttgaatcggcagccgccgaaatggggggcagagccgaggtggaaatcgaagtcatgtacccgggctttaaatacaaagacggtgatcttgtcgttgaaattgccaaaaaagccgccgggaaaatcggccgtccgtacgagctgttgacgagcggcggaggaagcgatgcgaacgtcatcgcaggccacggcattccgactgtcaaccttgcagtcggatatgaacagatccatacgaaaaacgaaaaaatgccgattgaggaacttgtcaaaactgcagaaatggtcgttgccattattgaggaagtagcgaatcgttcataa

SEQ ID NO: 248 - DNA, 1245 bp, Bacillus licheniformis
gacataaaggcgataaaggagaaggcgtctcgtcttggctggcattctttaattccgccgcttcccgtgtcggaacgggtaacctgaccggtgtggcgcttgctgttgcaacaggcggaccgggagcggtcttttggatgtgggtcgtcgcgcttgtcggaatggcttcaagctttgtggaaagtacgctggctcaagtctacaaggtcaaagacggcgatcatttcagaggaggccctgcttattacatggaaaaagcgctgggcgccagatggatggggattatctttgccgttttaattacaattacattcggcttgatttttaatgcggttcaagccaacactatcgtcggttcgatgcaaggggctttcaacctggataaaacagtggtaggcatcatccttgctgcaatcaccggatttatcattttcggcggattgaaacgcgttgtgacagtttcgcagttgatcgttccggtcatggcgatcatttatcttggacttgctttatttgtcgtgctgacgaatatttctcaaataccggccgttttcgcgatgattgtgaaggatgctttcgggatcgagcagattgcagggggtacgctcggcagcatcattattatcggtgcgaagcgcggtttgttttcaaacgaagccggaatgggaagcgcgccgaacgcagcagcgactgccaatgtctctcaccccgcgaagcaaggctttatccaaacgcttggcgtattctttgatacgatggtcatctgcagtgcaacagcctttatgatcctgctgttcaatctgacgcctggcaaagagcttgacggcattcaaattacacaagcagccatgcagcatcacattggaagctgggcgcctgcatttgtcgcagtggcgatttttctgttcgctttcagttcaatcgtcggaaactactattatggtgagacgaacattgaatttattaaaaagagcaagacggcgcttgctgtttaccgtacagccgttgtagcaatggtgatcttcggatctgtatccggtttccagcttgtgtgggacatggcggatttatttatgggattaatggcgatcattaacctgattgcgattctgcttctttccggaattgctgcgaaagtgctgaaagactatactgaacagcgcaaagcaggaaagaaccccgtctttaaggcaagctcgattccaggtctgaaaaatacagaggcttgggaagacgagaaggaaa

SEQ ID NO: 249 - DNA, 1557 bp, Bacillus licheniformis
actttcaacagatgtttccgagcgaggatggcaatcacgaggcgcggtatcagctgctggcattgcttgaagcggtattggccggaatggacaggctgaaggatcccggccggctgacgcttggccgcgagtctgaagtttcatctgactactatcaaagcgtcattgaagaggccgtcttgccggaaaaaggcttcggggcggaaaaaagcgttgaagagctattgaaattgcttgacggccaccgctttttaaacaggcattatgtggccaacgcgacgcctctgccgaacaacgccagcatcgccgggaatcttttaatggttcttttaaacggaaacaatttatgggatgtcgacggcacggctgcagccaggacggaagtgcagatcacggcgatgctttctgatattgtcggctatgacaggcacaagagcggcggttttacaacctggggcgggcagggagccgtttttcagtcgctcaggctggcgatcgcaaacgcgtaccctgaagcgaatcagcaaggaacgccgcatcatctgtacgcgttctgttcagagctttcgcatttcagcctttataagtcgatggaagcttccggaatcgggacggaccatttgatcaaggtcaagacgaatcacgatcattcgatggatctggccgatttgcgggaaaaaatgcaagccgtgattgaaaaaggcggacatccgatttatgtattggcaacgcttggcacaaccgacgcatttggcatcgatgatttggccggaatcaagaacgtgactgaagaaatagatgccgcatacggtttgccgcctgtttatattcatgccgatacggcgatggggcgggatgtacagctttttttaacggatacgatttctccgggaaatctgtggcatattgaagatgaggtgcttgagacgcttgcccgctacaaacaacattttcagcatttgcacatggcggacagcttggtctttgattttcataaactcggacaaacgccgtatatcacaagccttttcttggtgaaaaaccgcaaggcattgcaggctgttgatttggatccggatgagacgccttatgtcggcaacagagggtttggcagctatcatacgagctatacgctagagtgttcgcgaatgggaagcagcataccgatttatgcttctctgctcgcatttggaatcgaaggctaccaggagatcttggccaattacatcagggttaacctggcgtttcgaaaaaaactgctgcaggcttttccgaatgcagccgtcaccaatgatgtatcacctgtgacgacattccgcttctatccgggaaatgtccgctatcacgaagaaatcagcggcgccatcacggaggaagaagtgcggaatattaacaaatacaatgagaaaatcgccgaaacattgggaaggtaccgcagtcacacctatttcggcagcacgaaaaagcaaacatacgtttatcctgctgacagccgtttgccagtgccgctttatgtccagaaattctacagtgtctcgccttacacgacggttgata

SEQ ID NO: 250 - DNA, 1055 bp, Bacillus licheniformis
atgtggaaaggactcatccatcaatataaagaatatttgccagtaacggacaaaacaccggaattgacgctgaacgagggaaataccccgcttatttatctgcaaaacctttcgaaaaagctcggaatcgagctttatgtcaagacggagggtgtcaaccctacaggctcctttaaagaccgcgggatggtcatggcggtcgccaaggcgaaagaagaaggcaatgacacgatcatgtgcgcttcgaccggcaatacgtcggctgctgcggcggcttatgcggcccgcgccaacatgaagtgcatcgtcattattccagacggcaaaatcgccttcggaaaattggcccaagccgtcatgtacggcgcagaaatcattgcgatcgacggaaacttcgacgatgccctgaaaatggtgcgcagcatttgcgagaaagagccgattgcgctggtcaactctgtgaatccataccggattgaaggacagaaaaccgcttcctttgaaatttgtgaacagctgggcgaagcgcctgatatcctagcgattcctgtcggaaatgccggtaatataacggcttactggaaaggctttaaagagtatcatgagaaaaacggcacaggcctgccggtcatgaagggttttcaggcggaaggcgcggccccgattgtcaaaaacaaagtaattgaaaagccggaaaccgttgcgacagcgatcagaatcggaaatccggctagctgggataaagcggtcaacgctgcaaaagaatcgaacggtaaaatcgatgcagtgtcagacgaggagattctccacgcttatcagctcctggcaagagaagaaggcgtatttgcagaaccgggatcatgcgcatccattgcgggcgtgctgaaacagctgcaaacgaaagagattcagccgggtgcgaaagtggttgccgtcttaaccggaaacggcctgaaagatccgaacacagccgttgatgtgtcgcagatcaaacctgtcacactgccgacagacgaagaagctattctcgaacacttaaaaggagccgctcgtgt

SEQ ID NO: 251 - DNA, 1270 bp, Bacillus licheniformis
atgaagatcaaatccatcagcggaaatacgtcggtttcactaaaacgctctattgacgccggaacggaggaacaaagaaaagcagtccgcggcattatcgaagaagtgaaaaagaacggaaatgcagctgtttccgcattcacaagacaatttgacggagcggatgtggccggctttcgcgtttccgaagaggaaatcaaggaagcatacagcgcgctcgaagaacgtgatctcgagattattcaggcggcgattttcaacattaaagaatatcatgagcgtcagctcgcaacatcttggttttaccaccgcaaggacggaacgatgctcggccaaaaaattacgccgcttgattcagcgggggtgtatgtgcccggcggaacggctgcttacccatcatccgttctgatgaatgtcattccggcgcttgttgcaggcgtcgaccgcattgtccttgcctcacctccgggaaaagacggtaaattgtcggcgggagtgctggctgctgctgcggagcttggcgtcacagagatttacaaaatgggcggtgcccaagcgattgccgcattggcttacggaacggaaacgattacccccgtcgataaaattacgggacccggaaatatttacgtcgccttggctaaacgggaagtattcggccaggttgatatcgatatgatcgcgggtccaagtgaaatcgccatactcgctgacagtacggcaaactaccgggaaatcgccgcagatctactttcacaggctgaacacgatgcgatggcatcgagcattcttgtcaccgattcagagacgcttgccgaatccgttttaaaagaggtttacagacagctcgaacatcttccgagaaaagagattgcacggcagtcgattgacaactatggcctgatctatgttacagagacgatgaatgaagcagtttccgtcatcaatgagctcgctcctgaacatttggaaattttaacagttcaacccgatgcgctgctgggacagatcaaacatgcgggcgccattttcctgggccgctacagttcagagccggtgggcgattattttgcaggccctaatcatgtcctgccgactaacggtacagccagattttcaagcccgctaaatgtgacagacttccaaaagcgctccagcatcatttcctacagcagggaagctttccgcgcgaatgctgagaaaattgcggcctttgccagattggaagggcttgaagcccatgcaagagcaattgaatccagaaaccggg

SEQ ID NO: 252 - DNA, 951 bp, Bacillus licheniformis
atgaaaaaaagaaaaattgtcgtcgcacttggcggtaatgccattcaaaccggagatgccagcgcagaagcgcaaaagcgcgcgcttgaagaaaccgccatgtatttggcggatatgatcgacagcggcgctgaattaatcatcacgcacggaaacggcccgcaggtcggaaacctgatgatccagcaaaaggaggcggattctccgaaaacgccggccatgccgcttgaaacctgtgtttcgatgacccagggaatgatcggctattggctgcaaaatgcccttgaccgggcgcttcacgcaaaagggaaaggcggacatgcggcaaccgtcatcacccgcgtcgccgttcgaagcgatgatgaagcgttccgcaacccgacaaagccgatcggtccattttacagcgaagaagaagcgaaagaactgatgaacagccgaaacggcggcctcgtttttaaagaagatgccggaagaggctggcgccgcgtcgtaccgtctccggccccggtatcgattcttgaacacgatgttatcaatgatcttgtcgaacacggacatatcgtcattgcagccggcggcggaggcgttcccgtcatcgaaaacggcgatgccgtctccggtattgacgccgtcatcgacaaagactttgcagcctgcaaactggcggagcttgtgcaggctgacgaactggtcattctaacaggtgtcgactatgttgccgtcgattatttaaagccgacagaacgtgcgctgaaacgcgtcaccaccgaagaactgaaaggttatataaaagaaaagcaatttgcagaaggaagcatgctgccaaaagtcaaagcagccattcagtttgctgaagctaaaaaaggcaacaaaacggtcatcacatccctgaaattagccaaagacgctctccaaggaaatgccggcacgattgtcgtccaagcctaa

SEQ ID NO: 253 - DNA, 1017 bp, Bacillus licheniformis
acggagcgtttggcgcgctcgctttcggaatcggaacgagcgaagtcgaacacgtcttgtcaacgcagacgctttggcagcaaaaaccgaagacgctggaaatccgcgttgacggcaaactgcaaaaaggagtgacggctaaagacgtcattctggcgatcatcggaaaatacggggttaaattcggtgcgggctatgtcattgaatataccggcgaagtgttccgaaacatgtcgatggacgaacggatgacggtttgcaacatgtcaatcgaagctggggcaagagctggattgattgcaccggatgagacgacgtttgaatatgtcaaaacaaaaaaatatgcgccaaaaggcgaggattttgagaaagctgtagaagaatggaagaacctgaaaaccgatccgggggcggtctacgaccggacgatcgtgatggacggaagcgccatttctccgatggtgacgtggggcatcaaccctggcatggtgctgccggttgatgaaacgattccggggcctgaggctttcttgcaggaagacgataaaaaagaagcgcagcgcgcatatgaatatatgggtcttgaaccatataaaaaaatcgaggacattacaattgagcatgtctttatcggttcatgcaccaactcgcgtatgacagatcttcgccaggcggccgaaatgattaaaggtcaaaaagtcgccgacggcgtcagagcgatcgtcgtacccggctcgcaaagcgtcaaaatccaagcggaaaaagaagggcttcacaagattttcatcgaagcgggctttgaatggagagaatcgggatgcagcatgtgtttgagcatgaacaatgatgttgtccctgaaggagagcgctgcgcttcgacttccaaccgcaattttgaaggcaggcagggcaaaggagccagaacgcatctcgtcagcccggcgatggctgcgatggccgcgattcacggccgctttgtcgatgtcagaaaatattaccaagagacaacagctgtat

SEQ ID NO: 254 - DNA, 1118 bp, Bacillus licheniformis
atgaagaacaaattgattgaacgcctcatttcttatgcgaaagtggatacgcagtcaaatgaaaacagtcagacgacgccttccactcccgggcagctggcgcttgccaatatgcttgtcgaagagctgaaagagatcggcatgaaggacgtcacaatcgatgaaaacggctatgtgatggcgacgcttccttcgaatacagaaaaagaggtgccgacgatcggtttcttggctcatgtggatacagcaacagattttaccggaaagaacgtcaatccgcaggttatcgaacaatacgacggaaaggatattgtgctgaatgaatccctcaatgtcgtcttatcgcccaaggaattccccgagctagcagattatgcgggacatacgttgattacaaccgacggaacgactttgctcggcgccgacaataaagctgggatctctgaaatcatgacggcaatggaatatttaattgcgcaccccgaaatcaaacacgggaagatcagagtcgcttttacacctgatgaagagatcggcagagggccgcacaagtttgacgtcgaggcgttcaatgccaaattcgcgtatacggttgacggcggaccgcttggcgaactgcagtacgaaagcttcaatgccgcagccgcgaaaatcacttgtaaaggaacgaacgtccaccccggcacagcaaaaggaaaaatggtcaatgccgccaaaatcgcgatgcagttccacgccgcattgccggaaaacgaagctcctgaatttacagaaggttatgaaggcttttatcatctgctttcaatcaagggcgatgtttctgaaacgagcctctcttatatcattagagattttgacagagaccgatttaacgagagaaaagacaccgtccaaaaaatcgcaaacaaccttaaagcgaaatacggcgaaaacagcgtcacagtggacatgaatgatcaatattacaacatgagggaaaagatcgaaccggtcaaagagattgtcgacattgcctataaagcgatgaaaaaccttgatattgaaccggtcgttaaaccgatccgcggcggtacagacggctctcagctctcatatatggggcttccttgtccgaacat

SEQ ID NO: 255 - DNA, 1116 bp, Bacillus licheniformis
atgactcaaccgaatgaaacgattttgttggccggtttgggcttaatcggcggttcgatcgccctggccatcaaaaaggaacacccgggcaaacggattatcgggtttgacgtgtcagaagagcaggcaagggctgcacaaaagcttggcgtaattgatgctccggccgcttcttttttagaaggggtgaaagaagcgtcgactgttttcttagcggcgccggtcgaacagacgcttcacatgcttgatgagcttgccgcttcaggcatcaagaaaaagctgctcattacagatgtcggcagcacgaaacaaaaggtcgtcagccatgccgaaaaagtgctgccggatgactacaggtttatcggaggccatccgatggcaggctcgcataaatcgggcgtcgctgccgccaaagacttccttttcgagaacgcgttttatattttgacgccatccggctccgccggcaaagaagcggttgcttctttaaaagatctgctcaaaggaacaaatgcaaagtttgtggaaatgtctcctgctgaacatgacgctgttacaagcgtgatcagccattttccgcatatcgtggcggcgagtctcgtccaccagaccgtcaaattcgaagatcagtacccgctcgtcaagcgttttgccgcaggaggcttccgcgatatcacgaggattgcctcaagcagcccggcgatgtggcgcgatattctcttgcacaataaagataaaatattggagcggtttgacgaatggaaacaagagctggacagaatccagtcttttgtcgaaaatgaagatgcagacgggctgtttgaattttttcggcaagccaaggaataccgcgacggtctgcctttgcggcaaaaaggcgcgattccttccttttacgatctttatgtcgatgtcccggaccatccgggggttatttcggaaattacggcgatcctcgccgacgagcaaatcagcattacgaacatccggattatcgaaacaagggaagacataaacggtgttctcagaatcagctttcaatccgatgaagatcgaaaacgcgccgaaaaatgcatccaaacccgcgcaaaatacgaaacattttatgctgattga

SEQ ID NO: 256 - DNA, 918 bp, Bacillus licheniformis
tactctgtgatccgcgggatatgtcctttcctgaactggaacgtttaagcagagggtacgttcgggcgatcagccaaattgtcggaccgacaaaagacgtaccggctcccgatgtatttaccaattctcaaatcatggcatggatgatggacgaatattcaagaatcgacgaattcaactcgccgggcttcattaccggcaaaccgctcgttttaggtggttctcacggcagagaatctgcgacagcaaaaggggttacaatctgcattaaagaggcggcgaaaaagaaaaacatcgacattgagggagcttctgtcgtcgtgcaggggttcggaaatgcgggaagctaccttgcgaaattcatgtatgacgcaggtgcaaaggttgtcggcatttctgatgcatacggcggcctgtacgatcctgaagggcttgacatcgattacctgcttgaccgccgagacagcttcggaacggtcacaaagctgtttaatgacaccattacaaacaaagaactgctggagctggagtgcgacattcttgtgccggctgccatagaaaatcaaattaccgcggaaaacgcccataacatcaaggcgaaaatcgttgtcgaagctgccaacggcccgacgacgctcgaagcgacgaaaattctttccgaccgcgacattcttcttgtaccggacgtgctggcaagcgccggcggtgtaacggtatcctattttgagtgggtgcaaaacaaccagggattctactggactgaagaagaagttgaagaacgtttggaaaaaatgatggtcaaatcgttcaacaacatttatgaaatggcgcacaaccgcagaattgacatgaggcttgcagcctatatggtgggcgtccgcaagatggcggaagcatcccgcttcagaggctggatat

SEQ ID NO: 257 - DNA, 914 bp, Bacillus licheniformis
ccaaaaagctcgtcgaagtggctgagaaagaaaacgcgcaagccgtggctcacggctgcacaggcaaagggaatgaccaagtgcgcttcgaggtgtcgattaaatcgctcaatccggatttggaggtgctggcacctgtgcgcgaatggaaatggtctcgcgacgaagagatcgcgtatgcagaaaagcatggcattccaattccgatcaatcttgacagcccgtattcaatcgaccagaacctgtggggcagaagcaatgaatgcggagtcctggaagatccttgggccgcgcctcctgaaggagcgtatgatttgacgaagcctcttgaaaaaacaccggatactcctgatgtgatcgaaatcgcttttgaagaaggcgttcccgtatccattgacgggactcactacccgctgtcagacttgattttaaagctgaatgaactggcgggcgcacatggagtggggcgcatcgaccatgttgaaaaccgccttgtcggcatcaaatcgcgcgaagtttacgaatgcccgggcgcgatgactttgattaaggcgcacaaggagcttgaagatttgacattggtaaaagaagtggcgcatttcaaacctataatcgaacaaaaaatggctgaagtgatctataacggcctctggttttctccgcttaaagacgcgctttccggtttcctgaaagaaacgcagaagcatgtcacgggcgtcgtccgcgtcaagctgtttaaaggccatgcgatcgttgaagggcgtaagtccgaatactccctgtatgatgaaaagcttgcgacgtatacaaaagacgatgcattcgatcatcacgctgcagtcggctttatcgagctgtggggactgccgacgaaagtaaacagcatcgtccaaaaaaaggagcagattaaagca

SEQ ID NO: 258 - DNA, 1107 bp, Bacillus licheniformis
gtttggcgtcaagctttgtcgaaagcacgctggcgcaaatttataaaataaaggataaagacggcttccgcggcggccctgcttactatatggaaaagggcttgaaaaaacgctggatgggcgcggtttttgccgtcttgatcacattgtccttcgggatcgtttttaacgcggtccagtccaatacaataacggtcgcttttgaaaactcgttcgggacagaccgtctcacactgggaattatcatcacgattgttttcggcatcattacattcgggggaatcaaacggatcgccaagctgtccgaatatatcgtcgtatgcctggccgtcttatatatcggcgtcgccgttttcgtcatgctgatgaatattacgaaactgccggacgtcatctctttgattatcggtcatgcgtttggccttgaacaagcggcgggcggagccatcggcgcggccctgatgaacgggatcaaacgcggcctcttctcgaatgaagccgggatgggcagcgcgccgaatgccgcagccgcagccactacgagccaccctgtcaaacagggccttgtccaggctttaggagtctttacgagcactttggtgatttgttcaagcacggcttttatcattttgttttccgatgcgtataaagagccggggcttagcggaatcgagttgacgcaagcgtcgctcagcacgcacatcggagcatgggcctcaggctttctcgccattatggtgttcctgttttctttcagcaccttgatcggaaactactactacggcgagacgaatatcgaattcctgcacacgaacaaagcatggctcttcatttaccggatctgtgtgcttgcgatggtcatcttcggatcggtatcaaaagtccagcttgtgtgggacctcgccgatttgttcatgggcctgatggtcatcgtcaacctgattgcgattttcctgctgtcaaaagtggcatttgccgccttgaaagactatgtgaaacagcgcaaagcgggcaaagacccggtcttttataaagatgtcattaaaaaccatgaaggcatcgaatgctgggagcactccggcaccgaacaaaaatccgaaagcaaaa

SEQ ID NO: 259 - DNA, 1088 bp, Bacillus licheniformis
atggaaagaattgaacaaatctcttcctggctgaaagaaaaaaacatatcttcggcttttattcattcaaaagaaaacgtattttatcttaccggcttttatacagaaccgcatgaacggctgatgggcgtttttatttttcaagatgaagagccgttttttgtttgtccgcaaatggaggccggtcaggcgagagcagccggctgggcgtatgagatcatcggatacggggatcatcaaaacccttgggaactcatatcctcagcgcttcaaaagcgaaacggccaatgtttaaaagtggcggttgaaaaagaaacgcttgctctttcgcgcgccgaaatgctgcaggcggtcacaaacggtgcggagcttgtctctgcagaagaaaggctgaaccaaatccgcgtcatcaaagacgaaaaagaaatcagcatcctccgcgaagcggccaagcttgccgattacggggtcgaagcaggagccgccgcattaaaagaggggatagcggaaatcgatgtcgtcgctaaaatcgagtatgagctgaagaaaaaaggagtccaggggatgtcgttttccacaatggtcctttttggagaaaaatcgggacagccgcacggaaaccccggcagccggacgctcaagccgggcgatttcgtcctctttgatttaggtgtaatcattgacggatactgctctgatattacaaggacgctcgtgtatcaaaatgtgagcgaaaaacaaaaagaaatatataatacggtgcttcaagccgaaacggaggcgcttaagatgagcaaacccggtgtgagaatcggcgatcttgatttaaaagcgcgcggcatcatcgaaaaagcgggctacggcgattactttccgcaccgcctagggcacgggctcgggatttcgcctcatgaatacccgtccatgagccataacaatgacgaacttttgaaacaaggcatggtatacacgattgaacccggcatctatgtgccggaaatcggaggcgttcgcatcgaggatgatgtacttgttacagccgatggagcagaagcgctgacaaagtatccaaaagagctgactgtcat

SEQ ID NO: 260 - DNA, 1164 bp, Bacillus licheniformis
atggattttaatacagagcataacagacgcgggacccagtctgtaaagtgggacttaacacaggaattattcggcgtaaatgacgcgcttccaatgtgggtggctgatatggattttcgtgcccctcagcctgttattgacgcccttcagcagcgcctggagcacggggttttcggctatacatctgcaaacgcgggcacgaaggaagctgtcaccgattggctcagccgccggcacggatggaatactgaaccggcgtttatcaccttcagcccgggcattgtaacagcgctcgcccaagcggttcaggcgtacacagagcctggcgagcgggtggtcgtacagccgcctgtatatacgccgttctttgatatagttgaaaaaaacgggcgggttgttttacataatccattaatcgaaaaagacggccgctatgaaatggatttttccgaccttgaaaaaaagcttgtggaaccggatgtcaagctgttcattctttgcaatccgcataacccttccggccgttcatggtcgaaagaggaactgacaacgcttggcgaactctgccttaaacacggtgtcacagttgtttccgacgaaatccactcggacctgatgctgaacggactgaaccatacgccgttcgcctctttatctccggaattcgcggatatatccatcacatgcattgcaccgagcaaaacgtttaacttggccgggttgcaggcctcagccatcatcatacccgacaaagcgaagagaaccgcctttgcaaaggtcatgcagcgtcagggactgcattctttaaatacatttgcgattgcagccatcgaggcggcctattcaaaaggcgaaccatggctcgatcagcttatcccatacattgaacgaaatatggaagaagtccgccgctttttggcagaggagctgcccgaggtccgcatgatggagcctgacgcctcttacttggcatggcttgactgccgaaagctcggattgtcggatcaggacatcaaacggcttctccttcataaaggaaagctgattcttgagccgggaccgaagtacggaccgggcggagaaggattcgtcagaatgaatgtcggatgttcgctctctgttgtaaaagacggactccgacgtctgaagaccgctttttcgtaa

SEQ ID NO: 261 - DNA, 1008 bp, Bacillus licheniformis
gcagcatggtctaacgcatttaaaaagatatggaagacatgggcttctcagatttcaatcttggaccagagccggaattcttcctgttcaagctagacgaaaaaggcgagcctacgcttgaactgaacgacaaaggcggatatttcgaccttgcgccgactgatcttggcgaaaactgccgccgcgacatcgtacttgagctcgaagaaatgggctttgaaatcgaagcgtctcaccacgaagttgcacctggacagcacgaaatcgacttcaaatacgccggagccatccgcgcttgcgatgacatccaaacgttcaagctcgttgttaaaacaatcgcgcgcaaacacggcctgcacgcaacattcatgccaaaaccgttgttcggcgtaaacggatcaggcatgcactgcaatctatcactcttccgaaacggcgccaacgccttctttgacaaagacgccgatcttcagctgagtgaaacggcaaagcaattcatcgccggcatcgtcaagcacgcaacaagctttacagctgtgacaaacccgactgtcaactcttacaagcgccttgttccaggctatgaagcaccttgctatgtggcatggagcgcgcaaaacagaagcccgttaatccgcatcccggcttcccgcggcatcagcacgcgcgtagaagtcagaagcgtagacccttctgcgaacccgtaccttgccttgagcgtacttcttgcagcaggacttgacggcatcaaaaacaagctggaagcaccggctccgatcgaccgcaacatctatgtcatgacaaaagaagagcgcctcgaaaacggaatcgtcgaccttcctgcgacactcgcagacgctctcgaagaattcaaatcaaacgaagtcatggtcaaagccctcggcgaccatctattcgaacacttcgtcgaagcaaaagaaatcgaatgggatatgttccgcacacaagtccatccttgggagcgcgagcagtatatgtctcagtatt

SEQ ID NO: 262 - DNA, 1206 bp, Bacillus licheniformis
aaatgaatattccgaaacggacaattatgactcccggtcctgtcgaggttcatccgagagtgctgagggcgctttcctcacctgtactgggacagttcgatcctgcatttacagacatgatgaacgacgtcatggcgctgcttcggcagattttccgaacgacaaataaatgggcattcccgatagacgggacatcgcgggccgggcttgaagccgtccttgccagtctcatcaaaccgggggacagggtgctcattcccattttcggacggttcggctatctgcttgccgagatttgcgaacggtaccaggctgatgtttatacaatggaatgcccgtggggagacgtttttgaaccgaaagaggtcatctccgaaatcaaacggacgaaaccggagattgttgcggttgtgcacggcgagacatcgacgggatgcattcagccgctcgaagaaattggccgggcctgccgggagcttgatgtgctttgtgtagtcgatgcggtggctacaatcggcggcacggatgtcaatacggatgaatggtgtcttgacgcggtcgtcggcggtacgcaaaagtgtttatccgttccttcaggtatggcgccgatcacatttaacagccgggttgaaaagcgcatcaatgaaaggaaaaaggtagaacggggcattgccacaagagaagatatcgtgcttgaaacgggacgcttgccgatttccagcaattattttgacctcggcatgctgatggattattggagcccgaggcgccttaatcatcatacagaagcgacttcgatgctgtacggcttgcgcgaaggagcgcgggtcgttcttgaggaagggctccgcgagcgattctcaagacaccggctccatgaaacagcactaatcaagggcatcaaagcgatgggactcgaattgtttacggaaggccggaaaaagctgccgaccgtcacttgtgtgaaagttcctgatcgggttgacgcagatcttgtcaggaagatgatgcttgacgacttcggcgtcgaaatcgccagctctttcgggccgctggccggaaagatatggagaatcggaacgatgggatacagctgccggaaagaaaatgttctttttacattggctgctctcgaagctgttctcattcgcacaggtgcttcagtatcgccgggaaatgcgcttcaggcggcactggatttctatc

SEQ ID NO: 263 - DNA, 853 bp, Bacillus licheniformis
  misc_feature (1)...(853): n = A,T,C or G
atgatcatgacaacaccgatacacgtttactcagaaatcggccctttaaaaaccgttatgctgaagcggcccggtcgggaactggaaaaccttacacccgaatatctggaaaggcttctctttgacgatattccctttttgccagcggtgcaaaaagagcatgaccaatttgcagaaacattaaagcaacagggggctgaagttctttatttagaaaagctgacggccgaagctttggatgacgcattagtccgcgagcagtttatcgatgagcttttaacggaaagcaaagcggatatcaacggcgcatacgacaggctgaaagagtttttgcttacctttgacgccgattcaatggttgaacaggtgatgagcggcattcgaaaaaatgagcttgaacgcgaaaaaaaatcgcatcttcatgagctgatggaagaccattatccattttatctcgatccgatgccgaacctttatttcacaagagatccggcggccgccatcggcagcggactgaccatcaacaaaatgaaggagcctgcccgccgaagggaatcgctgtttatgcgctacattatcaatcaccacccgcgttttaaaggacacgagattccggtttggctcgaccgtgatttcaaattcaatatcgaaggcggagatgagcttgtcttaaatgaagaaaccgttgcgatcggggtatcggaacggacaacggctcaggcgatcgagcgtcttgtccggaacttgtttcagcggcagagccggattcgccgtgtactggccgtcgaaatacaaaagagcanagcctttatgcatttagataccgtcttcacgatggttgaccgagatcaat

SEQ ID NO: 264 - DNA, 1251 bp, Bacillus licheniformis
aagaaaactctctcatccaagtcaaagacattttaaaagcccaccaaaatgtaaaagatgttgttattcatacccctctccaaaaaaatgagaggctgtccgagaggtacgattgcaacgtatatttaaaaagagaagacctgcaggttgtccgctcttttaaactgagaggcgcctattataaattgaagcagctttcaaaagaaacgacgaaaaacggggtggtctgcgccagtgcaggaaaccatgcgcagggagtcgctttttcctgcaaacatctcggtattcacggaaagatttttatgccgtcgacgaccccgaggcaaaaaatttcccaagtcgaattgttcggcaaggaatacgtcgagatcatcctgacaggcgacacgtttgatgatgcttatcaaagcgcagtcgcctgctgcgaggaagaaaagcgcgcatttatccacccgtttgacgatcctgccgtcatggctggccagggtacggtcgcggtcgaaatcttaaacgatatcgaaacggaaccccattatttattcgcaagcgtaggcggagggggtctgctttcaggagtgggaacctatatgaaaaacgtgtccccggatacaaagctgatcgcggttgagcctaaaggcgcgccggctctttttgaatcaaacaaaaaaggcgaagtcgtcatccttgagaaaatcgataaatttgtcgatggagccgctgtgcagaaaatcggcgaagagacatttaaaacgcttgaaaccgttgtcgatgatattttgctcgttcctgaaggaaaggtgtgcaccgcgattcttgagctgtacaaccaatgcgcgattgtcgccgaacctgcgggagcgctgccgatcgccgctttagatctttacagggatgaaattaaagggaaaaatgtcgtatgcattgtgagcggaggaaacaacgatatcggcagaatgcaggaaatcaaagacagatcgatgatgtatgaaggactccagcattatttcatcgtgaacttcccgcaaagggcgggagctttgcgcgaatttttagatgaagtgctcgggccgaccgacgatatcacccggtttgaatatacgaagaaaaataataaaagcagcggccctgcgctcgtcggcatcgaattgaagcagcgcgaagattacgagccgctgatcgcaagaatggacaggaaaggcttccgctatgtcgaagtcaataaagatgaagggctctttcatttgctgattt

SEQ ID NO: 265 - DNA, 1060 bp, Bacillus licheniformis
  misc_feature (1)...(1060): n = A,T,C or G
atgggtctcatcgtccaaaaatttggcggaacttccgtagggtcagtggaaaaaatattgaatgtcgcataccgcgtcatcgaagaaaaacagcgcggtcatgatgttgtcgtcgtcgtttcggcgatgggcaaatcgacggactccctcgtcgcgcttgccaaggaaatcaccgagcagccgagcagcagggaaatggacatgctgctgacaacaggagagcaggtgacgatttcgctgttgacaatggctttgcagaacaaggggtatgatgcggtttcctatacaggctggcaggccggcatcgaaaccgaaaatattcacggcaacgcaagaattacgaacattgatacagccaagctgaaagagcgcctgaatgaagggaaaatcgccgttgtcgccggattccagggcgtcacagcggaaggcgaaatcacaacgctcggcagaggcggatcagatacgacagccgttgccctcgcagcagccctgaaagctgataaatgcgacatttacaccgatgtgccgggggttttcacgacggatccccgctatgtgaaaacagcgcggaagctggccggaatctcctacgatgaaatgctggagcttgccaatcttggagcaggcgtccttcatccgagagctgttgaatttgcgaaaaactaccaggtgcctttggaagtccgttcaagcaccgaaaaagaagccggcacattaatcgaggaggaatcatcaatggaacagaatttaatcgtaagaggcattgcatttgaagatcagatcacacgcgtgaccgtatgcggcctggcgagcggcctgacgacgctgtcaacgatttttacaacgctcgccaaacagaacatcaacgttgacatcatcattcaatcggtgacaggcacaagcaaaacgtcgatttctttctcagtgaaaacggaagacttaaaacggacggttgaagttctcgaagaatacaaagacgcgctcgactatgaacagattgaaacggaaaacaggcttgccaaagtgtcgctaaaagnttttgccaatgcatctagacccc

SEQ ID NO: 266 - DNA, 939 bp, Bacillus licheniformis
atgaaaaagaaaacaagcggaatccatcacattaccgcgattgtcggccatccgcaagagaatgtcgatttttacgctggcgttctatgtttacgtttagtgaaaaaaactgttaattttgatgatccgggaacataccacctgtatttcggtaatgaaggcggaaaaccgggaacgattattacattctttccatgggtgggtgctcgccgaggagtcattggagatggccaggtgggagttacttcatacgtcgttcctaaaggcgcaatggcattttgggaaaacagattggcaaaatttaatttgccttatacaaaaatgaaccgttttggagaggagtacttagagttcgatgatcctcatggacttcatctggaaattgtcgaaagagaagaaggggaaaagaacagctggaagataggagaaattacaccggacaaagcaatcaaaggatttggcggagcaacacttttatccaaacaaccggaaaaaacggctgaattattagaaaaggttatgggacttgaaaaagttggtgaagaaggagattttgtacgttttcgttcttctggtgatatcgggaatataattgatttgaaattaacaactataggcagcggacaaatggggattggtacagttcaccatattgcctggagagctattgatgacaatgatcaattagaatggcaaaaatatgttgcagaaaatggttatcgtgttacacccgtgcaagacagaaattattttaacgcgatttattttagagaacacggggagattttatttgaaattgcaacagatcctccagggttcgcccatgatgaatcacatcaaacaatgggagaacagttaatgttgccggctcagtatgaacactacagagagcagttagaaagaagattaattcctataacagtgaaggcgctggattaa

SEQ ID NO: 267 - DNA, 1062 bp, Bacillus licheniformis
atgaaactaaacaaattgagagagcttttcggcggtttaggcattgacggtatattggtgacgagcggcgttaatttgcggtacatcaccggatttaccggatcttcaggactggcggtcatctcagacgatcaagcagtctttattacggatttccgctatacagaacaggcgaaggatcaaatcaaaagctttgacatcgttcagcatgccggcggaatcgttcaaaagaccgccgaagtgatcaaagagatggggataaacaaaatcggttttgaacaggataaaatgacatacggaacgtatgccgcctacaaagagcagcttggcgcagctgaactcgttcccgtttctcaatctgtggaaaagttgcgcttgattaagtcaagtgaagagattaagatattaaaggaagctgcaaagattgcagatgatgcattcagccatattctgacggtcatcaagcccggcatcaccgaaattgaagtcgccaatgagctcgagttttacatgcggagccagggagccgatcattcgtccttcgatatgatcgtggcgtcaggcgtacgctcaagtctgccgcacggagtggcaagcggcaaagcgatcgagaaaggcgaccttgtgacgctggactttggggcttactataaaggttactgctcggacattacgcgtacagtcgcggtaggagagccggatgatgagctgaaacgcatttatcaaaccgtgtttgaggcgcaggctatcggcatgcggagcatcaagccgggaatcaccgggaaacaggctgacgcatacacaagggactacatatcttcacaaggctacggcgattatttcggccattcaacaggccatggcctcggcatggaagttcatgaaagtccggcgctttcagcacgttctgaccagatgcttgaaaaaggcatggttgtaacggttgaaccgggaatttacataccgggcaaaggcggggtcaggatagaagatgatattgtcctgacagaggaaggaaacgaatcccttacccattccgcgaaagatttaattattttataa

SEQ ID NO: 268 - DNA, 1085 bp, Bacillus licheniformis
atgcttaaacgtacgcctttatttgacctttataaggaatatggcgggaaaacgattgattttggcggctgggaactgccagtccaattttcttctattaaagaggagcacgaagccgtcaggacgaaagcggggctttttgacgtctcacacatgggagaggtcgaaatcacaggaacggacagccttccgttcttgcaaaagctgttgacaaacgatgtttcgacgctgaaagaaggcggcgcccagtatacggctatgtgctatgaagacggcggaacgatcgacgatctcctcgtctataaaaaagcggccaatgtctatatgctcgtcattaacgcagccaatatcgacaaggacgtcgattggatgaacaagcatataaagggtgacgtgtcggttcgaaacgtatctgacgagattgcgctccttgcccttcaagggccgaaggccgaagcaattttaaaacaggtcgcagatcatgaccttgcagaattaaagccgtttatgttccgggatgatgcagcggttggcagcgtgcaggcgcttgtgtccagaacgggatacacgggagaggacggctttgagatttactgccggaatgaagatgcagcctgcatttggaagctgctccttgaaacgggcaaggattcgggattggtgccgtgcggcctcggggctcgggatacgctgaggtttgaagcgaagctgccgctttacggacaggagctctcaaaagacattacgccgatcgaagccggcatcggatttgccgtcaaaacgaacaaagcctcggatttcatcggaaaagccgtcctggcaagccaaaaggaacatggagcggacagaaagctggttggccttgaaatgatcgataaaggcattccaagacacggatacgccgtctattatcaaggcgaacaagcaggcgaggtgacaaccggcacacagtcgccgactttaaagaaaaacgtcggcctcgcattgctgaaaaaagaagcctgcgccctcgacaccgtagttgaagtggagatcagaaataaacgtttgaaagccaaaatcgtgaaaaccccattttacaaacg

SEQ ID NO: 269 - DNA, 1636 bp, Bacillus licheniformis
atgtacagagatggtttccgagcgaggacggaaatgaagcaaaacgaaacgagttcctatcattgatcgagcagctgatcgagggagtggacaacctgaaaaatccggatcaggtcaaccttggcggcgagaagaaccgagagggcttcttttatgaaaagctggttgcagagagtcggattccgcatgaaggtgcgccgatgaaagaggttaacgaagagctgttgaagctgttgcacggccatccgtatcacaccaaatactttttcacgaacattctgccgatggccagcatcccggggatattaggcatgcttacggcgtttatggtcaatggcaacaacctgtgggatgtgtacggtccagccggagcggaggcggaagtgaaggttacagcgatgatgtcaaagcttgctgggtatgatgccgaaacaagcggaggatatacaacgtggggaggacaaggggcggtatacagcggcctcagaatcgcgattgccaaaatggctccgtcatccctaaaagaaggggttcccggcaatttctatgcgttttgttctgaagcggctcattacagcttgtataagtcgatggaagccgcaggactcggcagcgatcatttaattaaagtcaaaacaaatctcgaccattccatggatacggaagatttgcgagagaagcttagacaagtatgcgaagccgggggcattcccgtctatatcgtagccacgacgggaacgacagatgcgatcggcatcgatgatgtgagcgctgtccgccgtgcggctgaagaaaccgcgaagagcttcgggctgccggttccgcatatccacgccgattccgccctgggaggattttttgccttttttaatgagtacgatctgaatgagaacgctttatccttcagtcccggtgtcctcagcatgatcaaaccgattcaggaaaaaatgaggcatctgcatgctgccgattcgctttgctttgattttcagaagctcgggcagacgccttatgtgacgagcctgtttcttgtgaaggatcgcaatgacttaaaacggatcgatctggatcccgatgagacgccgtatgtcggccaccgcggctatggggactaccatacgggctacacgctggaatgttcgcgcatggccagttcgatcagtatgtacagcgcattgatggcatttggctatgaaggctatcaaaagctgcttgcccagttccttgaagtcaacctgcattttagggaacagctgtctcggcagattccggaggccgatattgtgaacccggacaactgcggcatgtctacgctgtttcgcatttatcctgaaggggcgcctagatttgaagacgaaatttcgggagcatgcaccattgaagagctggaaagaaacaatgcgcttactgaaaaattatttgaaaagctcggaacaaaaagggacaagatgttttttggcgatacgaaaaaacacttgcttgtgaagtcctgtgaaggggttgaattaccgctttgcgtcagcaaatttttcgtcatttctccgtataccatgcctgaacatgtcccgggaattatcgattatttaaaagaaactattgaggaagtcttccgggagcatgggtctctcatgacaaa

SEQ ID NO: 270 - DNA, 939 bp, Bacillus licheniformis
tgaacctggccaccgccaagctttttggagaattggagttctggttcgcgttaatcaaagtcattgcgatattggcgctgatcgcgatcggacttttcatgatcttcaaaggattttctacccattcgggcactgccgcctttcacaacctttggagccacggcggcatgtttcctaatggactgcacggatttctcctttcattccagatggttgtctttgcgtttgtaggcatcgaacttgtggggctgacagcgggggaaacgaaagatcccgaaaaggtcattcctaaagcgatcaacaatatccccgttcgggttttgcttttttatatcggtgcgctccttgtaatcatgagcatctatccgtggaatgtcatcaatcctaatgagagtccgttcgtccaagtcttcgcagcggtcggcatcattgcggctgcaagcatcatcaactttgtggtgctgacatcggcggcttcggcaagcaacagcgcagtcttcagcacaagccggatgatatactcgctcgcgaaagaacataatgcgcccggcgctatgaccaaactgacctcccgcaaagtgccgggcaatgcattgtttttctcagcggtcgttattctgattggcatcatgctgaactatatcatgcctgagcaagtgtttacgctcattacaagcatctcgacgatatgcttcatctttatttggggaataaccgtcatctgccatttgaaataccgcagaactagaccggatttagcgaaaagaaacaaattcaagatgccgctttacccgttttcaaattatgtggttctcggttttcttgcgtttatcctcattgtgctcgcactggcgcaagaaacccgtgtttccttatttgtcacgccggttttggttatcatgctgatcgcgatttacaagctgagaaaacctagtcacg

SEQ ID NO: 271 - DNA, 928 bp, Bacillus licheniformis
ttgtgagagccgttcaaaatattgcagaattaatcggggaaacgccccttgtcaagttgaaccgcgttcagcccgaaaacgcggcccaagtttatatcaagcttgaatcttttaatccgagcggaagcgtaaaagaccgcgcggcctaccaaatgatcctggatgccgaagaaaaaggcctgctgaaaccgggttcaaccatcattgaaccgacgagcgggaacaccggcatcggccttgcgatgaacgcggcggcaagaggctacaaagccattcttgtcatgcctgatacgatgacgaaggagcggatcaatcttctgaaagcgtacggagccgaagtcgtcctgacgccgggggatgaaagaatgccgggcagcatcaaaaaagcgcaggagctcgctcggcaaatcccaggcagctttattccgatgcagtttgataatgaagccaatccggaggctcaccggagatcaaccgctctggaaattgcccgggcaatagaagaaatcggcaaacctctcgctgcatttgttgcaacagcagggacagggggaacgattaccggaacaggcgaaaagctgaaagctttatttccgggaataaccgttcacgtggcagaacctgcagggtcgcctgttttatccggcggcaaacccggaaaacacaagcttgtcgggacaagcccgggatttatcccaaacattttaaacgaaaacgtctatgacgaaatcttaaagatcaaggatgaagaagcctatgagatgacgcgcagattggcgcgggaagaaggaatccttgtcggcccttcttcaggagccgcttgcttcgctgctgttgaaacggccaagaagctccctcccgacaaagtggtcgtctgcatgacggccgatacaggggaacgctatttatcaagcgatttatttcaatt

SEQ ID NO: 272 - DNA, 937 bp, Bacillus licheniformis
  misc_feature (1)...(937): n = A,T,C or G
atgagtcatgaaaactggacgcttgaaacaaagcttgttcataaccaaaataaaacggacggagcaaccggagccgtcagcgtgccgatccagcacgcatcaacctttcatcaagattcttttgacaaattcggcgaatatgactacagccggtcaggcacaccgacaaggaaggcgcttgaagacacgatagccgagcttgagggagggacgagaggatttgctttttcatccggcatggctgcgatttcctccgcctttctgcttttgtcaaagggcgatcacgtgctcgtcacaaaagatgtgtacggcggcacttaccggatgattacggaagtgctgagccgctttgggattgaacatactttcgtcgatatgacggatttaaatgaaattgctttaaacataaaggaaaacacaaaagtcatctatcttgaaacaccgtcaaatccgacgctcggcattacggatattagaggggtcgtcaagcttgccaaggcgcacggctgtctgacgttccttgacaacacgttcatgaccccggcgttgcagcgaccgcttgagctcggcgtcgatattgtgcttcacagcgcgacgaagtttttaagcggacacagcgacgtattatcaggccttgccgtcgtgaaagacaaaaagctcggcgaagaactctataagctgcaaaattcgttcggcgctgttctcggcgtccaagactgctggcttgtgctgagagggctgaagacgctccaagtgcggcttgaaaaagcaagcaggacggctcagcagctcgccgaatttttcgaaaaacatccggccgtcaaacaagtgtattatcccaggctgtcttcgcatccgggtgcatcgatccacaaacaccaggcgaacggcgccaggtgcggtcctttcttttgacttgaggatgcngaagcagtca

SEQ ID NO: 273 - DNA, 865 bp, Bacillus licheniformis
atgagtcggaacacaaaagcattcacaacggaagattggcaggccaaacgggatcaattcgtggcaaggggtgtctccaacggaaatcgtcatctggccgctaaaggggaaggtgccgttttatatgatattgacggacgccgttttatcgattttgccggggcgatcggcacattaaatgtcgggcattcacatccgaaagttgtagaagctgtcaagcggcaggccgaacagctcatccatcccggttttaacgtcatgatgtatccggcctatttggaattggcggaaaagctttgccggcttgcgccgggcgcccatgagaaaaaagcgattttcctgaactcgggtgcggaagccgtagaaaacgccgtgaaaatcgccagaaaatatacgaagcgtcaagccgtcgtttcttttacccgcggattccacggacgcacaaacatgacgatgagcatgacgagcaaggtgaaaccgtacaaattcggattcggtccttttgcacccgaggtatatcaggcgccgtttccttactactatagaaagcctgaagggatgactgatgaaagctatgatgacatggttattcaggcgtttgacgatttcttcgtctcgtctgttgctccggagacggttgcttgcgtcgtcatggagccggtacagggagaaggcggttttatcattccttcaaaacggtttgtgcagcatgtcgcagccttctgccaaaaacacggcatcgtttttgtcgctgatgagattcaaacaggctttgccagaacgggcaaatattttgcgattgagcaatttgaagttgttcccgattctgggacagggttcaaattggtggcggccggcgttccgg

SEQ ID NO: 274 - DNA, 908 bp, Bacillus licheniformis
  misc_feature (1)...(908): n = A,T,C or G
gtgataacaagagactttttcctattcttatctaaaagcagcatcctgaatcgcctggcgagaaattgggggagttccgtcgcgaccggaaaaattatcggaggaaaagattttgaagcttcaattccgattattaaggggcttaacgaacaagggctgactgtgacagtcgatcacttgggcgaatttgtgaacagcagggaagtcgcaagggagcgcacgcaggaatgcattcgggccattcagctgattgctcaggaacagcttaattcacatgtttcattaaagatgacgtcattgggactcgatattgaccttgaccttgtcagggataatatgaacagtattctggaatgtgccgagcagcaccaagtgatggtcacaatcgatatggaggatgaagtgcgctgccaaaagacgcttgacctctttaaggagttcaggcanaaatacgagtatgtcagcaccgtcctgcaggcttatntgtaccggaccgaacaggatttggaggagctcaattcattaaatccgtttttccgtcttgtgaagggagcttataaagaatcgccgaaagtggctttccctgacaaaaaggatgtggatgagaattacaaaaagctcattaaaaagcagctgctgagcggccattacacagctatcgcaactcatgacgacaagatgattgatttcgccaaagaaattgcgaatgagcatcaaatcggcaaagaccgcttcgaatttcaaatgctgtacgggatgcgcagcaaaactcagctggaactggtgaaggaaggctacaatatgcgcgtgtatcttccttacggagacgactggtacggatactttatgagacggcttgctgagcggcctgccaacatcgcttttgcgtttaaaggcatgacgaagaa

SEQ ID NO: 275 - DNA, 1113 bp, Bacillus licheniformis
ctctaatcaacagagggtagttgtcaaagtgggaagcagttctttaacaagtcttcacggcgaaatcagcagcaaaaagctcgaaaagctcgttgagcagattgtccgcctcaaagatgaaggacacgaagtcctccttgtttcatctggcgctgtagcagccggttaccggaagctcggctttatcaacaggccggatacattgcctgaaaaacaagcatccgcttctgtcggccaaggcttattaatcgaagcgtattccaagctttttttatcccacggctatatcgcttcacaaattttaatcacaaaaagcgatttttcagatgaaaaacggtacaacaatgtgagaaatacgatgaacgtgctgctgaaacgcggcattattccgatcatcaacgaaaatgatacggttaccgtcaatcggctcaaattcggagacaatgacacgctttctgctaaagtggcgggtctgatcgacgccgacctgctgaccatcctctctgatatagacggcctttatgacgcgaatccgcgaaaaacgccggacgccgcactcgtccaggaagtaactgaaatcacgccggaaatagaagcttcagcaggggatgcaggaagcgaagtcggaaccggcggcatgaagtccaaactggacgcttttaaaattacaatggcttcaggcatcaaagggtttttagggcgcgcggacacccccggcattttgcacgaagcgatctgcgggactgcgaggggaacgtattttataccgaatgcggattcacacgccctcaaccataaaaagcaatggatagcatttaactctggacctgaaggagacatcgtcgtccacaacgaaagcaaagagtttattatcgaccgtaaaaaaagcctgtatccttctagtatttacgacatcaacggccgtttcagcaacggatccgtcgttcgaatccttgatcaggaaggagaggaaatcggcctcggcgtcgtcaacttttcctcatcccagcttcgtaaatggaagaaggatacgaatcaggaaacagccgcttcctcacaggctgtcgttgacagagaagcgtttgtctgtcatttagagctatccgttccgct

SEQ ID NO: 276 - DNA, 942 bp, Bacillus licheniformis
aaaaagaagtcctgttgacgcctattacggcgtacaaaccatgagagccgtggagaactttccgattacaggctatcagattgatgaagagctgattaaagctttggcaatggtcaaaaaagcggcggctctcgccaacatggatattaaacgtttatataaagagcttggcgaagtcatcgtaaaagctgccggcgaaatagcggaagggctctggcacgagcattttattgtcgatcccattcaaggcggcgccggcacttcaatgaatatgaatacgaatgaagttatcgcaaacagaggtttagaacttttagggaaagaaaaaggggattacttccatttaagtccgaacacacatgtcaatatggcccaatcaacgaatgatgtgtttccgacagccattcatctggccacattgaatcacttaaaacggctcttatcgacgatggagcatatgttggatgccttccgcaaaaaagcggcggaattcgattcagtcattaaaatgggccgcacccatcttcaggatgccgtcccgatcaggctcggccaggaattcgaagcctactcccgggtgatcgaacgcgatattcagcggatcaggcagtcgcagcatcatctctatgaagtcaatatgggggccacggccgtcggcacaggtttgaacgccgatccgagatatattcaaaacgttgtcgcgcacctctcagatattagcggctatcagctgaccggcgcagaccatcttgtcgatgccacacaaaacacggatgcctacacagaagtatcggctgctttgaaagtcggcatgatgaacatgtccaagatcgccaacgatttacgtttaatggcgtctggcccgagggcaggtctagccgagatccggctgccgccccgccagcccggctcctccatcatgcccggcaaagtaaatccggt

SEQ ID NO: 277 - DNA, 1302 bp, Bacillus licheniformis
taaaatggtggcagctgtccatgatcggggtcggctgcacaattggaacggggtttttcctcggctcaagcatcgcgattaagaaaagcggcttttccgtattagccgcctttcttcttgctgcccttggcacttttcttgtttttcagcagctggcgaaattaacggcagatcatcctgttgaagggtctttttgttcttacgccagagaggccttcggcaattgggcggggtttagcaatggctgggtctactggtcatcggaaatgctgatcatcgggagccagttgacagcgatttccctgtttacgcgccattggtttaacgagattccgctgtgggtgttcgcctctatttatgcgattctcggattgatcgtcattttcacagggcgcagcagctttgaaaaaacggaaaacatattggccgtgttgaaaacggcggccattttaatgtttatcatcatcgctgtcttggcattgtgcgggctgctgcctggaaaaacgcctgaagtgcagttccctgaccgggttcacgaattgtttcctttcggctttatgggattgtggacggggttgatttatacattttacgcttatggaggaatcgaagtcatgggtctgatggcgattcacttaaaagacccgaaggattcatcaaagtcaggcagcctgatgctcataacccttgctgtggtctacgtcgtatcgatcgggctggccatgctccttgtaccacgcggaacattcaccgaacagaacagcccgtttattacgtcattaaaagactttcatctcgatttgatcatggatattttcaacggcatttttattattgccggtttttcaacgctgaccgcttccctgttcgccgtcaccacactgatgggaacaatggcgaaaaacggggatgcaccggcctgctttgccaaaaaagaaaaggcgaaagtatcgtggccggcactcggcctgacagtgctcgttctcgctgcttccatcgtcttgtcgctcattttgccgaagcagctttatgaacacatgacgacggccgccagcttgatgctgctctataactggatgtttatcctgctttccagcaaaaagctcacaaaaccgaaaatgaaagggaatgtccagattgtcacagcgctcgtcctgattttgttcgccgtttcgggtacgttatttgaaaaaaacagcagacccggtttttttgtgagccttctctttcttgccgttattgctgctgtgacgatgctcatgaaaaaaaagtgggcggatcaggaagagaaaaacgggcaga

SEQ ID NO: 278 - DNA, 825 bp, Bacillus licheniformis
aaaaagccgaaaggagaaaggacggtttacaccgctgcaggctttgacatcggctctcagctcaacagtcggcgccgccaatatcgtcggtgtgcctgcggccatcatgttcggcggtccgggagccgttttttggatgtggctggtcgcgctgtttgccatggcgatcaagttttcggaaagcgtcctcgccgtccactacagagaaaaaaatgaagaaggcgaatatgtcggtggaccgatgtattacattacaaaagggctctccatgaaatggctcggcgtctttttttcagtagcgctgatgatcgaacttgtaccgagcatcatggtgcagggaaattcggtttccgcatcgctggctgagacgttctcgttcaatcgtttatacaccggaatcgggattgcttttttgatcggtttagtggtgatcggagggattaaacggattggaaaagtgacggagctcgcagttccgcttatggcaggggcgtacatcggggccggtttcctgattgtcgtcacaaacctttcctctgtacccgcttttttctctctcatcttttcgaatgcgtttacatcttcttcggcattcggcggctttgcaggtgcggcagttgccgaaaccgttcgctgggggtttgcacgaggcctttattccaacgaagccgggatggggacggcgccgattgcccacgcagcggcgatgaccgaccaccctgtgagacaggggttctgggcggtgatcggcatcgtggtcgatacgctgctgatttgcacgaccaccgccttcgtcgtgctcgcatcaggcgtctggccggcgaa

SEQ ID NO: 279 - DNA, 1100 bp, Bacillus licheniformis
atgagaaagcgctatgatacgatcgtgatcggcggaggcatcatcgggacttccatcgcttatcatcttgcgaaagcggggaaaaaaacggccgtgtttgaaagcggggaagtcggcaaaaaagcgacgagcgcggctgcgggcatgctcggcgcccatgcggaatgcgataaacccggtacctttttcgaatttgccagagccagtcaaaaagcctataagcgcctgacgggggaattgaaagacataagcggcattgatatcagaaggcatgacggagggatattaaagctggcattttcagaaagcgaccgcgaacacctgatgcaaatgggtgcactggattctgtggaatggcttgaagctgatgaagtatataaattagaaccgaatgccggaaaaggaattctcggcgccaattttatcagggacgacgtccatgtcgaaccggctgcagtgtgcagggcatttgccaggggagcccggatgctcggtgcagatgtcttcgagtatacgcccgttttatcgatagaatccgaagcgggggccgtccgcgtcacgtccgcttccggcacagcggaggcggagcacgctgtcattgcaagcggcgtgtggagcggagctttgtttaaacaaatcggcttagacaaaaggttttaccccgtcaaaggggagtgcctgtccgtatggaatgacggcatctctttgacgagaacgctttaccatgatcattgctacatcgttccgcgccatagcggaaggcttgtcgtcggcgcgacgatgaagcccggggactggaatgagcagccggaacttggcggaatcgaggagttgatccgaaaagccaagtcgatgctccctgggattgaatccatgaaaatcgaccaatgctgggccgggttgcgtcccgaaacaggggatggcaatccgtatatcggaagacatcctgaaaatgaccggattttgtttgctgccggacatttcagaaacggcatcctcctggcacctgcaaccggtgagatgatggcagacatgatcctcggcaatccggtcaaaacagagtggatcgaggcgtttaaagcggagcgaaaggaggctgt

SEQ ID NO: 280 - DNA, 813 bp, Bacillus licheniformis
atgggtaggcgattgcgacgtatgcgcaggggaaaatggattgatgcgtgtgtttggacagcgggtttattggtatacttctttttggcgctgcccgtcttcgtgatcatactgtcggcattcagcccggacgaatatccgaagttcccgccatcaggcatctcgctgcgctggtttgccggagttttcagcagcagcggctggatggaatcgatttgggtcagctttatgctgcttctcgttgtaacgcatcttgcggtgatccttggaacagttgcagcctatgcattggcgcggctgaactttccgggaaaacaggcgattcaggcttttgttttatcgccgttgatgattccccaaatcgcattaggcgtatcatttctctatttattgacaatgattggggtaaacggcacgtttgccgggctggccgccgggcatatgctgatcagccttccgtatgtcgttcggacggtcggagtcagcatggcaaacgtggatcagaagcttgaactggcatccatgaatctcggcgcaggtccctggcataccttttttcatgtcatcttgccgcttattaaaccgggaatcattgcgggagccgtttttgcctctgtaacgtcattcggagaaatatcaatcagtctgtttgtttcttcaccggctgtcacgcctgtaccggttcgtacattcagctatattgaccagacatttgatccgagcgttcatgcgatttcggttatttttatcacggtttcagtgattgcgctgatcatcatcgaacggacgatcgggctctcaaaaaccatgtag

SEQ ID NO: 281 - DNA, 2040 bp, Bacillus licheniformis
ttggaattgatgtcggcgggacgtttacagatttagtggcagtcaacaaggacggaaaaatggtttcgacgaagacgccttcaaccccagaccagtctgatggtgtcatgaacggaattaaaaaaatggctgaaatcatcggaatagacgtaaaggatctattagccaatagtccattggttgtccatggaacaacagttgccactaacgccttgctggaatataacggagcaaaggtggggcttctcacaacggaaggctttcgggacgaaatcgaattccgccgcgcgtataaagaaagcgtgttttctccgcgcttagaagctccttatcaaattgtcccaagaaggtatcgtgtggggattcctgaacgactggatcatacaggaaatgtcgtaactaagcttgatgaagaagccgtccgccgggcagtccgcgggtttatccaagagggggtcgaagccgttgctgtctgctttctgttcagcttcatgaatccttcacatgaaatccgtgtcaaagagattattcaagaggaagctcccggcatgtttgtatcgttatcgtatgaagtgctgccgcagattcgggaatttgaacgggtgagcacgaccattgtcaatgcgtttaccggcccttccatgcaaagctacttaaaccatcttgacgaacggtttcgcgaagacggatttactggagaactgtttgttatgcaatcaaacgggggggtccaaaatgtcattcaaagcgggaaatttgccgcgggtggccttttgtcaggtccagccggaggagtgacggctgcttcctttatcggggaaaaatcgggctacgagaacgtcattaccgtagacatgggcggaacaagctatgatgtctcggttatcgaaaaattaaatccggcgatcacgacggaaaattggatcagcagatacagggttgccttgccgatgatggatatccatacgatcggctccggcggcggaagcatcgcctggattgacagcggcggagctttacaagtcggcccgcgaagcgcaggctcaaatccggggccggcctgctacggaaggggcggagaagaaccgactgttacagacgtgaatgtcttcttaggctatatcaaccctgataacttccttggcggagaaatgaagcttgaccgttcgctggctgaaaaagccattcgtacacgaattgccgaaccgctcggaatttcgacagtggaagccgcgcttgcaatctcacaaatcgtcaatagtgatatgtcaaatgcagtccactttgtaacgacacagcgaggccatgatccaaggaacttcgccctgatggctgtcggcggcgccggagccatccatgcaggcaagcaggcggaagacctgggcattaaaaccgttatcgttccgtcccttgctccggtcttttgtgcgctcggcgatgtggcggcaaaccttaaagtaacggagctcaggacgcgctttgaaagtttgaaaaacgttgacctgcaagcgatgaacgccgattttgaaaagatggaacagacggcccgcgaaaaacttggaggccaatcggtcaccaatcaatatgaaacgcgtcgctttatcgatatgcgctacgcgggggaagtccatgaagtaaccgtaccggtgaagtcaaggacgcgaaggattacagagttgaatcttgaagcaacggcggcagacttccatgaccttcatgaaagaatgtttgcccataaagaccctgagcacgacattgaaatcttaaacctccgtcttgatctggtgggagtcagagagccgttaaagcttaaggaggagcagtttgaacaagaggatccttcaaaagcgaaaacaggtgaacgcgatatgtattttgacatcgaaccggcgaaaacgcctattttcaacgggtcaatgcttgagccgggcaacctgattgtcggtcctgccatcattgagcaatggggtacgaccattgttgtttacccgggacatgaggctctaatcgattcataccgcaactgtgtcatcgaagtaa

SEQ ID NO: 282 - DNA, 967 bp, Bacillus licheniformis
atgacacaatcaaccgatgtactgaagcaaacgcctggaagaaaaatcggaccgtacagagctgatcaggtgggcagtcttttaaggtctgagcccgtaaaaaaagcgcgcctccaaaaagcgaacggcgaaattagcgctgaacaattgcgcgaagtcgaaaacgaagagatcaagcgcattgtcgaaaagcaaaaagaaatcggtcttaaagccgtgacagacggggaattccgcaggtcatggtggcatttcgattttcttgaaggacttgacggcgtagaaggatatacagcggacaagggcattcaatttcataatgttgaaacgaagccgcgcggcatcaaagtaacaagcaaagtcgactttacaaaccatccgatgctggaagattataaatttcttcatgatattgcgggcacacatacgccgaaaatgacgattccgagcccgaatatgctgtttttcagaggaaagcttggagaaagcccgtatgaggatcttgatgaatttcatcacgatgtagctcaggcttacaaaaaagcgatccgcgcattttacgatgccggctgccgctatttgcagctggatgacacggcctggtccgtatttttctcagacaaaggacatgagcagatcaaagctttcggccgccagcctgatgaactgcgccagtctttcgccaacacgattaatgaagcagttgaagggcgcccggacgatttgacggtcaccatgcacatctgccgcggcaacttccagtcgacatgggtggcggaaggcggctacgatgcggctgctgaaacgattttcgacggactcaatttagacggacttttccttgaatttgatgacgagcgctccggcggcttcgaaccgcttcgctacgtccaacggaaagacttgcaaatcgtcctcggtttaattacatctaaattcggcgagcttgaaaacccggatgatatta

SEQ ID NO: 283 - DNA, 852 bp, Bacillus licheniformis
ttacggagctgggctatgattttgaggcggggcgcctggatgagacggttcatcctttccaggtgacgatcagccaaggggatgcccgggtgaccacagcatacaatgaaaacgattttcggtcggctgttttcggaacaattcatgaatgcggccatgccatttatgaacagaacattgatgaagcgctgggcggaaccaatttatcagacggcgcatcaatgggcattcatgaatctcaatcccttttctatgagaactttatcggcaggcatcaaagcttttggacgcggtattttgataaaataaaggaagcaagccctgaccagtttgcaggcgttactgccgaagggttctacagagccgttaatgaatcaaagccgtcgctgattcggatcgaggctgatgaactgacatatccgctgcatattatgatccgctatgaaattgaaaaagcgattttcagcggcgaagtatcggtcggagaccttccaaaactatggaatgacaaatatgaagcatacctgggcattacgcctcccgacgatgctaaaggaatcctgcaggatgtccattggtccggcggagatttcggttattttccttcatatgcgcttggatatatgtatgcggctcaactgaagtcaagcatgctgaaagatcttccggagtttgaccgtctgattgaaaacggcgattttcaaccgatcagaaagtggctgacagagcatgtacacatccacggcaaaagaaaaaaaccgctggaaatcattaaatctgcgacaggcgaagaattaaacgtccgtcatttaatccgctatctggaagaaaaatatacaacactctatttgt

SEQ ID NO: 284 - DNA, 1120 bp, Bacillus licheniformis
ttgatggcattcatcaacatcaaaccggagttaaagcagaatatggaaagactgtctgacattctgaacatacccgaaccgcttttaatcagtgcaaatgcaaatgtatccgcggacgaactttattttccgggagtatcttttcatgcaggaaaaaacgttcaagcagcagaaacatatgaacagctgcaattattggcgaatcaatacacgtttgaagatgaacagtggctgacaaaaacagccgtttacgattcagcagaactgaaaaaggaaattggcagattgacggaatgctttccgtttgttacttcccgtatcatcggccgctcaagcatgggccagcctatatatgaactgctccttggagctgaaaatgccggaaaaagaacgcatatgaatgcctcttttcatgccaatgaatggatcaccacttctgttttgatgaaatggctcaaagaatactgttatcatttatgtacaggccagaccgctttaggtttttcgccgctcgatattttttcatcaacaaagctttccgtcgtgccgatcgttaatcccgacggtgttgaccttgtacttaacggccccggtcatcttgggatcgcgagagaagcgctggatgagatgaacgagcatcagccggatttccgggaatggaaagccaatataaacggagtggatttaaataatcagtttccgtctttctgggagatcgaaaaacaaagaaaaccgcctaaatccccttcctacagagactaccccggagatgaaccgctgacagaaccggaagcggcagcgatgagggatttaatcgcaaacgagccgcctgaccggcttgtggcgcttcacacacagggggaggaaatttattggggatacaagggattggagcctcctgaatcagctgatgtgatccaaacatttgagcgcctgagcggttataagggcgtcagatatatagacagctatgcaggatttagagattggtttattcattattacggaagagaaggatatactgttgaacttggcaaaggaaaaaatcctttaccgctgaaacaatttgacgatatatattgtaaaagcagaggaatactttgggcatcctgtttttttg

SEQ ID NO: 285 - DNA, 843 bp, Bacillus licheniformis
tttatcatcgcttccccgcattcctttagccgattggatcgatcagtttgttgactggctgacggtgtcgttcggcggtgtatttaacggaattgccagcggagtggaatcgtttgttgatgagattgtccaagggctgggttttgttccgccggttatgttgaccgttatttttgccgcgctcgtctggctgatcagcaaaagaggcattgcgctgtttactttaatcggattttttatcattgattatttaggatattgggacgccatgctccagacattggcgcttgtcgtcacatccgttctgatttctgtcattatcggcattccggtcggaatctggggctcccaaaagaaaacggttcggagagtcgttacgcccatccttgacttaatgcagacaatgccggcattcgtttatttacttccggccatcttctttttcaatatcggggttgtgccgggtgttgtcgcttccgttatctttgcgatgcctccgacaatccggatgacgatcttagggatccagcaggtgcctgaagatctgattgaagctacagaagcatttggttcaacgacaagccagcggctctttaaagtgcagctgccgctcgcgacgaaaaccattctggccggtatcaatcaaagcatcatgcttgctttgtcaatggtcgttattgcatcaatggtaggcgcgcccggactcggagaagaagtttaccgggctgtgacccagctgcaaacgggtaccggtgtagaaaccggacttgcgattgttattattgcgatcgtacttgaccgggttacacaaaatataaaattgaaaaagagcagggggaatgc

SEQ ID NO: 286 - DNA, 1959 bp, Bacillus licheniformis
ctgcccggctggaaatgatgagaagctactttaacgcgatagccgcgggaatggggcacgttattgaacggacgtcctttaccacatttgtaaaagaatcggctgatttcgctactgcgcttgcgacgccggaaggggagtttttcgtttatccgaaaacggtcggcgtcacgatttttttagggctttcattaaaacgggtcatcgaagaaagcggcccatttgaaccgggagatattatcctcacaaacgatccttatacaacggacggattggcgacccacttgcctgatattcatgtggtgaagccgattttcttggagggcgagataatcagttacgcgtggtgctttgtccattgcagcgatgtcggcggccttgtcccggcaagcatttcgccgaccgcgacagacatccatcaggaaggcctgagaataccgccggcaaggatttacaaaaaggggagagaaaatcgcgatatattgaaggttttgcgggcaaacagcagggttcccgacttaaatgaaggggatattcatgcgatggtggccgcggtcaatacggcggagaatcgattgacagaaatggtcggaaagtttggaaaagaagcggtccaacaaggaatggatgatttgctcgaacaagccgcgatgagagccggacgggtaatcagcaggattccggaaggttcatacagtttttcagattatcttgatgacgatatggtttctgacgttccgatccgcttggctgttacggcaaacgtctcgggaggggagatcacattggacttttcagactgtgatcctcaggtgaagaccgcatttaaccttgtcaccaatggaagcaaacattcatttctatatcagggcctgatcaactatatcataagtgaagacccgtatattccgattaacggggggctgacacggccgatccaagttatcgctccaaagggtacgctggttcatccggaatatcctgcggcggtcggcattcgtcattcgatcacgatgagactttataatgctgtactgggcgcattggcaaaggcgcttccgaaagccgtgcctgcagcaggcgccggtcagtcagcgattgtcgtactgtcggttcccgatgaatcaactggcagcaggaagatgtcggtggtcgaaccgatgggaggcggaggaggcggccagcatgacatggacggagcagatggaattgaccatgcctccggatttttgaaaaatacgccgattgaaagccttgaacagcacatcgacatccatgttcgccgctatgaattgatcaaaaatacagccggagccggttttcacaggggaggccatgcaatcgggctggagtttgaagcggcggcaccagaatcaattgtgaccgcaagagggatggagaggatgcgttttcatccgtgggggctcgccgggggaacggcaggagcgctcgggcgggtgcgcctttatcctgatcagcctcaggagaaaacgatgtcgaagatcgatgttctaaagctcaataaaggggatgttatcagcattcattcaccaggcggcggaggctggggaaatcccttccgccgggaagctgaatcgattttaggagaagttgaagcgggcttgctgagcccggaagcggcatatcatcaatacggcgttgctgtaaaagaaaacggcgctggctccttcattattgatctggaagaaacagctgaaatcagaaaaaagaaagcaggcgaacatcggaaacaatgggatttcggaatcgccagagaagaatacgaacggtgctggacagaagaagccagcagcacattggcccggcttctgcgacagcttccggctcatcaaaggtcacatgttaaacatttagtccatcgttatttctcaaaagaacataacggtccgatcagtaaaagcgaagttgcggccgctgtggaaaaactggctggaaaaa

SEQ ID NO: 287 - DNA, 917 bp, Bacillus licheniformis
atgactgaggctgacatgctgttttccgttacggttcccggaagcacggccaatcttggcccgggctttgattcagtcggcatggcgctgtcccgctatttaagactgtctgtttttcctcatgatgagtggcgttttgaagctgaaacagaagtcgtagcgggaatacctgaaggaacggacaatttaatttaccaggtggccaaacggaccgccgcacacttcggaaaagaacttccgccaagccttgtcaaagtgtggagcgatattccgcttgcgcgcggtctcggcagcagcgcagccgcaattgccgctgcggttgagctggcgaacgaacttgccgatttgaagctttcagaccgcgagaaacttcattttgcgagccttgaagaaggccatcctgacaatgccggagcatcgcttttcggcgggcttgtcatcggacttcatgaggaagatgaaacagagatggtttctatgaaagacatcgatttggatgtcgtcgtcgtcattcctttttatgaagtgctgacaaaagatgcgcgggatgttcttcccgaaagcctctcttatccgaaagccgtggaagcaagcgcggtcagcaatatgctcgtcgccggactgatggcgaaagattggaagcttgtcggccgcatgatgcaaaaagacctctttcaccagccataccgaagggcgctcgtccctgagctttcgaaagtggagcatgaagcaggccaaaacggcgcgttcgggacggctttaagcggagccggcccgacgatcctttcctttattgaaaaaggaaaaggagaggcgctgagaaaccagcttgcgtccaagtttccgcactgtgaggtcgactgcctttatgtcccggatacaggcattatcgttgaaagaaaatcagtaaacagtgt

SEQ ID NO: 288 - DNA, 864 bp, Bacillus licheniformis
aatcggagcgcatcccaatgaaatcgtttttacgagcgggggaaccgaagccgacaatatggcgattctcggaagcgcgctggcgagagagaagcagggccgccacatcatcacgacaaagatcgagcaccatgccgttctgcatacgtgcaacaggcttgaagaaatgggatttgacgtcacatatctagacgtcgacgaaagcggaagaatctccgccgagcaggtgaaagacgcactgcgagacgataccatcctggtgacggttatgtatgggaacaatgaagtgggaacgattcagccgatagatgagatcggcgatctgctaaaggaccatcccgcgctgtttcatacagatgcggttcaagccttcggttttttgccgattgatgtgcaaaaaagccgtatcgatatgatgtctgtctccggacataaacttaacgggccgaagggaacaggctttttatacgtcaacgaaaacgtgaagctcagccagcttcttttcggaggagagcaggaacgcaaacgccgggcgggaacggaaaatgtcccgggaatcgcggggctcggtgaagctgttttgctctcgggtcgggaaagagaagaaaaatcggatctttaccgccggtttaaagacatcatcacccgtacgctggaagcagaaggcgtctcattcgatgtgaacggcagcaggcggcacagtctgccgcatattttgaatctgtatttcccgggagtatctgttgaatcgctgctcgtcaatctcgatatggcgggaatcgcagtatcgagcggatcggcgtgcacggccgggtctgtgcttccgtctcatgttctctccgccatgtttggcgaagaagacga

SEQ ID NO: 289 - DNA, 846 bp, Bacillus licheniformis
atggacttggagtaaagaaagcgaggggattgacagtggctgaagaaaaaaaatcgaagaaactgccttcaagagaagaggtgaagcaagaagacacgtggagactggaggatatcttcccgtcagatgacgcttggaacgaggaatttcaagccgttaaagaactgctgcccaagctttccgaattcaagggcaagctcggccattccgccgatgatttatatgaagcgctgacttatcaggataaggtgatggagcgtctcgggaagctgtatacttacgctcatatgcgctatgatcaggatacgggaaattctttttaccaaggtctcaatgataaagcggcgaacctctatactcaggctgcgagcgccacggcctacatggtgccggaaatattatcgattcaggaagaaaagcttcagcagttcctgttggaaaaagaggaattaaagctttactcacacgctctcgaagaaatcaataaagagcgccctcatgtgcttagcgaggaagaggaagggattttggccgaagcgtctgatgttctttcatctccttccaatacattcggcatgctgaataacgccgatatggaatttccggagatcaccgatgaaaacggagaaaaggtgcagctcacacacggcaattatatcacctttttggaaagcgagaaccgcgatgtccgccgcgcggcattcaaggccgtttatgaaacatacggccgctttaaaaacacgctagcttccacgctcagcggagctgtgaaaaaagacaacttttatgcgaaggttaaacattataaatcggcgcgggaagctgccttgtcgcgcaacagcattc

SEQ ID NO: 290 - DNA, 924 bp, Bacillus licheniformis
acagctgtgagtattatttggaacacggggaaatgatgcctgatgacggcttggagcagctgaaagagttcgacagcatctttcttggggctgtaggaaacagcaagcttgtccccgaccatatttccctgtgggggctgctcattaaaatccgccgcgaatttgaacaggtcatcaacattagacctgcgaaatatttgcaaggaatcaagtctccgctggccaacccaaaagatttcgatctgcttgtcgtcagggaaaacagtgaaggggaatacagctcgatcggaggcagaatcttcagggatgaagatgaaatcgccattcaaaatgccgttttttcaagaaaaggggcggagagggcgatgcgctttgcttttgagttggcggctaagcggaaaaagcatgtcacaagcgcaacaaagtcgaacggaatcgtttattcaatgcctttttgggatgaagtctttgagaacacggcaaaagactaccccgatattaccgcagattcgcagcacattgacgcgctgtcggccttttttgtaacgaggccagagaagcttgacgtcattgttgccagcaatttattcggcgatattttgaccgatatcggggcggcgattatgggaagcataggtgtggcgccggccgccaacattaatgtaaacggcaaatatccatctatgtttgagcctgtgcacggctctgctccggacatcatcggaaaaggaatcgccaatccgatcggccaaatttggacggcaaaaatgatgctcgatcatttcggggaagaagaactcggtgcaagattgcttgacgtgattgaagacgttctaaagagcggctacttaacgcctgatatcggcggttcaagtacgacggatgatgtgacagaagaaatcatcaagcgcgtgaggaccatat

SEQ ID NO: 291 - DNA, 807 bp, Bacillus licheniformis
tggccagcatacaggatacgaatattcccggacgggaaatccgacgagaacggcgctcgaatccttgatcgcggatgttgaaggcggtgcagcaggctatgcgttcggctctgggatggcggcgatcacagccgtcatgatgctttttaaaagcggcgatcacatcgtattgacagatgatgtatacggcggcacctaccgcgtgatgacaaaggtattgaatcgcatcggcattgaagcgaccttcagtgatacgagcagcatcgaagacatcgaaaaagcgatcaagccgaatacaaaagcgatttatgttgagacgccgacaaatcctttattgaaaatcactgacatcaagaaaactgctgaaacagcgaaaaagcacgacttattgctgattgtcgacaacaccttctacacgccgtactttcaaaatccaatctcgttgggagccgatatcgtcctccacagcgcgacgaagtacttgggcggacacagcgatgtcgtcggcggacttgtcgtagcagcctcgaaggaactcgcagaagagatccatttcattcaaaactctacaggcgggattctcgggcctcaggattcctggctcttaatgagggggatgaaaacccttggcttgagaatggaagcccatgagcaaaatgcccggaaaatcgcggcgtttttagacgatcatcccgccgtcaaaaaggtttattacccagggctgccgtcccatccgggacatgagcttgccaagcggcaaagtacgggcttcggaggcatgatctcgtttgatatcggaaaagaaga

SEQ ID NO: 292 - DNA, 764 bp, Bacillus licheniformis
ttgaatctagctaaaagagtatcagcgttaacaccatctgcaacattggcaatcactgcaaaagcaaaagaattaaaagcggcagggcacgacgtcatcggtcttggggcaggtgagccggattttaatacgcctgagcacatcattgaagcggctgtccgttcgatgaacgaaggacataccaaatacacgccttccggcggtcttgcggcgctgaaagacagcatccgcgataaattcaagcgcgatcagggaattgaatacagccaatcggaagttattgtgtgcacaggtgcaaagcatgctctttacaccctatttcaagtgctcctcgacgaaggggacgaagtgattattccgactccgtactgggtcagctatcctgaacaagtcaagcttgcaggcggcaaacctgtgtttgtggaaggccttgaggaaaacagcttcaagatttctccggagcagctcgaaaaagccgtcacagaaaaaacgaaggctgtgatcatcaattccccaagcaatccgacagggatgatgtatacggaagaagagctcaaagctctcggtgaagtatgccttcgacgcaacgttttaatcgtatctgatgaaatatatgaaaagctgatttacggcggaaaaaaacatgtatccattgcacagctttctccagaacttaaaaaccaaaccgtgatcatcaacggggtttccaagtcacacagcatgaccggctggagaatcggttatgcagcaggcagcgaaccgat

SEQ ID NO: 293 - DNA, 813 bp, Bacillus licheniformis
atgtctgttgatatggaggggatttccgggcttccggatgatacgttcgtcgattcaagcaagccgaactatgagagaggccggaagatcatgacggacgaggccaatcatgtgattgacgaagcgttcaaaaatggatgcagagaggtgattgttaatgacagccactctaaaatgaacaacctgttaattgagaggctccatcctgaagcgcggcttatttcgggagatgtcaagccgttttcgatggttcaggggcttgatgatacatacgacggagccgtgttcgtcggctaccatgcgagagcgtcgatgagaggcgtgatgtcgcacagcatgattttcggcgtcagacatttttacatcaacgatcaggcggtcggcgagctggggttcaacgcctatgttgccggttattacggcgtcccggtcatcatggctgccggtgacagcgaggcggcagctgaggcggaggagctgattccgaacgtaacgacagcagccgtcaaagaaacggtctcccgttcggcggtcaaatgtctgacgccggagaaagcggggcggctattaagagaacggatggcatatgcgattcaaaaccgcggtcaagtcaagccgctcacacctccggacaggccggtgctgcggatagaatttgccaattacggccaagccgagtgggccagtctgatgccgggtgctgaaatcgaaccgcaaacgacgactgtccgctatcaagcgaaagacattcttgaagcctatcaagcgatgcttgtcatgaccgagcttgcgatgagaacgacattctcctag

SEQ ID NO: 294 - DNA, 804 bp, Bacillus licheniformis
agagcctccggtcgattcaaaactgatcgatcatccgcttgtagtgaggactcctcacttgggcgcctcaacaaaagaagcccagctgaatgtcgctgcacaagtgtccgaagaagtccttcagtatgcgcaaggaaaccctgtgatgtccgcgatcaaccttccggccatgacaaaggattcattcgaaaaaatccagccttatcatcagtttgccaatacgatcggaaaccttgtgtctcagtgcatgaatgagcctgttcaagatgtagccatccaatatgaaggctccatcgccaaacttgaaacgtcatttattacgaaaagccttttggccggatttctgaagccgagggtcgcggctaccgttaacgaagtgaatgccggcaccgttgcgaaagagcgcggcatcagcttcagcgaaaaaatttcttccaatgagtcaggctatgaaaactgcatctctgtgactgtcacgggagatgtaacaacattctctttaagagcgacgtacattccgcacttcggcggacgcatcgttgccttaaacggctttgatattgatttttatccggctggacaccttgtctacattcaccaccaggataaaccaggggctatcggccatgtcggacgaattttaggagaccatgacatcaatatcgccactatgcaggtaggccgaaaagaaaaaggcggagaagcgatcatgatgctttcctttgaccgccaccttgaggacgatattttagctgagctgaaaaacatcccggatatcgtgtctgttaaagccatcgaccttcc

SEQ ID NO: 295 - DNA, 744 bp, Bacillus licheniformis
atgcttgcgatcaaagggctgaataaatccttcggcgaaaatgaaatcttaaaaaaaatcgatctgaacatcgaaaaaggaaaagtgatcgccattttagggccttccggttccggcaaaacgacgctgcttcgctgcctgaacgctttggaaattccaaaccgcggcattctttcttttgacgatttcaccatcgatttttccaagaaaaataaacctgctgacctcctccgcctgcggagaaagtcgggaatggtattccaggcctatcacctgttcccgcaccgcaccgtgctcgaaaatgtgatggaagggcctgtaaaagtgcaaaagcgcaataaagaagaggtcaaaaaggaagccgttcagcttctgcaaaaggtcggccttgaagacaaaatggatctctatccattccagctttccgggggacagcagcagcgcgtcgggatcgcccgcgccctggccatcaagcctgagctgatgctttttgacgagcccacatcggctctggaccccgagctggtcggcgaagtgctgaaagtcatgaaagaccttgcaaatgagggctggacgatggttgtcgtcacccacgaaatcaaattcgcgcaggatgtcgcagacgaagtcgtctttatcgacggcggcgtcatcgtcgaacagggcccgcctgaacaaattttctcagcccctaaggaagaacgaacaaaacagtttttaaaccggattttgaatcctgtataa

SEQ ID NO: 296 - DNA, 895 bp, Bacillus licheniformis
atggacgtaccgaagaacattttcattaaagaagtcgggccgcgcgacggtctgcaaaatgaacaaaccgcactttcgacagctgataaaattacctggatcgacatgctttctgccacagggctttcgtatatcgaaatcacttcattcgtccatcctaagtggattcctgcactgtctgatgcccttgatgtcgccaaagggatcaaccggaagccgggcgtcacctacgcagccctgattccgaaccgaaaagggctggaacgggctctcgaaggagggatcgatgaagcttctgttttcatgtcggcaagcgagacacacaaccggaaaaatattaacaaatcgatcggggaaacgcttcccgtcctgaaggaagtcatcggagcggcaaaacaagcgggcctcaccgccagagcatacctgtccacagtatttggctgtccttatgaacatcacgtgccattggaacaaattatacggacatctgaaacgctgttcgacatggggatcaacgaactttccctcggagatacgatcggcgcagcaaatcccgtacaggttcaaagggtgcttgaagtcctcttaaagcgctttccaaaagagaatatcgcccttcattttcatgatacgagagggatggcgctcgccaacatgatcgcagcgatggacatgggaatcaccgtatttgactcatcatgcggcgggctgggcggctgtccttacgcaccgggagccacggggaatgcggcaactgatgatttgatctacatgtgcgcccagatgggcatcgaaaccggagttgatctcagcaagctgctttcagctgctaaatggatcgaagacaaaaccggaagagagctgccaagccgaaatttgcaggcggctaaatcaa

SEQ ID NO: 297 - DNA, 1218 bp, Bacillus licheniformis
gatcaacctttgaaacgttggataagaaattcacaagttttggcggtttagaacaagggggtattacgcgtctgttatactctcctgaatggattgctgcagttcgcgaactggaagcgacattcaaggaagaaggtttagaagtaagctttgatgatgttggaaacttatctggtcgccttgttggaagtaagcatcctgaagaaactattttaacaggatcacatatcgatacagttgtagaaggcggtcatctggatggacaattcggtatcttatctgcattggttgctgtgaaatatttaaaagaaaaacatggtcaaccattacgaacaatagaagtactatctctcgcagaagaagaaggaagccgattcccatatacattttggggaagtaaaaacttctttaacttagccaaaaaatcggatgttgaaacaatagaagatgctgatggaattaaatttgaagatgcaatgcacgaatcgggttttgattaccgtaaaacagatcatgttcgtgacgatattaaagcatttgttgaagtacatatcgaacaagggaaagtattagaggcggaaaataaagcgataggtgttgtaactgggattgttggccaaaaacgttacacaattaacttgaaaggtgaagcaaatcacgctggcacgacaccgatgtcattacgaagggatacagttgttgcatatagtgaaattgtaacagacttaacgaaacgagctagagaaattggggagcctcttgtattaacgtttggacatgtcactcctgttccaaacacggtaaatgtcgtccctggagaaattactttttcgatagactgtcgtcatattgatcaacaactattaaataattttgcgaaagaaattgaagataaagttaaagcggttgcagaagcaaacaacatgacttatgacattaatttatggatggatgaagcaccgtcattgatggataaagaaatcattaaaataattgaacaagcagctaaggccaatgtgggggacagctataaattgatgccatctggtgcaggtcatgatgcgcaaatttttgcggattttgtcccaacagcaatgctgtttgtaccttctattggcggaattagccacaataccaatgaagaaacgaagatagaagaccttgtgaaggggattgaagtattgaaagatgtattgtttgaactagcttataaggaat

SEQ ID NO: 298 - DNA, 1085 bp, Bacillus licheniformis
ttgcaaattaaagaacagttaaaacaattaacgccttaccagccgggcaaaccgattgaagaggtcaaaaaagagttcaacctcgaccgggtcgtcaagctcgcttcaaatgagaatccttacggctgttcagaagcggcaaaggaagccctccagattgaggtgcagcaaatggctctctatcctgacggctatagtgcggcattgagaacaaagcttgcctcccatctcggcgtaaatgaaacgaacatcatcctgggaaacggaacggacgaagtcattcaaattatttcccgttctttgttggaccctgcctcaaacactgtaatggcgaatccgacattttcacaatacaagcacaacgctgtcatcgaaggagcggaagtcagagaagtcggcctgctcgaaaacggctgccacgaccttgatgcaatgctgaaggcgatcgatgaacagacgaaggttgtctgggtttgcagcccgaacaatccgaccggaacgtatgaatccggccgcaacttgatccgtttccttgaaaaagtgccggaacatgtccttgctgtcgttgatgaagcttattacgaatacgtaacggctgaagactaccccgagaccatcccgcttctggagcgctttccgaacctgatgattctcaggacgttctcaaaagcctacggtttggcgtctttaagggtgggctacgggattgcttctgaacagctgattcaggcgattgagccggcgagacagccgtttaatacaaaccggctcggccaggcggccgcgcttgccgccctcggcgatcaggcatttatccacgactgtgtgagaaaaaacaatgaagggctcaaacagtactacgatttctgtgatgagcacgggctaaattactatccttcacaaacgaactttgtgctgattgattttaaacgggatgcagacgaacttttctcagagctgctgaaaaaaggctatatcgtcagatccgggaatgcgctcggctttccgacgttccttagaatatcggtcggtacgaaggaacagaacgaaggctttttgaaaacgttagccggcatgttgtaaga

SEQ ID NO: 299 - DNA, 1161 bp, Bacillus licheniformis
aatcaagataaaagtagaaaaagtgtccaaagtgtttggaaagaatacaaagaaagcaacgcagctgcttgccgatggcaaaaccaaaaaagaaattctgaaagaaaccggggcgaccgtcggggtgaaccaagcagattttagcgtgtatgaaggtgagatatttgtcatcatgggtctatcagggagcggtaaatcaaccttggtgcggcttttaaaccgtttgattgaaccgactgcaggacatgtgcacatagatggtgacatgataacaaatatgtccaaagaccagcttcgggaaatccgccgaaaaaaaatcagcatggtctttcaaaaattcgctctgtttccgcacaaaacaattcttgaaaacacagagtacggattggaactgcaaaaagtggataaaagaaaacgccggctaaaagctatggaatcattaaagcttgtcgggcttgaagggtatgaacagcaatatccggatcagctgagcggcgggatgcagcagcgcgtcgggcttgcccgcgcattgacgaacgatccggacattctgctgatggacgaagcgttcagcgcgcttgaccccctgattcgcaaggatatgcaggatgaactcctcgatttgcatgaatcagtaggaaaaacgattattttcatcacccatgatcttgatgaagcgctgagaatcggcgatcgaatcgcattgatgaaagacggaaacatcgttcaaatcggtacgccggaagagatcttaatgaacccgtcgaacgaatatgttgaaaaattcgttgaagatgtcgacttatctaaagtgctgacggccggccacattatgaaacgggctgaaaccgtgcgcgtagacaaagggccgcgcgttgcactgacgctgatgaaaaacctggggatctcctcgatttatgctgttgacaaacacaataggctcctcggctccgtcgatgctgaaacagcgaagaaagcagccgaaaaaagccagacgctggagagcgtcatctcaagagaaatcacaaccgtagaagagaatgttgtcctgacggatatctttgaattggtctctgatgccagcattccgattgctgtcgtcgatgaaaaacagcggatgaaagggatcatcgtcaaaggcgcattaatcggagcgcttgc

SEQ ID NO: 300 - DNA, 1446 bp, Bacillus licheniformis
aaactttgattccctgtttatgcacaacggggaacaggggatcaaagcataccgtgacgcggtagagaccgctgtagagacgctttgggccgattggaagaataaatcgaagccctacagcgggaagatgccgaaagaattggatctcgaaatcaaaagcttgttttcgtttcaggaagcgggagaatcgcttgcggatgttcttgagcatctgaaagaagcctatttgccgcaccggattcatgttgaagatccaaaatgcgccgcacacctgcactgtccgccgctgatcccggcgcttgctgcagagatgctgatcagcgtgctgaatcagtcgatggattcgtttgatcaaagcggagcggcttcattgatcgaggaagaaatggtgcagtggctttgccgaaagtttgaatacggaaaagatgctgacggaacatttacgagcggagggacacagtctaattacatggggcttcttttggcccgcgatgccttctgcgaaaagcagtggaactggaatgtacagaaggacggactgccgccggaagcgaacaggctgcggatcctctgttcaaaggatgctcattttaccgtgaaaaagtcggcttcccagctcggcctcggagagcgcgccgtcgtgcttgtcgataccgatgctgaaaagcggatgagcctttacgatttaaagcaaaaaaccgctatgctgaaggaatcgggcttacatccatttgcgattgtcgcaacatgcggaacgacggacttcggaagcatcgatccgctttccgagcttgcggatgccgcgcatgctggcgggctttggttccacgttgatgccgcatatggcggagcgttgattttgagcaggacccgccgctataaattggctgggatcgacagggccgattcaatcagcgtcgacttccacaagcagttttatcagccggtcagctgcggcgcttttcttgtaaaagacagaagacatttccgcttgattgattatcatgccgattatttaaatcctgaggaggatgaagcggagggaatcgttcatctcgtcaataaatcgattcagacgacgcggcgctttgacgccttaaagctgtttgtctcgctgcgtgtgcttggagaagatacattcgccgagatgatcgactggacattcgcattggctgaagcggcagcggaaaaaatctcagcaagcgatcggttcgaactgctgaatccgcaccctgaactgaacgctgtcgtcttccgctgcctcgcctcagaagacgacgcggagaacgaccgtttgaataaatgtatccacagagaattgttcagaacgggacaggcggtgatcgcaaagacggcagcagctgggaaaacatatttaaaattcacgctgctgaatccgcggacgacgctttcggatcttgatgacattctcgggaggattcaaga

SEQ ID NO: 301 - DNA, 1017 bp, Bacillus licheniformis
atgaacgaactgctgaaatcatgcgttaacggacggacactgaatgaaatcgaggcacacagcatcatgcgcgacatgatgaccggctcgctgagcgctgcggaaatcggaggcctcctgtccgttctcgcctacaggggagaaacggctgaagagattacgggatttgtcagagccatgcgggagcaggcgcatacaatagacggaccggaacatgttgttgatacgtgcggaaccggaggagacggaagctccaccttcaacatttccacagcggctgcgatcatcgcttcatcagccggggcaaaaatcgcaaaacacggtaatcgatccgtttcttcaaaaagcgggagcgctgacgttctcgaatatctcggcgtttctattcagacgtcgcctgaagaaacgattaagagcattgaacgccgaaatatgggattcctgtatgcgccaagctatcactcttccatgaagcacgtggcaggcgcgaggaaggatctggcttttagaaccgtattcaatctgctcggcccgctcagcaacccgatgaaggccaaacgccaggtgatcggcgtctactcgatcgaaaaagcaaagcttatggcccgcgctcttgaagcgtttgaaccggagcacgtattgtttgtttcgagccgggacggtcttgatgaactgtcgatcacatcgccgacagatgtaattgaactgaaaggcggcaaaacatacgaatacaccgtcgagccgggcgatgttggactgcctctcggaaggctgagagacattcaggtggcgacgcctgaagaaagcggccgtctgatcgtcgatattttgaaaaaccgcggtccggactcggctgttcatatcgcagcgtttaatgccggagccgctttatacgtcgcagaacaggcagcggatttaaaagagggcgttgcgctcgctttagaagctgttgctggcggtgaagcgctcaatcagctggagcgattaaaacagaaagaggaagagttgtatgcttaa

SEQ ID NO: 302 - DNA, 757 bp, Bacillus licheniformis
gtgatcacaaaacgaatcatcccgtgtttggacgtaaaagatggacgcgttgtcaaaggtgtacaatttgttgaattgaaagatgccggcgacccggttgaactggctgaagtatatgatcatgaaggcgcagatgagcttgtttttctcgatatctcggcttcccacgaggggagaaaaacgatggttgatgtcgttgaaagagtggcggccaagctggcgatcccgtttaccgtcggcggcggcatcaatcgtttggatgatatgaaaacgatactgcgggccggagccgacaaagtttccgtcaatacggctgccgttctccggccggaactgataacggaaggcgccgactttttcggctctcaatgcattgtcgtcgcgattgatgcaaaatacgatccagaagctgatctgtactatgtttatacacacggcggtcggaaaaaaacgaaccttgaggccgtttcctgggcgaaggaagccgttcggcggggagcaggtgaaatcctgctgacaagcatggattcagacggagaaaagaacggatttgactgcaggctgacaaagcttgtgtcagaagccgtttcagtcccggtcattgcatccggaggcgcagggcgtgcggaccacatgtatgatgcgtttgcagaaggccgggcggacgcggctcttgccgcatctatctttcattacaaagaaacatctgtaaaagaagtaaaagcttatttaaaagagcgcggggtgaatgtaagat

SEQ ID NO: 303 - DNA, 1130 bp, Bacillus licheniformis
gtgagtcacttatttcaaacgtacagccgctggaatatcaatattaaaaaagcgaaaggcacgatcgtccaggatgagaaggggaacgcctatctcgatttcgtccagggaatcgcggtctgcaatctcgggcattgccccgattcagtaacggctgctctcaaaaaacagcttgacgatgtctggcatgtttccaatttgtttcaaaatgagcttcaagaaaaggttgcacagctccttgccaaaaacagtgcaggcgatctcgtcttcttttgcaacagcggggcggaagcgaatgaaggggcggtgaagcttgcgcgaaaacatacgaaaaaaacaaaaatcgtaacctttcagcaatcgttccacgggcgcacgtatgcgggaatggctgcaaccggacaggaaaagatcaagcacggattcggaccgatgcttgaaggattccattacctcccttacaacgagccgaaagcatttgccgaattgcaggacgaaaaagatatcgcggcggtcatgctggagccgattcaaggcgaaggcggcgtcatcccggcgagcagagaatttctgcagagcgttcaagacttttgccgagataagcaggctctccttatcattgatgaagttcaaaccggaatcggccgcaccggtaaagcattcggatatgaacacgaagggctgtcacccgatatcgtcaccgttgcgaaagggctgggcagcggttttccggtcggagcggtcatcggcaaaaaagagctctcagaagcgttttcgccgggctcccacggcacgacattcggagggaacatgcttgcgatggctgcggcaaatgccacgttggagaccatttttgacagaagctttcttgaagaagtgagcgccaaaggagcatttttgcatcaacagctgaaagataagctccaatttccgcttgtgaaagatatccgcgggaaagggctgatcgccggaatcgagtgcaaagaacccgtgcagccgctgatcgaagcgcttcaaaaagaaggcctgctcgttcttcctgcgggtccgaacgtcatcaggcttctgccgccgttgacggttgcgaaaagcgaaatcaaagcggccgtggagaagctgaaagatgtcat

SEQ ID NO: 304 - DNA, 727 bp, Bacillus licheniformis
atgaatgctaaagatattcgcgaacagtttccgattctcagccaacaggtcaacggacacgatctcgtttatttggacagcgcggccacctcgcaaaagccgcgcgtcgtcattgagacgcttgatgagtattacaactcttacaattccaatgtccatcgcggcgtccatacattaggaacaaaagcaacggatggatatgaaggagcacgtgagaaggtcaggaagtttataaacgcgaaatcgatgcaggaaattattttcacaaggggtacgacaacggccctgaacacggttgcgctcagctatgcccgcgcaaaccttaagcccggtgatgaaatcgtcattacaccgatggagcaccatgcgaatattattccgtggcagcaggctgtcaaagcaaccggcgccacgctgaagtacattccgcttcaggaagacggcaccatttccttggacgatgtcagggaaacggtgacggaaaatacaaaaatcgtctctgcagcgcatgtttcaaacgttctcggtacgatcaacccgattaaggaaatggccaaaatcgcccacgaacacggcgcggtcatggtcgtagacggtgcgcaaagcacgccgcacatgaaaattgacgtccaggatttggactgcgatttctatacgttttcagcccacaaaatgtgtggtccgaccggaatcggggtattgtaggaaaaaaagcattgcttgaaaa

SEQ ID NO: 305 - DNA, 1107 bp, Bacillus licheniformis
tgcgaagatggcgtgccggatgattttcgtttttagccgagattgaagcgaagtgatcgccgcgggagcggatgtcgtcaatctgccggatacggtcggttatttagcgcctgccgagtacggaaatatcttccgctatattaaagaaaatgcccgcaatgccgacaaagtccagctttcagcccattgccacgatgacttgggcatggctgtcgccaactctttggctgcgattgaaaacggagcggatcaagtcgaatcggtcatcaacggcataggcgaaagagcggggaacgcctcgcttgaagaaatcgccgtcgccctccatatccgaaaagatttctaccaggcggaatcaacgattcagctgaatgagattaaacggacaagtgatttagtgagcaagctgaccggcatggccgtgccgcggaacaaagcggttgtcggcgataatgcctttgcccacgaatcaggcattcaccaggacggcttcttaaaagaaaaaacaacatatgaaattatttctccggaacttgtcggcgtgaaaacggatgcgcttgtgctcggaaagcattcagggcgccacgcatttaaagataagctgcaaaacctcggattccagcttggagaagaagaaatcaataaattcttcaacatttttaaagagcttaccggaaagaaaaaggaatttacggatgaagatctcatctcgctgatactcgaagagaaaacggcagaccgcaaaatcggctatgattttatttcactgcaggttcattacggcacctcccaggttccgacagcaacagtctcccttaaagatcaggaaacggatcaggtcatccaggaagcggcgaccggagcgggaagcgttgaagcggtgtacaacacgctgaagcgctgtatggataaagaagtccagctccttgattaccggattcaatccaaccgcaagggacaggatgcattcgcgcaagtatacgtcagggtgatgatcgatggaaaagaatcgggaggacgcggggttgcccaggatgttctcgaagcatctgccaaagcctacttgaatgctgtgaaccgctatctcgtattgaagacgaatacgga

SEQ ID NO: 306 - DNA, 807 bp, Bacillus licheniformis
atgaagaaagcaatattcgctgtattattgacgctgttgatcaccgtgatggccgcatgcggcgcgtcaggggacaattccaaggataaaaacgcagccggcgacagcctctggtcttcaattaaagataaaggcgtattgacagtcggtactgaaggaacgtacgaaccttttacattccacgataaaaaaacagataaattaacaggttatgatgtcggagagatgcaagaagtcgccaagcgcctcaacctgaaagctgaatttaaagaaacgcagtgggacagcatgtttgccggactcaactcaaagcgttttgacgtcgttgccaaccaagtcgggaaaaaagaccgtgaagatcagtacgatttttctgattcatatacaacttcccaagccgtcgttgtcacaaaagcggacaacaacgatgtaaagtctgaaggagatgtcaaagggaaaaaagccgcgcagtctttgacaagcaactataatgaccttgcgaaaaacgccggcgctgaaatcgaaggcgtagaaggaatggctcaagcgtttcagctgattcagcagggccgtgtcgacctcacctataacgataaactggcggtgctgaactatttgaagacgtcaggaaacaaaaacctgaaaatcgcttttgaaacaggcgagccgcaaactacgcattttgctttccgcaaaggaagcggcgaactggttgacaaggtcaactccgcgctgaaggacatgaaagaggatggcacactcgcgaaaatagcgaagaaatggtttggcgaagatgtttctaagtaa

SEQ ID NO: 307 - DNA, 871 bp, Bacillus licheniformis
atgtttcgaaatgtgaaagaattaattcaactgacaaaggaaaagaacgtgtccatctctgaaatcatgatcacacaggagatcgaggtgacaggccggacgcgggaagatatattcaagcagatggaagccaacttggctgtcatggaagacgctgttcaaaaaggcattgagggcgtcgtatcgcactccggattgacgggcggagacgccgttaagcttcaggcctaccttaaatcgggcaaagggctgtcaggggatgtcatccttgacgctgtcagcaaagcggtagcgacaaatgaagtcaacgctgcgatgggaacgatttgcgcaacgccgacagccggatcggccggcgttgtcccggggacgctctttgcggtaaaagagaaacttcacccgacgaaagagcagatggtccgctttttatttacatcgggagcgttcggattcgtcgttgccaacaatgcgagcatttcgggagccgccggaggctgtcaggctgaagtcggatcggcctcgggcatggcggctgccgccatcgtcgaaatggcgggcggaacccctgaacagtgcgccgaagcgatggccatcgctttaaaaaacgtactcggtctagtctgcgatcctgtcgcagggctcgttgaggtgccgtgtgtgaagcggaacgcgatgggcgcagccaatgcgatggtcgcggctgatatggcgcttgccggcattacaagccgcattccatgcgatgaagtgatcgatgcgatgtacaaaatcggacagacgatgccgacggcactgagggaaacaggccggggcggtcttgccgcaacaccgacgggcaaagaattggagaaaaaaatattcggaggagcgt

SEQ ID NO: 308 - DNA, 1218 bp, Bacillus licheniformis
gtacagcccgcaatatcgaagacatgatcaattggctggcatcattcggtgaaagcggagaaggaggggtgacaaggcttctctattcaaagccgtggctcagcgcccagcagtcgttgaaggaaaagatggaggactggggaatagagccgtacttcgatgatgccggaaatctgtttgggagaatagaaggtacagagaaccgtacgaaagcgatcttgaccggttcacacattgatacggtcatcaacggagggaaattcgacggagcgtacgggattttagcgagccttttgtctgccaaacaccttctggacacgtacggcaggccgaaaacgtcaatcgaagtcgtgtctctgtgcgaggaagagggaagccgtttccctttgactttttggggatcggggaatttaacgggcttgtttgactgtcaaaagacgccggctgtgcacgatcgggacggagtatcgattgagcaggcgatgaaagattgcggtttcggaaaacggcggtacaggcgcccgttcaggcgtgatgtgaagtgctttatcgagcttcatattgaacaggggagcattcttgaggagagcggccgtcaaatcggcattgtcacggacatcgtcggacaaagacggtttacggttatggtcaagggagaaagcaaccatgccgggacgacgccgatgaacgccagaaaagatgcggtggccgtctcggcattgtgcatttcctatttgacgaacaaggctaaagctgcttatccgcttttaacagcaacggtcgggaggattgaagcaaagccgaatgtgccgaatgtcatatcaggagaagctgttttttctcttgatctccgccatcatcatgatgcggtgttggaccggtattgcgacgatatttttgcttatttcacagagctggccggcgaatggaacgttcagatcacagttgaacagacgacggatgcgaagcctgtgaggatggaccgggatttgattcaactctcaaaacagtcggccgaggatcttgacgtatcctatcaggagatggtcagcggggcggggcacgatgcccaggttttcggcccgcattgcccgacgtcactgctgttcgttccgagccggaagggcatcagccattcgccggaagaatggacaaaaccggctgatcttgcagccggcgttgagctcttgactcatgtattatacaggctggcatatg

SEQ ID NO: 309 - DNA, 858 bp, Bacillus licheniformis
attgcatacgtataagcgcattacattgttgataactgtgttggcgcttgctcttataacagctgcatgcagcacagctcaaaataaggctgaaaacaaaaaaacggcctgggatgagataaaggaaaaagggaagatcgtggtagcgacttcaggaaccctttaccccacttcatatcatgacactgattccggcaaggacaagctgaccggctacgaagttgaagtcatccgtgaagcggctgaacggctcgacctggatgtcgaatttaaagaaatgggctttgacggcatgctgactgcggtggggagcggacaagtagacgctgccgccaacgatattacgatgacagacgaccgcaaagaaaagtttttgttctctacgccttataaatattcattcggaacggctatcgtccgcaaaaaagacttatcaggcatccacacgcttgaggacttaaaaggaaagaaagccgctggtgcagctacgacagtttacatggatatcgcacgcaaatacggagcagaggaagtcatttacgacaacgcgacaaatgatcaatttttaaaggatgtagcgaatggaagaaccgacgtcatcttaaacgactactaccttcaaaagctcgcgctcgccgcaatgcctgatctggatctgacaattcatcccgatcttaaatactatccgcatcagcaaggcatgatcatgaaaaaaggaaacactgaacttaaaaaacaattcgacaaaacgattgatgaaatgctgaaggacggcacaatcaaaaagatttcgaaaaagtttttcggcggtgccgatgtttcgaaaaagcaggatatcgactatatcgatgtcgatgt

SEQ ID NO: 310 - DNA, 711 bp, Bacillus licheniformis
cccatgcaatatcaatcgcttaaatccgcgttctccgcccgggggaagaacttctttacatcactggcaaaccgtacgataccctcgaagagatcgtcggcgtcaggggcgaggaaaactcggggtctttgaaggatttccagatcggatacagccatgtcgagctgacagaagagggagccgttgattttgaccgggtggcagcttccatcacgccgcagacaaaggtcgtcggaatccagcgctcaaaaggatacgcagaccgtccgtcttttacaattgatgagattgagaagatgattcgctttgttaaagaaataaacgaaaacatcatcgttttcgtcgacaactgctacggcgaatttgtagaagagcgtgagccgtgccatgttggagcggatctcatggcaggctcgcttattaaaaacccgggaggcggcctcgccaaaacaggcggctatatcaccggcaaggaaaaatgggtgaaagcctgctcctacagaatgacttcaccgggaattggcagtgaagccggtgcatcgttgtacacgctccaggagatgtatcagggctttttccttgcgccgcatgtcgtctcccaggcattaaaaggagcagtgttcacagcccgattcctcgaaaagctcggctttaggacgaatccttcatggggcagcaagcggaccgatttgagccagtttgtcgaatttt

SEQ ID NO: 311 - DNA, 912 bp, Bacillus licheniformis
aatatacgaaaacacggcgtctaaggaaatcaaagaaggcgaccggccaaaagtgctgacaagaagcggacatcaaatcttcagcgattatgtcacgtgctgcacgcactttccatttcatgataaaaaaggattctattttgcaaggcttgagccgagccggtcatacgtgctcgccgtcaagccgaaaacgccgtatccaggcggcatgtacttaagtatagaccagccttcacgctcgcttcgctcggtgacgatcgacggagaaaaaatggttcttgtcggcggtgaaagccacaaaaccggccagggagaagatacaatcaagcattatcaggcgcttgaatcatttgcggaaggcgtgctcggcatcgaatcgatcccttaccgctggtcagcgcaagatttaatcacgcttgacaaaattccgtatatcgggccgatctatccgaaagaaaagcgcattctcgtcgccaccggatatcggaaatggggcatgacaacgagcaccctcgccgcgcagctgatgacagatcatatcgcgggtgaagacaatccttatcaagccgtctttcagccggcccgtttccacccggatccaagcatcaaaaaagcgatttcctacaacgcggatgttgcaaaacactttgccgaaggaaaactcgagcagccgatcaggaagccggaagaccttgtcaacggagaaggcgcggtcgtgtcgcatgccgggaaacgggcgggcgcttatcgcgatgaaaaaggcgagcttcatctggttgacacaacatgcacccatatgggctgtgaagtcgagtggaatgatggagaaaagacatgggactgtccgtgccacggctcaaggttttcgatcgacggcgatgtcattgagggccctgccgtagaacctcttaa

SEQ ID NO: 312 - DNA, 753 bp, Bacillus licheniformis
atatggcggcgacgagcgttcataagctcggaggatcccttacacaaagttcgattctcaatatgaaagaaggtctggtttcaaaggaaagggtgcaatcgattttaagcatgctgacgacgacatcgacctcctatctattgctcgcttcgcttgatgtcgccagaaaacgcttagccacagagggacacgaactgatcgaacaaacgattaagctcgccaacgaaacaagggaacgcatcaataatatcaacgggatttcatgcgtcgggagggaaatcctcggctccaaagcggcttttgactatgatccgaccaaattgatcatatctgtgaaagacctcggcctgaccggtcatgatgtggaaaaatggctgcgcgagtcatgccaaatcgaagtggagctttctgacttatacaacatcctgtgcatttttacaccgggagaccggaaagaggatgcagatgcgttaattaaaggattaaccgagattgctcaacaggccgcttcatctgcggaaaacagacgcaagcctgaagtgcttctgccaaacattccggcgcttgcgatgacaccgcgtgacgctttttacgcaaacacggagatcattccgttcaaaaaagcagctggcagaatgattgccgagtttgttatggtttatccgccagggataccgatcttcattccgggcgagatcattaccgaggataatatcaactacatcgaaaagaacctggaagctgggctgcctg

SEQ ID NO: 313 - DNA, 800 bp, Bacillus licheniformis
atgaagacacctttatatacagcattggtgaaccatgctgaaggacatcattattcttttcacgttccgggacatcacaatggagatgtcttttttgatgaagcaaaaactttttttgaaacgattctcaaagtggatctaactgaactgacaggactggatgatttacatgagccatctggcgtcatcaaggaagcacaggatttagtttcgcggctttacggagcggaagaaagcttttttctcgtcaatggttcgaccgttgggaatctggctatgatcctggctgtttgtcagccgggtgatacgatactcgttcagcgtaactgccataagtctgtatttcatgcgattgaactttcaggcgcccatccggtttttttgacaccggaaattgatgaggcgatggctgttcccacacatatactgtacgaaacagttgaagatgcaatttcacaatatccgcacgcaaaagggatcgtgttgacatatccaaattactacggccatgcagttgatctgaagccgataatagaaaaggcccaccaacacgatatttccgttttagtcgacgaggctcacggcgcccattttgtgctggaccatccatttccccagtcgtcgttgaaagcgggcgctgaagccgtcgtccagtccgcgcataaaacgctcccggcgatgacgatggggtcctatctgcatattaacagcggcaggatcaacagggacagactggcatacaatctgtccgtgcttcaaagcagcagtccttcctacccaattatggcatcttttgatat

SEQ ID NO: 314 - DNA, 669 bp, Bacillus licheniformis
ttggagggttttttacgctcgtccatgaattcggccattccgtgcacagctcctatacgagaaaatatcagccttacccgtacggtaactacagcattttcgtcgccgaagttgcttctacgacgaatgaagcgctgttgggcgaatacctgctgaatacaatcgccgatgaaaaacagcggctctatattttgactcatatgctcgaaggctttaaaggaacggttttcagacagacgatgtttgccgaatttgaacatgagatccatgtcaaagcccaggaaggggaaccgctgacacctgagctgttaacgagcatatactatgatttgaataagaaatatttcggagacaatattgagattgataaggaaatcggtcttgagtggtcaagaattccgcatttctattacaattattatgtatatcagtatgcgacaggcttcagtgcagctcaggcgctcagccagcagattttaaaagaaggcaaatcggctgttgaccgctatattgagttcttgaaagctggaagctcggattatccgattgaagtgctgaaaaaagccggcgtcgatatgacgtcttcagagccgatcgaagctgcgtgcaaaaagtttgaagagcagctgaatgaaatggaagaactcctgcaaaaagtcaatcattcat

SEQ ID NO: 315 - DNA, 611 bp, Bacillus licheniformis
atgaaacatttacctgcgcaagatgaacaagtttttagcgccattcaagatgagcggaaacgtcaacagtcgaagattgagctgatcgcttctgaaaactttgtaagcgaagcggttatggaagctcaaggctcggttttaactaataaatatgcggaaggatatcctggtaaacgctactacggcggttgtgagcatgtagacgtggcagaggatatcgcgcgcgaccgcgccaagcagattttcggcgccgagcacgtcaacgttcagccgcattccggcgcacaagcgaacatggcggtatacttcacgattttggagcacggtgacactgtgttgggaatgaaccttgctcacggcggacatttaacgcacggcagccctgtcaacttcagcggtgttcagtacaacttcgttgaatacggcgttgataaagagacgcagtatattgattacgaagatgtccgtgaaaaggcgctcaaacataagcctaagctgatcgtggccggagcaagcgcatatccgcgcaccatcgattttaaaaagttccgcgaaatcgctgatgaagtcggagcctatgtgatggtggacatggcgcatatcgccggact

SEQ ID NO: 316 - DNA, 693 bp, Bacillus licheniformis
cgctgacgccgaagacaatgtgttgttcttcctatccgtcgaatccgacgggaatgacgctgtccgaagaagagctgaaggacatcgcctcccttttaaaaggccgaaacgtctttgtgctctcagatgaaatatacagcgaactcacttttgacagaccgcaccactcgatcgcaactgtgctaagggaccagacgatcgtcatcggcgggctttccaaatcccacagcatgacgggctggagaatcgggtttttgttcgcaccgaaggaaatcgcaaagcatattttaaaagtccatcaatacaacgtatcttgcgcttcatcgatttctcaaaaagctgctctggaagccgtcaccaacgggtttgatgacgctctgatcatgcgcgagcagtataaaaaacggctggactacgtgtacgacagacttgtgacgatgggcctcgatgtgattaaaccgtcgggagcattctacattttcccgtccatcaaatcgtttggaatgtcttcctttgacttctgcatgtcgcttcttgaagaagaggggcttgcgatcgtgccgggcagctcgttttctgaatacggggaaggctatgtgaggatctcttacgcatattctcctgatacgctaagggaaggtcttgaccggctggagtcctttgttttcaataagaggcaatcgatacagacta

SEQ ID NO: 317 - DNA, 2001 bp, Bacillus licheniformis
atgaaaatatggtttggaatgcagggaaacaacaccgctttatggcaagagtgggtttccgccgtcaagaaatggggacgggcggaacggattcacagctacagctgcgggatcgcaaacatggctgaagcgcatatccgatacgatgaagcttttagaccttcaactcaaataaatcttttgcaccccgtcatcttagacggctggatcagcggcggtcttaacgcaaaatcggatggcacccgaaagatcgagcaatatgacaagctgtacgcatcattgaagcaggacaaagctgccatgctgtctcactcgcatggcgaatatacgatggtctggtgggatgacagtctgcatagccttgttttggcgactgatacatacgcaacccgtccggtttactactgggtcagtccgaaaggagaatggtatgcagcgaatgacatgcgcatccttttgcttgttcatgacattccttttgcgatcgatcaagatgtgtgcagaatgtttcctacttcgggctttgctgtaggagaaaacggctttgaagatcggacgttttttaaaggaatacgcaaagtgcctgcggcgtcctacgcttttctcggccgggatcaagcggttcacgtgcacagctattgggggcttccgcagctattaaacgagaaagatcttgctggagacgctgttccgaggttccgggagctttttcaggaagtgacagcagatcgtttaaaggatgaaaggcatattgtcgaattaagcggcggactggattcagctgccgtaaccgccgccgcagttgcaggcggacgcaaggaacagctgctggccgtcaatatatcatttgccgaacccgacatgatattaagccacgacagggaccttgtaaagaatatgatgcgagatatggatatccccggcctgatcattcttggagacgctacagccaaaattccaaacgcggaaattgggcgtgatccgctttggtttgtagacggtcctgatccgagagccaattcactggttaatgagacttttacagtgatcgctgaggagtatggtgcctcgtctgtccttacaggtgagggcggggatttcatttttagcggagaagtgtcagtgatcgattccttgcttcggcagagacggttttctgaaatctacaaattgcttcgcgaatggtcaggcggcagcatgaaagagatgctgaagctcggatttcaatacggaatcgcccctttcatgccttatattggagaaaagctctattacgacctgctgtggtcagatacggaatatgagctgcctgaatatttcactgaagaacaccgaaagagagaatgggagatcaataaagaggatcatctacgctatcgaaaaagccgggagctctcagtgtggggcaagaggtttcactatgactttttgtggccgagagcgaggtacatggatgctgttggtgtgacattgcatacgtaccatccatttttggaccggcggctgatcgagttctcattttctgtaccgcctgaacagcattttgatgttttaaaagggcttgaagaacattatgcaggctctaaaatgcttcttcgcaaatctttcaccgatatcctgcctgcctatgtttataacagatcaacgaaaacaacatatgcccatatggccaggaaaagctttatgaatgaccgcagacacgttcttcagttatttgagccgggagagcgcgtcttcgttgaagaactcggcatcattaagcgcgatatatggtggaaacacttgctggctatggctatccgctctgaagatccaaataatgatctgggcatgggctatcagtacatgagatctgttattgacttggaaatatggctaagagaagcatccaaggggaaggagcaccttctcgaccggagccgtccggtaaagccaagggtcatggctgatatcgaaaccgtcaatacgccggagaaagccaaaatatactcgtatcaatga

SEQ ID NO: 318 - DNA, 650 bp, Bacillus licheniformis
atggaagtgctgcagcagctttggacgtattacgcgcaaaacggcggctatgtgctgggggaattttaccgccactttttaatgtcggcatacggcgtattgttcgccgccgtcgtcggcatcccggccggcattttcatcgccagataccgtaaaatcagcaaatgggtcttttccatcactaatgtcattcaaacggttccggcgctggcgatgctcgccgtcttgatgcttgtcatggggctcggcgcaaacacggtgattctttcattgtttttgtattcgctgttgccgatcattcgaaacacatatacgggaatcgccagcatcgagcatgcctatcttgaatcagggaaggcgatgggcatgacgaaatttcaagtgctccggatggtggagcttcccctcgccttgtcggtcattatggcggggctcagaaccgcgctcgtcatcgcgatcggcattacggccatcggcacgtttgtcggcgcaggcggcctcggggatatcattgtcaggggatcaaacgcgaccaacggaacagcgatcattctagcaggcgcgatcccgacggcgctgatggcgatcatcgccgatctgttcatgggatggctcgagcgtgcgctgagccccgttaagcatcataaagg

SEQ ID NO: 319 - DNA, 924 bp, Bacillus licheniformis
gatcaatctgtcaggcaaggatttcttaagcctgaaagacttttcaaaagaggagatcgtctatttgctgaaagaggcagcggcaatgaagcgaaataaaattcaagacatctttaaaggaaaaacattggcgatgatctttgaaaaatcgtcgacgagaacgcgcgtatcgtttgaagccggaatggcgcagctcggcggaaacgccctgtttttaagcagtaaagacatgcagctgggcagaggggaaacgatcgcagataccgcgaaagtgctttcgcgatatgtggacgcgattatgatccgcacattcgaacacgaaaaagtcgaagagcttgccaagcacgccgagattcccgtgatcaacggattgaccgatctttttcatccgtgtcaagcgcttagtgacctattaacgattcaagagatgaaaggaacattaaaagggctgaaagccgtttatgttggcgacggaaacaatgtcgcgcattcgctgttaatcggctgcgcgaaagtgggatgcgacattacggtggcttcacccaaagggtatgagccgaatcaggacgtggtgaaactggccgagacattcgccgaagaatccggtgcggccgtcacgatcacaaatgatcccgtgtcagccgttcaacaagcggatgtcatctattctgatgtttttacaagcatgggacaggaggaggaagccgaagaacggatgaagatttttgctccttaccaagtcaacggaacgcttgtctcccatgccaagcctgattacatctttctgcactgccttcctgcccaccgggaggaagaggtcaccgcagagatcattgacggtccgaattcagcggtatttcagcaggctgaaaaccgcctgcacgtccaaaaagctttattaaaagcactgttatcttaaatgaa

SEQ ID NO: 320 - DNA, 837 bp, Bacillus licheniformis
atgaaaccgatatacggactgattggcaatccggtggcccattccatgtctccggacatccataatgcggctttgaaggatctttctttagaagggcattatcacgcttttcgcgtggaaaacgaagatcttgaagatgctgtgaaaggtatgcgggcccttggcattcaagggtttaatgtgaccgtcccccacaaagtatcgatcatgaagcatctcgaccgtattgatgaaagcgccgaagctctcggggcggtaaacactgtcagaagagaaaaagaagggctggtcggatataatacagatggagcagggtttcttaaatcgctgaagccatcccttgatcgtccgctttctgagctctcgatactgttgatcggagcaggcggtgcggcgagggcgatatttaccactctggcagccgagacgcccaagcggcttgatgtggcgaatcgtacgcctgaaaaggcattagcattcactcagcgttttgatggagaggcacgcgccttgtcactgcaggaagcggaagcagacttgtcagcatatgatatcgtgattcaaacgacgtcggtcgggatgcatccgaatgtcgaagctgccccgctttcattggcgaatgcgaaagaaacgtgccttgtatgcgatattatctacaatccgctgaaaacggccctgctgcatgaggctgaagcaaaaggcttgaaaacattggacggagtcggcatgttcatcggccaggcagcccttgcttttgagctgtggacaggacatgagccgaatatggaaaaaatgaaatcaattgtgttgcagcaactaggaggaaaatcatgctaa

SEQ ID NO: 321 - DNA, 820 bp, Bacillus licheniformis
ttgaatatcggctttatcgggacaggaaatatggggaccattttaattgaggcgttgattgaatccagagcggtcattccctcatctttaacaattactaaccgaacgatcgacaaagcgttaaacataaaaaaacgattcccagacattcaggttgcagaacggccggaagaagtgattacggaaagtgatgccgtgtttatctgtgtaaagccgctggatatttatcctttgctaaaacggctttcacccgtcttcacccgcgatcagactgtggtaaccattacgagtccggtgcaggtcgaacagctggaaaccatcgtctcctgccaggcggcaagagtgatcccgagcattacgaacagagcgctgtccggcgtgtcattattgactttcggagaaagctgcacagctgaggcaaaagaaaaattgacggctttagtaagcaagatctcaatccctctcgaaatcgaaagcgagattacgagggtcgcctcagacattgtcagctgcggccctgcctttgtcagctatttggttcaggagtttattcaggcggctgtcgaagaaacatccgtgtcaaaagaggacgctattttaatgacgaaagagatgctggtcggtttgggaaggctcctcgaaacaggcctttacacactgcccgccctgcaggaaaaggtttgcgttaaaggcggtgtaaccggtgagggaattaaggcgctggaaagcggtgttcaggatatgttccgccagatgttccgaaacacccatttgaagtatgaagaagatatcgctctagtcaagaagcaattttccgttt

SEQ ID NO: 322 - DNA, 1971 bp, Bacillus licheniformis
atgaccgcagttaaaacgccgaccgttcccgaagatccggcccgaggaatcatcaacggcttggctctcttgaaaactcggggtgtccagccttcagaaattcatcactttgtacacggcatgacaatcggtttgaacacattattacaacgcaaaggggctgatattgctttattcgtaaccgaaggtttccgtgatattctttcgcttcagcgtctccggcttccggtaccctacgattttagatctagaatgccggagcccctcattcctcggaaaaacgtgtttcccattcaagaaagaatgctttatgacggctctgaaaagctgccgcttcatatggaagatatcgatgaggcggttggacaagctttaagaaaaggcttaaaaggaatcgttgtttcttttttgcacagctatcggaatccgctccatgaacgccaggctgccgaacggatcaggcaaatagcgcccgagcttgaggtggcaacgtctgcggagctttggccgcaaatgagagaatacgaacgaacggttatgtccgtcgcgaatctatacatcaaaccgaatatccatcactactttggaacgctgaaagagaggcttgtccaggaaggaatatcggcgcagccgtttatcacccagtccaacggaggactgatggacattgaatcggctgccgaggcacctgtcaaaacgcttttttccggaccggcagcgggggtcataggatccatcagaacggcggaagccgccggcgaggccaatatcatcacctttgatgtcggaggaaccagcgcagatatttcgattgttgaaaaaggagagccgacctttacccagtcaaatcaaatctcgggatttccgattgcgattccatctgtagcaatgtattcgatcggtgccggcggaggatcggtggcatggattgacagcggcggtctcttgaaagtagggccggagtcagttggctctgatccggggccggcctgttacggaaaaggaacaaaggccgcacttacagatgcgtttcttatatgtcattatttaaacccaaacaggtttgcagcaggaaatatgaaactgtaccgggaaagagccgaaaaagcgctcctcccggttgccgagtatttaggcacagatgtggagcaagccgcggataagatgattcaagttgcgcttgccaatatgtacacggaactaagcaatgtcatggagcaacacgggtttgacccgcgtgaattcagccttatggcttttggaggcgcaggcccggttactgctaattttttggctgaggaaattcaggccaaaaatgtgctgatcccgccgcatccgggaactctatcggctttgggcgcactgacggctgattttatctacgatgctgtatgttcaagacaggtgctgcttgagcaaataaaaacggctgagttaaaagtggagtttatgaggctgcaagaacaggcggaaacatggctgcggaaacaacgggcggacatggtgactgaagcctctcttctttacttgcttgatgcccgttataaaggtcaggcgtatgaaattgagctccctgtttcaccggaatggctggaaggcgaaagtacgagtgaaatcgcagactcctttcatctcttacatgggaagcaatatggacacagcgatgggaaagcaagcattgaattgatgaatatgcgcgtccgcattataggcaagacgccgaaaccgccaggcggaaaaggatgtcaaagtaatctgcccgaagctgaacctgtcagccaaagaaagatcatcatgaaaggcggtacatatcaagcctccgtataccgccgtccagatttaaggagcgggcagagaatagatgggccggccattgttgagcaggacgatacaacgacgctgattttgccaaattggagcgggaaaaccgatcatgccggaaatttgatcattgaacggaaggagagctga

SEQ ID NO: 323 - DNA, 756 bp, Bacillus licheniformis
cagggccgaaggcaccacaacggtgacggagcctcataaatcaagagaccatacggaacggatgctgtctatgttcggcgtcagccttcgggaagatgaaacgagcgtgtccattgagggcgggcagcagctgaaagcagcagaagtctttgtgccgggtgatatttcatcagctgcgtttttcctggcagcagcatcgcttgttcctggcagtgaagtcgtgcttcgcaatgtcggactcaatccgaccaggacgggaatcatcgatgtcttgaaagaaatgggagccgatcttgaaatcgaagaaaaggacacaggaaataccgagccgtacggcgatctgagaatcaaaacgtcctctttgaaggcagccgaaatttcgggcgatttgatcccgcgcctcatcgatgaaataccgatcatcgcgcttctagcaacacaggctgaagggacgacggtcattaaagatgcggctgaactcaaagtaaaagaaacgaaccggatcgataccgtcgcctcagagctgaaaaaaatcggtgcgaacatcgaaccgacggaagacgggatgaagattcacggcaagacgcctcttacaggcggcgcgaaggtctcaagccatggggaccaccggatcggaatgatgctggggatcgccgcctgcatctgcgagcagccgatcgacatattacagcccgaagctgtgagcgtctcatatccttcattttttgaacatatcgaaaagcttgcagaaaaagc

SEQ ID NO: 324 - DNA, 735 bp, Bacillus licheniformis
atgagcgagtttactgtatatcctgccattgacataagaaacggcaagtgcgtcaggctcatccagggagattacgaaaaagaaacgatttacggtcattcccctctggagatggcctcacggtttgctgaagagggggcaagctggattcatcttgtcgatttggacggcgcaagagaaggcaaaaaagtgaacggcggccacgtcataagcattgctgataagcttgacgttaaagtgcaagtcggcggcggcatcaggaccgaaaaagacgtgtatgactacttgtcgcaaggcgttgagagggtgatcctaggcagctctgccgtatcaaataccgagtttgtcaaaaaaatgctgaaggcctacggagggcacatcgcaatcggtcttgacgcaagggacggatttgtttcgactgaagggtggcttgagacctcttccgttagagcggaagagcttggccgcgagcttgcaaatgaaggtgcagaagtttttatcttcactgacattgcgactgacggaatgctgtcaggacctaatatcaacagtacagtggagcttgccagggcaaccggcaaacaagtcattgcctccggcggcgtcagttctctcgccgatcttgaggcgctcgcttcccgcgcttcggaaggcgtctctggcgctattgtcggaaaagctctttataccaaccaatttaccgtggctgaagcgcttgaaagggtggcggcaaag

SEQ ID NO: 325 - DNA, 637 bp, Bacillus licheniformis
atgtgttctttaaaatgctgaaagaagatgtagatgtcgtatttgaccaagatccggctgcgagaagctacattgaagtcatcttaacttattcaggtttgcatgctatatgggcacatcgaattgcacatgctttatataaaagaaaaaggtttttcatcgccagagcgatctctcaaatcgcccgcttctttacgggaatcgaaattcacccgggtgccaagatcggcaggagatttttcattgatcacggcatgggggttgtgatcggcgaaacctgtgagatcggaaacaatgtcacggtttttcagggcgtgacgcttgggggaacaggaaaagaaaaaggcaaaaggcatccgacaatcgaggacgatgccctgatctcaacaggggctaaagtgcttggatccattacagtcggaagaggggcgaaaatcggtgcaggctccgtcgtcctgcacgatgtgcctgaatgctccaccgttgtcggcatcccgggccgggtcgtcgtacaaaacggaaagaaaatcagacgcgacttgaatcaccaggatttgccggatccggtggctgaccgcttcagagaattggaaaacgaaatcaggcagctgaaacaagagctccggagaaaagaaag

SEQ ID NO: 326 - DNA, 654 bp, Bacillus licheniformis
atgaatcagcttgtccaatttcttcagcacaacggcggggaaatgctttataaaacatgggagcacttatatatatccattttcgcggttctgctcggcatcattttcgcggttccgctcggtgtcgttttaacgagaatgaaaaaaggagccggcgtcgtgatcggcgttgtcaacatcattcagacgctgccgagtttggcgatcctggcgttttttatcccgcttctcggagtgggaaagattccggcgattgtcgcgctgtttttctattcagtcctaccgattctgagaaacacttacacgggcgtaaaaggcgtcaatcaaaatttgcttgagtcaggaaagggaatcggtatgactgcatgggaacaaatccgcctggtcgagctgccgctatcggtgccggtgatcatggcaggcatccggacgtccaccgtttacttaatcggctgggcgacgctttcggcttttatcggcggcggcggtctcggcgactatatttttatcgggctcaacctgtaccagcctgagtacattatcgccggagcggtgccggttacgatactggccatcgtgatcgactatattctgtcgaaaaccgaagacaaagtcacgcctcaaggattaaaagggatgaaggaagtatcataa

SEQ ID NO: 327 - DNA, 534 bp, Bacillus licheniformis
ccggacactgcatctatgacacatcaagcggttcatttgccggtacagccactgtttcgccgggacggaacgggacaagctatccttacggctcagttaaatcgacgcgctactttattccgtcaggatggagaagcggaaacaccaattacgattacggcgcaatcgaactaagcgaaccgatcggcaatactgtcggatacttcggatactcgtacactacttcatcacttgttgggacaactgttaccatcagcggctacccaggcgataaaacagcaggcacacaatggcagcattcaggaccgattgccatctccgaaacgtataaattgcagtacgcaatggacacgtacggaggacaaagcggttcaccggtattcgaacaaagcagctccagaacgaactgcagcggtccgtgctcgcttgccgtacacacaaatggagtatacggcggctcctcgtacaacagaggcacccggattacaaaagaggtgttcgacaatttgaccaactggaaaaacagcgcacaat

SEQ ID NO: 328 - DNA, 633 bp, Bacillus licheniformis
cgaagccgctgcctgtgattacctatacggaaatctgtaatttagcctatcagggggccaaggtgatccacccgagagccgttgaaatcgcaatgcaggcgaaagtgccgatccgcgtgcgttcaacctattcaaacgaaaccggtacgctcgtcacaagccatcacaactcgaaagccggaagcgacgtttttgagcggctcatcacaggcatcgcccatgtgaaagacgtgacacagtttaaagtcccggcaaaagaaggacaatataacgtacagactgaagtgtttaaagcgatggcgaatgcgggcatcagcgtcgatttcttcaatattacaccaagtgaaattgtctacacggtggctggaaacatgacagaccgcgcccacagcatcctgaaggaattgggctatgaaccggccgtgacgagaaattgcgcgaaagtgtcagcggttggcgcggggattatgggcgttccaggcgtcacctcaaaaatcgttaccgctttgtcagaaaaaggcattccgatcctgcagtctgctgacagccatacgacgatatgggtgctcgtgcacgagaaaaatatggcgacggccgtaaatgcgctgcatgaagtgtttgaactgtcaaaat

SEQ ID NO: 329 - DNA, 885 bp, Bacillus licheniformis
ctgaaacgggtggcggcttgattttcgtctacagggcgttcggacgaaaaacggcttttgtcgccgcttggggtgtgctgttcggctatgtttcggtgattacatttgaggcggtcgcattgcctaccgtcatcgattacgtcctgcctgtcgaacatcaggggtttctctggtcgctaagcggctgggacgtgtatgtcacttgggtgttgatcggttcgggaggtgcggtcgtcctgacagcgctcaattacttcggcgtcaagccggccgcgatttttcagtcggtctttacgattgcgattatcgccacgggctttctccttttgggcggcgccttggtaaacggtgatttcgaacatgtacagcccctttttaaagacgggttttccggtatgatgtccgtccttgtcatgattccgtttctatttgtcggatttgacgtcatccctcaggttgcggctgaaattaatgccccgaaaaaaatcatcggcaaaattttgattatttcgattatcagtgcggtcgtgttttatttgctgattgtattcggcgtaacgatgggtctgtcagaaagcgagcttgcgacgacttctttggcaaccgcggatgcaatggtcaatctgctcgggaaccagctgttcggcacggtgcttgtcctcggcggcgtcgccggaatcattacgagctggaacgcatttatcatcggcgcgagccggattctgtttgcaatgtcggaaaagggcatggtgccgaaatggttcggcttcatccatccgaagtataaaacgccgactaatgcaattttatttctgggtgcgctggcgttttttgccccgctgctcggacgccctgcccttgtttggatcgtcaatgcagggggaa

SEQ ID NO: 330 - DNA, 1114 bp, Bacillus licheniformis
atgaagcatccattcgacaatttccgttctttattcccgaaattgtctgatcatgttcatcttgccgcatgttccggaagcgcattggctctgcctgttgccaaagcggtcgatgagtatcagaacggccttttaacagccggtgcagactggaaagcacatctcgacaagatggatgagaccaaggaaaaattcgcccggctgatcggtgctgaaaaagaagagatagccgttttgccgtcagtatctgacgcagtggccgctgtggccgccgcaatgccgcagccaccccgtcgaaggcagatcgccttcacggatatcgattttcctgctgtcggccaaatttggcttgcgcaagaccgcttcaaagatcacctcatcatcattcaaagcgaagatgggatgattgacttggaacaatacgaaaaagacgttaccgatcagacgctcttgacgtgtgtgccccatgccggctatcggaacgggtttaagcaagacataaagcagattgccgagattgttcatcagaaagggtcgcttttattcgtcgacgcctatcagactgccggccacattccgattcatgtcaaagacatggatatcgacatccttgcggcggggacgcgcaaatacatgctcggcattcccggaacagcttttttatatatgaaacgcgaactttgcgaacaatttgagccaaaaacggccggctggttcggaaggagcgcgccatttgccttagattcaggctttgcggaaggtgcgaaacgcttcgagtcggggacaccgtcatttatcagcatatatgcggcagacgcggcattgaagctgctgcttgaagcggagcccgacaggatcgagccctatctgcggcagcttgcggcattctctttgcaatacggtgcggaaaaaggcctgaagatcacaggacccaacaccgtacataacagaacaagcctgatctcggtgtatgccgaagaagccgcccgtgttgaatccctcttgcgtgaaaagcatatcatcgtctcaaagcgaaacaacgtcataagaatagccccgcatttttacaatacaaaggaggaaatcggatttgtgatggatgagatcgcggcaa

SEQ ID NO: 331 - DNA, 780 bp, Bacillus licheniformis
  misc_feature (1)...(780): n = A,T,C or G
tcatattgcaaaagaccgcgcggatatgacatttattgaccgcggacatcggggataggctacagatgccgcggctggaatcgtctgcccctggctttcgcagcgcatgaaccaggcatggtacaagcttgcaaaaggcggtgcggcgtactatgccgatttaatcaaccagcttgaagctgacggataatcggatacggggtataaacggacaggcgctatcagcttgcatacagacgagcgaaagctggagaaaatggaagatacggcgcatctaaggcgcaaggatgcgcccgaaatcggcgatatcacccggttatcccatgatgaaacgaagcgtttatttccgcctttggcagaagggtacatctcggttcatatcancggagccgcgcgcgtgaatggaanattgctgcgccgctcacttgtgaatgccgcananaaatacngagcttctgttgtctcangaaacgcttcattgctctatgaatgaaaccgggtaacacggatctccactgggggcaagaaaatatacgctgatcaggtgcttgtcacagcgggagcttgggcgaacgagctcttgaagccgctcggcgttcgtttttcagtcagctaccaaaaagcgcagatcgtccacctttgtcttcctgatgccgataccggcagctggcctgttgtgatgcctccgaatgaccaatacatactggcatttgaagacggccggatcgttgccggcgctactcacgaaaatgaagcggaactggacgatcttcgggtaac

SEQ ID NO: 332 - DNA, 709 bp, Bacillus licheniformis
atgaatgtgatcaaggatatcaccgaattgatcggcaaaacgccgcttctgcagattttggattttcgaatccctaaaggcgttaacatatatgcaaaacttgaaatgatgaatccgggaggcagcattaaagaccggctcggagaagtgctgattgctgaagcgatcggttcgggaaagctgaaacccggtggaacggtcattgaggcaacagcaggcaatacgggaatcggtctggctctcgccgccagaaagcacggcattcgacccgttttttgcgtacccgagcatttcagcatggaaaaacagtcgattatgaaagcgctcggcgctcggatagttcatacccccagaagtgccgggatgaagggtgcgattgaaaaagcacttgaacttgagaaggagattcccgattcttattgcgttttgcagtttaaaaacccagtaaatccattggcttactataaaacgattgccccggaaatatggaatgatcttggcggccggattgacgtcttcgtcgccggagcggggtcaggcggcacatttgcgggaaccgccaagtttctgaaagaaaaaaatccgtccattaaaacggttattgttgaaccggaaagctcgattttaaacgggagggaaccgcatgggcataagaccgaaggaatcggaatggaattcatcccggaatacatggaggaaaagctatttc

SEQ ID NO: 333 - DNA, 600 bp, Bacillus licheniformis
atggagccattaaagacccataacggaatagcggcggtgctaaacagaatcaacgtagacacggaccagatcattccgaagcaatttttaaaaaggatcgaaagaacgggatacggccgttttgctttctttgactggcgctatctggataacggcgatcccaatcctgattttgaactgaaccggccggaatacaaaggcgcttcgattttaatcgccggcgaaaacttcggctgcggctcttcaagggaacacgcgccatgggcgcttgacgactacggatttaaaatcattatcgcgccgtcttttgccgatatctttcaccaaaactgttttaaaaacggcatgctgccgatccgccttccttatgaggcgtggaaagagcttgctgaacagtatgagtatcaatctttgacgatgacggtcgatctcgaaaaacagacgataacagatcatgccgggcggcagattgcctttgaggtcgatccgcattggaaagagatgctgctgaacggttacgacgaaatttctttaacattgctccttgaagaagaaatcgaacaatttgagaaacagagaagttcttggctgcaagcataa

SEQ ID NO: 334 - DNA, 585 bp, Bacillus licheniformis
atgagaaaagccgaacgggcaagaaaaaccaatgaaactgatattaaattatcctttcatattgacggagaaggaaaagcggatattcaaacggatgtcccgtttatgacacatatgcttgatttatttacaaaacacgggcagtttgacctttcaattgaagcgaaaggcgatgttgaaatagacgaccaccatacgacggaagatatcggaatttgtctcggacaggcgcttttggaagcgctcggagataaacaaggaatcaaacgctacggttcgagcatggtgccgatggatgaagcgctcgcccaggttgcgattgatctgagcaacaggccgcacctcgagttcagagctgaattcccaagcaggaaaatcggaacatttgatacagagcttgtccatgaatttttgtggaagtttgcactggaagcgcgaatgaatctgcatgtcatcgttcattacggtacgaacacacaccatatgatcgaggccatttttaaagcgctgggacgtgcgcttgatgaagcggcattgatcgatccgcgggtcaagggaattccatcaacgaaaggaatgctgtaa

SEQ ID NO: 335 - DNA, 609 bp, Bacillus licheniformis
aaggctttcggtttaacaaactcatcgtatcgacttatcaggcggtgtctggagccggaaacgaagctgtaaaagagctctacgggcaaaccgaagccattttgaacgacaaaccgttcgagcctgagatcatgccggtgaagagtgatgaaaaacactaccaaatcgcatttaacgctattcctcaaatcgataaattccaggaaaacggctttacgtttgaggaaatgaaaatgataaatgaaacgaaaaaaatcatgcacatgcctgagcttcaagtttcagccacatgtgtcagactgccgattgcaacagggcattcagaatccgtctacatcgaaacagaccgtgatgatgtgacagcagaggatattaaaaatctgttaaaagaagctccaggcgtcgttctgcaggatgatccagctaaacaggtctatccgatgcctgcagatgcagtagggaaaagagacgtatttgtcggccgggtgagaaaagaccttgaccgcccgaacggtttccatctgtggatcgtttccgacaacctgctgaaaggcgcggcatggaattccgtacaaatcgcagaaagcctaaaagctttaaatttagttt

SEQ ID NO: 336 - DNA, 1491 bp, Bacillus licheniformis
aaaaacgatctctctgcttgacctgattttgatcggcatgggtgcgatattcggatcggcttggctgtttgccgtcagcaatgtcgcttcaaaagccgggcccgctggaagcttttcgtggattatcggcggcgtcattatccttttaatcggcctcgtttatgccgagctgggagctgcgttgccgcggacgggcgggattatccgctatccggtgtatacccacggccaccttgtcggatatttgatttcatttatcacgattgttgcctatacaagcctgatttcgatcgaagtgacggctgtcaggcaatacgtagcctattggtttcccggtttgacgataaaaggttctgaatcgccgacgattatcggctggcttttgcagtttgcgctgctttgtttgttctttttactgaattattggagtgtcaaagcgtttgcgaaatcaaatttaattatttcggtttttaagtattttgttcctttgacaatcatcatcgtgttgatattccattttaaatcggcgaactttgcgggagaatttgcgccgtttggctttggcggggttcagacatccatttcgaccggcggggtgatgttcgcatacctcggtctacatccgatcgtttcggtcgccggcgaagtgaaaaatccgcagcggaacatcccggttgctctgctgatttgcatcattgtttcggcttgcgtctatacgatactgcaagtggtgtttatcggagccataccgactgatatgctaaatgacggatggaaagcgatcggcagggaattttctcttccgtttaaagatatcgcggtgctgctcgggatgggctggcttgccactcttgtcgttctggatgcgattttatcacccggcggaaacggcaatatttttatgaatacaacatcgcgcttggtttatgcatgggcgcggaacggcacattgttcaaaatctttgccaaggtgaataaaccaacgggaattccgcgtccgtcgttgtggctgtcgtttgcgctcgccgttttttggacgcttccgtttccgtcttgggacgcgctcgtcaatgtttgctctgttgccctgatcctctcctatgcgattgctccggtttcagcagcggcgctgaatgtgaatgccaagcagcttaaaaagcctctgcaaatcaaaggaatggctgtcatcgctcctgtctccttcatatttgcgtcgtatatcgtctattggtcagggtggaacaccgtgtcatggctgctcggatcacagcttgtgatgtttgctgtttattgcgcgtgtaaaaaatacgttccgcaggacgatgtttcgtttgcacagcagcttaaatcaagctggtggatcgtcggatattatgtgatgctcctgattttatcgtttctgggctcattcggtaacggccttggcctattgagaacgccggtcgatttaatcttgatcgcgctaggatcgattgcggtattttactgggc

SEQ ID NO: 337 - DNA, 878 bp, Bacillus licheniformis
  misc_feature (1)...(878): n = A,T,C or G
atgtggaaaaagatagcgggaatcggcactgcagcggtactcacattgggtctggctgcctgcggaagcagcaataataatgaaaatgcgtcagtaggcgatcaagtcaattataaaattaccggcattgatcctggagcgggcattatgaatgcgacggaccaggcgctcaaggactacgatctcagcaagtggactgtaacgtcaggatcaagctcagcaatgacagccgcattgaaaaaagcttatgacaaaaaagatccgatcatcattacgggctggacgccgcattggatgtttgcaaaatacgatctgaaatatttaaaagatcctaaaggttcctacggcgatgccgaagaaatccatactgttacgcgcaaaggattcaaggacgaccatccgggcgcaaacaagctgctcagccaattcagctggacagaggatgatatgggagaagtcatgcttgccgttcaggaaggcaaaaaaccggaagaagctgcagcagacttcgtgaaaaacatcaagatctagttaagaaatggacaaagggcgtcgataagcggacggtgaaaaaattaagctcggctatgtggcatgggacagcgaaaatgcgagcacgaatgtcatcgcaaagttcttgaagactagggatacancgtacgctcagcccaagtagaagcaggcccgatgtganctggcatgcaaaatggaagcgtcgatgcttcacttgctgcatggctgccgcaacgcaataaaacatatgctgaaaaatacaaaggcaaatacgaagatatcggtactagcatgacaggcgtaaaaattggccttgtcgttccgacatatatgaaagatgtcaattcaatcgaagacttgaaaaa

SEQ ID NO: 338 - DNA, 1797 bp, Bacillus licheniformis
atggaaaaagcggatagcattttgcatgcgctgcgcattaaagactttgcggtacatcccgatgagactcagcttatttttgatacaaacctcaacggaacatcgaacctgtgggcgatggatcttcccgatacatacccgtaccagctgtcattcttgaatcaggactcaaaaggaattgcctacaatcccgacggctcaatcctttatgctggttttgacaatgacggaaacgaacaaagcggactgtacaagctttctttaaaaaacgggacgttccaatcattaaacggaaatcaaacagaccgccacttcgcccccatccctgtgcaaaacgcagtttactactcctctacaaaggacaatccgacatttttaaatacatacagatatgattgtctcactgaaaaagaagagcttatttttgaaggaaaagacggaacttcaatgctgtctgatgtaagcccgggcgagaaagccgtcagcatacatgtctactatgtcaacagccattctgtctgtatggtccatacagctgaaggcgtgacgacaggaatcttcccggatgagacgctgcctcacatggtttattcttcccattttgcatctgatgatcggttattcgtcacgacaaactacgaagccgagttctcatatcttgccttgtacactgtttcatccggtatttttacgccggtgctttcgattgataaaactgatttaacatccatccacgctgacccgaatggaactttcctttatctcattggaaaaaaaggtgtcaaagaggtgatgtatgagtacaacacagcaacggggcaaagccggcagatcgattgcccttgcacatccatttcgaaaatacactgcgcctattctggtacgctgtacattctcggctcaacgccgaccaggccgactaatctctacgtattaacgaaaggacagtcaaaatggcggcaattaacgaaacattcggttccgggtttctccgaacaggagctgtcttatcctgaagttgtgacatatccttcttttgatggcctgccaatagaaggactgctgtttaagccctccccggtagaagcgaacggctggacgattatttggccgcacggcggaccgcaagatgcagaaacctttatgttctacgatctctttcaactcgctgcaaaaatgggttaccagttattcgctcctaatttcaggggatcagcgaattacggttattcattctttaaaatggttgaacaagattggggagacgggccgcgcctcgatatgaccgcgggcatcgactggcttatcgatcaaaagcttgcagaccgcgaaaaactctttttaatgggcggcagctatggaggatatatgtcgcttttgctccacgggaggcatcctgagtatttccgcgccgtcgtcgatatatgcggagtcagcaacctgttttcgttcgtcaaaaccgtacctgatttctggcagccgatgatggaaaaatgggtcggcaatccggagcgggattatgaaaaaatgaaagccgattctcctgttacatatctggagaatatgactcagccgatgctgatcatccaaggcgcaaacgatccgcgcgtcgtaaaggaagagtccgatcaggtcgtcgatcagttgaggaacatggagcggaatatcgagtatctcgttttggaaaatgaagggcacggtttttccaaaaaagaaaataaaatgaaagtctaccgcgccattttcgaattttttgaaaagcaccgcttatatcacgcggccaaggttgaagaataa

SEQ ID NO: 339 - DNA, 669 bp, Bacillus licheniformis
tggtaagccgagcgagcagtacgtcaatcagaacggcgaggaagaagcggttgacacgctgttttataaaaagtcggaaatggaaagggtcatcagggaagccttccaaatggcgcagagtcgaaaaggcaaagtgacctccgttgataaagccaacgtccttgagtcaagcaaactatggcgcaagacggcggaagaagtggcgaaagagtttcctgacgtcaagcttgagcacatgctcgtcgacaatgcagccatgcagctcatctatgcgcctggacagtttgatattatcgtgacagaaaacatgttcggcgatattttaagcgatgaagcatcgatgctgaccggatcgctcggcatgctgccgtcggccagcttatcaagctctggacttcatttatacgaacctgtgcacggctcggctcctgatatcgcgggacagaacattgccaatccgcttgcggcgatcttgtccgcggctatgatgctcaggacgtcattcggtcttgaagctgaagcgcaagctgttgaacatgcagtcgatcaagttctccgggcaggaaaacggacgaaggacctggcaaaaggctcggaacattgcacaactcaatcgattacaggggaagtaaaagccgcgctggcagacgacaatgccatttcaaacat

SEQ ID NO: 340 - DNA, 674 bp, Bacillus licheniformis
ttgggctctattcaatgggagtatatttttaatgcagaattggctgcgaaatcgtttccttatgtgatgcaaggcatatggaatacgcttttcatttcttttgcgagcatgtttgccggtttaattctcggttttttcatcgcgcttgggcgcatgtccgggctcgctttgcttcgttggccggcaagaatctatatctcgtttatgagaggcgttccgatccttgtcatactatttatcctttatttcggttttccttatatcggaatccaatttacggctttggctgctgccttaatcggcttcagcatcaacagcgccgcatacattgccgagattatccgctcggccctgtcgtccgttgacagagggcagtgggacgctgcaaaatcggtcggattctcctactggcagacgatgcgccacgtgattgtccctcaatcggttaggattgcgctcccgcctcttgcgaacgtgatgcttgatctcgttaaagcgtcttccctggccgccatgatcaccgtgcctgaattgtttcagcaggcaaaaatcgtcggcggacgggaattcgactatatgacgatgtacattttagttgccttgatttactgggccatttgctcggggatcgctttgctccaggatttcctggaaaagcggacagaggtttatat

SEQ ID NO: 341 - DNA, 1740 bp, Bacillus licheniformis
atgatcaatcaggactttatcttatcacaggtggtcggcggttctcttgatgcggttgccagggaaatgagcgccactgtcacgagaacggcccgttcaccattgtttaacgaagcgcatgattttacgacgggcgtctttgacctttccggcaaaaaatcgcgccttgtcgcgcaggcccccggctgtacgcttcacctttatgcggtcgtaggcgcagtggaccatctattggacgcctttcggtatgatcttcaccccggggatattctcctggtgaatgatccgtatcatggaggctcgcacagccttgactggacgatcgtcatgcctgttttttataatcgcaagccgatcctgcttcctgctgtacgaagccatatggccgataatggcggtccggttgccggagggtacaatccgcgctcaaaagacatttggcatgacgggctgcggattccgccgttaaaaatttatgagcggggagaaaagcgaagggatgtattcgatttaatcgttgcaaacaaccggctttcacattggcttgaaggcgacttaaatgcgatgatcggggcgtgcaaggtcgctgcctcccgaatccagacgatgctggataagtatggcgccgagaaggtgattacagccattgacaaccggattcaatatacagaaaacagggttcgcgatgaaatcagcagctggccggacggcacctatgtcggtgaaacattcgctgatcacgactttcaaggcaaccgcgatattaaggttcgcgcaacggtgaccgtcaaaggcagcgatcttcacattgactttaccggttcatccccgcaagtaaaaggcttcatcaacagcccgctctcaaatacgacttcgtttgcttttgtcggtatttcgacttgctgtgatgaggatattccgatcaatgaaggatatatgaatccggtaacagtaaccgcgcctataggaacagttgtgaacccgcagctgccggcaccgtgcggacacgcgactgcgtgcgtcggagcagaaatagccgaggctgttcttcaggccatttcacaatgtgcgccaaaacgggtcggagtgaacgcccataagcttcctctcgcctattctcacggaaaatacgatgacggcaagccgtgggtgaatctgaatttttacggctataccggcggtgcgggagctgcatacgaaacggacggatgggggctttatcctcctgttatgacaggagttattcttccatctattgaaatgaccgaagttcaatacccgagccgtgtattaaagcatgaatatacaagcgattttacgggtgcgggccgatggagaggcacacccgggttggatgttcaaatccagcacttaaaggaaagccgcacaagcgtcatgatggcagggggccgaaacacaacaaaaggcttctgcggagccggcgattcaccaagcaacaaggtgattgtcgggtatggaacagacgaagccagagaaatcgatgaaacggcttttgaagtcaaaatgcctgtgggcggcatcatccaattttaccgtgcaggcggcggaggctggggaaatccgctggaacgtgaaccggaaaaggtgctggacgacgtcttaaacgagtttgtcagcattgaatcagcattgcaggattatggtgtcgtgattgaccctgagacacttgccattaacgaagctgaaacaaaacgtgtgcgggcatccaggcttccataa

SEQ ID NO: 342 - DNA, 722 bp, Bacillus licheniformis
ttgacttattatcaccttccacatgcacgaggtctctaccgtcctgaatttggacatgatgcatgcggaatctgtctttatgctcatttgaagggccttcctactcatgatattgtccaaaaaggattgcaaatgctttgccaattggaccaccggggcggtcagggcagtgacccgcataccggagacggggcaggcatcatgatgcagattccggatgctttttttaaaaaagtgtgcgccgatttcaacttgcctgaaaaaggacgctacggcgtcgggatgatcttcttttcgaaagacgacagcgggcgcgaaaaatccgaagcgcgcattaacgagctgatcgaacaggaagggcagacggtactcggctggcgaactgcacctgtaaatgtcggaaaaatcggaacagtcgcacaagaaagcgcgccagtcgtccgccaggtatttatcggagcaaatgaagcgctgaaagacaatttggcatttgaacgcaagttgtacatcattcgcaaacaggccgaaaattgggcaaaagaacacgagaaaacgttctatttcgtcagcctctcgagcaataccatcgtatataaaggtcttttaacgcccgagcaggttgatgccttctatgaagatttgcaagaccgaggacttcgtctcggctttttatttggttcactcccgtttcagcacaaacacgtttccaagctggaaagggc

SEQ ID NO: 343 - DNA, 780 bp, Bacillus licheniformis
gaaatgcgaacaaagggagatgttaaagatctttaatcaaaaaaacgtagcttttataggggcgggatcaatggcagagggaatgatctcaggcatcgttcaatccaaaaaactgcctgcttcgcaaatctatgttacaaaccacacgaaccaccggcgtttagaagaactccagcagaaatatggaatacaaggcgtcaaaaaagaacaacttgactatcagaacatcgattgcttcatcctggcgatgaagccgaaagatgcagagggcgctcttaattccatgaaaccgcatatcaaaccccatcagcttatcgtgtcagttttagctggcatatcaatatcatttattgaaaacacgctgcacgacatgcagccggtcatcagaatcatgcctaatacctcaagtgcaatcggcgcatctgcaaccgccatggccgaaggaagccatgtaacggccgatctgtcaaaaaccgcgaaacaactgcttcaatgcatgggagaagtctattccatcgaagaaagcaaaatggacattttcactggcattgccggcagcgggcctgcttacttttattatttaatggagcacatcgaaaaagcgggagccgaggctggattaagccaaaaattaacaagggaaatcggcgcgcagacattgttaggcgccgccaaaatgctgttggaaagccctgaggatacagctgttctcaaagacaacatcacttcccctaacggtacgactgccgccggtttaaaggccttggaagaaagcggcgg

SEQ ID NO: 344 - DNA, 622 bp, Bacillus licheniformis
  misc_feature (1)...(622): n = A,T,C or G
atgattatcggcgtaccgaaagaaatcaaaaacaatgaaaaccgtgttgctttgactcccggtgcggcttctcaattgatcgcggcaggacaccgcgtcatcgtggaaaaagacgcggggactggaagcgggtttgaaaatgaggattacgtctcagtgggagccgagatctcagaacaagcggaagccgtctgggaagcggctgaaatggtgatgaaagtcaaagagccgctccctgaagaatatccgtattttagagaaggtctcatcttgttcacctacctgcatctagccgcagagccttccttggctgaagcattaaagcagaaaggcgtgacagccatcgcctatgaaaccgtcagcaatggccgttcccttcctttgctgacgccgatgtctgaggtagccgggcggatggccgcccaaatcggcgcgcagttcctcgaaaagccgaaaggcggaaaaggcatattattggccggtgtacccggagtcgcgcgcgggaaagtgacgatcatcggcggaggcgttgtcggcacaaatgcggcaaaaatcgcggcgggcctcggagccgacgtgacgatgatcgatttaagcgcggatcgcctgcgccagnttgata

SEQ ID NO: 345 - DNA, 628 bp, Bacillus licheniformis
atgatcaaggcagacgagttgacatttaatgaagccggcttgatcccggcgattgtccaggatgcagcgagcaaagaagtgctgacacttgcttatatgaataaagaatcgtttgaaaaaacgctggaaacgaaggagacatggtttttcagcagatcgcgcggagagctctggcataagggagcgacgtcgggtaacattcagcgtgtgaaagacatcaggcttgactgtgatcaagatgcgctcatcgtgcttgttgaaccggcggggccggcctgtcataaaggaagctacagctgtttctcgcccggcgaacatatcagacagactgatggcggccgctttgacatcatcaatgaacttgaaaccgtcattgccaaacggcaggctgaaatgcctgaaggcgcatatacaacatatttgttccgtgaaggcgttgataagattttgaagaaagttggcgaagaagcggcggaagtcatcatcgctgcaaaaaaccgtgatcctgaagaactgaaatgggaggcggctgaccttctttaccatctgctcgttttgctgagggagcagtcccttccgcttgatgatgtgcttggcgtcttgaaagagcgccatgaaggatctgaat

SEQ ID NO: 346 - DNA, 840 bp, Bacillus licheniformis
aaccatatcctgaattattacaaatttatgaacaagtaaatcagcgcttcttcggcaacccgtcgtctctgcaccgccacggcgttgaagcggatcaattgctttctgaagcgcggaaacagattaaatcggcgctttcgctaaaaaatcatgatatcgtgtttacgtccggcgcttcagaagccaataacatggcgcttaaaggcattgctttggcacatgcgcaaaaaggaaagcatatcattgcttcctccattgaacacccgtctgtgacggaatccttggagcagctgaagacggccttcggctttgaggttacatatcttcctgtcgacggccatggctttgtttctcttgaagacttgaaacaagcgctccgcaaagacacgattcttgtaagcatcatgcacgtcaacaatgaaacaggcgtcatccagcctctggaagaaatcgggaaaatcgtaaaagaaaacacaagggcatactttcacgttgatcatgttcagggcatcaacaaggttccgctggacatctccggggcagccattgacctttgtacaatctcgggtcacaaatttcacggcttaaagggaacaggagccctcattctaaacgaacggatctcgctttttcctttgatttccgggagagaacagcagaacaacaggcgtgctggaactgaaaataccgcccgcgccgttacacttgcaaaagcgatcaatttgtcaaaacaggattattaccctttttatagaaaaaaataaagggcggcaaaatcagccttttatcaaaggagcctaaaagagcttgaaaggtgtttattttaaaataccccccgga

SEQ ID NO: 347 - DNA, 712 bp, Bacillus licheniformis
atgggtaaaacaatcgtttttaaatgcggcggaagcgtcatccgcgaactctcggacgaattttttcaaaacctgaaagatctgactgaaagcggctggaaaatcgcgctcgtgcacgggggtggacccgatattacaaagatgctgaagaagctcaatattcgaaccgaattcgtcaacggacagcgcaagacgacaaaagcggttcttgaagtcgctgaaatggtcctgtccggttcgatcaacaaatttttcgttgctgagctgacaaagcacgggcttccggctgtcggcgtatcgggaaaagacgggggactgctccttgcagactatttaaatgaaaaggaatacggtcaagtcgggcgcattaaaaaagtaaacggccaaatggccgaagcgctcatggaaaaaggatttattccggttatcgcacccctctcgatgacggatggctgtgagaccttgaatgtgaacgccgatttggcggcgtcggctgttgcggcagccttgcgcgctgacaaattgatgtttgtgacagatgtcaaaggaattatgaaaaacgaagaaatgctgaaagagctgacgcccgaagacatcgaaagcctgattgctgaaggcgtgatctcgggaggcatgataccaaaagtgcattccgcaaaagaggctcttacagatgaagggaagaagtaagatgtaagcgggaaaggcacaa

SEQ ID NO: 348 - DNA, 672 bp, Bacillus licheniformis
ggtcgctgattcatatcacatgcagagaccgcaacctgatcggcctgcagtcccatttaatgggactcgatacgctggggctgtcagacgtgctggcgattaccggcgatccgtcgaaaatcggcgactttccgggagcgacttccgtctatgacctgacatcgttcgatttgatcagcctgatcaagcagtttaacgaaggcttgtcctattcgggtaaaccgctcggcaagaaaacgaatttctcagtggcggccgccttcaatccgaatgtcagacacattgacaaagcggtgaaacggcttgagaaaaaaatcgcctgcggcgcagactatttcatttcccagcctgtctattccgaggagcagctcattaaaatccacaaggaaacgcggcatcttgaaacaccgatctatatcggcgtcatgccgctcaccagcagccgcaacgcggaattcatccacaacgaaatccccggcatcaagctgtctgattcaatccgcgaaaagatggcgctggcaggaaacgacaaacaaaaacaggccgaggaagggctcgcgatcgctcgctctctgcttgatgcggcgtgcgacctgttcaacggcatttatctgatcacaccgtttttgcggtccgatctaaccgccgagctgacggcatatatccatcaga

SEQ ID NO: 349 - DNA, 732 bp, Bacillus licheniformis
atgaaaaaaagcttggtgatggttctcgtttttctgcttctgctttcaggctgcggagaggacgatcccagaaaagtcgtagcatttggagacagcaatacacgcggctcaaattggcaatttcgcgattatccaaaagcggaaaagtgggtcaatttacttcagacttcccttcaagggcagtacaaaataaataatgcaggaataggcggagaaacgacggaagacgccaggtttcggttcaggaaggatgtgctggacaagcagccggcatatctttttatcatgttcggaacaaatgatgcagcaattcttacgaaagggctgccgcgcgtatccaaaaaaaggtttaaagaaaacctttattattttgttaaagaaagccgccgccgcgggatagagccggttttaatgacgtgcctgccgatcgtcgaaggaagcggggacaacatcttttattatgcaagataccgggcttcttcgtttgaaaaatacggtggagcgcgtaaatggcacgattcctataatgacgtcacaagggaaacggcgcgggaacttgatgttccgcttatcgacaactggaaaaacatcgtgaaaaaagcgggcggagctacagatgagaagctgatccattcgaggtttatcgacccatcgggaaatcacttaaccccaaaaggcgcgcgaattatttttgaaggaattaacaaaagcaaaatcataaaaacgtcttga

SEQ ID NO: 350 - DNA, 506 bp, Bacillus licheniformis
gtggcgaacaaagaattgaagagaggcctgggcgcgcgccacatccaaatgattgcgcttggcggcactatcggcgtcggtttatttatgggatcttccagcacgataaagtggacaggaccttccgtcctgcttgcttatgccatttgcggaatttttatcttttttattatgcgtgcaatgggggaaatgctatatgtagagccaagcaccggttcatttgcgacattcggccatcaatatatacacccgttggccggatatatgaccgcgtggagcaactggtttcagtgggtgattgtcgggatgtccgagatcatcgccgtcggggagtacatgaagtactggtttccggatcttcccgcttggataccgggcattatcgcaatggcgattctcggaggagcaaaccttgtctctgttaaatcatttggtgagtttgaattttggtttgcgatgattaaaatcgttacgattgtattaatgattgcagcggggttcgggat

SEQ ID NO: 351 - DNA, 1136 bp, Bacillus licheniformis
atgtttttggaatctacattaaaatataacaaaaaattaatagaggctgcattgagttttcatcagcagggaatcatttcacctaacacttatgtattagacttggacaccgtcaaaaaaaatgcaaaagtgttaagtgaaaaagccagaaaacaggatattgaactgttttttatgacaaagcaatttggtcgtaatccgttggtggcacaagctatagccgaaagcggaatcggcaaagcggttgctgtagacccgtgggaagcaatcacactcagccaaaatggaatcaaaattgggcatgtcggacatcttgttcaaatacctattcatatgatacccgcaatattggagcttcatcctgattatgttacggttttcagccttgaaaatgctcaaaacattaatagagtcgctaagaaaatgggaagaaaacaaaaagtttttttgcgtatcgcaaacaaagaggattatatatataaaggtcaagagggagggttcacttttgagcaaatcgttaaggatatcgaatcgattgaacaattagaaggacttgaaattgcaggtttaacaagctttccttgcatattgatccaagacggccttccagcagttactccgaatgtagcatccatgcaaaccgtaaaatcgtttttaatggaaagagggtataaaaagcttgagatgaatatgccaagtgcaacatcttgtgcaacaatgaaattgttaaaggaaaatggtgcaactcaaggcgaacccggccatgctttaattggaacgacacccatacatgcaacgaaacaacttgcagaaaggcctgcgatggtatatgtaaccgaagtgtcccacatatctaatcatcatgcttatgttttcggcggcggtttctatccgcgttcacatatgaaagcggcgctcgttggaacaaacaaagatcatcttaagaaggttcaagctattgaaatgacgcctgatcatattgattattacggttcattaaacacagttgaagcaaaagtcggcgatacggcaatatttgcttttcgtacacaagtctttgtcacgaatgcacatatagccatcttaaaaaacgttgctgaagatcctgaacttatcggtgtatatgattctaaagg

SEQ ID NO: 352 - DNA, 594 bp, Bacillus licheniformis
ttatcggcggcggagtggttggtacgaacgctgccaaaatcgctgtcggacttggcgctgacgtcactttgatcgacttgagcgctgagcgcctccgtcagctcgatgaccagttcggcaaagacattcaaacgcttatgtccaatccgctcaacattgcggaagccgtaaaagactcagaccttgtcatcggcgccgtcttaattcctggtgcaaaagcgccgaagcttgtcacagaagagatgatcaagtcgatgtcgccaggttcagttgttgtagacgtggcgattgaccagggcggcattatcgaaacggttgataaaatcactacgcatgacgatccgacttacacgaagcacggcgttgtccactatgccgtcgccaatatgccgggagccgttccccgtacatcaacgatcggcttaacaaacgtcaccatgccttacgccttgcaaatcgcaaataaaggcgttgaacaagcagtcgccgaaaatcaggcgctcgctctcggcgtcaacgttgcaaacggaagcatcacctacaaggccgtcgcgcgcgaccttggatatgaatatgtatctgtagaagatgcat

SEQ ID NO: 353 - DNA, 810 bp, Bacillus licheniformis
gggcgcacgttccgaaggcgccggtctttcagcctgaagacttgaaacggcactatttgaaaaacatcgacctttcctatattgtgccgtatgtcaatgaacaaatgctgctcggccatcatctcggcttgaaagggaaagtcaaaaaactactggctgaacagcatccaaaagcactggagctgaaagaactgatcgacgagctgctgagagacggaaaagaacacggctggttcgatcctgcggtcgtctaccaatttttccctgcgtacagcgacggggattcgcttcatattttagatccagtgaacaaagacagcatccttgaaacgtttgtttttccaaggcaggaaaagcttccgtaccgctgtatttccgattacgtccgaccgaagggagagcttgattatgtctcgttctttgccgtaacggcgggcaggcatgtaagagctgccgccaaccgctttaaggaggaaggcgactacttgaaaagccatgcggtacaagcgcttgctcttgagctggccgaagggctcgccgaacggacgcaccaggttatccgcgaccgctggggcttccctgatgcacccgacttcacgatggaacagcgttttcaggcgaaataccaagggcagcgctattccttcggatacccggcctgtccgaatcttgaagatcaggaaaagcttttcaggctcatccagcccgaaggcatcggcgttcacttaacagacggcttcatgatggagcccgaagcttccgtatcagcgatcgttgtctcccacccggaagccagatatttcaatgttc

SEQ ID NO: 354 - DNA, 720 bp, Bacillus licheniformis
ttggaattgtcgtcattacggcaattaaagaccgcggagtcacaaatccaaagtcaatcgccgcttcatgcatcaaagcggggatagtcgctgcagtcggtctcggactcgtttacgtttcactcgcttatttaggggcgacaagcgttgaaaccgtcggttcgctcgacaacggcggcgaaatattgtccaaagcttccgcatatttgttcggctcgcttggaaatgccgtgctcggcatcgcgatcttgttcgcctgcctgacgacaagcgtaggacttgtttcttcttgcggagagtatttttcaaatctgattccgaagctctcttacaaagcagttgtcatcattgtgacgcttttcagccttgtgattgccaatttcggactgacagaaatcatctcgttttcagtaccgattctgtctgcgatttatccgcttgcgatcgtcgtcgttttgctctcattcattgataagctgtttaatgaacggcgcgaggtctatatcggcacccttatcccgacaggaattctgagcatcatcgacggattaaacgcggcgaaaatcccgctggggccggttaacgatatcttaaaagcgaacatcccgctgttcagcatgggtgtcggctgggtcgttccggctgttatcggcgcagtgatcggttacattgtgacattttttatcgctttgccggaggacaaattaaagaacgtcagct

SEQ ID NO: 355 - DNA, 669 bp, Bacillus licheniformis
tcggcgactccgcggttatcatccagcttggagaggggataagcgaacagacgcaccgtgtcgtcagcgcgctgacaaagcggattgaaaacgatccgtttcccggttttattgagtgtgtgccggctttcacgagtgtgaccgttttctatcagccatttgaagtataccgcaagatggagagcggcaaggctgttgattctccgtatgaaaaggtaaaagccctcctcgaccatcatctccaagagctcacaatggaagaagagacagatcagcgcacggtggaaattccggtttgttacggcggccgtttcggccctgatttggaggaagtggccgacatcaacggcctgactgcacaggaagtcatcgatattcacacctcgggtgagtacctcgtttatatgatcggctttgcgccgggcttcccttacctaggcggaatgtctgaaaagatagccgcaccgcggcggtcatctcctcggacttcgattcccgccggttcagtcggaatagccggcatgcaaacaggcgtctatcccctttcaacgccgggcggctggcagctgatcggcaatacgccgcttgaattattcaagccttatgaacagcctccgagccttctgagagcaggggatatcgtgaaatttgtcagcgtgacagaagagg

SEQ ID NO: 356 - DNA, 553 bp, Bacillus licheniformis
atgtggatagaaaaaagaaggtttccatcgccgaacaaagaggtgcgtctgttttccgtcacatacctttcacaaggactcaaggttaaggggcttttggccgaaccggccgctcccggaaattatgacgggtttttgtatttgcgcggcggaattaaaaacgtcgggatggtcagaccgggccgaatcgtccagttcgcttcacagggctttgtcgttcttgctccgttttacaggggcaatcaaggaggagaaggcgatgaggattttgcaggtaatgaccgggaagatgcttttgccgcttttcgtcttcttcagaagcacgaactggtaaaggacggacgcgttcacatttttggcttttcccgcggcggaatcatgggcatcttaacggcaatcgaaatgaaagcagcggccgcttcgtttgtgtcttggggcggtgtcagcgacatggtcatgacctatcgcgaacgaaaagatttgcggcggatgatgaagcgggtcatcggcgggacgcctgaaaaggttcccgaagcgtatgaatggaggacgc

SEQ ID NO: 357 - DNA, 624 bp, Bacillus licheniformis
tgacgattgcgatgccgaaagggcggatatttgaggaagcggccgatatgcttcgaaaagcaggctatcagctcccggaagaattcgacgattcgagaaagctgatcattcaagtgcctgaagaaaaccttcgctttatcctcgctaagccgatggatgtcacaacatatgtcgagcacggggtggccgatgtcggaatcgcaggcaaagatgtcttgctagaagaagaacgagatgtctatgaggttcttgatttaaacatcagcaaatgccgtcttgccgtagccggcctgcccgagacggcggcagacaccgttgcgccccgggttgcgaccaagtacccgaatgtcgcatcaagctacttcagagaacagggagaacaagtggaaatcatcaagctcaacgggtcgattgaactcgctccgctgatcgggcttgccggccgaatcgttgatatcgtatcaacagggcagactttgcgtgaaaacgggctagttgaaactgaaaaaatttgcgacatcacatcccgcttaatcgtaaatcctgtcagctatcgaatgaaagacgcagtcatcgatgaaatggcttcaagactttctcttattgtggaaggagaaaaagcaa

SEQ ID NO: 358 - DNA, 690 bp, Bacillus licheniformis
  misc_feature (1)...(690): n = A,T,C or G
tcggcctgtttatttatgtcatcgcccgattgatcattcttgtcacaaactttgaacttgtccccggcgctgtcggtttaattttctctgacgcgtttaccgggcaagccgtggcaggaggcgcgatcggaaccgtgatccgctggggcgtancgcggggcgtattttcaaatgaagcaggtctcggctcggcgccgatcgccgcagccgcggcaaaaaccgatatgccggcccgccaggcgcttgtctctatgacccaggttttcatcgacacattgattgtctgttcgatcacggggatatcaattgtcatgggaaatatgtatctgacagaaaaaaccgatgccctgacatcgatgacattcgcacactttcttggtcctgcgggatcgacaatcgtcgcgatcggactgctgctgttcgcctactcgacgattttgggctggtcgtactacggagaaaaatgcttcacctacctgctgaatgaaaaatatgcgatcgtctatcgtatcatctttgtgatcgccgtctttttcggagcggtctttaaaaatgacttcgtctgggcgcttgccgatatgctgaacggcctgatggcaattcagaacctgatcggcctgctcggtttgacaggcattgtcgtctatgaatccaaacagatcctcgccaaaatcaaagccgaaaaagaag

SEQ ID NO: 359 - DNA, 559 bp, Bacillus licheniformis
atgatcattggaattcctaaagaaattaaaaacaacgagaaccgtgtagccattactccggccggagtagtcgcgctaaaaaaaagcggtcatcaagttttaattgaacagggagccgggcttggaagcggattcgaggacgccgactacaaagcagccggggcggacattttggctgaagcgaaagatgtgtggggaaaagcggatatggtcatgaaagtgaaagagccgatcagctctgaatacggctatttccgaaaaggacttgttttatttacttatctgcacttagcggctgaacctaagcttgcgaaagcgcttgtggacagcggcgtcacagccatcgcttacgaaacggtcgaagtgaaccggacgcttccgctcttgactccaatgagtgaagtcgccggacgcatggcttcgcagatcggcgcgcaatttcttgagaaatcaaaaggcggcaaaggcatcctgttatcgggcgtacccggtgtaaaacgcggcaaagtcacgatcatcggcggcggagtggttggtacgaacgctgccaaaatcgcgt

SEQ ID NO: 360 - DNA, 669 bp, Bacillus licheniformis
caaaaaaccgaaagtgacagtatatttggccggggactcgaccgtcgcagactgtcccccgcatgaagcgccgatggccggctgggggcagatgcttccgctgtttttctcagatgaggctgcggtcgtgaatatggcaaaaggcggggccagttcgaacagcttcattgatgaaggccggctcgatgacattacggagcggcttgcgcctggtgattatgtgttgatccagttcggccacaacgatcaaaaaccgtacggaacagacccttatacaacctatcaggagcatcttgtccgctatgtggaagcggttcgcgaaaaacaagcgacaccggttttgatcacttccgcagagcgcagacgttttgatcaaaacggaaagcccgccgacacactcggggattttccgaaagcgatgaaggcgctcgctgacagcttcgacgttccgctgatcgatttatggtccaaaacaaaagcgctctatgaatctctcggaatcgaaggttcaaaacggctgtttgtccactttcagcctcatgagcaccctcattatccaaatggaatcgaagacaatacccatttttccgaagcaggggcccgtcaagtcgccaggctggtgacagaaggaatcagagagcttggtctgcctctatcggcttatctgct

SEQ ID NO: 361 - DNA, 1290 bp, Bacillus licheniformis
accaaagcgctgtgaggtgccggaggaactgacttggaatcttactgatttattttcttcttatgaaacttgggaagacgcacttgtgaaaattgaggaagatctcgcatccatcggctcatttaaaggaaggctgcatgaaggagccggcgtattgctggattgtttatcgctgcgggagatactgctgaagcgcctagtccgggccgccgcctatactcacctcagaaagtccgaagatttgacaaaccccgtcaaccaagctgatgcttcaaggatggccgcgctgcaagcaaaaataaacgccgggctttcatttatccaatcggaaattcttgaattccccgaaaatcaagtggagacgtacataaaaaacgagaaaggactggagcctttcagcaaaatgctgacggagataatggaactcaagccgtataaacttgctcccgaaacagaggaagcgctagccgttttaggcgaaatacatgatgccccgtacaaaattttcgggatggcgaagcttgcggatatgcaattttccccgattcaggaccgaaacggcaatacactcgccaattcgttcgcgttatatgaaggaaaatacatgttctctcctgatacgcatattcgcagaaccgcattcgactcctttaccaataccctgcaaacatacaaaaacaccatcgccgccatctatgaaacagaggtcaaaaaacaggtcagcatgtcaaggctgcgcggatatgaatccgtcacccatatgcttcttcagccgcaaagcgtcacgctcgaaatgtaccgcaaccagcttgatgtgattaaaaacgaacttgcacctcatatgcgcaagtatgccgccttgaaaaaacgcgtattagacctcgacgaaatgcgcttctgcgatttgcaggctccgctcgatcacgacttcagtccaaagacgacttacgaacaggccggccggatgatcttggacgctttacaagtgatggggccggagtacacggaagtcatggaaaccgccttgactgagcggtgggttgatctcgctgacaatatcggcaaatcaacgggcgcgttttgttcaagtccgtacggagcgcatcctttcattttgatgacatggacggatacgatgcgggatgcctttacccttgcccatgaactcggtcatgccggccatttttactttgccaaccgagagcagcgcatcatgaatgtcagaccgtctctatatttcattgaagcgccttctacaatgaacgaaatgcttctcgctcagcattgttt

SEQ ID NO: 362 - DNA, 933 bp, Bacillus licheniformis
atggggaaaagtgtagtaatcgcactaggaggtaatgcaattttacagccaaaacaagaagcaacttatgctaatcaattcaaaaatgtaatctctgcaacacgtcatatgattgaaattaaagaagcaggacataaaattgtgattacacacggcaatggtccgcaagttgggaatattattgctcaaaatgaagctgccaaaaatgtcgttgaaccgctgccgatctatgcttgtaacgcagaatcacagggattcattggttatatgctcgaaaaagctttaaaaaaccatattaaaaaacggggcattaccgcgaatgtagctacatttctaacaatggttgaagtggacaagtatgataaagcatttgaaaaaccaacgaaaccaataggagtattttattcagaggaagaagcgaagaaattggagaaaaaagggtttgctatgtcagaagatgcagggcgtggctatagacgagttgtgccttccccagaaccgaaagtgatccatgggatagaagagattcgacgtttaattgatgaaacgattgttatctcctcgggcggcggcggtatacctgtatatcgtgacgacagcggtctattacatggtcttgaagcagtaatagacaaagatcgttcaggattaaagctggcacaacaattaaatgctgatgttttcatgatgttgacagacgtaccaaatgtgtttatcaattttggcaaagaaaatgagcaaaaactaagccgaattacagtagaagaagcagaacaatatgtggcagaaggtcaatttcctgctggcagtatgctgccaaagatgcaagcggctatagaatttgcaaagttaggtaaagaggcaattatttgttcattgaaccaagcggcagctgcactagacggaaaagcggggacgcgcataacaaaataa

SEQ ID NO: 363 - DNA, 822 bp, Bacillus licheniformis
gtctcgccaaaaagccgatcccgtctggcctgatccgggtgccgtttctgcagacggctgcgaccggcgattttgcttcctcaggcagaagcaaagtcggctatggaacgaatgatgaggcattgggcggtccattttcaaaagacgatacatgggtatttacatggcagggaaatgaacgaagctatttcagggtggaaacaaaaagccgctatacaggaaaaggctggattgaagacgaaaaatcaggcgcatccattcagcttgaagaggataaactggattaccagtggtacgacgaaagcgtgaagaccgaaacgcgcaaagcgatcgtcgatatcgatcccgcttaccggtacgatcatgtcctgtatccgatcgggacgaccgaaatcaagctcaataatttctttgtgccgctccgcatgaacttaaatacggagaaaataaaaccggccggcaagacaggcgcggacattcagaatctggaaagctattcggtcacctataaatcacccgtctttgatgtcgatcagctgaggaaagtcagcttggagtcggaggggaaatgggccaggagccatgagaagtacctgcagcttcccacttcccttcccgaccgcgtgaaaacattggcgcacgatttaacgaaagacgaagataatatatatgacaaagcgaaagcgattgagaagtatctcggttcttccgaattttcttatgagacggaagatgtcgctgttcctaaaggagaccaggattacgtcgatcagtttttatttgagacgaaaatcggctactgcgacaatttttccaccgcat

SEQ ID NO: 364 - DNA, 636 bp, Bacillus licheniformis
atgatcggtgtcatagattacggaatgggaaacctgtacagcgtttctaaagcgcttgaacggattgatgccccttattttgtgtccgagcatccggatgaactgaagagagcggacagctatatccttccgggagtcggcgcttttcgggatgcaatggagattttaaccgagaacggcctgaaaacatttattcaagctgccgcaaacgaaggaaaacctcttctcggcatatgcctcggcatgcagcttttgtttgaagaaagcgaagaacacggggcgtcagaagggctcggcctgttgaaaggaaaagtcgttaaactgaaagactgtgatcaagcgggaaatcgcttaaaagtgcctcacatgggctggaatcttctcaaagtccaccgcgactcgccgcttttgccaaaagcgaaagaaggattcgcgtatttcgttcattcgtattatgtcagcggaatcgaagaggaagctttgcttgcaagcgccgaatacggtgtgtgtgtacccgctgtcgtcggtcttggcaatgtatacggggcccagttccatccggaaaagagcagtacggtcggcatgttgatcttagagcggttcaagcagtttacacaagaacagaaggtgaaaaaa

SEQ ID NO: 365 - DNA, 811 bp, Bacillus licheniformis
atgaaacgaataggatttatcggagccggttcgatggctgaagcgatgattaaggggcttgtcaaaagcggtgcaatggaacctgaggcgatattcgttacgaatcagtcgaatacggccaggcttcgtgaattaagcgagacttacggggtatgcggagaagcagatacggcaaaagtcgccgcccggtcggatacactcgttttggcgatgaagccgaaagacgcggcaggaggaatagccgcactccgcccctatttgcgaaaagaacagctgctgatctctgttcttgcaggcattccgattcatactatccagcactatgccgggcttgagctgcctgttgtgagagccatgccgaatacatcggccgccattcaaaaatcagccacagcctttgcggcaagcccgcttgtcacgaaagagcagatgcaggaagcggctgacctctttgcgacggtcggcagcgttacaatcgttgaggaatctgcccttgatgctgtgacagccgtagccggaagcgggcccgcttttgtttatcggtttgtcgaagccctgcaggcgtcggctgccgagctggggcttcctgaaaaaacggcgaaacagctgattatcgatatgatggcaggagcggctcaaatgcttgaaaccggcagagatccttctgtcatgaggaaagagatcacaagcgccggagggacaacggaagcaggccttaggatgcttgacgaccatcaatttgaacagaccgtcatatcctgcgtcaaagaagcggcgaatcgttctgcggaactcagggatatgtttgccg

SEQ ID NO: 366 - DNA, 623 bp, Bacillus licheniformis
ttgaacatcttcctgagctatgtgtttttgggtttgtcattggccgcaccagtcggacctgtgaatgccgcgcagatcgacagaggcatgaaaggcggattctttcatgcctggctgtttggccttggcgctgtaacggcggatgtcctatatatggctttaatctactttggagttgcgcaatttttgacagcgccattcttaaaaacgtttttatggctgtttggtttttttgttttgacctatacggggatcgagagcctggtcaaggcgaaggaagtatcgctgatgagaggtgcgggagagaaagggtcataccgcaaatcttttttgtcggggctggtaatctccctttcaaacccgctgagcatcatgttctggctcggcatttacggaagcattttggcgaaaacggtagaggcgtacgaatcataccagctgctgatctgcagttcaggcattttaatcggactttttctgtgggacttggccatgtcttttctagccgggacattcagaacatttttaagcccgcggatgatccagggaacgacttggctcgcgggcatcagtctgatcgtatttggatgctacttcggctatcagggaattctcgaactgct

SEQ ID NO: 367 - DNA, 751 bp, Bacillus licheniformis
ttgaacatacgttttattacagtcatgatggccctcgtctgtctgctttcagcctgtacggagtggaatgcgggtgttgaaaaaacatcggtctcccctaagcgcgatatcgtgattgcagcggtgggcgattctctgacagagggggtaggcgatcaagaaaagaaaggctatgtcggcatggtggccgatgagcttgaaagccggagcgatgtgaagtccgtaacggtcaaaaattatgccgttaaaggctcccggactgatcagctgcttgaaagattaaaagacaaagaagtacaagagggcctgaaagatgcagactacattttgtttacaatcgggggcaacgacctgatgaaagtcgtccgccaaaacttcgcgcacttaacgctcacacctttccgtgctgaacaaaaactgtttgaaaagcggttttcgaatattttagcggaaatcagagagcaaaacgccagcgctgaattgatttatgtcagcatgtataatccgtttaagtttacgctgtctgaactgcgggaagttgaccaagtcgtagacgaatggaatgaaggcgcggaaaaaaggctgaagaaggtctccaacacgaaaatggcggatatcgctgatatttttgaggaatacagcgatgaaaagaagattgcagaagacgagtttcatcctaatcaatacgggtattctttaatagcgaaacgcgtttacgaacaaattaaaaacgaagacctcccagcagaat

SEQ ID NO: 368 - DNA, 1512 bp, Bacillus licheniformis
atgttttatgcctttaaagatttcgaaaaaaaagaaacgcttttaatcggactgtttaaaaaaagccggctgtacggtaaggctgaagaaatcgaccgccttttgaacggccagctttctcagctgctgaaagacggggatgtatcttccaaaaaagcgaaagtgtctaaaatatttaccccttcgcttcagggagtcaaacgcatttatatcgtcggattgggccgtgaagcggaatttaccttcgaggatgcgaagcagtgctttgccgaagctgttcagctgattcacaaagatcgaaagcaggagttaaccgtcatgctcgacagcttcgtatccgaagaagtcccagctgctgacgccgcacatgcattggctgaatcgtgcatgctgtcatgctatgaagtgcaggattacaagcacagatcaaatgtgcctgatcaatgtctgcaaagcgtctatgttttgacagaccatgacctgaaggagattcaggcgagtctgcatgtcggacaggtgtacggaaatgcgacgaattcggcgagaaccctcgtgaacatgccggggaacatgctgacagcggcggatctcgcgtcatatgccgctgaattggcggcgaaatacgaatttgaatgtgaaattcttgaaaaggctgaaatggaagagctcgggatgggcggtctcctcgcggtcaaccaaggatcagaagagccgccgaaaatgatcgtcttgaaatatcaaggaaaagaaacatgggatgacgtcatcggtttagtcggcaaagggattacgtttgataccggaggctattcgattaagacaaagagcgggattgtcggcatgaagtccgatatgggcggagccgccagcgttttgggagcgatggaagcgatcggcgaattgaggccggaacaaaacgtgcttgccgtgattccgtcgactgataacatgatttcgggaagcgcaatgaagccggacgacgtcatcgtttccttgagcggcaagacgattgagatcttgaatacggacgccgaaggaaggctggcgctcgctgacggactgacatatgcgaagcaccacggagcttccgtgctgatcgatgtcgcgacactgaccggaggcgtcgtcgtagctctgggaacggaaacgacgggagcgatgacaaatcatgatccgctttatcagcaggtgagacaggcggctgaagaagcgggagaagcgatttggcagcttccgattactgaaaaagacaaaaaaagagtaaaaaacagccaaatggccgatcttaacaattcaccgggcagggaaggccatgcgattatggccggaacgttcctcggcgaattcgccgagcagacgccatgggttcaccttgacatcgccggaacggcaacgacagctcaaaactcatgctttggaccgaaaggcggaacgggcgtgatggtgagaacgcttgtcacgtttgtcgagcgggtttcgggaaattttgtagtctttcattccctttgctag

SEQ ID NO: 369 - DNA, 754 bp, Bacillus licheniformis
gtgcacaaatcgaagaaaaagcgataaaggcaaaaacggccgcaaaatctttgcggctggcaactgaaaaagaaaagaacgaggcgcttgctgcattggccgaccacctgaaacaaaacatgagctatattctcactgaaaatgccaaagatatcgaagcgggacgaaaaaaaggctatgatgcagcctacatcgaccgcctgtcgctcaatgaagacagggttctggattttgccgatgggctgctggaagtcgcggaacttgatgatccggtcggagaaacgctatcaagctggacgctcgacaacgggttaaaagcggaaaaagtcagcgttcctctcggcgtcatcggcatgatctatgaagcgcgtccgaacgtaactgtcgatgcgaccgggcttgctctaaaatcaggcaatgcgatcgttttgaaaggcggctcttccgccattcattcgaatacagcgatcgtatcggtcatgcatcaagcgcttgattcgacaaacatcccccgcgatgccgttcaattcatcgaaagcacagaccgaagcgcaacgaagcagctctttaagatgaaagaacatatcgatgtactcatcccccggggaggcggggccctcattcaggaagtcgttgagaacgcaaccgttccggtccttgaaacgggagtcggcaactgccacatctatattgaccgggaagcggaccctgaaaaagcgatcgatgtcatgatcaatgcgaaaacagaccgccc

SEQ ID NO: 370 - DNA, 426 bp, Bacillus licheniformis
aagtcgatgacggcttcatgcacattgcccaatctgaaaatgagtacgatgtcatcatggtggattcaaccgagccagtagggcctgctgtcaacttgtttacaaaaggcttttacgccggcatagcaaaagcgctaaaggaagacggcattttcgttgctcagacggacaacccttggtttacacctgaactgatcacaaacgttcagcgcgatgtaaaagagatcttcccgattacaaagctgtatttggccaacattccgacatatccaagcggattgtggacgtttacgatcggttcgaaaaaatacgatcctcttgaagtggaggacagccgcttctttgatattgagacgaaatactacacaaaagaaattcataaagcggcattcgtccttccgaaattcgtcagcgatttaatcaaat

SEQ ID NO: 371 - DNA, 1266 bp, Bacillus licheniformis
catcgccagggcttcaatttaaaagattgatatatgcattcaaacttgcattcgggaaagaaaaagaatcagccggagcagacggtgatgtcagcaatttcaaggcgctgatgacaacgcttgccggaacgatcggaaatggaaatattgccggtgtagccacggcgattacggttggaggtccgggggctttgttttggatgtggctcgtcggtcttttagggatggctacaaaatacagcgaacgattgctcgccacgaaataccgcgtcaaaaatgagcggggcgaatattcgggcgggccgatgtactatgtcgaaaaagggctcgggaagaagtggaagccgcttgccgttttatttgcattgtcaggtgtgcttgcctcttttggaatcggggattccgtccagtccaacacgatttcggaagtcgttacacagagcttcgggattcccggctggatcatcggccttgtgctcgcggtattgacggctgcgatcatcttcggcggttttcagcgtgtcagcacggttgcgagcatttttgtgccggtcatggcgatactttatatcggcggatcactgatcattattttccttcattatgatcaaatcattccggcgttccagctgattttttatcacgccttcaacccggtgtcagccgcggggggctttactggcgtggtcgtctctgaggcgatcagaaacggaatgtcgaaaggaatcttttcaaatgaagctggtcttggtaccgctgctttaatcgcaggaaacgcgaaatccgatcaccccgtcaaggccgctttggttgcgatgacgggaactttcatcgttacattgatcgtttgtacgatgacggggcttgtcctcattatcacgggattctgggatccttcaggcggtctgctttctggtgttgcccacgatgcatcgcttgatgccggcgcgctgacaaacgccgcgtttgcttcttcgctgggagccgcgggcaaatacatcgtcacgttttcggtgattttctttggctactcaaccattgtcggttggtatgtatatggagaaaaatgtctggaatatttagttggtttaaaatgggtgccgctttatcgtgtcgtttatgtcattgctgcatattacggtgcagtcgcaagcctgaatactgtatgggcttttgccgacgcggcaaacgcattaatgatgatcccgaacttgatcgcccttgtgctcttatggaaagtcattcgggcggaaactgacgatttct

SEQ ID NO: 372 - DNA, 488 bp, Bacillus licheniformis
atggatatcttagaaatactaggcaagattaataaggtactatgggggccgcccagtttaattttattatttgggacaggcttatttttaacgattgttttaaaaggactgcaatttcgccgcctgatctatgcgtttaagatcgggtttggcaaagaagacagcaaagacgcggctgccgaaggggatgtgagccattttaaggctttgatgacagcgctcgccgctacgatcggaaacggaaatatcgcaggtgtcgcgacggcattgacactcggcggaccgggttcgatcttttggatgtgggttgtcgggctgttggcgatggcaacgaaatacgcggaaaccttgctggctgttaaatccccgcgtaaaaatgacaaaggggaatattcaagcgggccgatgtattatatcgaacacggactcggccgcaaattaacaggactcgccatcgcctttgcgctgtttggaacctttgccccttt

SEQ ID NO: 373 - DNA, 1404 bp, Bacillus licheniformis
atgaaatcccgccatttgtttatgatctcgcttggcggcgtcatcggaaccggcttttttctcggaacaggttatacgattaatgaagccggaccgatcggcgcgattctttcctatttagcgggcggaatgatcatgtattttacgatgctctgccttggggagctcgctgtggcaatgccggtttcaggctcttttcagacgtacgcgacaaaatttatcgggcctgctacagggtttgccgtcggctggatctattggctcggctggtcggttactgttgctttggaatttttgtcagcggggcagctgatgaaaagatggtttcccgatgtcggcgtctggatatggtgcttgattttcgggctgctgcttttttcactcaatgctttatcggcaaaggctttcggggaatcggaattttggctgtccggcatcaaaattatcgtcattcttctgtttattattctcggcggaggcgcgatgttcggactcatcgacttgaaagacggacaggctgcaccgttcttttccaatctgattggagacggaatttttccaaacggattcggcgcgatctttatcacgatgatcaccgtcaactttgcctttcaggggacggagctgatcgggatcgcggcgggggaaagcgaaaatccggaaaaaacggtgccccgctccatcaaacagacggtctggcggacactggtgtttttcggcctgtccgtatttgtactggcgggattgattccatgggaaaaagcgggggttgttgaaagtccgttcgttgtggtatttgaacaaatcggcattccgtatgccgccgatctgatgaactttgttattttaattgctttgttatcggtggcgaattcgggcttgtacgcatcgacgaggatgctttattccctggcgaaagagggaatggccgctcaggctttaagccgggtcaataaaagaggtattccgatgaatgcgctttggatcacgctcggttttgcgggtttgtccctcatctcaagcgtagtcgcagcagaaacgctctacatttggcttttgtctctagccggtttaagcgcgcaagtcggctggatcacgattacggtatcacagctgctatttcgcagacgatatgtcaaagaaggcggaaaggttgaagacttaaaatttaaaacgcctctttatccttatttgccgctgacgggatttattttaaacagcgccgtccttgtgagcctcgcttttgattcagagcagaggatggcattgtactgcgggattttattcatgtcggcctgctactttgtttatcacgtgtttgtgaaaaaacgccaggctcttgatcgacaagaagcaatgatctatcaaaacaaaacaaacgatgaggtggttattgatgaataa

SEQ ID NO: 374 - DNA, 1404 bp, Bacillus licheniformis
atggaacagacaaaaaaatggggcttctggcttcttacggcttttgttgtcggcaatatggtcggctcagggatttttatgctccccagcacactcgcccagacggctagcccgctcggcgtaacggcggcatggctggtgacgggtgcgggggtgctgatgatcgcccttgtattcggccatttatccattcgccgcccggatctcaaagcaggtccgcaaagctatgcaagagctttattctcagaccctaaaaaagggaatgcggcaggttttacaatggtatgggggtattgggtggctagctggatcagcaacgtggccatcattacaagccttgcaggctatttgacgactttcttgccgatcttaaccgacggacgcgagctggttgaattcggcggacaccccgttacacttggccagctcttgacattcatcgtgtgtacgattttgttatgggggacgcattttatcctagtctccagcataaatggagcgggcaagctgaactttttggcgactttttccaaagtgcttgggtttgtcctgtttattgttgcaggtttgttcgtttttcaaacggcattattcgaatcattttattttccaatcgaatcagaaggcaaaagcatagggctgggcggacaggttcacaatgcggcgatttcaacgctgtgggcgtttgtcggcatcgagtctgcggtaatcttatcagggcgcgcatcatcccagcgtgatgtcaaacgcgcgaccattaccggcctgttaattgcgctcggcatttatatgatcatcactttaattacgatgggcgtcatcccgcacgatcagctccaggcatcagataaaccgttcgttgatgtgctgcacgtgattatcggcagcttcggcagcgtgattatggcggtcttggcaatcgtttctttgttcggatcgatgctcggctggattttaatcggcgcagaggttccgtatcaggcggcaaaagccggtgattttcctgctttctttgcgaaaacgaataaaaagggaagtccggtcaattcattgatcgtcacaaacgtgatgtcgcagatctttattttctcaacgatttcgggaacgatcagcgaagcctttacgtttttaacaacgtcggcgacgctcgcttaccttgtcccttatctcatagcggctcttttcagcttgaagctcatcctcaaaggggagacatacggcgagctgaaaggttcaagaacaggagacggcatcattgccttggccgctcttgcgtactctttatgggtcatcgtttcaggcacgtctgacttgaccacctttatcttgggaatcgggctgtttttcgtcggtcttgcgatctacccgttcgtctacaaaaagttcaaaaataatcaagtgtga

SEQ ID NO: 375 - DNA, 425 bp, Bacillus licheniformis
gtgcatacgctagaaaaaatggagcaaacaaatttccagacggcgagagattatgtgacacaagcatacgagacagtacagaagcgaaatttttacgaaagcgaatttcttcaagctgtaaaggaaatatttgattcccttgtccctgtattggcaaggcatccaaagtatatcgaacaccgcattcttgagaggatcgcagagccggaacggatgatcaccttcagggtgccgtgggtcgatgatgaaggcaatatccgggttaaccgagggttccgggttcaatttaacagtgcaatcggtccgtataaaggcggcatccgctttcacccttctgtgaacgcgagcattattaaatttttgggttttgagcagatttttaaaaattctttgaccggactgccgatcggaggcggaaaaggcgg

SEQ ID NO: 376 - DNA, 529 bp, Bacillus licheniformis
atgaaaaaatggatgttactggtagtgacagcatgtgtcacatttgcattgactgcttgcgggacgagcagcagctctgatgataaaaaaacattggtgatgggaacttctgccgattacccgccttttgaatcgaaagacggggataagattgtcggttttgatgttgatctggccgaagcactggctgaaaagacgggccatgaaatcgaagtgaaagacatggacttcaacggcttggtgaccgctcttaaaacaaacaaagtcgacattgtgctttcaggaatgacgccgacgcctaaacgcaaaaaacaggtcgatttttcaaatgtctactatacggctcacaacatgatcgttacaaaaaaatcaagcggcatcaaatcgcttgacgatctgaaaggaaaaacggtcggcgtacagcttggctccatccaggaagaaaaagcaaaggagctcacgccggattacgatttaaaagttgaaaaccgcaaccgcatttcggatttaactgaagaaatcaaagcgg

SEQ ID NO: 377 - DNA, 729 bp, Bacillus licheniformis
atgacatggtggtcgtcagctcaaggaatgacgggaaaacagaggagctgaaaaagctttatccgaatgtcgcctgtcaatcagctgatgagctcgccaaacagtgcggcctgatcttcatctgtgtaccgccgatggcggtaaaagaaacgcttgaaaaaatacagccgtttcttcaggaggatgtccacatcgtttcgattgccgcgggggtcgagcttgaccggcttcacgactggacaagcggacaggtgacgagatacattccgacactcacatctgaagccgggatcggcgtttcgcttgttgtccacggcgagcgggtcgctgaggcggacaaaagccggctggaagaatatctttccgccttcagcacagtcaaacagatcaatgagagagatattgacgctgcgagcaatttaacaagctcttcaccggggttcatcgcttcgatttttgaagaatttgctcaagccgccgtcagaaacagcagcctcacgaaagaagaagcgtttcaatttctgattcattcattgctgggaacaggcaagctgttaatggaaaaagacatgacgtttgctcaaacgcttgatcgggtggcgacaaaaggcggcataaccgcagaaggtgcggaagtcattcaagatgccatgccggaagtctttgacgagctgtttgccagaacgatgaagaaatatgaagtcatcaaagacgctgtccgccggcagt

SEQ ID NO: 378 - DNA, 423 bp, Bacillus licheniformis
gcaaaggccgattgagctaggcgctgatcttgtcattcacagcgcgacgaagtatttgggcggtcataacgatcttttggcggggcttgtcgtcgcaaaaggcgaagagctgtctgaggaaatgttccagcaccaaaatgccatcggcgcggttttatcgccgttcgattcgtggctcttaatgagagggttgaagacgctcgctcttaggatgagacagcatcaggaaaacgcgcgggagctcgcggcctttttggaagagcaggaggaaattgccgatgttctttatccgggaaaaggcggcatgctgtcattccgcgttcaaaaagaagaatgggtcaatccgtttctaaaaaatctcaagacgatctgtttcgccgaaagcctcggcggagtcgaaagcttcatcacctacccggcgac

SEQ ID NO: 379 - DNA, 660 bp, Bacillus licheniformis
ccagcctgcagggatgatctttgaagccgtacaaggagaaggaggctcagttccggcccgggctgaatggataagagaaatgagaaggattacaaaagaacgcggaatccctctgatcattgacgaggtgcagaccggcatcggcagaaccggcaaaatgtttgcgttcgagcacgccggcattataccggatgtcatcgtcctttcaaaagcgatcggcggaagccttcctctgtctgtcgtcatctatgatcaagaccttgatcagtggggacccggggcgcacatcggcacattcagagggaatcagatggcgatggcggccggaagtgcaactttaaaatatataaaagagcacgatgtgctatcacatgtagaaaaggtcggagcgaagctcatgcgggaattgcaagacattcaggagcacgttcccgaaatcggcgatgtccggggacgagggctgatgatcggcgccgaaattgtcgcaccgcataaaaagcaaaacgcaaacggcagctatccggctgatgcggagcttgcaagcacgattcaaagaaaatgctttgaaaaaggactgatcgttgaaacgggaggccgccacggaagcgtgatccgcttcttgccgccgcttatcgtaacagaggcgcaaatcgacgatat

SEQ ID NO: 380 - DNA, 1245 bp, Bacillus licheniformis
aagcaaaatcggagagaaaatgattgagaaaacaggggtcagggctgtgatgagcgatattcaggaagtcctggccggcggtgaacggtcatacattaatttaagtgcgggcaatccgatgattttgcccggcgtgtcagccatgtggaagtcggctcttgccgatctccttgacgatgacaggttttcttcggtgatcggccaatacggatcgagctatggaaccgatgaactgattgcaagtgttgtccgcttcttttcagagcggtatagcgccggcattcgaaaagagaacgtgttgattacagccggaagccagcagctgttttttctggcgatcaattcgttttgcggaatgggaagcggatctgtgatgaaaaaagccttgatcccgatgctgcctgactattcgggatacagcggggcggcactggagcgggagatgattgaggggatccctccgctcatatcgaaattggatgatcatacgtttcgatatgagctcgaccgtaaggggtttttagagaggatgcgcatcggtgctgtcttgctatcgcgcccgaacaatccttgcggaaacatcttgcctaaagaagatgtagcattcatttcagacgcatgccgagaagcgaatgttccgctgttcattgattccgcatatgctccgccttttccggcgattcactttatcgacatggaaccgattttcaacgagcagatcattcactgtatgagcctttcaaaagccggcctgcctggcgaaaggatcggaatcgccatcgggccgtcccggtatattcaggcaatggaagcttttcagtcgaatgcggcgatccattcttcaaggctggggcagtatatggctgcatcagtattgaatgacgggcgcctcgccgacgtgtcgctgaatgaagtcaggccatattaccgcaataaattcatgctgctcaaggaaacgcttttatgcaagatgcctgaagacatcaaatggtatctgcatcaaggggaaggatcgcttttcggatggctgtggtttgaagacctgccggtgaccgatgcagcgctgtatgagtatatgaaagcggatggagtcattatcgttcccggatcatctttctttcaccgtcaatcccggcgcctggcgcattcacaccagtgtatacgaatcagcctaaccgcggcggatgaagatattataaggggaatcgatgttttagctaaaattgcgaagggtgtatatgagaa

SEQ ID NO: 381 - DNA, 606 bp, Bacillus licheniformis
cccaatccggatggttttccagcaagggtttctttggggcttggcgccggctcgtcaaaaaggggcagcatcacgaatcctttggtcatcatggatcaaaaaacaggggtatcggggcaggcaaaaagccgtcaatgggcactcatttttcagaggtcaatgacaattttaaaatatacaaggtaaacgaacaccagcacacgcctgaaatcgagcagactgtcaaacagtggaactccgcatttaaaccgatcacattcagcacgcatttagttccaatgacaagaggcattatggcgaccatctacacagagctgaaagacagcatggatgccgaacagctgcagcttattttttctaaattttataaagattcatactttgtcagagtgagagaaacgggttcgttccctgccacaaaagaggtgtacggcagcaatttttgcgatatcggcgttaccgtcgatgaacggacgaacagagtgacaatcgtgtcagtgatcgataacttgatgaagggagccgcgggtcaagcggttcaaaacttcaacattatgaacggcttgagcgaaaccgccgggcttgaatttacgccaatttatccat

SEQ ID NO: 382 - DNA, 1104 bp, Bacillus licheniformis
tcgaggtgtatcagttcgatttcggtgacgggcctcttgcttcgggttttattccggtaggcgctgcttcggcctatacccctctaaaaggctacggatttgacgacgcggcaaaggtgtcctgcacggaccgaggtacggccgacccgcttcgttcagacttctgcattccggatgggacggcgtttactgtcgatttgcctgacggtcaatatcaagtccaaatcataaccggagatgcgcgggcaaagacgaacatggacgtacgggcaaacggcatgctccagctgtattcgtttggagcggaagcgggcggatacaacgaaaaaacgtttccgattcatatttccggcggccgtctttcgatccaagccttaacggcgagaacaatgccgcgccttaatgcgttggtcattacgaagacggcttatcatgtgacggatgacaacacgacggtctttctggcgggcgattccacggtctccgattatgagcccggctatgcgccgatggcaggctgggggcaatttttaggcggctatttctcggatgaaatcgtcatcgacaaccaggcgaaacgcgcgagaagcgcgaaaagttttgtggatgaacggtcgctggctacgattttgaaccggatgaaacggggcgactatttgttgattcagttcggcattaatgacgcagggcaagatcctgcccgccatacagatccgtatacgacatttcaggaatacttgagaacatatattaacaaagcccgcgaaaaaggaggacgtcatgtgctcgtcacttctcaaagcaaacgtacctatgatgaaaagggcgttttctacaacagcatcggagaatatccgaacgcaatgagacagctgggacgggaaatgaacgttccggtgatcgatttaaacaaaaaaagcattgaatattacaacgagatcggcgttgaagcgactaaaaacgtatttatgtttctggaaccgggagaaagcccgaattatccggaaggcatccaggacagggtgcattttcacgagttcggcgccaaccaattggcaaggctcgtcacaggagaaatctccgatttgaatatatatccgctga

SEQ ID NO: 383 - DNA, 631 bp, Bacillus licheniformis
atgacgcttcaatatacggctctcggcgactctttaaccgtcggggtcggtgcaggtttgtttgagccgggatttgtacagcgctataaaaggaaaatggaagaggatttgaacgaagaagtttctttgattgtatttgcgaaatccggtcttgagacgtcggaaattttagcgatgctgaacgagcctttcatcatggaacaggtcaaaaaagcggacgtcatcacgataacgggctgcggaaatgatcttctgcaatcgctggagatatatgaaaaagaaaaggatgaacacgtctttttggaagcttcctcccactgtcagaaaaactactcaggcatgcttgagaagatcagagaaataaagggagaaaaagatacgcgttatctcgtccggcttctcaatttatacaacccatttccgtcaatcgaattagcggacaaatggatttccggctttaacaggcacttaaagcagctagagtccgctccgcaaatcaaggtgatcgatacttatgctgtctttaaaggacgcgaaaaagaatatttgtcaattgaccgtgtgcatccaagcagcagagggtatgaagcgatgtcggaaaagctgagagcggcgggctacgggcggctgg

SEQ ID NO: 384 - DNA, 612 bp, Bacillus licheniformis
tatttgttccgtttattacagcgggagacccgctgccagaaatctcgatcgagctggcaaaatctcttcaagaggcgggagcgtccgcccttgaactcggggttccgtattctgatccgctcgctgacggcccggtgattcagcgcgcatcaaaaagggcgcttgacaacgatatgaacatcgtaaaagcgatcaggcttggcggtgaaatgaaaaaaaacggcgtccatattccgattattctctttacgtattataatcctgtgttacaattagatacagatcactttttcgctttactgcgacaaaatcagctagacggactccttgtaccggaccttccttttgaggaaagcgtatatttgcagcagcagtgtaaaaaacacgggattacctatatttcgctggtcgcgccgacaagcgaatcgcgcattcaaaaaataacgcagcaggcggaaggttttgtgtattgcgtttcttcgctcggtgtcacaggtgtgcgcaatgaattcgaagattctgtttcttcatttatcaggtctgttaaaggaatgagctccgtcccggttgccgtcgggtttgggatttccagctccaaacaagtggagatgg

SEQ ID NO: 385 - DNA, 375 bp, Bacillus licheniformis
  misc_feature (1)...(375): n = A,T,C or G
cccgcctgcccaggngcctgaacgagacatgctgatcttcgttcttgaaagaggaaaaacggcagacgagattcatacaactgaagaacacaatttgccggaagtgctgaagagaacgctcggcctttcagatgtcaacttgatcttctgcggcggcggagacgaaattgcttcagccagggagcaatggaatgacggctccaatacactcgcgatcgctccgggggttgtcgtcacctatgaccggaattacatttctaacgaatgtttgagagaacagggcattaaggtaatcgaaatcccgagcggggagctttcaagaggacgcggcggcccgcgctgcatgagcatgccgctctaccgagaagatgtgaa

SEQ ID NO: 386 - DNA, 459 bp, Bacillus licheniformis
ttttggattttgatacatttgatgaaagaatcaaagattcgatccgtctagccgaagaaaagggaatcgccatcgagttccgggaagaagaagcggtaccgaagcatcccaatacagcccgcatcctcatctctgatgatgaaggctcccttgaactcgcaggcatctcaatcggcggagggaaaatcgagatcattgagctgaacggcttcgaactcagattatcgggtaatcaccccgctattttagtcgtccataacgaccgctacggaacgattgcaggcgtagccaatgtgcttgcgaagttcgcaatcaacatcggccatatggaagttgcccgcaaagacgtcggccaggaagcgctcatgacgattgaggtcgatcaaacgattgatccggctgtttttgatgaattgagagcgctgccgaacatcattgaggtgacccagatcgctgact

SEQ ID NO: 387 - DNA, 428 bp, Bacillus licheniformis
attttgaacttgtcggtgcaatcgaccgtacatataaccgtgaaaagctgtcagatgtgatgacgtcaagttcagatgctgtcatttacaccgatatcacggaatgcttttcagaaacgtctccggatgttctgattgatttgacaacgccggaaatcggcaagctacatacaaaaatcgcgttggagcacggcgtccgtcctgttgtgggaacgacaggattttctgagagcgacttgaacgagcttatggaactgaccgatgagaagggaatcggagctatcatcgcgccaaacttcgcgctcggagccgtgctgatgatgaagttttcgcaaatggctgccaactattttaccgatgttgaaatcattgaacagcaccatgatcaaaaacttgacgcgccaagcggaacggccttgaaaacggcg

SEQ ID NO: 388 - DNA, 573 bp, Bacillus licheniformis
agggatgctttctatgcctgtacaaacgagttctaaaaatcaagtgtttttggagcagcaaaatagaagagaatctaatgcgcgttcatatccgagaagatttccgctcgccatgcagacagcggaaggcgtcttggtgactgatgcggatggaaagcaatattatgactgtctggcaggagcggggacgcttgcgcttggtcataatcatccagttgtgattgaagcgattcaaaaaatgattgaggaaaaacgcccgctgcacacccttgatattacttcggaaatcaaagaggagtttgtcaacgaagtatttgcaagccttcctgaggcgtttgccaaacgggcgaagatacagttttgcggtccgaccggcggcgatgcgatcgaagccgctctcaagcttgtcaaaacggcgactgggaaaagaaccatcctatcgtttcacggcgcctaccatggagcaactcacggaacgatggcgctgagcgggaatttatctcctaaggaaaacgtccagggtctcatgcctgatgtgcatttcctgccatatccgtatgaataccgctgccc

SEQ ID NO: 389 - DNA, 498 bp, Bacillus licheniformis
aataagagataagaatattgtgctgatcgggtttatgggcgtcggaaaaacaaccatcggccagcttgtgtcaaagaaattaggccgtgactttatcgatatcgaccacgagatcgaaaaagactttcaaatgaccattccggagatgtttcagcaaaaaggggaagcgtttttcagacagacggaaaaagaatatatttttcagatgtgcgaacatacaatgggcaacatcgtatccttagggggcggcgcttttcagcaggaggaaatcagaaagaagtgcctcgaacactgctttgtcatctttcttgatttaagatgggagaattggaagcagcggatggatctcttgattgaaaacaggccggttcttcataaccgcacaattgaagaaatgaaacagctgttcaatgaaagaaagagcatttatgcatttcaccatttaaaagtgaaaccgataaccgtgttgccgaagaaacgggccgactatattgtgga

SEQ ID NO: 390 - DNA, 651 bp, Bacillus licheniformis
atcttgtgcgtgagtcattttggccgatctttttaaggggaatctattactcgattccccttgccattctctcttttatattcggtatgatcatcgcattgatcacggcgctggcgagaatgtccaaatcccgcattttaagagcggttttcggcatttatgtctcagcgatccgcggaacgccgctgctcgttcagctgttcattattttttacttgtttccagcgtttcaagtcacgatcgacccgtttccgagcgcaatcattgccttttcattaaatgtcggcgcttatgcgtcggaaatcatcagggcttccatcctttccgttccgaaaggacagtgggaggcggcttattcgattggaatgactcaaaaaacggcgcttaccagggtcatcctgccgcaggctgtgcgcgtgtcaattccgccattatccaatacattcatcagcttggttaaagatacatcgcttgcgtcacagattcttgttgctgaattattccggaaggcccaggaaatcggggccggcaatcttgaccaaattttaatcatttatatggaagccgcattcatctattggatcatctgctttgttctcgcgcttgttcagcagcagattgaacggcgtttggaccggtatgtggccaagt

SEQ ID NO: 391 - DNA, 444 bp, Bacillus licheniformis
tcgcatcaggcgtctggaccggcgaaaacgcatcaagcgatccgggggcgctggccgcagccgcatttcgcagctattttggccctgggggcggatacttcgtctctgtctcgctcgttttctttgtcttatcaacgatcacagtggtcattttttacggtgtaaaacaagctgaatttctgttcggacggctcgcgggacatgtgattaaattcatctacctggccgccgtcgtcatcggtgctgccggaggagcaaaggcgatatggggattcctcgatctcgcgctcgttttcattcttcttccgaatattttggcggtgctgctcttgagcagaaaagtaaggtctttatatgatgagttttttacatcagaaaagtattatttgaaagacatcggtcagcaggacggcgtttatgaaggtgacgaaaaagtgaacaatt

SEQ ID NO: 392 - DNA, 447 bp, Bacillus licheniformis
ctacggcattcgcaaagtcaaactgccgaaaaagacatttggcgtttttgaacacagaataatggagaaaaatgaaagactggtcagaggctttgaagagttctactatgtcccgcactccaggcatacagatatcaatatggatgaccttaaagccgtttcccatttaaaagtgctcagcatatccgatgaagcgggcgtctgtttaattgcttcaaaggatgaaaaacaagtttttttaactggacatcctgagtatgatacagatactcttaaagaagagtatgaaagggatttagccaggaacatggagattgatccgccggtgaattattttaaagaagggccggatggcgcggtacctgtaaaccgctggaaagcccatgcgactcttttgttcatgaattggctgaactactacgtttaccaggaaacgccgtatgagtg

SEQ ID NO: 393 - DNA, 831 bp, Bacillus licheniformis
gacagggctgattctcgtcattctcgtcagcgtcattatcttcggcggcatccagcggatcagcaccgttgccagcttctttgtgccgatcatggcttttctttacatgggcggggcgatcttgattctgattttgaattatgacaagattattccggcttttgcgctgattttttattatgctttccaccctgtagcggcagccggcggcttccttggaattgccgtatctgaagcggttcggaacggggtatcccgcggtattttctcaaacgaagcaggccttgggacggcggcgctaatcgccggaaatgcgcgcgcagaccatccggtaaaacaggcgctcgtcgcaatgaccgggacatttatcgtgacgatcgtggtgtgtacaatgaccggtttaacccttatcattaccggtttctgggacccgtccggcggcttgatatcaggcgtggcccataatgccagcctggaaggcggggcattgacaagcgcagcttttgcttcagtactcggcgcggcaggcgaatacattgtgtctctgtcggtcattttctttggcttctctacaattgtcggctggtatgtttacggagaaaagtgcttcgaatatttggcaggcgccaaaggaattgcgggctacaggctggtctacatcctcgcctgcggcatcgggacggttgccaacctcgtcaccgtctgggcgtttgccgatatggcgaatgcgctgatgatgattccaaacctgatcgccatcctgctgctttggaaagtcatcaaagcagagacaaatgattattttcaccacttctatgaacataccaaatc

SEQ ID NO: 394 - DNA, 942 bp, Bacillus licheniformis
gaggagagcttttggttaaagtgctgttgacgctcaacggactgttttaccgcgctgcgccgcgcttgagagaaagggtcgaacggctcggcgccgaatttgcgtttttggattcaaatcggttgacgagacaggatttactgactcatatcaaggatgtccatatttatatcgccggcgttgaaaaagcggaccgggagctgatcgacgccgctccgggactccggtatatcatgaaattcggcgcgggaatcgacaatattgatgtggaatatgcaaacgaaaaagggattctcgtcacgaatgcacccggctaaaatgcctcggcggtcgccgatttggcattcggtcttctgctgtctggcgcccgttcgatcccgcagtcaaacgcggcagtcaaagcgggcttatggcaagcggcgatgggctatgagctcgatggaaaaacgctggggcttatcggttttggggaaatcggcaaaaaggttgcaaggcgggctgccgggtttaatatgaacgttttggcgtacggcacatacaaagactacaatgcagccaaacggctgaatgtgaggttcgccgagcttgacgatctcctggaaaaatcggactttgtatgtatcagcacatcattgagacctgccacctatcatttaatcaatcaagaaaaactggcaaaaatgaagaaaaccgcgtacctgatcaacattgcccgcggagaagtggtggacgaaagcgcgcttattcaagcgcttgagcaaaaacagatcagaggcgcagcattggacgtctttgaaaccgaaccgccggctgcccggatcgccggtctcagcaatgtcatttgcacggcgcatatcggcggcgctacgtatgagagcatcaggcgcatcgaagagatgacatatcaaaacatcaaaaggtttatcgaaaaacagcagccgg

SEQ ID NO: 395 - DNA, 347 bp, Bacillus licheniformis
atgatgcctcgaacgatcatcgaaaaaatttgggatcaacacgtgattaaaaaaggtgaagggaagcctgaccttctctatatcgatctgcatctgatacatgaggtaacgtcgcctcaggcctttgaaggcctgaggcaaaagaacagaaaagtcagacggcctcaaaatacgtttgccacgatggaccacaacattccgactgtcaatcggtttgagattaaagatgatgtcgctaaacggcaggtcagtgcgctcgaacggaattgcgaagaattcggcatccgccttgcagacttgtcaagcgtagaccaggggatcgtccatgtcatcgggccctgaactgg

SEQ ID NO: 396 - DNA, 348 bp, Bacillus licheniformis
gggcatgaaagaagaatttgaatgggcaaaagaaaacggcatgcacatttctaaatttgaagtgcttgagccgcttaaagccgtcctgccgaaactcgcggggcgtccggtttatgtgacgatcgacatcgatgtcttagatcccgcgcatgcgccgggaaccggtacggttgacgccggaggcatcacatccaaagagctgctcgcttcgattcacgaaatcgcccgctcagacgtcaatgtcgttggaggagaccttgtcgaagtcgctcctgtctatgaccattcggaacaaaccgcaaatacggcaagcaagctgattcgcgaaatgctgctcggctgggtgaa

SEQ ID NO: 397 - DNA, 1104 bp, Bacillus licheniformis
atggaacagtatcaatgtcattcttgccgtacgaaatacaatgtgtctgaacaggtgtggaaatgccagtgtggcggagtgttagaccttgtaaaagaaaaagtagaatggtccgattcaaaagtgctcaaagatattccttctatgtggagatatattgaagctatgccatttgatcgcgactccgccatatggagcggcatcaccatgggggagggatacacgcctttaatcgtgttagacagcggggagccgaatactcttgtgaaagtggactatatgatgcctactttgtcttttaaagatcgcggtgcggctgtattaatagctaaggcaaaggagctgggagtgaagcatgtgatcgccgacagcagcggaaatgcagggacatctattgcagcttacgccaagcgggctgaaatcgcatgtgacatctttcttcgaaagggtacatcgcctaagaaaatcgcgcaggcgaaagcgcatggagccaacgttcgcgaaattgaaggcacaagagaagatgtggctgaagcagcgcaaaaggctgtggatatagagaaaaaattctatgccagtcacgtttttaatccatatttctatgaaggaacaaaaacgtatgcctttgagatttgggaacaaatgaatggagcgccggatacgcttattattccagttggcaatggtacgttattgcttggggtttactatggatttaaagagttattagagaacaaatgtatagacaaaatgccaaggctggttgcgatacaggcagagaattgtgcgccgttggcaaaggcatttatcaacaatcaaaaagctgctgaacccgtcaaaagcagcggaacacttgcagagggcatcgcgattgccaaaccggcaagatctgctcaaatattagaaaccatccgtgccacaaacggtcaaatcattacaaccaatgaggaagagattctaaaagctcgtacagcattagcaagtaaaggcttttatgttgagccaacaacagcggctaactatgcaggatatttaaaatacagtcattcttctgatgaaaaaatcgtgattccattatgcggggctgggattaaatctaattag

SEQ ID NO: 398 - DNA, 581 bp, Bacillus licheniformis
  misc_feature (1)...(581): n = A,T,C or G
aaacagctgtgntgcatctttttaaccctcggagtcagaagtttcggcctgacatggaactgggccaatacgttcgcagacggcgctttagaagaaagaaacgccggcttgacttcttacggggaaagactgattcgcaaggcgaacaaaaaccgggcatggacagatctctcccatttatccgaaaaaagcttttggggtgctattgaaacggcggcgtatccgatcgcctctcattcgaatgcccgcagcctttgccctcatccgagaaatttaaaagacgatcaaatcaaagcgcttattgataagaacggcgtcatcggcttgacatttgaccctgaattcgtgagaaacggaaaaacacctgtgatcaaagatatcctctcgcatattgaccatgtctgctctttaggaggcgagcggcatatcggattcgggtctgattttgacggcatcgaccgtgtcattccgaatcttgaagcccacaaagattacgggaatctgatcgaagcgctgcagcgctcatatacaccaagtcaagtcgacggatttctctttcaaaatttcatcagccgcatccc

SEQ ID NO: 399 - DNA, 483 bp, Bacillus licheniformis
taagccacagcgccgatattttttctttaaatgaagcggttgttaaaacagggcttgccgatgtgattgatatcgagctgttcaatgacgaagagcaagtgaaagcgctggtggaaacagcacatggtcatgaagtgtccgtgattatatctaatcatgattttgaaaagacaccagctgcagaagaaattgtttcccgtttgcgaaaagcacaggaattaggggctgatctgcctaaaatcgcggtgatgccggaaaccacggctgatgtcttgcgtctgcttgaagccacttgtacgatgaatgagaagtatgcagatcggccgattattacgatgtcaatggccggcaaaggtatcatcagccgcctggcgggcgaggtattcggttcagcaatgacgttcggtgccgcaaagaaagcttcagcaccggggcagattgcagctggtgagctcaaggaaatccttcatatattgcatcgca

SEQ ID NO: 400 - DNA, 1020 bp, Bacillus licheniformis
atgtcctttttattttgtcttttttgtataactattcaaaaaaatgtcttgttgagtcaattccgaatcggaaggtacaatgaaggtctgaaagggggatatcatatgttaaaacagcagatttcaatgatcggcgtgccgatggatcttggacagctgaggcggggagtcgatatgggaccgagcgcgattcgctgtgcaggtgttaatgaacggctggaatgtctttgtcaggatattgaagacctcggcgatatgacgatcgggcaaagagaggatgagaaagaaggcggggagccggcatctgaagagctaagaaatttgaaagcgattacaaaagcgagtgtaaaacttgctgagactgtcgataatatcgtagcttctggcgcttttccgctcgtgctgggcggtgaccacagcattgcgatcggaacgcttgccggccttgcgaagcattatcaaaacctgggtgtgatctggtatgacgcccatgccgatttaaatacaaaagaaacgtctccctcaggcaacattcacggcatgccgctcgccatcagcctgggaatcggccacgaagggctgaccgccatctatggaaaagaagctaaaattaaagcggagaacatcgtcatcatcggtgcgaggtcacttgatgacggggaaaaagaattgattcgcgacaaagggatcaaagtatatacgatgcatgaaatcgaccgcctcggcatgacaagggtgatggaagaaacgatagactatttgcgaggcaggacggacggtgtccatctgtcactcgatttggacgcgcttgatccgaacgatgcaccgggtgtcggaactccggtagcaggaggcatcagctacagggaaagccatctggctatggaaatgcttgaggaatcgaagctgattacgtccgccgagtttgtcgaagtaaacccgatattggatgagaaaaacaggacggcggaagcggctgtagccttaatgggatcgctgtttggcgaaaagctgctttag

SEQ ID NO: 401 - DNA, 957 bp, Bacillus licheniformis
gctagagaatgtatcaaaggtttataaaggcggaaaaaaagcggtcaaaaacattaaccttgatatagcaaaaggtgaatttatcgtctttatcggaccgagcggctgcgggaaaacaacgacgatgaaaatgatcaaccgcttgattgaaccgacttcaggaagcatttacatcgacggagaaaacataatggatcaggacccggtggagctgcgccggaaaatcggctatgtcattcagcaaatcggactctttccccatatgacgattcagcagaatatcacgctcgttccgaggcttttgaaatggccggaagaaaagcgaaagaagcgggcggaggaactgctgcagctcgttgatatggggccggaatatttgaaccgctaccctcatgaactaagcggcggacagcagcagagaatcggcgtgctgcgggcgcttgcggcagagccgcccctcattttaatggatgaaccgttcggagcgctggacccgattacccgtgattcgcttcaggaagagttcaaaaagcttcagaaatcgctggacaaaacgattgtctttgtaacccacgatatggatgaagcgattaagcttgctgacagaatcgtcatccttcgcgccggcgagatcgtgcaagtcggatcgcctgacgacattttgcggaaaccggcggatgaattcgttgaggaatttatcggaaaagagaggcttcttcagtcccgtcctgacatcgagcatgtcgaacaagtaatgaacccgaatccggtcacgattacgagcgaaaaaaacctgactgaagcaattcaagtgatgagggaacgccgcgtcgattcactgctcgtcgtggacgaacacaatgtcttaaaaggatatatcgatgttgaaatcatcgatcagaaccggaaaaaatccgtcacagtcggggaggttgtcaatgagaatgtttactccgt

SEQ ID NO: 402 - DNA, 384 bp, Bacillus licheniformis
atgctggaatcgattcatcacatcgccatcatatgctcggattatgaagcatccaaaacattctatgtcgacaagctcggacttgagattctgagcgaaacgtacagaaaggatcaggaatcatataaactggacctctcattaaacggccgctatgtcatcgaactgttttcttttccggatccgcccgcacgccttaccagacccgaagctgccggactccgccatttggctttcacggtggccgatcttgaccagaccgtcaaggagctcaagcaaaaaggcatcactgctgaaccgatccgcaccgatcccgggacgggcaagcgctatacgttcttctccgacccggacggcctgcctttagagctttacgaagcatag

SEQ ID NO: 403 - DNA, 399 bp, Bacillus licheniformis
gggcggcctatttaatatatttaggcattaaaagctttttcgcgaaaaaaatgttttctttggaagagatacaagccgagaagaacaaaaacgaaaacgcatcaagccggcattataaggattcttttatgcaaggattgttcagcaacattctgaatccgaaaactgttttggtctatatcacgattatgcctcaatttattaacttaagagaaagcgtcaaccagcagttgatcatcctcgctttaatccttacttttcttgctgtgttttggttcctcatcctcgtatatttgatcgatttcgcaaagaaatggctgagaagcgtgaaattccagaagatctttcaaaaagctgcgggtctggtgcttgtcggatttggcgttaaaacgggtttag

SEQ ID NO: 404 - DNA, 711 bp, Bacillus licheniformis
atttttcatatattttaaaaaactctaaaaaaggaggccggggtctcgaacgacagagcctcaacaatgagatgacaaatccgatccgaacttctttacaacaattttctgtcattatacttgacggcgcgatggccaccgagcttgaacggtacggctgtgatttgaacgatagcctgtggtctgcgaaaattctcatcgaaaaccccgagcttatcaaacaagtccatctggattatttccgtgcgggcgccgattgcgcgattacagccagctatcagtcgacggttgagggtttcacaaaacgcggccttagcgaacaagaagcgctccacctcatccgggagtctgtccgtcttgctgcagaagcacgcgatgaattctgggcggctccggaaaaccgcgaaggccggcctaaaccgtttgtagcagcttcagtaggcccttacggcgcctttttagcggatggttccgaatatcagggaaattatggcgtcacagaagatgaattggccgattttcacaggcggagaatgggcgctttaatcgaagcaggcgccgatattttggcatgtgagacaataccgtgcctttcagaagcaaaagctatcgttcatttattaaaagagttcccggatacacatgcgtggatcagtttcagcgctaaagacggacgccatatcagcgacggtacgaaagccggcgaatgca

SEQ ID NO: 405 - DNA, 419 bp, Bacillus licheniformis
atgtgtggatttgtaggggtattcaatcatcgcccatcatccgagacagcagcacaggaagaactgattaaacaaatgaatgaaatgattgtacaccgcggtccggacgatgatgggtactatcatgatgagcatgtaggcttcggatttagaaggctcagcatcatcgatgtggaaaatggaggacagcctctgtcttatgaagacgactcctattggattatttttaatggagaaatctataactatatagaactgaaagacgaacttcttttctaaagatacgagttcaaaaccgattccagtacgggaattttgcttggggattaccggcactttgaaaaaggggacgggtttaaaacgtggcgggatatttgcgcttttaaacgcggggaaaaaaagagcggtgtttataaggg

SEQ ID NO: 406 - DNA, 496 bp, Bacillus licheniformis
atgaagaaaccgagtctaaaatattgcgggattcattcattggaagatttaaaggtgacagcccgctcgaaagccgattatctcggatttattttcgccgaaagcaaacggtcggtagacccggcggatgtgaaacggtggtgcggcgaaacggatacgccaggtaaaaagcttgtcggcgtttttgttaatgaaaacatgagccgaatggctgaaatcgtaaaagatgcaggcttggacgtgatccagcttcacggagatgaaacggcggcagacatcaagcggcttaaaagcatgacagactgcgagatatggaaggcgctccctcacgggaatgataccgtacagagcatggcttctttcgcaccttacatcgacgggtatgtcatcgactcgtctgtcaaagggatgaaagggggaacgggagtttcgttttcgtgggaacagcgttccgctgtttataaatgcaacccaaagagaaggcaagcgcctgttt

SEQ ID NO: 407 - DNA, 684 bp, Bacillus licheniformis
atttaaaactgccaaagcggtcatttaaaaaagcgctcctttctccgaaccggtttgtcgctttaattgcggaggtgaaaaaagcttctccgtcaaaaggcgtgattcaggagggttttgagcccgtcaagatcgcaaaacaatacgaacaggctaaagccgattgtttgtctgttctgacagatacacctttttttcaagggaagaacagttatttgtcagatgtgaaacgctcggtttccctgcctgtgctgcgcaaggattttatcattgattccattcaggttgaagaagcggaccgcatcggagcggatgcgatcctgctgatcggtgaagcgcttgaaccgcaaaagctgtttgaactctatcagcaagccgttgaaaaaggcatggatgtgctcgtcgaagtacatggcgaagagacgcttgagggcattttaaatgtctttacacccgaaatcatcggcgtaaacaatcgaaatctaaaaaactttgaaacgaccgtcggacaaacggagcgaatggcgaaactcgttccgccggggaccgttctcatcagcgaaagcggcatcggaaaatcggaagacctgacttttgtaaaaacgtgcggagcccaagccgtgcttgtcggcgaatcgctgatgagagagacgtcacagctgaaggctgtctatgcgttattcg

SEQ ID NO: 408 - DNA, 342 bp, Bacillus licheniformis
agcggcagctaaaaagcaaggcttgcaactgcttcgcgacggagctttcaaaccgcggacaagcccgtaggacttccaaggcctcggcgtggaaggcctgcaaatcttaaagcgtgttgctgatgagtatgatctggccgtcatcagtgagatggtgaatccgcagcagattgaagaagccattgaataccccgatgtcatccaaatcggcgccaacaacatgcagcacttcgagctcttaaaagcggccggttcagtgaagaagccggttctgctgaagcgcggacttgccgcaacgctgaaggaattcatcaatgcagcggagcacatcacgtcgcaggg

SEQ ID NO: 409 - DNA, 526 bp, Bacillus licheniformis
gtgttaaagccgggtctgatgacaacggttcaagacttgggccgcacaggttttcaaaaatacggcgtgcttgtcagcggtgccatggatgccgattctttgcggattgccaatctgctcgcggggaacagccagaacgaagctgcgcttgaagtgacgctgatggggccggggccgtctctccgctttcaaaaacctgctcttatagcggtgacgggcgctgacttttcactgatggtaaatgacgaagaagtcccgctttggcgcccggttttcatcaaagagggcagcgtgttgacattcggcatgtgcaagcgcggaagccgtgcatatatggcagtggccgggggaattgatgtgccgcctgtaatggaaagcaaaagcacatatgtcagagcaggactcggcggctttcaaggaagggcgcttcaaaagggagacgtgttatcgctatgcatcccgacgccgttgtcggaagcgctgcacagaaagctcgcagacgaaggcaaagaacggggctttgcgg

SEQ ID NO: 410 - DNA, 478 bp, Bacillus licheniformis
atggaatttatttcacatattgtagatacaatgaacggttttttatgggggcctccgcttttgattctcattgttggaacagggatttatttgactttcaggctggcttttttgcaggtcagacttttgccttactctttaaagctcgccttttcaaggcatcaggataaatcctccgaaggcgatatttcccactttcaggcgctgatgaccgcccttgccgctacggtcggcacagggaatatcgtcagcgtcgcctcagctgttattgccggcgggccgggcgccgtattttggatgtggctcgccgccttcttcggaatggcgacgaaatatgctgaagcggtgcttgctgtcagattccgcgtgaaagataaaaacggcgaaatgtcaagcggtccgatgtattatttggaacacggcctcaagcaaaagtggcttggcgtgttatttgccatattcggggcgcttgccgctt

SEQ ID NO: 411 - DNA, 906 bp, Bacillus licheniformis
atgttacccggctcagaatcgaaaaagcgaaagagctgcttcttgagacgaataaaaaaatccatgacgtttctgaagaggtcggctacagacacagctatttcaaccggattttcaagaagcaggtcggcattccgccgagccgctacaggcagattcatcaggaatcttcgtgaaagggagagtgctatgaaacgaacagacaaaaaaccgaaagtgacagtatatttggccggggactcgaccgtcgcagactgtcccccgcatgaagcgccgatggccggctgggggcagatgcttccgctgtttttctcagatgaggctgcggtcgtgaatatggcaaaaggcggggccagttcgaacagcttcattgatgaaggccggctcgatgacattacggagcggcttgcgcctggtgattatgtgttgatccagttcggccacaacgatcaaaaaccgtacggaacagacccttatacaacctatcaggagcatcttgtccgctatgtggaagcggttcgcgaaaaacaagcgacaccggttttgatcacttccgcagagcgcagacgttttgatcaaaacggaaagcccgccgacacactcggggattttccgaaagcgatgaaggcgctcgctgacagcttcgacgttccgctgatcgatttatggtccaaaacaaaagcgctctatgaatctctcggaatcgaaggttcaaaacggctgtttgtccactttcagcctcatgagcaccctcattatccaaatggaatcgaagacaatacccatttttccgaagcaggggcccgtcaagtcgccaggctggtgacagaaggaatcagagagcttggtctgcctctatcggcttatctgctttgtgaaaggagcgatttccgtgccggagtgtaa

SEQ ID NO: 412 - DNA, 417 bp, Bacillus licheniformis
aaatcctcggcatcaatcatctcttgttttcggtctctgacctgtccgtctctatttcattctatgaaaaggtgtttgatgccaagtggctcgtaaaagccgagaaaaccgcttattttgacctgaacggcatctggctcgcattcaacgaagagaaagacattaaaagacaggaaatccacgactcttacacccatatcgcgttttcgatccaacaggaagatttgccgttctgggaaaagaaattacacgatttaggcgttaatgtgctgaagggcagaaaacggcatgaaggagacagagattcaatttatttctcagatccagacggccataagttcgagcttcacacaggctctgtatttgaccgtcttcaatactatcaaaatgaaaaaccgcatctttcatttcatgaag

SEQ ID NO: 413 - DNA, 453 bp, Bacillus licheniformis
ccacagcatgaccggctggagaatcggttatgcagcaggcagcgaaccgatcattaaagcgatgacgaacctagccagccacagcacgtcaaatccgacatctgtcgctcaatatggagccattgccgcttacaatgggccaaacgagcctgttgaggagatgagaaaagcttttgaagaacggctgaacaaggtgtatgaactgcttgttgacattccgggattaacatgcctgaagcctgaaggagccttctacttgttcccgaatgcaaaaaaagcggcagaatcgtgcggcttttcaagcgttgatgaattcgccgaagcgcttttggaagaagaaaaggttgcgatcgttcctggttcagggttcggcgcaccggacaacatccgtctgtcgtatgcgacatccctgtcacttttggaagaagcggttgaacgcatccgccgctttgt

SEQ ID NO: 414 - DNA, 500 bp, Bacillus licheniformis
atccgcttaagctgtgtatcagatcagcgtacggccactccggttttgaactgaaatccatatttgaagcaaacggcatccatcctgaattggcagatgaaaggcaagtcctgttgatcctgccgcttgaaggaaaaaatatgcccgcgccggaactgatcagcacaatcagtaaagacatgaaagatacagcagttcgaaatgatcttcctgccggaatcggaatcccttctgaaaaagtcacggctttgccttaccggaaaagcaagttgtctgccttcaaaaaagaatcggtgccttttaccgaagcagcgggcagaataagcgccgaatcggtcacaccttatcctccgggcattccgttgatcacggcgggtgagagaataacaaaagagacgatcagccggctgacgcggctcgtcgatctgaatgtacacatgcagggcagcaatcagctcaaacaaaagcaattaactgtatatatagaagaggagaaatca

SEQ ID NO: 415 - DNA, 870 bp, Bacillus licheniformis
atgacatatatcatgagtatgagagtaggttatttaggtccagaagcaacttttacgcaccttgccgtctgctcctgcttttcagatgcagaccagcaagcatttaacacgataccggcctgcatggatgcggcgatgaacggggagatcgatctggctgtcgtcccgcttgaaaatgcgattgaaggatcggtgaatctgacaatagactacttaattcacgaacagcctctttatattgtcggagaaatcaccgctcccatccgtcagcatttgcttgtgcatcctaccagaaaagaggcttgggaagacattcagaaggtttattcccattcccatgccatcgcgcaatgccataaatttttgcacagccggttccgctccattccgtttgaatatgcgacatccaccggagcagctgcaaaatacgtgagcgaaaatccggaagagaacatcggcgtgatcgccaatgaaatggcagcagatacttacggattagacatcgtcaaaagagatgtgcatgactatgaatacaatcacacgagatttgtgatgcttcatccggatcgcgaggcatcccctccggtcaaccctcaactcaagggaagaccgaaaacgactttgctggtgacccttccttcggacagatcgggagctctccaccaagtgctgtcggctttcgcctggagaaatttgaatctttctaaaattgaatcgcggccgacaaaaaccggtctcggcaattatttcttcattattgatattgaaatggccctggatgacgtgctgattccaggtgcaatagctgagcttgaagctttgggctgcaaggtgaaaatgctcggtgcctacaacgcatatacactataa

SEQ ID NO: 416 - DNA, 393 bp, Bacillus licheniformis
tggtcattcccttttgatgaaagtgatgaccaaaagatgcgcgggaggttcttccgtggagcctctcttatccgaaagccgtggaagcaagcgcggtcagcaatatgctcgtcgccggactgatggcgaaagattggaagcttgtcggccgcatgatgcaaaaagacctctttcaccagccataccgaagggcgctcgtccctgagctttcgaaagtggagcatgaagcaggccaaaacggcgcgttcgggacggctttaagcggagccggcccgacgatcctttcctttattgaaaaaggaaaaggagaggcgctgagaaaccagcttgcgtccaagtttccgcactgtgaggtcgactgcctttatgtcccggatacaggcattatcgtgg

SEQ ID NO: 417 - DNA, 291 bp, Bacillus licheniformis
agaattgactttttttcagtcaaaccacggaggggacctgattgatgctcttcatgaggcagaggagcaatacgatggaatcgtcttgaatccgggggctttctcgcattacagctatgccctccgcgatgcggtggctgcaatcagcataccggtgattgaggttcatctttcaaatcctcatgcaagggaagagttccggcaccgctcggtcatcgctccggttgcaagaggccagatcaccggactcggctttgaaggttataagctggccatctcttattttatgaa

SEQ ID NO: 418 - DNA, 579 bp, Bacillus licheniformis
gtgaaaatcatcgttcaaaaattcggcggaacgtctgtaaaagatgaccgcggcagaaagcttgccttaaaccatattaaggaagcggtcaatgaaggatacaaagcggttgtcgtcgtatcggccatgggccggaaaggcgatccgtatgcgactgattcattgcttgatctgctttacggcggacaggatacaattaccgagcgtgagcaggatatgcttttatcatgcggggaaacgatttcctctgttgtgttcgccagcatgcttttggaaaacgggattaaagctgctgctttaaccggtgcgcaagcgggctttttaacagacaacaaccatacgaatgcaaagattctcgaaatgaagccggagcggcttgtcagcatgctggccgaccatgatgcggtcgtcgtcgcaggcttccaaggcgcgactgcaaaaggggatatcacaacgatcggccgcggcggaagcgatacatcggccgctgcgcttggcgcggctctggacgcggaatttatcgatatttatacagatgtcgaaggcgtcatgacagctgatccgcgcatcgttaaaaag

SEQ ID NO: 419 - DNA, 483 bp, Bacillus licheniformis
ttcactaaagggagagcttcatattccgggagataaatccatctcccatcgttctgttatgttcggagccatggcagaagggaaaacggtcatcaaaaactttttgccaggagccgactgcttgagcacgatcgcctgctttcggaaaatgggtgtcgaaatcgaacagaatggcagtgatgtcaccgtccgcggcaaagggctcgatcagctcgctgagcctgccgagctcctcgatgtggggaattccggaacgacgatcaggctgatgctcggcattttggcggggcgtccgtttcacagtacggttgccggcgatgagagcatcgccaaaaggccgatgaagcgtgttacagaaccgcttcgaaaaatgggggcgaaaatcgacggccgcgccggaggggaatacacaccgctttctgtccgcggcggacatctgaaggcgatcgattttcagtcgcctgttgcaagtgcgcagatcaa

SEQ ID NO: 420 - DNA, 303 bp, Bacillus licheniformis
agtgaagcagtatgcggccgacaggcacggaattgaatttacagaagtccaatatttccccggcctgtccgatttaagctacctgcagctgcaaaaacagtcagtcgatgcgttcacatccaatatgccgctttttcatcacggctattcacttccaaaaggacgcgaaaacgcactgtttgtgccggtcatcaatatcgggccggccggcaaagatcctcacaaatggacggaacgtctccatgtgccgttttcatttggaaagctgccagatatcctccggctcgcgatacacaagcttct

SEQ ID NO: 421 - DNA, 332 bp, Bacillus licheniformis
gtaaatggcattcaccacgtatctgctttaacagcaaacgcccagcataacctggatttctatgtcaaagggcttggcatgaaactgataaagaaatcggtcaatcaggacgatccgaccatgtaccacttgttttacggggatgaagtcgcgtctccgggttcggatttgacatttttcgagattccgatgcttgcccggagacgggaagggacgaactgtatttcggccgtatcacttcgggttcccggtgaacaagcactcgaattttgggagaagcggcttcatgagctcggcacagagatttgcggcatcgagacgcgtgcggggcg

SEQ ID NO: 422 - DNA, 801 bp, Bacillus licheniformis
atgactgcgacgagcgagagcatcagtgcacaaatcgaagaaaaagcgataaaggcaaaaacggccgcaaaatctttgcggctggcaactgaaaaagaaaagaacgaggcgcttgctgcattggccgaccacctgaaacaaaacatgagctatattctcactgaaaatgccaaagatatcgaagcgggacgaaaaaaaggctatgatgcagcctacatcgaccgcctgtcgctcaatgaagacagggttctggattttgccgatgggctgctggaagtcgcggaacttgatgatccggtcggagaaacgctatcaagctggacgctcgacaacgggttaaaagcggaaaaagtcagcgttcctctcggcgtcatcggcatgatctatgaagcgcgtccgaacgtaactgtcgatgcgaccgggcttgctctaaaatcaggcaatgcgatcgttttgaaaggcggctcttccgccattcattcgaatacagcgatcgtatcggtcatgcatcaagcgcttgattcgacaaacatcccccgcgatgccgttcaattcatcgaaagcacagaccgaagcgcaacgaagcagctctttaagatgaaagaacatatcgatgtactcatcccccggggaggcggggccctcattcaggaagtcgttgagaacgcaaccgttccggtccttgaaacgggagtcggcaactgccacatctatattgaccgggaagcggaccctgaaaaagcgatcgatgtcatgatcaatgcgaaaacagaccgcccccgccgtctgcaatgcacttga

SEQ ID NO: 423 - DNA, 239 bp, Bacillus licheniformis
atggcaaagtatacaagagacgacattgttaaactagtaaatgaggagaatgtaaaatatattcgccttcagtttacagacattcttggaacgattaaaaacgttgaaattcctgtgagccagctggaaaaagcacttgataataaagtcatgttcgacggctcttcaatcgagggattcgtccgcattgaagaatccgatatgtacttataccctgacttagatacatttgtgatttt

SEQ ID NO: 424 - DNA, 376 bp, Bacillus licheniformis
atgaaaatcgaacacatcgccatatggacgaacaatttagaggaaatgaaagatttctatacccgtttttttcacggaaagacgaatgaaaaatatgtcaatccgaaaaagcatttcgaatcatatttcatccagtttgaatcgggaacacggcttgagctgatgagacgccccgaccttgcaaaaggagaggagaacgcttccggctatgcacatatggcgttttccttagggtcgcggcaagaggttgacgagatgacgagccgctttgaaaaggaaggataccaggttgccggaaagccgcgcgtcacgggagacgggtattatgaaagagtcattctggatcctgacggcaacatcgttgaactgaccgttt

SEQ ID NO: 425 - DNA, 408 bp, Bacillus licheniformis
tagcagtagttggtgcgacaggcgctgtaggacagcaaatgttaaaaacactagaagacaggaattttgaactggataaactgactttattatcctcaaaacgttcagcaggtacgaaactgactttcaaaggcgaagagtacacagtagaagaagctcgtcctgagagctttgaaggcgtcaacatcgcgcttttcagcgccgggggaagcgtttcgcaggcgcttgctcacgaggctgtcaaacgcggggcgatcgtcattgataatacgagcgcgttccggatggaccaaaacactccgctcgtcgtacctgaggtcaatgaggaagatttgcacaagcacaacgggattattgcaaatccgaactgttcaaccatccagatggttgttgcgctcgaaccgatcc

SEQ ID NO: 426 - DNA, 1431 bp, Bacillus licheniformis
atgctgatagggggatggaagatggaaaacggtctgtttaagccgaaaaggcactggaaggatattgagctttggaaagatgttcccgaggaaaaatggaacgactggatatggcagctgaccaacaccgtcagaacgcttgaagatttgaaaaaagtcgtcaatcttacgaaagaggaagaagaaggggtgcgaatctccacaaagacgatccctttaaatatcacgccgtattacgcctcactgatgaatccggatgatccgcgctgtccgatcagaatgcagtcggtgccgctcgcagaagaaatgcacaaaacaaaatacgaccttgaagatccccttcatgaggatgaagattcgcctgtccccggcttaacccaccgctatccggaccgggttttgtttctcgtcactaatcaatgctcgatgtattgcagatactgtacaaggcggcgtttttccgggcaaatcggcatgggcgtgccgaaaaagcagctcgatcaggcgatcggctatattcgggatacgcctgatgtcagggatgtgctgatatcaggcggggacggcctcctcattaacgaccagatccttgaatatattttgaaaaacctccgcgccattccgcacgtggaaatcattcggatcggcacaagggccccagtcgtcttcccgcagcggattaccgacaagctatgcagcattttgaaaaagtatcatcccgtctggctgaatacgcatttcaacacgagcattgaaatcacgaaggaagcgaaggaagcctgtgagaagctggtcaatgccggggtgccggtcggcaatcaagccgttattttggcaggcattaatgacagcgtttccattatgaaaaagctgatgcatgatttggtgaaaatcagagtccgtccgtattatatttatcaatgcgacttgtctgaaggaatcggccatttccgagcgcctgtatcaaaggggcttgaaatcattgaaggcttgcgcggccacacgagcggctatgcagtgccgacctttgtcgttgacgcgccgggcggaggcgggaaaatcgccatccagccgaattacttgatttcgcaaagccccgataaagtcgtgctccgcaattttgaaggcgtcattacgtcgtatcctgagcctgaaaactatgttccggggagagcggacgactattttgccgaaatcttccctgatgtgatgaaggaaaaagaggagatcggcatatcggcaatctatgcggatcaagctctttcatacacaccggacggcttaaaacggctcgagagaagagaaagctattccaagaggcctgatcatgaaacattgaaaagccgccgggcaaagcgcgatgaattgaaagaaaagaaattccttgcccagcaaaagaaagaaggcgaagctgaggggcatgcgcaatga

SEQ ID NO: 427 - DNA, 306 bp, Bacillus licheniformis
tgtgatcggaatgacgctgaaaggcagaatgacccatacaaacggcgtcatgaaactcgcttttttaggctttgagaacagagacgagacagagctcgaactgatcgagggatataacgacaaccttcctcaggaaggaaaagttcatcattttgccgtctcgaccgatgatatcgaggctgaatttgatcgcgtaaaaggcgccggcatcaagctgatggaagatgagattaccgtattgccgaacggcttccgctatttttttctttttgggcccgaaggagaaatggtcgagttttttcaaag

SEQ ID NO: 428 - DNA, 291 bp, Bacillus licheniformis
ttttcaacaatggaagcgggcatcagctggaaagcaaacgggcgcctatctcgtgcttgtgcaggcgaaagagcagtttatcaaagcgggttatcacaggtgccgcgtcggcttaaaccatcttgctttttacgcggcatccaaagagcaggtcgacgaaatgacaatgaaactgagagagcggggatgccgcattttatatgaagacagacatccgtttgccggcggaaacgggcattatgccttgtataccgaagatccggaccgcatcaaagttgaacttgctgcccc

SEQ ID NO: 429 - DNA, 291 bp, Bacillus licheniformis
atggcgatgccgtcgctttaggcatgcaatttgctttgtttgtcagcgagaaggtgctgaattgtcctgttgaccgtacgaaaatcgccgcctggctgaaaaatctcggctatccggaaagcgtgaaacgcgaagtttcaacagaagcccttatctatcgaatgatgaacgataaaaaaacacgcggaggcatcattcagtttgtccttctggataagatcggcagtgtgcggctgcactcctttaaagccgaagaaatcgaacgatggctgaatatgtggagattggagg

SEQ ID NO: 430 - DNA, 279 bp, Bacillus licheniformis
caaagcttgggtggagatgggaggtcttccaaacgggttcaggctagttacgtttatttcttcataccgaagcttattccacccattggaaaagtttttggaaacagttgaagccaagcggcggagctacaagtactctgtgatgtttctcttaccccagttcattccgaaaaaaagctggcacaacattcttcacaatcagtccgcgcttttgctgcggctgaggctcctgtggaacaaagacatagttgttgccacgcttccataccattttaaaaa

SEQ ID NO: 431 - DNA, 654 bp, Bacillus licheniformis
atgacaacggttcaagacttgggccgcacaggttttcaaaaatacggcgtgcttgtcagcggtgccatggatgccgattctttgcggattgccaatctgctcgcggggaacagccagaacgaagctgcgcttgaagtgacgctgatggggccggggccgtctctccgctttcaaaaacctgctcttatagcggtgacgggcgctgacttttcactgatggtaaatgacgaagaagtcccgctttggcgcccggttttcatcaaagagggcagcgtgttgacattcggcatgtgcaagcgcggaagccgtgcatatatggcagtggccgggggaattgatgtgccgcctgtaatggaaagcaaaagcacatatgtcagagcaggactcggcggctttcaaggaagggcgcttcaaaagggagacgtgttatcgctatgcatcccgacgccgttgtcggaagcgctgcacagaaagctcgcagacgaaggcaaagaacggggctttgcggctcccgaagtgggctgtcgaccgcaaatattttctcccgctaaaaaagaacccggtcattcgtgtcatcaaaggcgatcagtttgcttgctttacctgatcatcacaagagcgctttttcgcgggtccattccgggtgacggctaa

SEQ ID NO: 432 - DNA, 617 bp, Bacillus licheniformis
atgaatgatttacaattagatacaccagctcttttaatcgataaagacgtgatgttaagcaatatgaaggatatgcaaaattacgctaacgaacagaaggtaagcttacgccctcatacaaaaacacataaaatgcctaaattagctaaactgcaagaagagatgggagctgtaggaatcgctgtagcgaaagtaggagaagctgaagtgatggcgagaaatggcttaaaagatatctttatcgcaaatgaaattgttgggaaatcaaagcttgaacgtattagaaaactatctgaaacgattgatatctcttttggaatcgatagtgcgtatcaagtacgtgaaattgaagaagtatttgaaggagcttcaaagaaagcccaagtgttggtggaaattgaagtaggagaacaacgctccggaattattgaagaagatgattttcgtactttattagaattaatcaaaacgtgtcaaaatgtcgagctaaaaggaatcttctcacatgacggacattcttataaagcgaaaagtgtagcccattgtaaagaactctataaagaaagtgtagaacgaacattacatttcgcccgaattgcggaagaaaggatccgaac

SEQ ID NO: 433 - DNA, 195 bp, Bacillus licheniformis
agacggtttctgagctgtatgccccgatcaacggaaaagtggtcgaagtgaacgaagttctggaagacagccctgaattcgtcaacgagtctccgtatgaaaaggcttggatgattgtcgtcgagccgtcagacgcttctgaaatcgaaaacctgatgacagccgggcaatatgaggacatgataaaagaagact

SEQ ID NO: 434 - DNA, 573 bp, Bacillus licheniformis
atgagtattatagcttttctttcgtatgtgattatgacatccattacgcccggcccgagcaatattttaatgatgaatgaagcgcaaaggttcggctttacaggttcatggcgttttagcagcggtatcttggcggggtttgcagtacttgggattctcagcggtgcctttacaatcagcctgtacaattggattcccgttgtagagccttattttaaacttgccggcgcgtgttatttgatttatttggctttgcaagtcggctttaccaaaaataaaaaacaggattccacagaagcccgctcctcttttatatccggctttatatttcagctgatcaatattaaaagcattttgttcttcattaaccgtaatgagcgcgttcgttttgccgttcaaccattccttgaaatcgacaatttattattcggcattagccattgttctcgggtggctggcgctgctattatggtcgggattcggctgctgtttttaaaagggtatttgcaaagcacgaccgggtatttcgagttccttatgtgcctgctgttcactgtattactgtcggtgtaa

SEQ ID NO: 435 - DNA, 180 bp, Bacillus licheniformis
agatgtgctcgccgttttctgcaccggtgcgtacggctacagcatggccaacaactacaaccgcattccgcgcccggccgtcgtctttgtcgaggacggggaagcgcagctcgtcattcagagagagacgtatgaggatatcgtcaagctggatctgccgctgaaatcgaaagtcaaaca

SEQ ID NO: 436 - DNA, 201 bp, Bacillus licheniformis
ctttttccgcctggatgcctgttcccgacggctatacatctgaggctttttccgatctgcttctcgaaaaagcgaatgtcgtcaccgcgcccggcatcggcttcggcaaacacggggaaggctatgtgagagtcggcctcttgacaagcgaagagcggctccgggaagcggcttcgcgtattgccgagctgaatatattca

SEQ ID NO: 437 - DNA, 536 bp, Bacillus licheniformis
  misc_feature (1)...(536): n = A,T,C or G
atgttcagtacaataaaggtgtacacattctctcttttcctaaatatgatatcacatacatttgcggaaaacagtgaaagagggggcttgctttgtgaagtggcagacagtggaagaactgaaacggctgctcatttctcttgttcaatancgaaagcatctacaggcacggccggagaagtggcgcttgcgaaatatatgcatgatgtcttaaaggaccgttcgtactttcaaaagaatcctgaatacttaaagcttcacccgatggaggatgggcgctattttttaaccgccctcgtcaaaaaggaaaagaaatcaaatacggtgctcctcttgagccattttgacgtggtcgatacggcagactacggagaattcaaacatatggcatgcaaagtcccggaactcatggacctattaaatgataaaaaagaacttttgcctgaacgggtcaaaaaagacctggaaagcggcgaatggctgttcggtaggggaagcatggatatgaaagcgggtcttgctgttcagggcgagtc

SEQ ID NO: 438 - DNA, 201 bp, Bacillus licheniformis
agagcagacagggggaaacggcacaattaatttccatcggcggggcgacatatgcacgatcactgaaagccggcgtggcattcggcccgctgtttccaggccgtcctgacgttgcccatcagaaagacgagtatatggaaatcgacgatttgctgaaggctgtatcgatttatgcacaggccatttatgaattggcgaagt

SEQ ID NO: 439 - DNA, 1038 bp, Bacillus licheniformis
gtgctcctcctttcgggatgcggcggaaacggaagtcaggaaagcaaacaatcagatacagtcgttatcggcgtctatgggggcgattgggaaaaacatatcaagccgagcctcgaatcttttgaaaaagaaacaggactgaaggtcaaagttgtcgcagggacagactctgagtggttcacaaaactcaaggcatcgaatggcagaaatgctccctatgatctcttaattctgcagccggacacgattcacagagcgcagtcggcgggattgctggcaccgatcgatcaggaaaaggttccgaatgtccgcgatctgtaccactctgttcagaaacgcttcaccgatgatggaaagcagtatgcggccggtttcagtatgggacagcttggaattgtctaccgaaaggatcttgtaccacaggagcctaagcgctggacggatctttggaacagcagctataaaggtcatgtcgccatatcatcgccggcttattcggcggggcttcagttttttgtaggattaatcaatgcccagggcggcctggagtcaaacgggaaagacgtggataaagcgttcaacagcttggctgatttaaagaacaacataacggcctatcccgataatccaggctcgatacaaacgcttctggaacgtggggatgcatgggttgttccgttttgggacggccgcgctttttctttgcaggatgcaggtcttgacctgggatttgcatatcccgaggaaggtgcagtcgcagcagttgcaagctgggctttaatgaaaggaagtcctaatcaggataatgcgtacaagctgttaaatcatctgctcagtccagaagtgcaaggagattttgccgatagaacgttttacggcatggccaataaaaaagtgaaatacagcgataaattaaaagggaagatcaaagtaggggaggattattacaggaatttaaaatgggttgactatgaagtcgcggcaaaagatctaggcgattggacaaatcgctggaatcaagtacttggcggaaaatag

SEQ ID NO: 440 - DNA, 453 bp, Bacillus licheniformis
ccccttcatgtttaagtttgatattccagaaggggtgacagaaatcagacctggcacttacatttttatggacgcctcacaagcaaatgtaattggtacgtatgatcgctgtgctgcttctgtactcacaaccgtgattagtaaaccaacaaaagaacgagtcattacagacgtaggggccaagggaattaccgcccaaacacgaagcgaagggcttactgcaaccaaagggcttggccgtatcaaagaatacgaggacgtttatattcatggcgtattcgacgaacatgctattatttatcatgaagaattcaacaaaaaagtaagcattggagataaggtgcgaattattccaaatcatatctgcccagtatgcaacttgcacgataaagcctatttagtcgataatggagaggttgtagatgaattaaatattgaagctagaggaagact

SEQ ID NO: 441 - DNA, 178 bp, Bacillus licheniformis
ttgtttttacacggtactagcagacaaaatgaaagagggcacctcgaaatcggcggtgtcgatgttctatcattggcagaaagatacggaacacctctttatgtatacgatgtcgcgctgattagagagcgcgcccgaaaattccagaaggcattcaaggaagccggtttaaatgcat

SEQ ID NO: 442 - DNA, 306 bp, Bacillus licheniformis
cctttccggaagcaaaaaccaggtcccgcccaaaattcaggggaatcggaggcgcgaattggttcccggaaaattttgaatcgggcaaatatcacgaatggaattcatccaggttataacgaagaaagcctttgaatttgcccgtaaaacggcgagacagtaagtaaatctcgaaggaatttcttcaggcgcagccatctgtgctgctcttcaagtggctaaaaagcttggaaaaggcaaaaaagttctcgctgtgcttcctagtaacggagagagatacttaagcccgcctctttaccaatttga

SEQ ID NO: 443 - DNA, 249 bp, Bacillus licheniformis
atgtaagctgggttttttggagtgcggccgggcattttgcaggagccgccatgccggctgttcttcaggaaagcatgagcatcgccctttatgccatgtttatcggattgttggtgccgcctttgaaaaaacagcgcaaagtcctgctgctggcgggagctgccgcgctattcaatacggttttccaaatgaacggaatgttgtcggcaggatggtcgatcgtctgcgctacgcttttatccgccatcc

SEQ ID NO: 444 - DNA, 465 bp, Bacillus licheniformis
atggaaaacaataaaatcctcggcatcaatcatctcttgttttcggtctctgacctgtccgtctctatttcattctatgaaaaggtgtttgatgccaagtggctcgtaaaagccgagaaaaccgcttattttgacctgaacggcatctggctcgcattcaacgaagagaaagacattaaaagacaggaaatccacgactcttacacccatatcgcgttttcgatccaacaggaagatttgccgttctgggaaaagaaattacacgatttaggcgttaatgtgctgaagggcagaaaacggcatgaaggagacagagattcaatttatttctcagatccagacggccataagttcgagcttcacacaggctctgtatttgaccgtcttcaatactatcaaaatgaaaaaccgcatctttcatttcatgaaggccacatcaaggctctttatgacagaaacaaataa

SEQ ID NO: 445 - DNA, 170 bp, Bacillus licheniformis
actttttcatacacggcacgacttcaatgattttagtgctggcggcaaataacgggttctcggacttcccgcagcttgcgtataatttggcccgggataaatatatgccgataatgtgtacggtcagaggacaccgcttatggtattcaaacgggatcatctttctcggt

SEQ ID NO: 446 - DNA, 411 bp, Bacillus licheniformis
  misc_feature (1)...(411): n = A,T,C or G
ggcgaaagcacggggtattcgtcctaacacgatgcgaaccgggaatacaattacatccggtggacatacgttcgcaatgttgtcagcgttaaatgagacatattcggctaggcagacatctccagtgagatcaagggagtggaatcgttcggcttacgtcggttcagagctgtacgtagacacgctcggcatcatcggtatgggccgcatcggaagcgaaatcgcgagccgtgcaaatgcattcggtatgaccgttcatgtatttgacccgttcctgacccaagaaagggcaagcaagctcggcgttaacgcgaacagctgtgcagaagttctgacatgcgccgacatcagtacgattcatacntggctcacgaaagaaacgaagggacttgtgcactaagaaaccatcgc

SEQ ID NO: 447 - DNA, 337 bp, Bacillus licheniformis
gtgaaaaaaatcgaaacgattatacgccccgaacagttcccccgcctccgcaaaaagcttgaagaggttggcataaacggattaaccgtctcataggttgccggctgcggccagcagcgggggaagcaggctctgtttcgcggcacctcctacgaaatcaagctgctgcctaaagtgaaagtcgaaatggtgattgaatcggagagcgttgatgaaattatcaaatcgaaagcacatgttcgacaaatacgggtcggccgaccggaagaatctttgtcctttcaattgaaaacgcgatccgaatcccggacaggggaatcaggaaaggaaccgatgg

SEQ ID NO: 448 - DNA, 261 bp, Bacillus licheniformis
tgtaggatcgattaaaacactttatggaggggttagcatgagcacaccgaaagagttgcgttattcagaagaacacgaatgggtgaaaaccgaaggagataaagtcagaatcggcattacagactttgcacaatctgagcttggagacatcgtatttgtcgagcttcctgaagtgggagacgaaatcaaagcggacgagccttttggcagcgttgaatccgtaaagaccgtttctgagctgtatgccccatcgatgggaaa

SEQ ID NO: 449 - DNA, 246 bp, Bacillus licheniformis
ttgtctatggtccggccgaacgtgcaggactcgtgacgttcaaccttgaagacgttcatccgcacgatgtggcaaccgtgctggatgcagaaggggtcgccgtcagagccggccatcactgcgcgcagcctttaatgaaatggctgaacgtctccgccactgcaagagcgagcttttatctgtataatacggaagaagacatcgacaaactgattgaagctcttcagaagacaaaggagtatttca

SEQ ID NO: 450 - DNA, 405 bp, Bacillus licheniformis
tgaaagtcgtatgtacatcaccgtcatttgcgaaatactcagacgatcccgtcttgtttttggaaaaaaagggcatgtcgctggaacgccttcctgcagatataaccgaggagcagtttattgaagcagcagaaggagcggatgccgcgatcgtggcgtttaaccagattacgccgtatgtcctggatcgtctcccttctttaaaaattgtctgcaaacatggcgtcggtgtcgacaatatcgatctgcacgctgcgaaagagcgcaacgtctgggtgacgaatgcccccaacgccaacaagcatgcagtcgccgattttgtattcggtctcatgctgtcggctgcaagacagattcctgcagccgacagggagacaaagctggaaaaggccaggatttggtcct

SEQ ID NO: 451 - DNA, 387 bp, Bacillus licheniformis
atgatgatctttacgaaaacagatcttcgctatccggtgaattttttcgggccagggttgaggattaaccattacggattgctcatcgtaaacagcaatgcaaaaataggtgcaaactgtgacattcatcaaggggttaatatcggacaaaatcacgctcgccgcgatgttcccacaatcggagacaatgtctggatcgggccgggggcaaagctctttggcgacattcacattgctgacggcatatcaattggcgcaaacgccgtggtcaacaaatctttcactgaggaaaatattacaatagccggcatgcctgccaaaaagattaaagaggcgccgtcaaataaagaccggaagcaagctgttcagcggcaaatacaagcatga

SEQ ID NO: 452 - DNA, 837 bp, Bacillus licheniformis; identical to SEQ ID NO: 320

SEQ ID NO: 453 - DNA, 360 bp, Bacillus licheniformis
atgatgccgaacccttcctcaagtaattcatcagtaatgacgagcggagacagaaaacggataatgttgccgttgatccctgccgtcaacaagagcagaccgtgttcattggcgtacttggcaatcttggccgcagctgctttgtccggctcccgcgtcttttcgtcccggacaatttcaatcgcagccattgcgccaagtcggcggacttccccaatctgcggatatttcatcttccattcaagcgcccgctcttcgatggctttgccgatttcttcagagcgcttgttgagctgttccgattcgataatatcgagcactgccaaagcggctacgcatccaagcggacttccggcgtag

SEQ ID NO: 454 - DNA, 111 bp, Bacillus licheniformis
accggaaacgcacgatgtacgaggtgacaaacaacaatgcccactcctgggttgaagtgtattttgaaggacaaggctgggttacgtttgaaccgacgaaaggctttacta

SEQ ID NO: 455 - DNA, 262 bp, Bacillus licheniformis
ttgccgcatattttaattttgaacggaccgaatttaaaccggcttggaaaacgcgaacccgatgtatacgggacagacacattaaccgatttgcaacaaagactttttcacttttgccgaaagcattcagaacagaatttgactttttttcagttcaaatcaagaaaggggacctgaattgatgcttcttccatgagggcagaaggagcaattacgattggaattcgtcattgtactccggcgttgctctccccccattaca

SEQ ID NO: 456 - DNA, 118 bp, Bacillus licheniformis
atgagatttgatgaagcatattccggcaaggtgtttatcgcaagccgccccgattgggaagaggcggacgccatcctttacggcatgccgatggattggacggtcagctaccgtcccg

SEQ ID NO: 457 - DNA, 321 bp, Bacillus licheniformis
atggggtaccgtcttcaaggagaggcgctcgaactcactcagcctctggaaatgatctctgaagcggtatcattcggaacgattcaagtgccgcccgacggcaatccgatcgttcttctcgcagacaggcagacagcgggcggatacccgagaatcgcccatatcgcatcagctgatttttctcaggtcacgcagatgatgccgggcgagcaggtgcagtttcagcttgtcagccttcaggaagcagagcgcgtttacatcgaacgggagacgaaaatcagcgaactttctgcccgattgaagcttgaatacatgttatga

SEQ ID NO: 458 - DNA, 201 bp, Bacillus licheniformis
cgaaatcatcaatgtcccgagcggttttatttggacttatttagtctatatattaataggaataggcctgttctttacgtttaaattgaaattcgttcaattccgctatttcttcgagatgtttcgtatcgtcggacaaaaagaggagaaaggaaaaggcgtctcgtctttgcaggcattctttatttccgccgcttcccg

SEQ ID NO: 459 - DNA, 168 bp, Bacillus licheniformis
ggaaggagctgccttggaaattcgaagccggcacaccgatcattgccggcgcgatcggattgggagcggcgattgacttccttgaagacatcggacttgatgaaatattagcgcatgaacaccgtttggcggcatacgcgctggagcgctttaaagagcttgaaggcg

SEQ ID NO: 460 - DNA, 140 bp, Bacillus licheniformis
gggttgaatgcggtcacttttcgagaaggaagaaaagcgcgacattcggcaggcaaaaaataaacctccacgaagccggaaaatagtttgagccgaaggcacagcacccgatgcccggctccgcagacctgtgtttcata

SEQ ID NO: 461 - DNA, 243 bp, Bacillus licheniformis
ctcaaaggcgctcgccgttgcgccggggttggaattgagcgagctgcttgaggcgcgcgtaggcttcaggccgtttacaccgggctttctccccgtgatcggctcattgccgaacatttgcgggctcctcgttgccaacggtctcggcgcttcagggcttacgtcaggtccgtaccttggcgctgaattggcaaggctcgctttgggagaagagcctgagcttgatatcgctttatatgatcc

SEQ ID NO: 462 - DNA, 237 bp, Bacillus licheniformis
atgatcgaaattacggatgatgaacagttccaactcggtacaaacgttctgtccatcggcaataaaaccgtgatcagcctgcctgttaaccgccacgtgaatcaggagctcagaaaaaggggctatacggtcatcgaaatcgacttatccgagatcataaaatcaggcggatcattcagatgctgtactctgccgattgagcgtacttccactgaatgttacaaaggcggcgcctga

SEQ ID NO: 463 - DNA, 237 bp, Bacillus licheniformis
atgtctcaagcgtatttaggtctccgtgtgcgtcataccaaatcacgccgagctgttgataatgcttggctacacccgccaatgtcccgatggcaatgctgtggtctccgcccagcacgagcgggaagcggcgctgctcgacgacattgtcgacgatatcggccagcttgcggtttccttccagtacggaaactaaatttttcagcccttcgtctccttttggctgatcgcggttga

SEQ ID NO: 464 - DNA, 231 bp, Bacillus licheniformis
atgaaagacttgcatgacctgctgatagatggacaacggcaggagcggctgcatccttcccccgacgagaagaggcgtaatatagcttccggcagaaagcgaaaacacgatcattgctcctgtcagcaatcccggaaccgtcatcggcaaggtaacgaaaaaaaatgtccgcagcctgcccgctccaaggctcatcgaagcaaatttaagatcaggtttcacttcgcttaa

SEQ ID NO: 465 - DNA, 222 bp, Bacillus licheniformis
atacgacactccgtgacggtgaacagtcgccgggcgttaatttaaacacgcaggagaagctggcgatcgcccagcagcttgaaaaactcggggtcaacattatggaagcgggctttcgcgctacatcccccggggatttcaatgcagggaaaggaatcctgaggacgattaaaaactgtgcggtgacagggcttggccgctctgagaaagagatattggctc

SEQ ID NO: 466 - DNA, 225 bp, Bacillus licheniformis
atggagccttgcgacaggtgtgatgagaagcggcgatgcccctttttgacgcgcgccgtcaacgtacattttcaagtattgtttatacgtcgtatacggctctgtatagcgttctggtttgtctttcgacgcatcattgtgccccatctgaacgaacagccaatcatcctgtttgatcacatccaaaatagatgcaagtcttccttcttcaacgaacgtttttga

SEQ ID NO: 467 - DNA, 225 bp, Bacillus licheniformis
atggattgccctgtttttccaggatttaaagcgaaatttctcctatattttctccggcatgtggcgggatatgtcgccgttgtttcggacgctgctcttttacgtccttctttggctgctcgtatacttgctgcactactgggtgatctatcagcgcagaattttattcttttttattatgaccgttgtttatgtcgcggtgatcgatacatttacgccgtttga

SEQ ID NO: 468 - DNA, 417 bp, Bacillus licheniformis; identical to SEQ ID NO: 412

SEQ ID NO: 469 - DNA, 669 bp, Bacillus licheniformis; identical to SEQ ID NO: 360

SEQ ID NO: 470 - DNA, 526 bp, Bacillus licheniformis; identical to SEQ ID NO: 409

SEQ ID NO: 471 - DNA, 757 bp, Bacillus licheniformis; identical to SEQ ID NO: 302

SEQ ID NO: 472 - DNA, 2439 bp, Bacillus licheniformis
tagcaccgagccaaacgctgagcgaccgcgaataccaaatgcttcgcaatgtctcgctgaaaatcatccgcgcgcttgaaatcgaaggcggctgtaatgttcagctggcgcttgacccggacagctttcagtactacatcatcgaggttaacccgcgggtcagccgttcttctgcgcttgcctcaaaagcgacgggctatccaatcgcaaagcttgccgcaaaaatcgctgtcggtttgtctcttgacgaaatgatgaatcctgttacaggaaaaacgtacgcgtctttcgaacctgcactcgactatgttgtgtcaaaaataccgcgctggccgtttgacaaatttgaatcagcaaaccgcaggctcggcacgcagatgaaagcgacaggcgaagtgatggcgatcggaagaacgtgggaggaatctctcctgaaagcggtccgttctcttgaagcggatgtctaccatctggaactgaaagatgccggtgagatctcgaatgaagtgcttgaaaaacggattaaaaaagcgggagacgaacggctcttttacctggccgaagcgttcagaagaggatacacagtcagcgacctccacgaattttcggcaattgacctgttcttcctccacaagcttgagggaatcatccgctttgaagagaagctgaaagccggacgcggcgacctcggccttttaaaagaagcgaaagagctcggcttttcagaccgctttatcagccttctctgggagatgcctgaacgaaagctttatgatcttagaaaagaagcaggcatcacgcctgtttataaaatggttgatacatgcgcggccgaatttgaatcggagacgccgtatttctacagcacgtatgaagaagaaaacgaatcggtcagaacggacaaaaacagcgtcatcgttcttggctccggtccgatccggatcggccagggggtcgaattcgactatgcgaccgtgcattcggtctgggcgattaaagaagccggctatgaagccattattatcaacaacaatcctgagacggtttcaacagacttcagcatatccgacaagctctactttgagccgcttactgttgaagatgtcatgcatatcatcgatttggagcagccgaaaggcgtcgtcgttcagtttggcggacagactgcgatcaaccttgccgacgagctcgcagaaaggggcgtcgccattctcggaacatcccttgaagatttggaccgcgccgaggaccgcgacaagttcgaacagacgcttgaaatgctgcaggtaccccagccgcttggaaaaacggcgacatctgtggaaggcgccgttgaaatcgcagccaatatcggctatccggtgcttgtccgcccatcgtatgtactcggcggacgtgcgatggagatcgtctaccatgaagcagagcttctccattatatggaaaatgcagtaaaaatcaatccgcagcaccctgtcctgatcgataaatatttgaccggaaaagaaatagaagtggatgccatttctgacggtgaaacggtcgtcattccggggattatggagcacatcgaacgggcgggcgtccactcgggggattcgattgccgtttacccgccgcaatccctttcagaggacatcaagaaaaagcttgaagcatacacgattaagctagcaaagggcttaaacatcgtcggcctgctcaacattcagtttgtcctttcaaaagatgaggtttacgtccttgaagtcaacccgagatcgagccgaacggtgccgtttctcagcaaaatcaccggcattccgatggccaatctcgcaacaaaggtgattctcggagggaagcttgccgatatgggctatacagaaggcctccaaaaagagcaggaaggcgtatatgtgaaagtgccggtcttctcgtttgcgaagcttagaagagtggatatcacgctcggaccggaaatgaaatcgaccggggaagtcatgggcaaagacagcacattggaaaaagcgctatataaaggactgatcgcttcaggcattcaaattccgaactacggctctgttctcctgacagttgctgataaagataaagaggaagggctgttgatcgccaagcggttccatgcgatcggctataaaatcttggctacggaaggaacggcaggctatttaagagatgcatccgtacctgttaaaaccgtcgggaaaatcggcgaagaaggtacaaatctccttgatgtcattcgaaacggggaggcgcagttcgtcgtcaatacgctgacaaaagggaagcagccggcaagggacggcttcagaatcagacgcgaatccgttgaaaacggcgttgcctgcctgacatcccttgatacggcggaagcgattttgcgggtgcttgaaagcatgagcttccgcgccgatcatatgccggcgattaaaa

SEQ ID NO: 473 - DNA, 1139 bp, Bacillus licheniformis
atgcctaaagaccaaaccatcaaaagcattctcgttatcggatcggggccgattatcatcgggcaggccgctgaattcgactactcaggaacccaaggctgcatggcgctgaaaagcgaaggctaccgggtgattctcgtcaacagcaacccggcgacaatcatgaccgatgaatcttttgcagatgaaatctattttgagccgttgacagtggaaagcctcacacaaatcatcaagcgcgaaaaaccggatggactgctcgccaatctgggcggacagacagcgctgaatttggctgtcgagcttgaaaaggccggcattctgaaagcgtacggggtgaagctgcttggaacatctgtcgatacgatcgaaaagggtgaagacagagaaaagttccgcgccttgatgaaagagctgaatgaacctgtgccggattcagaaatcgttgacaatcaggatgatgcgcttcgttttgcgctctcaatcggttttccgattatcgtgcggccggcctatacactgggcggaaaaggaggcggcatcgcggcgacaaaagaggagtttctgcctttaatcgaaagcgccctcctcgcaagtccgatccatcaatgccttgtcgaaaaaagcattgccggttttaaagaaatcgaatacgaagtcatgcgggacagtaacaatacatgcatcaccgtctgcaatatggaaaacatcgatcctgtcggcgtccatacgggagattcgatcgttgtcgccccgtcgcagacattaacggatgcggattatcaaatgctgcgttctgccagcttaaaaatcatttccgcgctcgatgtcgtcggcggctgcaacattcaattcgccttggacccggagagcaaaaactattatgtcatcgaggtcaatccgagagtaagccgttcatcagccctcgcctcaaaagcaaccggctatccgatcgcaaaaatggcggcaaaactggctgtcggctacacgcttgccgagctgaaaaatccgctcacagattcgacctatgcaagcttcgagcctgcgcttgactatgtcgtcgtcaaatttccgcgctggccgttcgacaaattcaaacaagccgaccgcaaggttggcacggaaatggaagcgacagg

SEQ ID NO: 474 - DNA, 1093 bp, Bacillus licheniformis
atgaaaagacgtcttatattagaaaacggaacgatttttgaaggggaagcattcggcagcctggaaaacaccatgggagaagtcgtcttcaacacggggatgacaggctatcaggaaatcctctcagacccgtcatactgcggacaaattgtcaccctgacctaccctttgatcgggaactacgggatcaacagagacgactttgaatccatcaccccttatgtaaaagggtttatcgtaaaggaattatgtcaacttccatcaaactggcgctctgcttatacacttgatgaatatttaaaaatgaaaaacatcccgggactctcagggatagacacgagaaagctgacaagaatgatcagaacggcaggtacgctgaaaggggtatttgccggccctgaagaagatgctggggctttggttcaaaagctgaaagaaacgaaccttccgaccgatcaggtcagccaagtatcaacaaaaacggcatatccgagccctgggagagggaagcgaatcgtgctcgtcgatttcggaatgaaacacggcatcttaagggagctgaacaagcgcaaatgcgatgtgatcgtcgttccccacaatataacggcagaagaagtgatgcagctgaagcctgacggcgtaatgctgtcaaacggacccggagatccaacggacgtaccggaagcgattgcgatgatccaaaacattctcggcaaggttccgctgttcggcatctgtctcggccatcagctgtttgccctcgcctgtggagcaaagacggagaaaatgaagttcggacaccgcggttccaaccatccggttaaagagcttgaaaccggcagagtatcaattacggctcaaaaccacggctataccgtatcgtctgttgaaaacacgccgcttgaagtgacccatgtggcgataaacgacgacacaatcgaagggcttaaacataaacacgaaccggcttttacggttcaataccatcctgaagcttcaccggggccggaagacgcaaaccatttatttgatcaatttttagacatgattgaaaccacagagaaagaaggggaagcggtatgcctaaacgcgt

SEQ ID NO: 475 - DNA, 3213 bp, Bacillus licheniformis
atgcctaaacgcgtagatatcaaaaagattttggtgatcggatcggggccgattattatcgggcaggcggcggaatttgattatgcaggcacacaggcctgcctcgctttaaaagaagaaggctatgaagttattctcgtcaactcgaatccggcgacgatcatgacggatacggaaatggccgaccgcgtgtatatcgaaccgctgacgcttgaattcttaacacggatcatccgcaaagagcggccggacgccatattgccgacattgggcgggcagacgggcctcaacttggcggtcgaactgtcagagcacggcatcttggctgagtgcggcgtcgaagtgctcggcacgaaattgtcggcgatccaaaaagcggaggaccgcgatttgttcagaagcttgatgaatgagttgaatgagcctgttccggaaagcgagatcatccactcgctcggcgaagcgcgcgagtttgtcgagcgcatcggtttccccgtcatcgtcaggccggcatacacgcttggcggaacaggcggaggcatctgctcaaacgaagacgagctgaaggaaatcgttgaaaacggcttaaaaatgagcccggttcatcaatgcctgcttgaaaagagcatcgccggctacaaagaaatcgagtatgaagtcatgagagactcgagcgaccatgcgatcgtcgtctgcaatatggaaaacatcgatccggtcgggattcataccggggacagcatcgttgtagcaccgagccaaacgctgagcgaccgcgaataccaaatgcttcgcaatgtctcgctgaaaatcatccgcgcgcttgaaatcgaaggcggctgtaatgttcagctggcgcttgacccggacagctttcagtactacatcatcgaggttaacccgcgggtcagccgttcttctgcgcttgcctcaaaagcgacgggctatccaatcgcaaagcttgccgcaaaaatcgctgtcggtttgtctcttgacgaaatgatgaatcctgttacaggaaaaacgtacgcgtctttcgaacctgcactcgactatgttgtgtcaaaaataccgcgctggccgtttgacaaatttgaatcagcaaaccgcaggctcggcacgcagatgaaagcgacaggcgaagtgatggcgatcggaagaacgtgggaggaatctctcctgaaagcggtccgttctcttgaagcggatgtctaccatctggaactgaaagatgccggtgagatctcgaatgaagtgcttgaaaaacggattaaaaaagcgggagacgaacggctcttttacctggccgaagcgttcagaagaggatacacagtcagcgacctccacgaattttcggcaattgacctgttcttcctccacaagcttgagggaatcatccgctttgaagagaagctgaaagccggacgcggcgacctcggccttttaaaagaagcgaaagagctcggcttttcagaccgctttatcagccttctctgggagatgcctgaacgaaagctttatgatcttagaaaagaagcaggcatcacgcctgtttataaaatggttgatacatgcgcggccgaatttgaatcggagacgccgtatttctacagcacgtatgaagaagaaaacgaatcggtcagaacggacaaaaacagcgtcatcgttcttggctccggtccgatccggatcggccagggggtcgaattcgactatgcgaccgtgcattcggtctgggcgattaaagaagccggctatgaagccattattatcaacaacaatcctgagacggtttcaacagacttcagcatatccgacaagctctactttgagccgcttactgttgaagatgtcatgcatatcatcgatttggagcagccgaaaggcgtcgtcgttcagtttggcggacagactgcgatcaaccttgccgacgagctcgcagaaaggggcgtcgccattctcggaacatcccttgaagatttggaccgcgccgaggaccgcgacaagttcgaacagacgcttgaaatgctgcaggtaccccagccgcttggaaaaacggcgacatctgtggaaggcgccgttgaaatcgcagccaatatcggctatccggtgcttgtccgcccatcgtatgtactcggcggacgtgcgatggagatcgtctaccatgaagcagagcttctccattatatggaaaatgcagtaaaaatcaatccgcagcaccctgtcctgatcgataaatatttgaccggaaaagaaatagaagtggatgccatttctgacggtgaaacggtcgtcattccggggattatggagcacatcgaacgggcgggcgtccactcgggggattcgattgccgtttacccgccgcaatccctttcagaggacatcaagaaaaagcttgaagcatacacgattaagctagcaaagggcttaaacatcgtcggcctgctcaacattcagtttgtcctttcaaaagatgaggtttacgtccttgaagtcaacccgagatcgagccgaacggtgccgtttctcagcaaaatcaccggcattccgatggccaatctcgcaacaaaggtgattctcggagggaagcttgccgatatgggctatacagaaggcctccaaaaagagcaggaaggcgtatatgtgaaagtgccggtcttctcgtttgcgaagcttagaagagtggatatcacgctcggaccggaaatgaaatcgaccggggaagtcatgggcaaagacagcacattggaaaaagcgctatataaaggactgatcgcttcaggcattcaaattccgaactacggctctgttctcctgacagttgctgataaagataaagaggaagggctgttgatcgccaagcggttccatgcgatcggctataaaatcttggctacggaaggaacggcaggctatttaagagatgcatccgtacctgttaaaaccgtcgggaaaatcggcgaagaaggtacaaatctccttgatgtcattcgaaacggggaggcgcagttcgtcgtcaatacgctgacaaaagggaagcagccggcaagggacggcttcagaatcagacgcgaatccgttgaaaacggcgttgcctgcctgacatcccttgatacggcggaagcgattttgcgggtgcttgaaagcatgagcttccgcgccgatcatatgccggcgattaaaatcgcccaaaaggcggccgtcagatga

SEQ ID NO: 476 - DNA, 1287 bp, Bacillus licheniformis
acacagcgccgtgcacggcgtcatgacgctgaaaagcctcggatttgaaacgatcatgctgaacaacaatccggaaaccgtcagcacggattatgaaatggcggaccgcctgtactttgaaccgattacacccgagcatattctcaatgtcgctgaagcggaagacatcgactttgcgattgtgcaattcggcggccaatccgccatcaatgtagcgcaagcgattgaaaaagcgggcatcaccctgcttgggacatcatcggaaacccttgacatacttgaagaccgcgatcaattttatcagctgcttgacgagctcggcatctcccatgccaaaggagaaacggcttcatcaaaagcggaagcggtgaaaaaagcgaacgaaatcggctatcctgtgttgatcaggccgtcatacgtgatcggcggaatgggcatgatgatcgttcactcagaagcggagctcagagagctgctgggcggggcatcgcaaatgccttacccgattctgatcgatcaatacgtatcaggaaaagagtttgaaatcgaccttgtcagcgatggcggcgatctctacatcccgacttatatcgagcatattgaaaaagcgggcgtgcattcaggtgacagctacgcgattttgccggggccttcggttactccggagatgaaaagcgccgctcgggatgctgccgcaaaaatcgtccgcaagctcggatttaaaggcattatgaacattcaatttatagcggattcggatgagctgctcatccttgaagtcaatccgagggcgagccggacggttccggttgtcagcaaggtgatgggagttccgatgatcccgcttgcggcgaaactgttagccggttcgtcactcaaagaactgaagcccgccgccaaaaattcacgcggcgttgccgtgaagtttccggtcttttcatcgcacgccattcaagatgtcgatttgaagcttgggccggaaatgaaatcgaccggtgaaggcatgtatgtcggcttcaatccggaaagcgccctgaagaaaatctttgcaggaatctggcaaacgaaaggctgcatttacatggaaggagccggcgagctccgttctctcgcagaacaggcgggcttcaccgtacagtcggacgattttccgggctggatcaaacggaaggacaaagcgctgcacatccatttagccgagtcaaaagaggcgagaaagcagaggatagaagccgtcactcacggcgtggcggtgatgacggaagaagagacggtgcgggcattttt

SEQ ID NO: 477 - DNA, 1025 bp, Bacillus licheniformis
atggaaggatatttagttcttgaagatggtacatccttcagcggagaactggacggtcttgacggctgcaccggtgaagtcgtcttttttacgggcatgaccggttatcaggaggttttgacagatccttcatataaaggccagattattgtctttacgtatccgctgattggcaactatggaattaatggaagcgatgctgaaagcaaacagcctcaggtgagaggggtcgtcgtctatgaagcgtgcgacagattttcccaccatcaggcgacagaaagccttcgggaatacttggcgaagtgggatgttccgcttttgtcgcacgtggacacaagagcggttgttcagcatatcagggcaaaagggacgctgaatgcgaggctgacgaaacaaaaggacgacatcccggctccgcgccagctggaaaactatgcggcacaggtttccggacaaaacgaaaacggcgcttttggggaaggcaatacgcatattgcgctgatcgatttcggctataaaaagtcgatcgcttcatcgctagcaaaccggggctgcaaagtgacggtcgttccctatcaagagatggacggcattgcgaagctgaatccggacggaatcgtcctttcaaacgggccgggcgatccgaaagcgatccttccatatatggatgcactccggggtatcatttcttcctatccgacgctcggcatctgcctcgggcaccagctgatcgcgctcgcattcggaagcgacacgtataagcttccgttcggccacaggggagccaatcatccggtcatggacaaagagaccggacgcgtgttcatgacaagccaaaatcacagctatgtcgtcgatcgggacaccatcagcgaaaatgaattttccgtcaggtttcatcatgtcaacgacggttcagtagaagggctgatgcataaaacactgcctgtcctatccgttcagtttcatccggaagcccatccgggaccggctgaaagcgaatggatattcggagaatatttgca

SEQ ID NO: 478 - DNA, 555 bp, Bacillus licheniformis
ttttggtgatcggatcggggccgattattatcgggcaggcggcggaatttgattatgcaggcacacaggcctgcctcgctttaaaagaagaaggctatgaagttattctcgtcaactcgaatccggcgacgatcatgacggatacggaaatggccgaccgcgtgtatatcgaaccgctgacgcttgaattcttaacacggatcatccgcaaagagcggccggacgccatattgccgacattgggcgggcagacgggcctcaacttggcggtcgaactgtcagagcacggcatcttggctgagtgcggcgtcgaagtgctcggcacgaaattgtcggcgatccaaaaagcggaggaccgcgatttgttcagaagcttgatgaatgagttgaatgagcctgttccggaaagcgagatcatccactcgctcggcgaagcgcgcgagtttgtcgagcgcatcggtttccccgtcatcgtcaggccggcatacacgcttggcggaacaggcggaggcatctgctcaaacgaagacgagctgaaggaaatcgttgaaaacg

SEQ ID NO: 479 - DNA, 1740 bp, Bacillus licheniformis
cttaaaggtgtttcaaggcaaaaatgagcagggaatggcgcatgcagcaatggcttacagcaagcaaatgctgagaaggaagatctatgccgtgtcgacatcagtcggaccgggagcagctaaccttgtggcagccgcaggtactgcgcttgcgaacaacattccagtcctcttgattccagccgatacatttgccacgagacagcctgatcctgttcttcagcaagtagagcaggaatacagtgcggcgattacgacgaacgatgcattgaagcctgtttcgaggtattgggaccgtattacgcgccctgaacagttgatgagcagtctgattcgcgcttttgaagtaatgacagaccctgcaaaagctggtcctgcaacgatttgcatttctcaagatgttgaaggcgaggcctatgatttcgatgaaagcttttttgaaaaacgcgttcactatgttgatcgcaaagagccgagcgagcgtgaactgaagggagcggcagaactgatcaagtcgagcaaaaaaccgctcatcttggtcggcggcggagcgaaatattccggcgcgcgcgacgaattgatcgccatgtctgaagcttacaatattccgctggtagaaacccaggccggtaaatccacagtagaagccgattttgccaacaatttgggcggaatgggaatcaccggtacgctggcggcaaacaaagcggctcgcggggcagacctgatcatcggaattggcacgcgctataccgattttgcgacatcatcaaaaaccgcttttgactttgacaacgcaaaatttttaaacattaatgtcagcagaatgcaggcttataaactggatgctttccaagtcgttgccgatgcaaaagtaacgctcggcaaactgcacggcttattggaaggctataagagcgagttcggttcaaccatcaaggagctgaaagacgaatggcttgctgaacgcgaccgcttaagcaaggtaacatttaagcgcgaaaacttcactcctgaaattaaagatcacttttctcaagacatactcaacgaatatgcggatgtgctgcaaaccgaactgccgcaaacaacggcattgctcgccatcaatgaaacagttgatccggacagcgtcgtcatttgttcagcaggctctttgccgggagatctgcagcggctgtggcattcaaacgtaccgaatacgtaccacctggaatacggctattcctgcatgggatatgaagtatcgggaacgctcggcttgaaattggcgcatcctgatagagaagtttattcactggtcggagacggaagcttcctgatgctccactcagagctcattacagcaatccaatataataaaaaaattaacgtgctgctctttgacaactcaggattcggctgcatcaacaatctgcaaatggaccatggaaacggcagctactactgtgaattcagaacagcagacaatcagattctcaatgtcgattatgcgaaagtggccgaaggctatggagcgaaaacctacaaagcgaacacgattgaagaattaaaagcggcgctggaagatgccaaaaaacaagatgtctcaacattgattgaaatgaaggtgctgccgaaaacgatgacggacggctatgacagctggtggcacgtaggtgttgcagaggtttccgaacaggaaagcgtgcaaaaggcgtataaagcaaaagaaaaaatgctggaatctgcaaagcagta

SEQ ID NO: 480 - DNA, 1722 bp, Bacillus licheniformis
atggcaaacaaaaccgcaggaaaaatagctgcagaaatgctgaaggaatggaacaaaaatcatgtttacggcatgccgggcgacagcgtcaacgaatttatcgatgaattgcggcatgaagaaaacagcctccgcttcattcaagtgcgtcatgaagaaaccgctgctctcgctgccgcagccgatgcaaagctgacaggcaaaatcggcgtctgcctttcgatagcgggcccgggcgccgttcatctgctgaacggcttgtatgatgcgaaagctgacggggcgcctgtgcttgcgattacaggacaggtgtcttcggatgaaatcgggagagattattttcaggagatcggtcttgaacgaatgtttgaggatgtggctctctttaatcagcaggtgcattcggctgaagccctgccagatcttttgaatcaggcgatccgtaccgcatacagccaaaaaggggccgccgttctgagcgtatccgatgatctgtttgcagaaaagattaagcggaagccggtttatacgtctgcgctttatatcgaaggcgatcttgaaccgaagaaaagccagctgatgcagtgtgcacaattgattaaccaggcaaaaaaaccggtgattttagcgggacggggaatgaaatcggcgagagacgagctgctcgagtttgcagataaagcggccgctccgatcattgtcacactcccagcgaaaggggtcgtacctgatcggcacccgcatatgctcgggaacctcggacacatcggcacaaagcctgcatatgaagcgatggaggaaagcgatctgttgatcatgctggggacttcatttccgtaccgcgattatctgccggaagatgccccggctattcagcttgacaacaatccggcgaaaatcggcaaacggtatcctgtcaccgccggccttgtctgcgatgcgaaaaaagggctttttgaactgacgaaaacaattgaacggaaatcgaaccgcgcatttttggaaagctgtatacaacatatgaggaagtggcgttatgaagttgaaaaagacgaacaggtagcgacagagccgctgaagcctcagcaggtgattgcaagacttgaggacgcggtcgcagatgatgcggttctgtccgttgacgtcggaaatgtgacggtttggacggcgcgccattttaatatgaccaatcaggattttttgatatcaagctggcttggcacgatgggatgcggtcttccaggcgcgatttctgcaaagctttcccatccggaacgccaggttgtagccgtgtgcggagacggcggtttcagcatgtctatgcacgattttccgactgctgtcaaatacgaactgcccattgttgttgtgattttaaataatcagaacttgggaatgattcaatatgaacagcaggaaaaagggcatgttaattatgcgacggcgctcgaaaacgtcgattatgccaagtttgccgaagcctgcggcgggaagggcttcagcgtgacaaagcacgaagagcttattcctgctttgaaaagcgcctttcattcacaaaagccgtcgattatcgatgtggcaattgaagacgaaccgcctcttccgggaaaaatatcctatacacaagctgtaaactacagcaaatatatgatcaaaaaactagttgagaaaaaagagctcgacttgccgccgctgaaaaaaagtttaaaaaggattttttag

SEQ ID NO: 481 - DNA, 1503 bp, Bacillus licheniformis
tgcaaggatttccgggaaaccgggtgtcgtcatcgctacatccggaccgggagcgaccattccttgtaacgggtctggccgacgcgatgatcgattcattgcctctcgtcgtattcaccggtcaggttgcgacatcggttatcggatctgacgcattccaagaagcggacgtcatcggaattacgatgccgattacaaagcacagctaccaggtacgcaatgccgaagatttgccgagaattattaaagaagcattccatatcgcaacaacaggaagaccgggccccgttttaatcgatattcctaaagacatcgccgttgtagaaggagaattccgctatgaccacgacattcaccttccgggctatcagccgacgaaggaaccgaattatctgcagatcagaaagcttgtggaagcggtcagtgcagcgaaaaagccggttattttagcgggtgcgggcgtcttgcacgggaaagcgtcagaagaattaaaaaattatgtcgaacagcagcagattccggtggcacatacgctgttaggcttgggaggatttccggccgatcatccgcttttcctcgggattgccggaatgcacggaacgtatgcggccaacatggctctgtatgaaagcgatctgttaatcagcatcggtgccaggtttgatgaccgggtcacagggaacttgaagcattttgcaaaatatgcgaaagtcgctcacattgacatcgatccggctgaaatcggcaaaaacgttcatacgcacattccggttgtcggcgacagcaagcttgtactgacggagctgatcaagcaaaacggcaagccgagcgcttctgatgagtggaaaaagcagcttgcggcatggaaaaccgaatatccgctctggtatgaagaaaatgaaacagaaggattcaaaccgcagaagctgatcgaatatatccaccgctatacaaagggcgaagctattgtaacaacagacgtcggacagcaccaaatgtgggccgcgcaattttatcagttccaaaaagccgacagatgggtcacttccggcgggctcggcacaatgggcttcggacttccggcggcaatcggagcacagcttgcggataaggatgcgacggttgtatcgatactcggcgacggaggattccagatgacgctgcaggagctgtctgttattcacgatctgaaccttccgatcaaggtcgtggtcttaaacaaccgctgcctcggaatggtccggcaatggcaggaaatcttttacgatgagcgctattcgcactccaagttcacatcacagcctgatttcatcaagctgtctgaagcttacggcatcaaaggcgtccgaatcacatccgaagaagaagcggaagaaaagctggaagcggcgctaacgtcgaatgaaccgatggtcattgatgttcaagttgcacaagctgaaaaagtatttccaatggttgcgcctggaaaagggctgcacgaaatggtgggggtgaaacctt

SEQ ID NO: 482 - DNA, 1284 bp, Bacillus licheniformis
  misc_feature (1)...(1284): n = A,T,C or G
gagaatacagcaancaggnaacgaccctgtcgcaatagcgaaagggaaagacggtatcacgacgattcaatataaaggggacgtcatattcaaagagggggatccgtttctgcagttttctcaatggtttgaaacgctgaaaacggagacagttgcagattttcccgactttcagggcggggctgtcggtttttttagctatgactatgcccggtatattgagaaattcaaaatcctgtctattgatgatctgcaaacgccggatttattctttttcgtatttgatgatatagccgtctatgaccatgagcagcagcagctttgggtgattacccacactgatgaagaaacgccggccgctgcggaagagaaattggacaggcttgagcaaatgtggaagacggaacatccgaaggccgctggaggtcatcagccgaatgataacaaaggcccggcattcgcggcctcatttacagaagccggcttttttcaggctgttgagaaagtgaagcaatacatcgcaagcggtgacgtatttcaggtgaatctttttgttcgccagtcggagggcctttttgggcctccttattaggtggataaaatgttaaaaaaaatcaaccctttgccggacatggcctacttggaaaccccggattttcaaatcatttgcgggtcgcctgaactgctcattaagaaaaagggcaccaggcttgaaacaaggccgattgccggaacgcgatcccgcggggcggatgaagcggaggatgaagcgctcgcgaacgaattgatcatgaatgaaaaagagcgcgccgaacatgtgatgctcgttgatttagagcgtaatgacctcggcagggtctccaagtacggttcggtccgggtcgatgaattcatggtgattgagaagtattcccacgtcatgcatattgtctcaaatgtgtgcggtgaactaagggatgaatgcgatgccgttgatgtcatccatgccgtgtttcccggaggtacgatcaccggagcgccgaaagtcagaacgatggaaattattgaggagcttgagccaacgagacgggggctttatactggttctatagggtggttcggatataatcaggatatgcactttaatatcgtcatccgaacgatttatgtgaaagcgggccaggcgttcatgcagtcgggagcgggaatcgtcatcgattcaaatcctaggcatgaatataaagagtcaattaaaaaggccctggcgatgaaaaaggcgctgcagttgagtgaagaagagaaaaa

SEQ ID NO: 483 - DNA, 1002 bp, Bacillus licheniformis
ttcaaagaaaacgtttagcaggcaaaaaagtagcggtgatcggatacggctcacaaggtccatgcgcacgccactgaacctgaaagaaaagcggagtggacgtcattgtcggcgtcagaaaagggaaatcctttgcaaaagcagaggaagacggccatcaagttttcacggtaagagaagcggcagaacaggccgacatcgtcatggtgcttcttccggatgaacagcagcaaaaagtgtatgaagcggaaattaaagacggacttcaagctggcaattcacttgtattcgcccacggattcaacgttcatttccatcagatcgtgcctccggcggatgttgacgtattccttgtcgctcctaaaggaccgggacatcttgtcagaagaacgtttgaacaaggtgcgggggttccggcgctgtttgcgatctatcaggatgtgacaggggaagcgaaagacaaagcccttgcttatgctaaagcgatcggcggcgcaagagccggtgttcttgaaacaacatttaaagaagaaactgaaaccgatcttttcggagaacaggcggtgctgtgcggaggattgacttcccttgtcaaagccgggttcgaaacgctgacagaagcgggctatcagcctgaactcgcatacttcgagtgtctgcacgagctgaagctcatcgtcgacttgatgtatgaagaaggtttggcagggatgagatattcgatttccgacacagcgcagtggggagacttcgtatcaggtccgcgcgttgtcgatgagaaggtaaaagaatcaatgaaagaagtattgaaagacatccaaaacggtacattcgcaaaagagtggatcgtcgaaaaccaagtcaaccgtccgcgtttcaacgccatcaatgcaagcgaaaacgaacaccaaatcgaagtggtcggcagaaagcttcgcgaaatgatgccgtttgtcaagcagggcaagaaaaaggaagcggtggtagccggtgcgaaaaatt

SEQ ID NO: 484 - DNA, 1074 bp, Bacillus licheniformis
ccttcctgtcgtgcttgtcgggatgaaaggcggaagacctgaagcgattgaagcggttcggcgtctgctaaggaaagtgaaactgccgtttgttgaaacataccaagcagcgggtacgctgtctcacgatttggaagaccagtacttcggccggatcggactattccgcaatcagcccggagacatgctattggaaaaagcggatgtcgttttgacggtcggctatgatccgattgaatacgatccggtcttttggaatggaaaaggcgaacgaagcgtgattcatcttgacgaaatacaagccgatatcgatcatgactatcagcccgaaatcgagttgatcggcgatatcgcagagacgttaaaccatattgaacatgattctctgccggtttccatcgacgagtcctttgcacctgtccttgattacttgaagaaagcactggaggagcaaagcgaacctcctaaagaaacaaaaactgatcttgttcatccgctgcaaatcgttcgcgatttgcgtgaactgctgagcgatgacataacggtgacttgcgacatcggctcccatgcgatttggatgtctagatatttccgcacctaccgtccgcatggactgctgatttccaacggcatgcagacgcttggggtggctttgccgtgggcgattgcagcaacgctggtcaatccgggacagaaagtcgtgtctgtttccggggacgggggcttcctgttctccgcgatggagcttgagacagcggtcagattaaaagcgccgatcgttcacattgtctggaatgacagcacatacgatatggttgcgttccagcaggagatgaaatacaagcggacgtccggagtcgacttcggcggaatcgatattgtaaaatatgctgaaagctttggtgcaaaaggtttaagggtcaattcacctgacgaattggcagaggtgcttaaagctggtcttgatgcagaggggcctgttgtcattgatattccggtcgattacagcgacaacattcatttggccgatcagcgttttccaaaaaaatttgaggaacattttaataaagaagc

SEQ ID NO: 485 - DNA, 699 bp, Bacillus licheniformis
tttttacttacagcacatgggaggaaccaaacatctcttttcaggaagatgactcttataaaggagcgctgtccgtcctgaaatgggcgtacggacatatcggggatcagctcgtatacgcgtgcagcttcggaattgaggggatcgtcctgatcgatttgatttataaggtgaaaaaagatgcagttatcgtctttcttgatacagggattcattttaaagaaacgtatgaaacgatcgacgccgtcaaagaacgatatccaggccttcagattatcatgaaaaaaccggagcttaccgtcgaagagcaggcgaaagaatatggggacgaactatggaagaccgctccgaattcctgctgcgaaatgaggaaggtcatccctctccgcgagacgctttcaggctacccggcgtggctgtctggtctgcgccgcgagcaatcgcccggacggagcaaaacgaattttttgaacaaagatgaaaaattcaagtctatcaaagtttgtccgctcattcattggacgtggaaggatatttggagatatgtgacaaagcacgatctcccatacaatccgcttcatgatcaaggctatccgagcatcggctgcgctccgtgcacctctccggcctttacaatggatgatcttcgatccggccgctggaacggatcggctaaaacagaatgcggattacacgagt

SEQ ID NO: 486 - DNA, 823 bp, Bacillus licheniformis
  misc_feature (1)...(823): n = A,T,C or G
ttgagtctgcaaaccgattttgcctctttttcagaggattcttcacactttaaaacgataccgattattgagagtttttccgtcgatacgctgacgcccgttcaattggtcgagaagctgcaggaagacatcgtctatttgctggaaagccaggatgaaacctctgcatggtcaagatattctttcatcggccttgacccctttttgacgatcaaagaagaacgcggccggtttcacgcctgcgatcaaaagcagaagaagctttattcggcttcacagttaaaagacgttctcgaatggatgtcggagacgtattcgatcaaagcgcctgagctcgacatcccgtttacaggaggagcggtcggctatttaagctacgatttaatgccgctcattgaaccgtccatcaaagggcacagcaaagaaacggaaatggcaaaatgcctcctgtttgtctgccggacgatgatcgcttatgatcacgaactgaaaaagctgcatttcatccactatacaaggcttgaaggcagtgaaaatagggaggaaaagcgccgcattttcaaaaaggggaaagaagagctcaagcagcttacacacaggctgtcagaccggaaaacgccgaaagagctgtttcttccgcaaggacggcacacggcccccagctttgaagggattcaatcaacatatgagaaatcccggtttttggccgatgtcgatcgcttgaaagaatacattaaagcgggagacatttttcaaggcgtcctttcgcaaaggttcgacattccggtgaaggtcggttcttttgagttatacagagtgctna

SEQ ID NO: 487 - DNA, 711 bp, Bacillus licheniformis
atgaacgatgttttaacgtatagcacatgggatgaaaaagcttctgaagaggtgatggatactttcagcggcgagatggacgttttgaaatgggcgtacagcacgtatcaaaaaatcgtttacgcctgcagcttcggcgcggaaggaatcgttttgatcgacttgatttcaaaggttgtgaaagaagcggacatcgtgtttttagatacaggactgcattttccggaaacatatgagctgatcaatgaagtgaaagatcgctatcccggtctgtcgatccactttttaaaacccggcctctcacttgaagagcaggaaaaacgctatggcagcgaactttggaagcgccagccggaccagtgctgccgccttcgcaaaatcgagccgctcagggagcatctgtcaggcatggaagcctggattaccgggctgaggcgggagcagtcggaaacacggaaacatgtccgatatatcaacaaggacgacaattttaaactgattaaaatctgcccccttattcactggacatgggaggatgtctggacttacattaagctgaatcagctgacgtatcacaagcttcatgatcaagattatccgagcatcggctgtgaggtgtgtacgcttcccgtgacagacagcggcaatttaagagcgggaaggtgggcccaccaggaaaaaacagaatgcgggctgcatcaattccggtag

SEQ ID NO: 488 - DNA, 836 bp, Bacillus licheniformis
atgatcatttacctgaacggtcaatatgtaaaggaggaggaagcaagactttctccttttgaccatggttttttatacggagtcggggtattcgaaacgttccggctttatgaagggaagcccttccttttagactggcatatggacagattgaacaacgctttggaacagctgaaaattgagcttgagctgacaaaaagcgaagtgcttgtcattcttgacaggctgcttcagttgaatcagccgcagaatctggatgcgagggtccggctaaatatatccgccggtcccggcggccccggcctttttcctgattcatacaaaaatcccggcgtcatggtgatgatgaatccttttcagcctgcatccgttccggctgaaaaggagggcgtcatcttgcaggtccgccgcaatacgccagagggtccgttccgcttgaaatcgcatcactttttaaataatttgtacggaaaaagggagctcggacatgacgcggccaaagaagggatttttcttaccgaaggcggagctgtagctgaaggaattatttccaacgttttttggcggaaaggcagctgtgtgtatacaccttctcttgataccggcatattaggcggtgtcacacgccgctacgtcatcgagcgccttgcagatatgggaatcgaagtcatagagggggtataccccttggaagagcttctctttgcggacgaagcatggatgaccaattccgttcaggaaatcgttccattccggagaatcggcagcactgaatttccgggaaaggatggaaatttgtcgaaacgtctgcaagaggcatacactaatgataggaa

SEQ ID NO: 489 - DNA, 581 bp, Bacillus licheniformis
atgattctaatgatcgacaattacgattcgtttacgtacaacttggttcagtatttaggcgagcttggcgaggagttggtcgtcaagcggaacgatgagatcacccttcaggaaatagaggacatgtcgcctgactttttgatgatttctcccgggccttgcagtccggatgaggccgggatcagccttgaagcgatccgccattttgccgggaagataccgattttcggggtttgcctcggacaccagtcgatcgcccaggttttcggcggcgatgtcgtcagggcagagcggctaatgcatgggaaaacttccgagatttcgcacgacgggctgacggtttttaaaggcctggaacatccgctcacggccacgaggtatcattctttgatcgtcaaaccggatacactgcccgattgttttgagacatcggcttggacggaagaaggggagattatggccatcaggcataaagaactgccggttgaaggcgttcagttccatccagagtcgattatgaccgcttacggaaaagagatgctgaagaattttattgagacttaccgaaagaaagtgaacgc

SEQ ID NO: 490 - DNA, 1746 bp, Bacillus licheniformis
atgaatgaaaatggaggagtgagggctttgaataatgtagccgctaaaaatgaaactcttactgtaagaggagcagagcttgtggtggatagtctcattcagcaaggtgtcactcatgttttcggtattccgggagcgaaaatcgatgcggtgtttgacgtattgaaagacaaggggcctgaattgatcgtttgccgtcacgagcagaatgcagcatttatggcggcggcagtcggacgattgactggaaagcccggtgtttgcctggtgacttcaggtccgggagcgtctaatttagcgaccggtcttgtaacagccaatacagaaggagatccggttgttgccctggcgggtgctgtaaaaagagcggatcgtctcaaaaaaactcatcaatcgatggataatgcggcgttgtttcagccgattacgaaatatagcgcagaagtggaagatgcgaacaacatacctgaggctgtaaccaatgcattcagagcggcggcttctggacaggctggcgcagcgtttctcagctttccgcaggacgttacggccggtccggcaactgccaagccggtgaaaaccatgccggcgccgaagctgggcgcggcttcggacgaacaaatcagcgcggccatcgccaaaattcacaatgcgaaccttcctgtcgtgcttgtcgggatgaaaggcggaagacctgaagcgattgaagcggttcggcgtctgctaaggaaagtgaaactgccgtttgttgaaacataccaagcagcgggtacgctgtctcacgatttggaagaccagtacttcggccggatcggactattccgcaatcagcccggagacatgctattggaaaaagcggatgtcgttttgacggtcggctatgatccgattgaatacgatccggtcttttggaatggaaaaggcgaacgaagcgtgattcatcttgacgaaatacaagccgatatcgatcatgactatcagcccgaaatcgagttgatcggcgatatcgcagagacgttaaaccatattgaacatgattctctgccggtttccatcgacgagtcctttgcacctgtccttgattacttgaagaaagcactggaggagcaaagcgaacctcctaaagaaacaaaaactgatcttgttcatccgctgcaaatcgttcgcgatttgcgtgaactgctgagcgatgacataacggtgacttgcgacatcggctcccatgcgatttggatgtctagatatttccgcacctaccgtccgcatggactgctgatttccaacggcatgcagacgcttggggtggctttgccgtgggcgattgcagcaacgctggtcaatccgggacagaaagtcgtgtctgtttccggggacgggggcttcctgttctccgcgatggagcttgagacagcggtcagattaaaagcgccgatcgttcacattgtctggaatgacagcacatacgatatggttgcgttccagcaggagatgaaatacaagcggacgtccggagtcgacttcggcggaatcgatattgtaaaatatgctgaaagctttggtgcaaaaggtttaagggtcaattcacctgacgaattggcagaggtgcttaaagctggtcttgatgcagaggggcctgttgtcattgatattccggtcgattacagcgacaacattcatttggccgatcagcgttttccaaaaaaatttgaggaacattttaataaagaagcctctaagcaatcttga

SEQ ID NO: 491 - DNA, 672 bp, Bacillus licheniformis
ccgtccccgtactgtactacatgaggcttcctgaccgcgatctcgtcggaagctcgcccgaacgtctgatccatgttcaaaacggccatcttgaaatccatccgatcgccggcacaaggaaaaggggcggtgatcaggctgaggataagcggcttgaaaaagaactattggctgatgagaaagaaaaagcggagcattacatgcttgtcgatttggcgagaaatgatatcggcagagtagctgagtacgggtctgtccaagtgcccgagtttacgaaaatcgtttccttttcgcacgtcatgcacatcatttcgatcgtaaccggcactttaaaagcgggtgtccacccggttgacgctttaatgagcgcatttccggccggaactttgaccggcgctccgaaaatccgcgcgattcagcttttaaatgagcttgagcccgaaccgagggaaacatacggaggatgcattgcttacatcggatttgacggaaatatcgattcgtgcatcacgatccggacgatgagcgtgaaaaacggagtggcgtccattcaggccggggcgggcatcgtagccgactccgtgcctgaaaaagaatgggaagagacctgcaataaagcaggggctctgttaaaaacgattcaaatcgcagaagaaacgtttctcgaaaagg

SEQ ID NO: 492 - DNA, 810 bp, Bacillus licheniformis
tctatgaatacggatttttatacggggacggcgtgtttgaagggatcagggtatacgacggcaacatcttcagaatgcaagagcacatggaccgcctctacgattctgcgagatcgatcatgctggagattccatatccacaggaagaactgacacagcacgtactcaaaacagtcgaaaaaaacgggctgaaagacgcttacatccgcttggtcgtttcaagaggagcaggtgacctcggactcgatccaaacaattgttcaaacccgagtgtcatcataattgtcgaaccattggcaatattcccgaaacatttatatgaaacggggattgacattgttacggttccgacaagaaggaacagacccgatgtgctgagccctaaagtaaaatcgctgaactacttaaacaatattcttgtccggatcgaggcgcatatggcgggtgtgacggaagcgctcatgctcaatgatcaaggctatgtcgccgaagggtctgcggataacgtatttatttataaaaacggaaagctcttgacgcctccgggctatatcggagcgcttgaaggaatcacccggaatgccatcatcgaaatagcgcgagagctcggctatgaagtgaaagaagagccgtttacccgccatgacgtatacacagccgaggaagtgtttttaaccggaacggctgcagaagtcatcgcggtcgtaaaagttgacggccgcaagatcggggacggcaaaccgggagtccacacaaaccggatgcttgaaaagttccgcgagcgcgtcgtccgtgaagggttaaaagtca

SEQ ID NO: 493 - DNA, 1539 bp, Bacillus licheniformis
atgaacaaggcgccatccacgcagccgaaggatatgcaaggatttccgggaaaccgggtgtcgtcatcgctacatccggaccgggagcgaccattccttgtaacgggtctggccgacgcgatgatcgattcattgcctctcgtcgtattcaccggtcaggttgcgacatcggttatcggatctgacgcattccaagaagcggacgtcatcggaattacgatgccgattacaaagcacagctaccaggtacgcaatgccgaagatttgccgagaattattaaagaagcattccatatcgcaacaacaggaagaccgggccccgttttaatcgatattcctaaagacatcgccgttgtagaaggagaattccgctatgaccacgacattcaccttccgggctatcagccgacgaaggaaccgaattatctgcagatcagaaagcttgtggaagcggtcagtgcagcgaaaaagccggttattttagcgggtgcgggcgtcttgcacgggaaagcgtcagaagaattaaaaaattatgtcgaacagcagcagattccggtggcacatacgctgttaggcttgggaggatttccggccgatcatccgcttttcctcgggattgccggaatgcacggaacgtatgcggccaacatggctctgtatgaaagcgatctgttaatcagcatcggtgccaggtttgatgaccgggtcacagggaacttgaagcattttgcaaaatatgcgaaagtcgctcacattgacatcgatccggctgaaatcggcaaaaacgttcatacgcacattccggttgtcggcgacagcaagcttgtactgacggagctgatcaagcaaaacggcaagccgagcgcttctgatgagtggaaaaagcagcttgcggcatggaaaaccgaatatccgctctggtatgaagaaaatgaaacagaaggattcaaaccgcagaagctgatcgaatatatccaccgctatacaaagggcgaagctattgtaacaacagacgtcggacagcaccaaatgtgggccgcgcaattttatcagttccaaaaagccgacagatgggtcacttccggcgggctcggcacaatgggcttcggacttccggcggcaatcggagcacagcttgcggataaggatgcgacggttgtatcgatactcggcgacggaggattccagatgacgctgcaggagctgtctgttattcacgatctgaaccttccgatcaaggtcgtggtcttaaacaaccgctgcctcggaatggtccggcaatggcaggaaatcttttacgatgagcgctattcgcactccaagttcacatcacagcctgatttcatcaagctgtctgaagcttacggcatcaaaggcgtccgaatcacatccgaagaagaagcggaagaaaagctggaagcggcgctaacgtcgaatgaaccgatggtcattgatgttcaagttgcacaagctgaaaaagtatttccaatggttgcgcctggaaaagggctgcacgaaatggtgggggtgaaaccttga

SEQ ID NO: 494 - DNA, 834 bp, Bacillus licheniformis
aagttctttttaacggccggctgattgaacggagcgagtgtgcggttgatattgaggacagaggctaccaatttggagacggcgtctatgaagtcatccgcatttacaatggaattttgttcacgcttgatgaacacattgcccgcttatataaaagcgcagccgaaatcggaatcgacctgtctttttcagaagccgagctgaaaagccagctgaaagagctcgtcgacatcaatcagatgcgggaaggcgggctgtatcttcaagtgacaaggggaaaagctccgaggaagcatcaatacggagcagggcttacgcctcaggtgacggcttatacatttcctattcagaagcctgaaaaagaacagcaaaacggcgtttcggctattactgcggacgacatgcgctggctgaggtgcgacattaaaagcttaaatctgttgtacaacgtcatgatcaagcaaaaagcgcatgaagcttcttcattcgaagcgatcttaattcgcgacggtttggtgacggaagggacgtcttcaaatgtttatgtcgtcaaacaaaacgctatctacacccatcctgcgacaacgctcatcttaaacggcatcacgcggatgaaagttcttcagctgtgtgaagagaacggcttgaattacgtagaaaaagcggtgacaaaggatgaattgctgaatgcggatgaagtattcatcacgtcaacgacagccgaagtcattccggtcacctcgagtgacgggcaaacaatcggctccggagcgcccggaccgctcacaaaaaataaacagaccgctttgcacaacagcattttgtcggaaacag

SEQ ID NO: 495 - DNA, 460 bp, Bacillus licheniformis
atgacaaaacaaacgatcagcgtacagctcagtacagcaaaaaagcaaaagccagaggctgacaagctcgaattcggccggacctttaccgaccacatgtttatcatggactatacggctgaaaacggctggcacgatccgagaatcgttccttaccagccgattgaaatggacccggctgcaatggtttaccactacggacaatccgtttttgaaggattaaaagcttatttatcaagcgaaggcagagttcttctgttcagacctgaaaaaaacttcgagagactcaataaatccaacgaccgcctctgcattccccgggttgatcctgaaatcgttctggaagggctgaagcagctggttcagatcgacaaggaatggattcctcaagctgaggggacatccctttatatccgtccgttcattatttcaacagaaccgtacttggcgtcgccccatc

SEQ ID NO: 496 - DNA, 1470 bp, Bacillus licheniformis
tcgccgctaaacagacaaaaacggccaatgagttttacacggcgggagggggacttaccggcattcaaaacggactggctattgcgggagattacatgtcagcggcttctttcctcggaattgccgggatgatcgctttgaacgggtttgacggtttcttctacagcatcggcttcctcgtcgcttatttagttgtcctttatattgtggcagaaccgctccgaaacctcggcaaatttacaatggcggacatgattgcctctcgttttaaacaatagtaaattcgcggtgtcgccgcattaaacacaatcacgatctccattttttatatgattgcacagttagtcggcgccggcgcgctgatcaagcttctgctcggcatcgattatacgctggcagtgtgcattgtcggggttttgatgaccatctacgtcgtattcggaggaatgattgcaaccagctgggtccagatcatcaaggccgttcttttgatggcggggacgctaatcatttcggtcatcgttttttcaaaattcggcttcagcctgacgaacatgttcgaacaaatgaaaacagctactccgctcggggcggattttctaaaccccggcaataagtataaagttcctcttgaaacactttcactcaatttggcgctcgtccttggaacagccggcctgccccacattctcatccgcttttatacagtaaaagatgccaaaacggcaaggaaatcggttgtctcggcaacatggattatcggtatattttatattatgacggtctttctcggttttggtgctgccgcttttgtcggttttgaaaacattttagctgccgataaagcggggaatatggccgcaccgctgcttgctcaggcgctcggcggagattttctgttcgccttcgtctcagccatcgctttcgccacgattttggcggtagttacaggacttgtcctgtcggcggcttctgcttttgcgcatgatatatacagccagattatcagaaaaggcgcggctacggaaaaagagcaaatgattgctgcaaggtgggcttccatcggcgtatccgtcctttcaattctgcttgctgtctttgcccaatcgctgaatgtcgcgtttcttgtctcgctagcatttgccgtggcggcaagcgccaatttgccgcttattatcttcaccgtcttctggaaaagattcaatgccgccggcgctttggccggcagcctgaccggccttttaagcgctctgatccttgtctccatcagcccgagcgtatgggacccggccggaaacgccatctttgttggagacccgctcatcccgctttccaacccgggaatcatctctattccgctcggctttttaggcgcttatcttggaacgattctatcttcaaaaacccctggtcaagacgcgtttgcagaaattcaggtcaaagcgcatacaggcatccacatggatcaat

SEQ ID NO: 497 - DNA, 1660 bp, Bacillus licheniformis
ttggtgtggattatcatgacatttttattgattaatgcaggaatttttattttttcttatttgaggacaaaagatattgatttaaaaacgtcagacggctattttctcggcgggcgcagtctcactgccctctatatcggaagttcgctgcttttaaccaatttgtcaacggaacaaatggttggattaaacgggcaaagctattcgggaaccatgagtgcgatggcgtgggaggttacagcaccgcttgcgctcattatgctggcatttgtctttttaccgaggtatctcagttccggagtcacgacgatacccgactttcttgaaaagcgctatgatcaaagaacgcggcaaatcgtctcgatcctgctgcttctgggatatgcgacctcgtttctgccaaccgttttgtactccggggcgctcgttctcgatcaagtattcaacatttcatccgcgcttgggatcaatacgttagtgactgtttttttaatctcgcttgtgatcggcgccgcaagctgctgctacatatttttcgggggactcaaagccgcggcctcggctgatgccatttatggcgtcggtttaattcttggcggtctgttcatctttgtgctcggaattatggcaataggagacggcagcctcttgagcggctatacagagctgacgagtgtacataaggaaaagctgaatgccattacagcggacaactctgcagaagtgccgtggccgacgatttttacaggactgcttgtgaacaacttattttattgggctgttaatcagtcgatcgttcagcgggcgctcggagccaaaaacttggctgaagggcagaaaggcgcattgctggccggtgtatttaaaacgatcggtgtgttttatctcgttctacccggcgttattgcttatcacctttacggaggccatattcaaaacgctgacaccgtttatccgaggctgatcgttgatttgctgccgactgcactgattggcgtctttgccgcgatcttattcggagcgattctcagctcgtttaacggttcgctgaacagtacgatcacgttgtttacattggatttatacaaaccgctcttcaagccagaggcaaaagaggaagagctcgtgaaaaccggaaggatctttgtggtgatcctggccgcggtatcgattatcatcgcaccttttattttgtttgcgccgtctggcctttacaattatctgcaggaaatgttcggttttttcaatgttcctgtattggctgccgtcgtcgttggatttttttcgaaaaaagtgccggcgcttgcagtgaaatgggcgatatttgcacacattgtattgtataccatctcaaaaatctatttcggccatattcattttctatatatattggctgttctgtttccgttttccgtcctcttgatgcttttcatcggaagattgaagccaaggccgtcggaattcaagcttgagaaaaatgccaaggtagatttgcagccatggaagcatgccaaacttgcttctgttcttgtgatttgcctgatggcctgcatttacctgttattttcgccttgggggcttgccaaataaaaaaggcaggggatgtgcgttcatcctctgccttaatgttttgtcctttgcgttatttgcctttatttca

SEQ ID NO: 498 - DNA, 1156 bp, Bacillus licheniformis
ttgggcgccgcttttttaatggccacatctgcaatcgggccgggatttttaacacaaaccacagtatttacacaatctttggccgcaagcttcggctttgtcatcctcgtttccatcattttagatattttcgcccaaaccaatgtgtggagaattattgcggtttctgaaaaaagagggcaggaaatcgccaacctcgtcttaccgggactcggctattttatcgcctttcttgtcgttctgggcgggcttgccttcaacatcggcaatatcggaggcgccggtctcggcatgcaggttttattcggcatttcgccgcagatgggagccatcatcagcgccgtcatcgcgattttgatctttgtcattaaagaagcgggaaaagcgatggaccggtttacgctgatcgcaggctttgtcatgattttactgacggtgtacgtcgctgtcaccaccggacctccggtaggggaagcgataacgaagacggtcatgcctgataacattgattatcttgcgattataacgcttgtcggcggtacggtcggcggatacattacatttgccggcggacaccgattgcttgatgcgggtgttaaagggaaggatgcgatccctgaagtaacgaaaagctctgtttccggcattttgatcacgtctgtcatgaggattgcgcttttccttgccgtacttggcgtcgtatcaaaaggtatgcagattaatccggataatccgccggcatcagtattccagcatgccgcaggaaatgtcggatacaaaatcttcggcctcgtcatgtggagcgctgctattacatccgtgatcggtgctgcttatacgtcggtatcattctttaaaacgttttctccgaaaatcgaaaagaattcacgcggcattataattgtctttattattgtatcaacgctttgctttgtaacaattggaaagccggtcaaccttctcgttcttgccggcgcattaaacggcttaatcttgccgatcgcactaggctcccttttaatcggcgcacataagaagaatgtcatcggcgactacaggcatccgatctggcttacaattccgggcattctggtcgttattgtcatggccatcatgggaggctatacgttaatcaatgaaattcctaagttatggg

SEQ ID NO: 499 - DNA, 936 bp, Bacillus licheniformis
taaaggtcctacatataccgccattattaaagatattttagtttgggtgatgatgctgtttatggtcgtttcgttgccgctcatccattttaacggctggacgccgatgattgacaagcttgcaaatgaagcgccgcatatgctgacgatcccttctgacggaccgcgcgggatcgcctggttcatcacggcatcgatcgtttccgcgtttgccctgttcatgtgggcccatgcggcgacaggcgtcttcacggcgaacagcgcggatgcgctcagaaaaaacagcatgtttctgccgctgtacaatatcgtattgatcttagtcattttcttaggctttatcgcatttctcgtacttcccgatgacattaatccgagatttgccttgctgtatttaatccaaagttcctacggcggcgtcacgcaaggattcgcctattcaacaattgccctggcaagtctgatcccgtgttcgatcatggcgatcggggcgtctaatctattcgccaacaatttataccgcgatttgatcaatccccgcgtttcggggcaaaaactgacgatcattacgcgctcaatggtatttgtcgtcatcggcctggcccttttatttggaatgctgttccccgcagcgcttgtcacgcttcagcttctcggcgtttcaggcatggtgcagatattcccggccatcgtcatcagcctgttctggaaaaaccagacgaaggaagcgacgatcatcggtcttctcatcggccttgccgttacatttaccgtttatttgacaggggccactttcggcatttacgaaggattctggggccttgcagccaaccttttgactgttgtcttgttgaatccgttttttgtgaaaaatgtaaaacacaattctgtgatcaactatttgtttcatactaagaagaatgtgcaaaaaagcgc

SEQ ID NO: 500 - DNA, 987 bp, Bacillus licheniformis
ataaaatcggtcttttcttaacggccgcagtcgtaattgcctatacgctgttcggaggatttttggccgtcagtctgacagacttcgtgcaaggtttgattatgtttatcgctttagtgctcgtgccgatcgttgcctttactcaattaggcggaattacgccgactttcaatgtgatcgaagaaatcaatccaagcttgctcgatttcttcaaaggaacgaccgtcattagcattatttcatttctcgcctggggactgggctatttcggtcagccgcatattatcgtccgctttatggcgatttcatccgtaaaagaactgaagcctgcgcgccgcatcgcgatgggctggatgatcatctccgtaatcggcgctctgctcgtcggactgaccggtgtggcgtatgtccatgagacgggtacagcgcttaaagatccggaaacgatttttatcggggtttcaaaggtattattccatccgctcatcaccggatttttgctttccgctttgctcgcggcgattatgagtacggtgtcttcccagctgcttgttacatcaagcgccatgacggaagatttttaccggacgtttttccggcgcaaagcttcggataaggaactcgttcttgtcggacgtctgagcgttctgcttgtcgccgtcatcgcgatccttctgtctctgacaccgaataacacgatccttgatctggtcggctatgcgtgggccgggtttggttctgcattcggacccgccatccttctcagcttgtactggaagcggatgaaccagtggggcgcattggccgggatgattacaggggccgtgaccgtgctgatttggattctgaccggcctgcaggagaagacgggtatctatgaaatgatccctggtttcttcctgagcttgattgtcgtttacgctgtcagcatgatcacgaacaaaccggcaaaagaggcaagagatatgtttgaagaaatggaacaga

SEQ ID NO: 501 - DNA, 1461 bp, Bacillus licheniformis
tcattggggcggctttatctccatgatgatattctttgctttcacctattatttaggcgctttttacgcagcaaagaaatcaaattctttttccgatatgatcgtggcaaaaaggagcatgccgtttttcgtcggaatggtgacgatggccgcaacatgggtcggcggcggatatattaacggaacggccgaatcgacttacagcgacggcctcatctgggcccaagcgccttggggctacgcattgagcctgattatcggcggtattttcttcgccagaaaaatgcgccgtcatcaatttatgaccattatcgatcctctcgaacagcgcttcggtaagcggatggccggcgttttatatataccggcgctgttaggagaattgttttggagcgccgcgatcttaacggcattgggcacgactttcggaatgattctgaatatcgatttccaaacgtcgattattctttcggcgatgatcgccatcgcttatacggtggccggaggcatgtgggcagttgctttcacagatgtctttcaaatgattgtcattttgctcgggctgtttttagtcgtcccatttgtattgtcgaatgtcggtgctctcgatagcgtatgggcaaattacaggcacgatttcggcagcagcgccaatctgcttccgccgttggacggctggaaaaacccggattggggaaacctgttttggaactggtgggataatgcgctcctcttaattttcggaggtatcgcatggcaggtgtactttcagcgcgttctttcggcaaaatcggaaagcgccgccatgtggcagtcgataattgccggagtgatctgcatcattgccgccattccgtgcgtaatcatcggagctgccggaaacagtaccgattggagcctgttcggagcgagcgctccggataacccggcgatgattttgccgcaaacgcttgcgtatttgacgccaggaatcatcgcaggcctcggcttgggtgcaatcgcagcagccgtcatgtcaagcatggactcatcgattctatcggcatcatcaatggccgcatggaatatttaccgtccgctcatcaagccgaaggccacccaaaaacagctgcaaaaagtcgtcaaacgctcaatcattttgttcggcgcgggagcagcggtcatcgcgctgaatgtcaaaagcgtttatactttatggtatttggcttcggatttagtttattgcattctttttccccagttaacaatggccctcttttataaaagagcaaatctttacgggtcgattgctggatttgcagttgcagtcattctgaggctcggcggtggtgaacccgcattcggcattccgccgcttctgccgtatccgatgattgaagacggcacggtcctctttcctttccggacgctggctgcagtcacagcatttatgacgatcttcgctgtgtccgaattgacgca

SEQ ID NO: 502 - DNA, 708 bp, Bacillus licheniformis
gctcgggcctgctgtcacggcgctcagcgccggcgcatcagacatgagcggctggcttttgatggggctgccgggcgccatgtttgcaacaggcctgagcggttcgtggattgtcatcggactcgtactcggcgcttgggcgaactggatatttgtagcgccgcgtctaaggtcatacaccgaagtagcgggcaattcaatcactatccctgcatttttagaaaaccgttttcatgacaaatcaaagatcctgcgaatattttccggagtcgtcattattaccttttttacgttttatgtatcatctggaatggtttccgggggcgttttatttaacagcatatttaatttggattaccatgcagggctgtggatcatttcaggcgttgtcgtggcctacacgcttttcggcgggtttttggcagtcagctggacggactttgtccaaggcatcattatgtttgtcgcgttaattcttgttccgattgtgacggtcattcagacgggaggacctggagaagccttcagcgagatccagtcgatcgatccaaacctcctcaatatttttaaaggtacgagcgtcctcggcatcatctccttgttctcatggggcctcggctattttggacagcctcatattatcgtgcgctttatggcgatatcctccatcaaggaaacgaagaaagcgcgccggatcggcatgggttg

SEQ ID NO: 503 - DNA, 618 bp, Bacillus licheniformis
tgcggcgtctgctgaccggattgctcggtattgcgtattactcgaagaacgggcttcacttggatgatccggagaccatcttcattcaattgggtaacatcctgtttcaccctctaatcacaggatttttaatctcggcgattttggcagcggttatgagtacaatttcctcccagctgcttgtgacatcaagttctctaactgaagatttatacaaaacactatttaagcgctctgcatctgataaagaactcgtctttttcggacggctttcggttttggcggtttccattgtcggactctgtctcgcctggacaaaaaacaatacgattctcggtcttgtcagctatgcttgggcgggtttcggagcgtcgttcggccccgtggtcatcttaagtttgttttggaagaggatgacaaaatggggggcgcttgccggaatggttgccggagcgcttaccgtcatcatttgggcggaagccgggctttccgatgttctttatgaaatgattccgggctttgccgccagcttgctgtttgtgtttgtcgtcagtctattgacgtcaaaaccggagcagcaggtgcttgatgaattcgagcaatacaaacaaacgctgt

SEQ ID NO: 504 - DNA, 768 bp, Bacillus licheniformis
cagtctcgtccgtttcaaggaacaaccgtaatcggtatcatatctttactggcatggggtctcggctactttggacagcctcatattattgtcaggtttatggcgatttcaagcgtgaaagaattgaagagtgccagaagaatcggcatgggctggatgatcttttcgatttgcggacgatgctgacaggactcgtcggcattgcctatttcagtgcgaatcatcttacgttaaagaatgccgagacgatattcattaagcttgccgaccttttgttcccttcaatgattacggggttcttgctggccgccatattagcagcggtgatgagcacaatttcttcacagcttcttgtaacctcaagcgcgctgacagaggatttttataaagcgtttatccggaaaggggcttctgataaagaacttgtacttgtcggaaggctgtctgtcctcgccatttcactgatcgcactcttgatggcgcttcatccgaatgaaacgattctgaatcttgtcggctatgcatgggcaggcttcggggcggcatttggccctgtcgttttgctgagcctgtattggaaacgaatgacgaagtggggcgcgcttgcagggatgctgtccggagcgctgaccgttattgtgtgggagcaagtgaaagcgtttgacccggtttatgaaatcattcccggatttattgtttgtacagtcgtgatcatcgccgtcagcctgatgacaaagaagccgcgggcagagattgaaaaggaatttg

SEQ ID NO: 505 - DNA, 537 bp, Bacillus licheniformis
atgaataaaaaagtagctctcattacaacgggaggaacgatcgccagccggaaaaccgaaagcggccggcttgcggcaggggcgatcagcggccctgaattagccgaaatgtgcagcctgccggaagatgtacagatcgatgtctacccggcgtttcagcttccaagtatgcatataacatttcagcatttattagagctcaagcaaaccatcgaacgcgtgtttcaggacggcggctatgacggcgcggttgtaacgcatggtacggacacgcttgaagaaaccgcctattttttggatttaacaatagaggatgagaggccggtcgttgtcacaggttcacagcgagcaccggaacagcaaggcacagatgcatatacaaatatcaggcatgccgtatatacagcttgcagtccggatataaaaggagccggcacggttgttgtttttaacgaaaggatctttaacgcgcgctacgttaaaaaagtgcacgcttcgaatctgcagggttttgacgtattcggtttcggctactta

SEQ ID NO: 506 - DNA, 960 bp, Bacillus licheniformis
caagaaaatcattttgctgagtaccggcggtacaattgcaagtaagcctgatcctgaaacaggtctattagaagcaggtgctatgacaggtgaagagctttctgaaatgtgtcgactgccttctcatatagagattgaaatcaagtcagccttttaaatgtcaagcagtcatatgacttttcatcaccttgacattctcaagcaaaatatagagagtttcttccggaatgaggatgttgccggaattgtgatatcgcatggaacagatacccttgaagagacttcgtatttccttcatctggttatttctgatgaaaggccggtcgtgttaacggggtcgcaaagaggaccgacacttgaaggtacagatgcgtttgtgaacctaagacaagctttcttattagcggcacatcctgatgcgcgaggcttaggggtaacagtgttgtttaatgagagggtttttgctgctcgatatgtgaaaaaacagcatgcgtcaaatgttgatggttttttctcaccgggattcggttatttgggaactgccgatcaagatgagatcgcaattcatcaaagattaatcaagcgtgagacgtatcagctgattcaaccattaccaaatgtggaacttattaagtgttcacttggatcagacggaaagtttatagattatgcagttaagtgcggaagtgcaggaatcattattgaggcgccgggaagagggcatacggctccagcaatattagaaagtgcaaagaaagccgcagagaaagggattcctgtcgttctgacaacaagtgctcacgaaggtgaagtcaagggagtatatggattcaaaggaagtgcttcaacatatgcagatgccggaatcatacttggcggcagctatgacagtaagaaagcaaggatcaaactcgctgttttgctggctgctggacagaagattgatgaggctagctttaa

SEQ ID NO: 507 - DNA, 683 bp, Bacillus licheniformis
atgagtcaatcacggaaggcgccggaaggcatattgggttttccggtggcgcccttcaacagggaaggaaaactggaggaagaagcactttacgaaaacatccgctttttattggatgaagggcttgaggcggtttttatcgcttgcggctcaggagagtttcaatctctcagcacaaaggaatatgagcaaatggtcgaaatcgccgtttcggctgcggacgggaaggtgcctgtttacacaggagtgggcggcaacttaagcaccgctttggaatgggcgcggatttccgaggaaaaaggggccgacggctatctgattctcccgccgcacttgacacacggagagcaggaaggcctctatcaatacacgaaaacaatcattgaaagcacggatttaaacgcaatcatttatcagcgagacaatgcggttttgacgcttgaacagattcagcggctgaccgatctcgagcagcttgtcggacttaaagacggcataggggatatggcgttccacatcagtatgtcatatacgataggtgacaggctgggctggctcaacggaatgccgatggctgaagtcacgatgccggcctatgctccgattggctttacatcatattcttcggcgatatccaattatattccccatatttccagaatgtttgacgaggacattattaa

SEQ ID NO: 508 - DNA, 457 bp, Bacillus licheniformis
atgaacttcggaaatatcgcaaccgcgatggttacgccctttgacaaaaatgaaaatatcgattttcaaaaactgtcaaagctgatcgattatttactaaacaatgggacggattccctggtcgttgccggaacaaccggagaatcgccgacgctttccgaagaagaaaaggtagcgctcattcaatactctgtcaaggaagcggcaggccgtgccccaatcatcgccggcacgggaagcaacaacacgaaggcgtcgatcaagctgacgaaaaaagctgaagaagccggcgctgacgctgtcatgctcgtcactccgtactacaacaagccttctcaggaaggcatgtaccgccatttcagagcgattgcggaggaaacatcgctgcctgtcatgctttataatgtgccgggaagaacggctgcttcgctcgcaccagagacgacaatccgcctgc

SEQ ID NO: 509 - DNA, 750 bp, Bacillus licheniformis
ctcattgctcacgggctttttgcgttgggtaccaacggggaattcatatgttcaacatcgaagacaagctgaaagttgcagaaatcatcattcaagaaacggccgaacgcgttcccgtcatggtagggagcggaggaaacagcacagaagaagcgatctggctttctaaggaaatagagaggcttggagcagatgcgctgtcggtcatcacgccattctttattccaccgacacaggaagaagcggcggtgcattataaaacaatcgcggcatccgtttcacttccgatccttttgtacaatatcccttcaaaaacaggtttccatttagaaccagaaacagtggcagagcttgcaaaagtggacaatatcgttggaattaaggacagcagcggaaactttgaaaacatacaacagtatatcgagcagacgaaaaatgacgacttttccgtttttgcaggcaccgattcgctcatattgaaaacgcttcaagcgggaggagcgggagcagtcgcagcaacagcaaatatgcttccggatatcgtaacgtctatttaccaccattgggcagagggtgagactgaaaaggcggaggctgcccagatggagcttcagccgcttcgcgatacgtttcgtttaggtacgatcccggcggcactgaaaaaagcggttgagctttattcgatccctgtaggcccgccgaaagcgcccgtcaaagaactgaccggtccggcgcttttggaggtcgaaa

SEQ ID NO: 510 - DNA, 297 bp, Bacillus licheniformis
taacactgccggcgctgtccgtgggagcgagaggaatcgtttccgttgcatcacacatcatcggaccggaaatgcaggaaatgatcaaacattataccgaggggaacacggctcaggctgctttgatccatcaaaagctgcttccgctgatgaaagggctttttgccgcaccgaacccgtctccattaaagacggctcttcagctgaagggtcttgacgtcgggtccgtccggctccctttgattccgctaaatgaagatgaacgactccgtttaagcagcctgatgaacggcctgt

SEQ ID NO: 511 - DNA, 606 bp, Bacillus licheniformis
atgttctttcgattattacgccatactttgttgcaccttcgcaggaggaattgtatcagcatttccgcacgatttccgaaaatgtcgcgcttcctgtcctgctctacacattccgtcgagacaggcgtatcattggagcccgaaacagttgaaaggctggcggcattgccgaacatcatcggcattaaggacagcagcggaagcttcgccaatattaaggcgtatcttgagcgtacaaaagaacagtccttttccgttctggcaggaactgattcgctgatcttagacacattgaaggcgggagggacaggagctgtggctgccacagccaatgtgtttccgcacaccgttgtttcaatctatgaatcttttaaacaaggaaacattgaagagagcgagcactatcaacagcagctgcagccgctccgtgatacgttttcactcggttcactgccggcgccgctaaaaaaagcagcggagcttgccggcatcgacgtcggaccgcctaaacgtccgattgcagaactgtcgggagagccgctgctaaaagtgaaaaagatgctggaaggctacggaattgaagcaaaactggcaaaggagcagtaa

SEQ ID NO: 512 - DNA, 1644 bp, Bacillus licheniformis
atgaataaacgcaaaacaggattttcaattttaagcttgctgctgatcttatcgatttttctaacggcctgcaacagcggcgaagtcggaggggatgaaaaagaaggcaaatctgacgggaagccgcagcagggcggagatctgattgctggatccacaggtgaaccgacgctgtttaattcactgtattcaactgatacagcaagttcagatattgaaagactgatctacaacactttgttagacgttaatgagaaacttgaagtggaaaaccaactcgctgatgaagtaaaggaatcggaggatgggttaacattcgatgtgaagctaaaagaaggtgtcaagtttcacgacggtgaagaaatgacagccgacgatgtcgtttttacttacagcattccgatgagtgatgaatacgttggagaacgcggctcaaactttaaaatgatagagtctgtcacgaaaaaaggtaaatatgaagtgcagtttaaattaaagaagcaggatccgtatttttacaatgttacacttgccagttacggtattctgcctaagcacattttaaaagatgtcccaatcagcaaactcggtgaacacgaattcaatcgaaagaatccgattggaacaggaccgtttaaatttaaagaatggaaagaaggacaatatgtaaaggttgaggcttttgatgattattatgccgggcgtcctcatttagattcgatcacgtataaaattattccggattcaaatgcagcgctgtcacagctgcaagctggagatgtcgattacttggtcgttacaccaggaccagactataaaacggccgagaaatttaacaatgtgaagatggaaaccgatttaggtttgaattatacgtatatcggctggaacgaaagaaatgagctgtttaaggataaaaaggttcgccaagcgctgacacatgcgcttgaccgccaggcgctcgttgaccaagttctagatggagatggggaaatcgcgaacatcccggaaagcccgctttcatggaactacccggataacaaagataagtttaaaacgtttgaatacgatccagagaaagcaaaaaaactgctcaaagaagcaggatggacagactcagatggtgatgggattttagataaggacggcaaaaagttttctttcgttattaaaacgaaccaaggaaacaaaacacgggaagacctcgcggttgttgttcagcagcaattaaaagaaattgggattcaagcaaaaccgcagattgttgaatggagtgctttaattgaacaaatgaacccgccgaattgggattttgatgcgatgatcatgggctggagccttgctacgttccctgatcagagcaacattttccattcgaaagaagctgaaaaaggactaaactatgtttggtatcaaaatgaaaagcttgataaactgctggatgaagctaaaacgttgaaggaccgtgaagaatataaaaaggcgtatgaagatatttacgaaattctggcggaagatcagccgtatacattcttgtattatacgaattaccatagagcgatgcctaaaaatatgaaaggctacgtattccatccgaaagaagatttctataaagccgaagactggtggctggatcaaaaataa

SEQ ID NO: 513 - DNA, 1068 bp, Bacillus licheniformis
atgaaacacttacttgaagtgaaagatttagccatttcttttaaaacatacgccggagaagtacaggcgatccgcggcgtcaactttcatgttgacaaaggagagacgcttgcgatcgtcggtgaatccggatcaggtaaaagcgtcacttcacaggcaattatgaaactgattccgatgccgccgggctattttaaaaacggacaaatcttatttgacggacaagacctggttccgaaaacggaaaaagagatgcagtcgatcaggggaaaagagatcggcatgatctttcaggatccgatgacttctttgaaccctacaatgaaagtcggccgccaaatcacagaagtgctgtttaagcatgaaaaaatctcaaaagaagaggccaataagcgggcggtagagcttctcagccttgtcggaattccgatgcctgaacgccgcgtcaaccagtatccgcacgaattcagcggcgggatgcggcagcgcgtcgtcatcgcaatggcgcttgcggccaatccaaagcttttaattgcggacgaaccgacaacggctcttgatgtgacgattcaggcgcagattttagagctgatgaaagacctgcagaaaaagatcgagacatccatcatttttattacgcacgatctcggcgttgtcgcgaacgtcgccgacagagtcgccgtcatgtacgcgggacagattgtggagatcggtacggtcgacgagattttctacaatccgaagcatccgtatacatgggggctgctggcttcaatgccgagccttgacaatgacggtgatgaggaattaatggcgataccgggctctccgccggatttgaccaatccgccgaagggcgatgcctttgcgttaagaagcccgtacgcaatgaaaatcgattttgaacaggagccgccgatgtttaaaatatctgatacacattatgtgaagtcatggcttttgcatccggatgctccaaaagtcgagcctccggcggctgtcaaaagcaagatgaaggagtttaaaaatcagtatgaaaaaccggttcaagtgaaagaaggtgaatga

SEQ ID NO: 514 - DNA, 1119 bp, Bacillus licheniformis
atgaaaagacgcttaaggtgacgcttgaaagtccgcagcagtcgtttttaagcattgtagccaatccggccttttccccggttcctcagaaaatcgccgaagacaatccgaaatggcatgaagaagcagccacattcgtcggcaacggtccgtttaagctggcagaatggaagcacgatgaaagctttacgatggtaaagagcgatacgtattgggaccgggatactgtgaagcttgataaagtgacatgggcgatggtcgatgaccgaaataccgactaccaaatgttcgagtcgaatgaacttgatacggcttatgtcccggctgaaatgagcgagaagctgatgggctctgatgaggtgaaggtgtttgatcaggcgggtctttatttttacaggttcaatgtcaataaagagccgttccagaatgaaaaaatcagaaaagcgtttgcgatggccgtcgatcagcaggaaatcgtcgattacgtcacgaaaaacggtgaaaaaccggcacgcggatttgtgtctccgggaatcaaagggccgaacggcaaggattttcgcgaggaaggcggcgatttgctcaaatataacgccgatgaagcgaaacagctgctcgaaaaaggcatgaaggaggaaaactacgaaaagctgcccgccgttaccttgacatacagcacaaaaccggagcataaaaaaatggcggaagcggttcagcaaaaactgaaaagtacgctcggcgtcgatgtgaagctcgccaatatggaatggaacacattccttgaagaacagaaggcgctcaagttccagttttcccaaagctcttttctggctgattatgcggatcctatcaacttcctggaaagctttcaaacgggtaacgcaatgaacagaaccggctggggcaattcagagtatgacgagctgatcaaggcggcgaaaaatgaagctgatgaagaaaagcgcactgagctgctgcatcaggctgaagaactgctgtttgaagggatgccgatcataccgatccacttctataatcaagtccatttggaaaaggagaatgtgaaaggcatcgtccgtcatcctgtcggctacattgaactgaaatgggccgaaaaaa

SEQ ID NO: 515 - DNA, 969 bp, Bacillus licheniformis
aagaatcccttctggagctgaaagacgtcaaaaagtactttccgatccgctcagggatttttcagaaaaaaatcggcgatgtcaaagcggtggacggcatcagcttttcgcttaaacgcggcgaaacgctcggcattgtcggtgaatcgggctgcggaaagtcgaccgccggacggacgatgatccgcctttataaaccgacggcagggcagattttttacaaaggccgcgacatttcaagtttgtcggaagaagctttgagaaaaagcgtccgcaaaaacatccagatggttttccaagatccgtttgcctcactgaacccgagaaaaacgctgcgttccatcatcaaagaacccttcaacacgcatcatatgtacaatttcaaagagcgcaacgaaaaagccgaagagcttttagccaaggtcgggctgcacccgtcgtttgcgaaccgctatccccacgaattttccggggggcagcgccagcggatcggaatcgcgcgggcgctggctttaaatccggagcttattatcgccgatgaaccggtatccgcattggacgtgtcaatccaggctcaagtgatcaacctgatggaagagcttcaggaagaattcaatctgacatatttgttcatttcccatgacttgagcgtcgtccgccatatcagcgacagggtcggcgtcatgtatctcggcaaaatgatggagctgacagacaagcatgagctgtacggcaacccgcttcatccatacacgcaggcgcttctgtccgccgttcccgtcactaggaagaaaggcggaacaaagcgggagcgaatcgttttaaaaggcgagctgccgagtcccgccaaccctccgaaaggctgtgtctttcatacgaggtgtccggccgcaaaagcgatttgcgcggaagccgaacctgctttcaaggaagtgaaaacaaaccatttcgtggcatgtcacctttacg

SEQ ID NO: 516 - DNA, 1527 bp, Bacillus licheniformis
ctccggtaacgaaagcggaaagaacgacggagggacgaacggcggaaaagatacgctgatcatcggcagaggaggtgattcgacatcgcttgatccgatcacaacgacagaaggcgaagcgtttaaagtgacgatcaatatgtttgagaccttgctgaattacggggaacaagacacaacgctgaaggaaggcctcgcggtgaaatgggacgcttcagatgacggtttgacctacacattggagctgagaaaaggcgtgaaattccatgatggaacggattttaatgcagaagccgtcaaatacaattttgagcggtggatgaacggggatgaagaaaaatttccttactacggcatgttcggaggctataagaaagatgaggggcacgtcatcaaagacataaaagttctcgacgaccataagattcagttcattttaaaacgcccgcaagcgccgtttttaaagaaccttgccatgacttctttcgggattgcaagtcctgccgccattgaaaaatacggcgaaaaattcagggagcaccccgtcggcactggcccttacaaatttgtcgaatggaagccgaacgaccggatcgtccttgagaaaaatgaagactattgggatcaaggcaaaccgaaattgcagaagatcattttcagagccattcctgaaaactcagcccgcttaaatgcattgaagacgggcgaaatcgacctaatggatggcgtcaatccgtctgatatcgaaagcatcaaagcagacgccaatctgaaaatatttgaaaggccttcaatgaacgtcgggtatctcggaatgacaacgacgagaaagccatttgacaataagctggtccgccaggcgctgaaccatgctgtcgataaacaggcgattatcgactccttctacggaggtctcgctgaatctgcaaaaaacccgcttcctccgtcgctcgaagggtacaacgaccaggttaaggaatatccgtatgatttaaaaaaggcaaaagaactcttaaaagaagccggctacccggacgggtttaaaatgaagctttgggcaatgccggtaccgcggccgtatatgccggacggtatgaaaatagccgaagtgattcaatcaagctttgaaaaaatcggagtcaaagcggaaatcgtcacttacgactgggcgacgtacttggataaggtgagcaaaggggaagctgatgcgtttttaatgggctggaccggcgacaacggagatccggacaacttcatttatacgctgcttgataaagataatatcggcggtaacaactatacgtacttcagcaatgatgagcttcatgacatcttaatcgaggcgcagtcagaccctgatcaaaagaaaagaaataaactgtatcaagatgcgcaggagctcctccatgaagaatcgccttgggttccgcttgtccattccacgccgattttggccggttcaaaagatatcgacggatatgttccgcacccgacagggagtgaagtattgtccggcgtagagtttaa

SEQ ID NO: 517 - DNA, 967 bp, Bacillus licheniformis
atgagcgcattgctggaagtcaatgatttaaaaacttatttttttaggaaaaaacagccgatacctgcagtggacggcgtcgatttttcaattaaaaaaggggaaaccgttgcgctggtcggtgaatcgggatccggtaaaagcattacctctttgtcaatcatgggactggtcgagggctcgggcggaaagatcatgagcggctctatcaagctcgaaggacaggatctcgttacatacaaagaacaagatttatgcaagatccgcggaaatgaaatctccatgatttttcaggaaccgatgacctcgctcaatccggttttgacgatcggcgaacaaatcacagaagtgctgatctatcataaaaagctatcgaaaaaagaagccgccaaaaaagcggtagaattattaaagcttgtcggattttcaagagccggcgagctgatgaaagagtatccgcaccgcctgtcgggcggcatgaggcagagggtcatgatcgccattgccttaagctgcaatccgaagctgctgatcgcggatgaaccgacgacagcgcttgacgtcaccattcaagcccaagtgctggaactgatgaaagacctatgcgacaaattcgatacctccatacttctcattacccacgatctcggcgttgtgtccgaaattgcggaccgcgtgatcgtcatgtattgcggacaagttgttgaaaatgccacagtagacgagctattcgacgaacccctgcatccctatacaaaaggactgttaaactccatccctgtcattgaaggctccattgaaaaattaacagccattaaaggaaatgtgccgacgcctgacaaccttcctgccggctgccggttcgctccaaggtgtccgagcgcggtcgacaaatgctggggggcgcagccagacttgaaaacgcgtccggacggccggtctgtcagatgttttttatatgaggagg

SEQ ID NO: 518 - DNA, 951 bp, Bacillus licheniformis
atgattacatatatcattcgaaggacgctcatgtcgattccaatattatttggtattacaattttgtcatttgcgattatgaaagcagcgccgggagatccaatggcattgatgatggatccgaccatcagcgcgggagaccgtgaaaaattcattgaaaaatacgggttggatgaacctgaacacgttcaatatttaaagtggctcggaaatatggttcaaggtgacttcggtacttcaatcgttagaaaaggaacgccagtgactgatttgattatggcgaggctgccgaatacgttattgttaatgctcgtttcaaccattttggctctcctcatatcgatcccgcttggagtgctttcagctaggcggccatattctaaattggattatggcatcacattcacatcatttatcggtcttgctgtcccaaatttttggcttggactgattctaatcatgtttcttgctgttaatttaggatggtttccaaccgggggcgttatgactctgaatgccgattttagtttatgggatcgcattcatcatctaattttgcctgcattcgtcctggcgaccgcagatatggcgggactcacccgctacacgagatcgagcatgcttgatgtgctcaggcaagactacatgcggacagcgagagcaaagggttttaaagaaaatcgtgtcgtgtacaagcatgggcttcgaaatggtttgcttccggttattacgatctttggtctgatgattccttctttcatcggcggagctgtcgttactgaacagattttcagttggccaggacttggaaagctgtttgtcgactctgctttccagagggactatcctgtcattatggcaatgacggttatttcagccacacttgttgtcattgggaatttagttgcggatattctttatgcaatggtcgatccgcggattgagtattaa

SEQ ID NO: 519 - DNA, 894 bp, Bacillus licheniformis
cgacaccttcgccggagatcacattgcaggaaaatgtcgcaccaaagcccgagacaatgacaaaaatcttttttgaaaagttttataaaaacaagctggcggtaattggaggagttttattatttattattatcctatcagcgatttttgctccggtgatcgctccatacccgccggaacagcaaaaccttctgaataagctaaaaccgccaagtggtgaacatctaatgggaacagacaagtttggccgagatattttcagccgtttactttatggggctcgggtttctttacttgtaggctttgcctctgtacttggatcgattacgataggtacggtggtcggcgcaatcgccggctactttggcggaataatcgacgctattatgatgagactggtggatattgtattatccatacccgacatctttctgttaatcacgctggtcaccatcttccagccgggcatagataaactgattttaatattcgccttgacgagatggacgacgacagcgcgccttgtccggagcgagtttttgtccttgaggtcgagggagttcgtcttggcggcgaaaacgatcggtacaagaaattacaaaatcattttttctcatatccttccgaatgcgatggggccgattatcgttgccgcgacgctttccgtcggtaccgtaatccttgcggaatcggcattaagctatcttggattcggggttcagccgccgatggcaagctggggaaacatgcttcaggatgcacagaactttacgatcatgatccaggcgtggtggtatccgctgttcccgggcctgatgatcctgctcactgtgctgtgctttaacttcttaggcgacggactccgcgatgcgcttgatccgaagaatattaaat

SEQ ID NO: 520 - DNA, 861 bp, Bacillus licheniformis
tattgaaagtcagccgtctgaaaatgcactttgacgccggaaggggcaaaacggtcaaagcggtcgacggcatttcatttgatattaaagaaggagagacgttcgggctcgtcggagaatcgggctgcggcaagtcgacatccggaagagtgctgatgcgtctttatcagccgacagaaggcgaggttacatatcgggggaaaaacatccaccatttgagcgatgatgaatcattccagtacaaccgcaaaattcaaatgatttttcaagacccgtatgcttcattaaatccgaggttaaccgtcagggagattatgacagaacctatggaaatccacggcctctacggagggaaaaaggcgcgtcttgaaaaggcggacgagcttctggaagcagtcggtctgcacaaaagctttgccaatcgctatcctcatgaattcagcggcggacagaggcaaagaatcggcatcgccagagcgcttgcgcttgaacctgaattcatcgtcgccgatgagccgatatcggcacttgacgtctccgtgcaagcgcaggtcgtcaaccttttaaaaaagctgcaaaaggaaaaagggctcacgtttttatttatcgcccacgatctttccatggtgaagcacatcagcgaccggatcggcgtcatgtatctcgggcacatggtcgagatcaccgacagcggccggctttatcaagaacctctgcatccttacacccaggcgcttttatcagctatcccgattcccgatccggatgtggaagacaagcggagacgaatcatactgaaaggcgagctgccaagtccgatcgatccgccgagcggctgcgttttcagaacgaggtgtcctg

SEQ ID NO: 521 - DNA, 918 bp, Bacillus licheniformis
atgcagcaaataccaaaagacatgtttgaacctgcagctgttgaccatagcgaagccgaaaagatctcaaagaaaaacctttctttttggacagacgtattcttgagatttaaagaaaacaagctggcgctgtttggactggtggttctgatcctgatcgctctgatggctatcttcgcgccggtgttctcaagctttcaatatgaagaaacagatttaacgaatgcgaaccagccgccaagcggtgagcactggtttggaacagatgaccttggaagggacgtattcgtccgtacatgggtcggcgcccgcatctcgctgacaatcggactcgctgctgcgctgatcgacgttttgatcggtgtgatatggggtgcgatttccggcatcagaggcggacgtacggatgaaattatgatgagaatagcagatattttatgggcgattccttctttattaatgaccatcctgctgctcgttgttatgggaaaaggcctgatcacgatgatcgtggcgatggttattacgggctggatcaacatggcgagaatcgtccggggccaagtactccagcttaaaaatcaggagttcgtactcgcctcaagaacattgggagcgaaaaactcgcgcattatcagaaagcacctgctgcccaacatcatgagcccgatcttggtcaccatgacattaaccgttcctacggctattttctatgaggcgtttttaagctacctcggcctcggggttccgcagccgcttgcaagctggggaacgatggcaacagacggtgttcagggattggaatactacccttggcgcctgttcttcccggctacttttatctgtctgaccatgtttgcattcaacgttatcggcgacggactgcgcgacgctttagatccgaagctgcgtaaataa

SEQ ID NO: 522 - DNA, 807 bp, Bacillus licheniformis
taagaaaaacaagctggcgatggcggcattgggcgtgttaatcttcctgttcttcagggctgctctcggaccggttctttctccgcacagcgtcacccagcagacgctatccgagcaaaacctgcctccgtcgacggagcattggttcggaactgatgagctcggacgcgatgtgtttacaagaacgtggtacggagcgaggatttctctgtttgtcggtgttatggcggctttgatcgattttgcaatcggcgtcatctacggcggcatcgccggctataaaggcggcaaaacagaccacgccatgatgcgggtcatcgaagtgctgcacggactgccttatttattggtcgtcattcttctcatggtcatgatggggcctggactcgggacgatcctcgtcgcgctgactgtcaccggctgggtcggcatggcgcggatcgtcagggggcaggttttgaaggtgaagcatgatgagcatgttctcgcatccaaaaccttcggagcgaaaacggtaaggatcatcaggcggaatctgcttcctaacatgatgggagcgatcatcgtccagatgaccttgacggtgccgtcggccatttttgccgaggcatttctcagtttcctcggtttgggcattcaagccccgtttgcgagctggggtgtcatggcgaacgacggccttccggtgatcttgtcgggacactggtggcggctgttttttcccgctttctttatttcattaactatgttcgcctttaatgttgttggagacggactgcaggatgcgttagatccgaagctgaggag

SEQ ID NO: 523 - DNA, 990 bp, Bacillus licheniformis
gtactgtttaaaacggacggccatgctgatccccgttctcatcggcatgacattggtcgttttttcgatcatccgctttattcccggcaaccccgcccaggttattctcggccagagggcgacaaaggaagcggtgcagcagctgaccgtccagctcggccttgatcagccgtggtatatgcaatatgccagatatataggggatttgctgaaaggggatctcgggacatcaatccgcacgggagcggcgattacgcaagaaataaagccatatttgttcgccactctcgaacttgcctttttcgcgatgctgatcgcagtgtttgtcggcgtgaatgccggaatcatcagcgcgtggtttaagaactcggtattcgactatatcgcgatgctggtggctttaatcggcgtgtcgatgccgattttttggctcggtttgatgggccagtggtttttttcgatcgagctcggctggctgccgacaacaggaagggagaatgtcagaaatccggtcgaagccattacgtacattcatacattggacacccttttgcacggaagatttgatcagtttgcagaagccatccgccatttaattctgccgggaacggctcttgccaccattcccgcagcgatcattgcgagaattacgagagccagcatgatagaggtgctgcagtccgattatatccgcacggcaaaagcaaaaggcgtgcatatgtttttcgtcatctataagcacggtttaaaaaatgcattcattccggtattgaccgtcatcggcctgcaaaccggactgttactgggcggcgcaattttaacagagactatttttgcctggcccggcatcggccggtacatttatgatgcgatcagctaccgcgactacccggttatccaatcgggcatcctcgtgatcgccttcatcttcgtcatgattaacttcatcgttgatctgctgtacgccgtcatcgatccgagaattaaata

SEQ ID NO: 524 - DNA, 1089 bp, Bacillus licheniformis
  misc_feature (1)...(1089): n = A,T,C or G
accgaacacgtatttactgaacngacagcattntaaaacttatgccagtcataaaaagtnagcagagagatgccgaatgtaacacaaaagcagatgagactagtatttaacggactttcaaaatggcgaaatggaagcacagcgganaaatcgtactggagaaaacgaccagtactgggataaagacgctgttaagctgaagaaaatcaatatggcgatggtcaacgatccgaacactggtctgaacatgtacaaaaaaggcgagctagactttgtaggacagccgcttgaccagatttcaacggatgcgattccaagcctgaaaaaagaaggcctgaacattgatccgttcgcatcggtttacctgtacaaattcaacactgaagcggctccgctgaacaatgtcaacatccgtaaggcgctgacatacgcgatcaaccgcgaagcgatcgtcaaaaacatcacgcaagcggaacagctgcctgcgatgggattagtgccgccggcggtccacggctttgaatccaacaaaggctatttcaaagaccatgatgtcgataaggcgaaagaacacttggaaaaaggcttgaaagagctcggtttgaaaaaagcgtcagaccttccgaaaatcacgctttcctacaacacggatgaagcgcaccaaaaaatcgctcaagccgttcaggaaatgtggaacaaggaactgggcgtagatgtggaattaggcaatgaagaatggaacgtttacatcgataagctccatgccggaaactatcaaatcggccgtttaggctggaccgccgactttaacgacgggatgaacttccttgaaacataccgcgacaaagaaggcggaaacaatgatacgaactgggaaaacgcgaagtataaagagctgctgaataaagcatcaagagaaactgattcagcgaaacgcatcgagctgatgaaagaagcggaaagcatcatcatggatgagctgccggtcgcaccgatctacttctacacaatgccgtatcttcatgatgaaagcttaaaagactttgttctgaccggtacaggtgagatctatttcaaaaccgcgcattt

SEQ ID NO: 525 - DNA, 829 bp, Bacillus licheniformis
atgataagtatacgcaggatattcaaaggccaaaaagtgattacggtatgcaccactatattaaccatcctttttattatcgctgtattcgccccttggattgcgccgcaccatcctgctgatgtccatatggtatataagctgcagcctccatcctgggaatttcctttaggaactgatcatctgggaagatgcaacttatcccgccttttgtacggcgcccggatttctttgggattcgcgatgcttattttcatttcctccctcgttatcggcctcattgtcgggacgatttcagggtataaaggcggctggattgaccagctgttaatgagatgctgcgatggtgtaatggcctttccgaacttaattttagttcttggcctcgtgggcattttcggccccggacttcctcaagtcattctggccctcatgcttgtgcaatgggtctattatgcgagaattttcagaggaatggtgctgagtctgaaagaggagaactttattgcggcggcaaaaatcaatggatcttcacaatggaaaatcattaaaaatcatatcatccctaatgtcctccctcccctcgtcgtcatcggtacgttggaaatgggctgggccattatggatatctcggctatgtcttttctcggcttgggcgtccagcccccggcggctgaatggggagcgatgattcatgaaggtaaatcgtatattcggtcgaatcccgagttaatgatttatccaggggtgatgatcatgattgtggttgtgacattcaatttattgggcgaagccttatcagatcaatacggtgtcaaacgtcgatttt

SEQ ID NO: 526 - DNA, 937 bp, Bacillus licheniformis
atgggcaactatatattgaaacgaatcatgtcgattattccagtttttcttttagctgcacttctgacaactggaatgattcatctctcgccggttgacccagctgaagcatacttagccgcagcgcatatccagccaactgatgaaattttagcgcaaaaaagacatgagtctggcttggatcagccattttttattcaatatgtaaactctgttttgaagatatgccagcttgattttggcatatcttatgtttcaaaccagccggtttgggacgaagtggcacaccgaatgccggcaacggtcgaacttgcgcttgggagtttattgattgcggtgcttgtcagtgtgccgctcggcttcttagcgggaatcaaaagaaatggtgcagttgatcatatcagccgcttcatttcctttttcggggcatccatcccaactttttggttagggtatatgctggtttttttcttttctgttcaattagaccttttcccggtagagggcgctgggacatggcagcatctcgtactgccgtctatgacattggcgcttcctttaattgcgatgtatacaaggctgctccgtgcaagcgtcatcgaaaacctgcaggaaccatatgttcaatttgcacgcataagaggaatagcgaagttgaacattatggccaaacatgtattgcgaatggccatttctccgatgattacgggtctgggaatgaatcttggcaagctgcttaccggcacaattattgttgaagtcgttttttcttggcccggctttggccgttattttattgaggccattttcaatcgggacatccctgtcattcaatgctatgtgttcttagccgctaccttttttatattgagcaacttaattgttgatctcattcaaatgtatattgacccgcgcatttcaagggaaagaagggcag

SEQ ID NO: 527 - DNA, 912 bp, Bacillus licheniformis
  misc_feature (1)...(912): n = A,T,C or G
agcggctgtttgaactggtcctgttcttattcctgctttcatttatcagctttgtgtttatgaaagcggctcccggtgatccggtgaaacagatgcttcgcgtagatgatgttgcggtaacggacgagcagatcgaggcattcagagaggagctcggtttggacaaaccggtttatattcaatattggaactggttcaagcgctttttccaatttgatttgggaaaatcctatacaacacacgaacccgtcatcgacgagctcagccggaaattcccggcgacattgcttctaaccggcgcatcgcttctcgttatgctgctgattgccgtgccggtcggaacgctttccgctttataccgggatcggtggatcgatcatctcagccgcttgctcgctttagtgggagccgcgctcccgagcttttggctcggattgatactgatcgatctcttttccgtcaggctgaattggctgccgtcgatgggagccggaacgtttaaacatttgattctcccctctctcacgcttgggatcgcgatgtcgggcgtttatgtccgccttgtacggtcaagcctgatcgaaagccttggtcaggatntcatcagatctgccagggcacgcggcatcagcgaggcgagaatttccttctttgacgcgtttcgccattgtcttgtccctgtcatcacgatattcggggtcagcctcggcagcctgctcggcggcacggtgattattgaagtcctgtttgcatatcccggcgtcggcaagcttgtcgttgatgccatcgttcagcgtgattatccgatcattcaggggtacattcttttcatggggatcgcggttgtcctgatcaatcttttagtcgacctctcttatcggtacctcaatccggaaattcgcttaaaggagg

SEQ ID NO: 528 - DNA, 831 bp, Bacillus licheniformis
ttcgcctttggcggaacatattcggcggttttttgagcataaattggctgccgccggcacgattctagtcgcgctgtttatcctgctagccatcttcgcgccgctcatcgcaccatacggaataaacgaccagtcactgtcagacaggctcgccgctccgtctgcggaacacctttttggcacggatgactttggcagggatattttctctagggtgctttacggcgcaaggctgtctttatgggtcggctttttctcctgtttggcatcggccttggcggggacgctgctagggctgatcgccggtttttacggcagatgggctgatgcattgatttcacggctgtttgatatcatgctcgcgtttccgagcattctgctggcgatcgccattgtagcgattctggggccttctcttgaaaatgccctgattgccatcgccatcatcaacgttccgacgtttggcaggctcgttcgttcaaaagtgctcagcatcaggcaggaggagtatatcttatcagcgcgtgctgtcgggatgtccaatataaggctgatgtttaaacacattctccccaacagcatggccccggttatcgttcaagcgacgctgaatattggaaccgcgattatagaagcggccgcgctcggatttttagggttgggggcgcaggcgccgaaccccgagtggggaaaaatgcttgcggatgccaggccttacttggcgcaggctccatggacattgttttttccgggatttgcgatcatgctgaccgttctcggctttaatctgatgggagacggcctgcgcgacacccttgatccgaaaatgaa

SEQ ID NO: 529 - DNA, 702 bp, Bacillus licheniformis
tccaggatccgatgacggccctgaatccgaccttgaccgtcggagaccagctggcagaagcgctgttggaacatcggcccgtgtctaaaacagacgctcgaaaagcagtcatttcgatgcttgagctcgtcgggatcccgaatccgaaagagcgtttgaggcagtatccgcaccaattcagcggagggatgaggcagcggatcgtaatcgccatggcgctcatctgcgaaccggagattttgattgcggatgaaccgacgaccgcgcttgatgtcaccattcaggcgcaaattcttgagctttttaaagacattcagcggaaaaccggggtatccatcattttaatcacccatgatttgggcgtagtcgcacagacggcagacagaatcgccgtgatgtacgcagggaaaatagctgaaacgggagcgaggagggatattttttaccgtccgcagcacccgtatacaaaaggcttgctgcactccgttccgaggcttgaccttgaagatgcagacctcgttccgattgacggaacaccgccggatttgttttctccgcctgaaggatgtccgtttacggcgcgctgttcccgcgcaatggaagtgtgcggcaaaatccatcctgccgttacagaagtctcggcgggtcatcgagtgtgctgctggcttcaggatgaaagggcaaaaagggctctgctgacaa

SEQ ID NO: 530 - DNA, 966 bp, Bacillus licheniformis
aaaagaaaaattgcttgaagtatctgatttatcgatttcgtttcaaaagaaaaagtccgaaaccccgattgtgcaaggcgtttctttcgatctccatcccggagaaatcatgggagtcgtcggagagtccggctgcggcaaaagcgtcacctctttggctttaatggggctgaacgcaaacacccggacgacgggccggatcaagtttcaaaacaaagaccttctcatgcagtctgaaaaagaatggagacagatgcgcggcaatgacatcgcgatggtttttcaagagccgatgacctccctcaatcccctttttacaattggcgatcaactaacagaagcactctccagccataccaatattcataaaaaagaagcaagaagaaaagccgttcaaatgctggataccgtcggcctgccgaggacggaccagctgatgaagcaatatccccacgaactgtcgggaggcatgaggcagcgggtcatgatcgcaatggcattaatttgcgaaccgaaactgctgattgccgatgaaccgacaacagctctcgacgtcaccatccaggctcagattctgtcccttttgaaaaaaatgaatgccgaatttaacacagccattctccttattacccatgaccttggcgtcgttcacaatacatgtgaacgcgtgatgatcatgtatgccgggcggatcgttgaagaaggcggtgtcaccgctgtttttgacagcccgaaacacccctatacaaaaggcttgttcgcctctattccggcattcacaggcaaatccgagcgtctgtcttcgattgaggggcaggtgccgaaaccggggtcgataaaaaaaggctgtatgtttgcgccgaggtgccctcataaacgcgaacgctgcgtagaggaggagcctggattgaacaggctggcggatgaccatgctgtaagctgctttctctacgaagaggaaggtgc

SEQ ID NO: 531 - DNA, 792 bp, Bacillus licheniformis
tgcttcgagtcagagatttgcatgtacaggttaacaaccaaaaaggacattcaacccttgtgcaagacatcaattttgatttgaagcgcggccaagtccttggtctgattggtgagagcggttgcggaaaaacggtaacaagcatgtctattcttcagacgcttgatccaaaaacaactaaggtggaaggaagtattgcattgcgaggccgtgaattgaacggattagcagataaggaaatgcgtaaaatccgcggcaaagatattgcctatatcatgcaaaatccgatgaacgcttttacacccgtttttacgataggacagcaaatgaccgaatcgattcgctctcatacatcttttagcaagaaacaggcgaaagagcttgcgaccgaagcattgcatcatgtgaacctaccccaccctgctaaacttttacattcttatccttttcaattaagcggcggaatgcttcaacgggtcatgattgcaattgcatcatgcttaaagcctgccattctcatcgcggatgagcctaccactgcgctcgacgtgtataatcagaagacggtgctgaaatatttagacggcatgcgttctgacttcggcacggcgattttgcttatatctcatgacctcggcgttattgctgaaatggcggatgaagttgctgtgatgcagaatgggagaattgtagaaaatagagatgtgtttcagctgtttgatgaaccaaagcatgaatatactaagaagctattaagtgcacggttgacattgccggtggatcaacttgcga

SEQ ID NO: 532 - DNA, 916 bp, Bacillus licheniformis
atggcagaaaaactgctcgaaatcaagaatttaaaacagcacttttcaacgccgaaagggattgtaaaagctgttgacggaatctcttttgacatttacaaaggggaaacgctcggtcttgtcggagagtccggctgcggaaagtcgacgaccggccgttcgatcattcgtttgtatcaagcgacttccggagaagtcttgtttaagggaaagaatgtccacgacaaaaagtctgccaaggaccttctcgaattcaaccggaagatgcagatgatttttcaggacccgtatgcatccttgaatccgcggatgacggttgccgacatcatcgcagaaggtattgacatccacggtttggccaaaacgaaaaaagaacggcttgagcgcgttcatgaactcctcaatctcgtcggcttaaataaagaacacgcgaaccgctatccgcacgagttttccggcggacagcgccagcggattggaatcgcaagggcgctggcggtcgaaccggaattcatcattgccgatgaaccgatctctgcactggacgtgtccattcaggcgcaagtcgtcaatttaatgaaggatttgcaaaaggaaagaggactgacataccttttcatcgctcacgatctgtcgatggtcaaatatatcagcgacaggatcggcgtcatgtatttcgggaagcttgttgaattggcgccggcagatgaattgtatgaaaatccgcttcatccgtatacacaatcattgctttccgccattcctctgcctgatccggattatgagcgcacgcgcgtgcggaagacgtatgatccgtccgtccatcagctgaaaggcgacgaacagatggagctccgcgaagtaaagcccggccatttcgtcatgtgtacagaggaagaatttaaagcctatcaat

SEQ ID NO: 533 - DNA, 756 bp, Bacillus licheniformis
  misc_feature (1)...(756): n = A,T,C or G
gaaaaaacgtatttcgatctaaaacaggactatggtttgtgctgctgttttccgcggcgctgttcaccgtccccttctttttgccgttcgatccgctccgcacagatatggccaaccgtcttcagccgatcagtatgcagcattggctcggaaccgaccatttgggcagagatatattttcccggatggtcgccggtgcgaaagcgacggtcggcaccgccttgggcgcgattctgatttccgttttcataggtgttcctgtcgggcttgtctccgggtttttcggcagacggctggaccggatgatgatgagaattgttgacgcggttatggcttttccggactatattgtcgcgattgttttaagcggtttgcttggtccggggctgatgaacttaatattggccgtcgtcgctgtcaaatgggtcggctatgcaaggctggtccgcagcacggttttttcggaaaaacaaaaagattacatcgccttggccgagcttaccggtttaaagctcggngcgattttaaaaaagcacctgctgccccatgttctcggcaacctttccgtacttgcgacacttgatatcggaaaaacggtgttaatgattgctcacctgtccaatatcggcctgggtgctcagcctccatacccggaatggggcgccatgctgaacgacggaaaacattacttcttgcatgcgcctcagcttatggtgattcccggtcttgcgatcatgttcatcgttctgttgtcca

SEQ ID NO: 534 - DNA, 753 bp, Bacillus licheniformis
tttctcttcttctcgcttcctgctccgccggaggcgctggctcagcgaaaggggaagagaagaaactcacctttcttttcaatattccgagtcaaacccttgacccgaatcttgatgtcaattatacggctatccgcgccggcatcagtgaaacactcgtcaaaatcagtgcggacctttccatcgaaccgtggattgccaaagattggaaaagcaaagacggacaaacttgggtcttcacccttaaagacaatctgacgtttcaaaatggtaaaaaagcggatgccaaagcggtaaaagcgtctttagaacggacgatgcgcgagagtaaagccatgaagaacgccctaaaaatcaaggaaataaaggctgaaggacaaacattgacgattacaacgaaggagccgtttcccgaattcccttcagaattggttcatccaaacacatcgatcattgacgtcagcgcagcaaacatttctcaacagcccgtcggaacgggacctttccaagtttcctcttttgaggccggccataaaatagagttagaacggtatgacgattattgggacggcaaaccgaagctgaagcacgtcacattctcgtttaatgaagacgcaaacgcccgcgtcatggctctccaatcaaaagatgccgatatcatttacagaccgagcgttgaggatattgaccaaattcaaaaagattcgtcgattaccgttgattcggtaccgagcttgcgcgttcaccagattc

SEQ ID NO: 535 - DNA, 525 bp, Bacillus licheniformis
ttgtcgggatctctgtgccgaacttcatcatggccgcgcttctccaatacgtgctggcaatgaagctgggcatgtttcctgtcgcgcaatgggagtcatggggacatactgtgcttcctgcaatcgctgttgcctcgatgccgatggcgtttatcgcccgtttgacgcgctccagcatgcttgaagtgttgagcagcgactatatccgcacggcgcgtgcaaaaggtttgagcacatcagccgttacgtttaagcatgcgatacgaaatgccatcatgccggttgttacatatatgggcccaatggcggcgtccattttgacaggaacgtttgtcgtcgaaaaagtcttcggtataccaggactcggcatgcactttgtcacaagcattacgaaccgagactatacggtgatcatgggcgttaccgtcttcttcggggcaatcttgctgctttgcgtcttgattgtcgatcttttatacggcttaattgatccgcgcattaaattgtttggcgctaagaaagggg

SEQ ID NO: 536 - DNA, 609 bp, Bacillus licheniformis
gggcaaatctttttcaaggacatgatctctataaagcagatcagtcaatccggcggaaaatccgccgcgaccttcaagctgtttttcaagactcctattcttccgtcaacccgagaatgacggctgaacaaattctagcagaaccgctagaaaactatgaaaggctcacaatcgctgagaaaaaacggaccattatcgagctcttggaaagagtaggcttaactgaaaaggatttaacaaaatatccgcaccagttcagcggcggccaattgcagcggattaatattgcaagagcggtctcgctcaagccgaagctgatcgtattagacgagtctgtcagcagcctggacatggtaacccaaacgcttatattgggtttattaaaagagctcaaagacgatttcggaatgtcttatttttttatcacacatgatttaaaagccgcctatcaattgagtgatacactaggtgtattagaccacggccaattggccggactttacgataaacatcgttttttaaagtcagaccacccggttgtacaagaaatgaagcgttccatactggcagaacacccgcgctttcgttcgatcagaacaagagcggttc

SEQ ID NO: 537 - DNA, 621 bp, Bacillus licheniformis
gcatgaaaataaaagatatttggaggaaccgctgatcgttcataaactcggaacgaaggcggaaaggagagaagtcgttcgctcgatgcttgaaattgtcggtcttgatgcttcatacggcgaccgatatgcacaccaattcagcggcggccagaggcaaaggatcggtattgcaaaagcgctgatcacaaagccgaaattaatcattgccgatgagcctgtttccgcgcttgatgtatccgttcaggcgcagatcttaaatctgctgtctgatctgcaggaggcattcaatttaacgtttctgtttatttcgcatgatctcggggtcgtccgctatatcagcgacagggtagccgtgatgtatttcggaaagattgtcgagatggcggacgccgactctttatttagagaaccgaaacacccctatacagaaacactgttagcggcagtacccgtcatcggcaaaggagaggcggttcatacggcgccggatattgccgcgccccgcatgagtgaaaagggctgtcctttttacagccgatgcatgaagcgggcggacgtctgccttgaagcggagccgcttcttgaagagactgcggacgggcattatgctgcatgcca

SEQ ID NO: 538 - DNA, 921 bp, Bacillus licheniformis
cgatgttatccattgaggacttatcaatcagctcccggcagcacaccattgtcaaaaatgcctccttctcgattcatgaaggggaatggttcgcgctgctcggggaaagcggcagcggaaagagcctgaccgcttcggccatagccgggctgcttccggacggactaacggtgaccggcggagacgtgatatttgaaggccaacagatgcttcaagccggacgcaaagcactccgacgcgtgcgcggaaaggatatcgcctgtatttttcaggactgtcacggagcattcaccccttttatacggatcggcaaacaaattgacgaaatggtcaaaacgcatacaggttggtctaagaataagcgaagagaagcgattctccatgcttttcgggaggtttctctgccggaaaacagagtatatgaaagctacccgtttcaattgagcggagggcagctgcaaagggccgcgattgctcaagcgatggtgctccgccccaagcttctcatcgcagacgaaccgacgacggctttagacagcatcacggccgcggacgtcttgcaacagctcgccgcgatgcgcgccaaaacaaactgcgccatcctttttatcactcatgacctgcggcttgtcaaaagatacgccgatcaaaccgccgtcatgcaaaacggagaaatcgtcgaaagcggcttaaccgctgatttaattagacagccggcacatgaatatacgaggtgtttattcgcggccatcccgccgctgaaaaatcctccgccaaggctgacggcagccccgcctgaaacaaaggaagcggtgctggcgggaacaggaggtgcgtgatgacccattctgcagagaccgttctttttgtcagcaatctgacaaaacattacgcttgcggccacaaagcggttgacaacgt

SEQ ID NO: 539 - DNA, 350 bp, Bacillus licheniformis
ttgattaaatatttaggccgtcgtcttgtttatatgttaatttctctctgggttatcgtaacagctaccttcttcctgatgagagcgataccgggcggacccttttcaggcgagaggaaacttccccctgcaattgaagccagtctcaattcctactatggtttagaccagcctctttttaaacaatatctcgattatttagtatcggtagcaaagtgggatttcgggccgtcatttaaatataagggacaaactgtgaacgacttgatcagctcagggttcccgatttcttttacactcggattggaagcgatttgccttgcgctcgctttcggcgtattgttcggcgt

SEQ ID NO: 540 - DNA, 543 bp, Bacillus licheniformis
taaacaaaaaagagacccggagactgcgtcgaaaactgcaggctgttttccaaaatccagctgcatcattcaatccaaagctcaatattatcgattcagttatggagccgcttgatgtttccaaacaagacatgccgtcatttttaagggacttccgaggcagccgccgtctgacggctgagcgtctgttctcaatggtcggccttccctcgcgcctccttgaccgctatccgcacgaattaagcggcgggcagcgccagcgggccttgatcgccagagccatcagcactcatccgtctttaatcatctttgatgagcctacagcaagcctggatgtcaccagtcaggcgaagatcctggatcttctcaaagatttgcaggatgctatgggcctttcttatttatttatttcccacgatctggccgctgtccacttcatgagccatcgcatcatggtcatgaaagacgggcagattgccgatcaatttgaaaaagaagagcttttttctgccgaaaggcacccatatgccaaaaagctgcttc

SEQ ID NO: 541 - DNA, 255 bp, Bacillus licheniformis
catttatcagtttaatgctcattttcacactcgtcctcagcgcctgcggcttcggctcaagctccggtgacggcggtaaaaaagacagcaaagggaaagacacattaaatgtcaacattaaaacagaaccgttttcactacatccgggactcgcaaacgattcggtgtctgcaaacgtgcttcgtcagacttttgaaggattgacgacaatcggtaaagatggaaagccggttgaagcggcagccgaaaaaatcg

SEQ ID NO: 542 - DNA, 282 bp, Bacillus licheniformis
gaaaaaagtattggaagtcgagaatttgcatgtttcatttacgacatacggcggaacggtcaaagccgtccgcggcgtgagctttgagttatatgagggggagacgtttgcgattgtcggcgagtcgggatgcggaaaaagcgtgacatcgcaaagcatcatgcggcttttgccgaagttttcggcaacggtcacagacggtgcgatccgctttaagggaaaagacttgcgccacctgtccgaaaaagagatgagaaagatcagaggagcagaaatgtcaat

SEQ ID NO: 543 - DNA, 240 bp, Bacillus licheniformis
atgcctcatttgtatctgccttctcatgtggcgaagctgttttgcatcaagggcctggtcatctcccgcccgagaaacgtcacctttccagaagtcggttcggtcagccgcagtatcgattttcccaaggttgattttccgcagccggattccccgacgatccctacgatttcgccttttttgactgacagtgtaacatcatcgaccgctttgacgattttcttgcgggacacgcggtaa

SEQ ID NO: 544 - DNA, 213 bp, Bacillus licheniformis
  misc_feature (1)...(213): n = A,T,C or G
atgaaaaggctgacgagcgtgttggcttccgcatttgcggtcatcctgctgttcggatgtacggcaaatgaacaggcggggcaggaaacgaagaagaaagcgaaagaaacggctggagaacaggttctgaggctgaacaacgaaaatgaaccgacatcttttgatccgncgatcggctttaataatgtctcatggcaggcgctgaacatctga

SEQ ID NO: 545 - DNA, 210 bp, Bacillus licheniformis
atggcaaaggtgcctcaaacgactgatgaaaaagagcggcaggagcattactcatctattttaaaatcacttcaagaccagggagccatcgtacctgtttcttacattaaaaagacggcgatatatcaaaagaatatcaccgactttacgttccctgctaaccgtgacgaacatccatttacaggcattcgcgtcaagcagcaacactag

SEQ ID NO: 546 - DNA, 1170 bp, Bacillus licheniformis
gggccggaagcctgcgccgcgccaaagaaacggtgaaagacctcgattacattatggctgtcactgatccggaacttgtccgggaagggctcttaaagctttcgaacatcaaggaggtcattgccgcaggagatacgaaagtgtctctcacatttgcgtttgaatacgaaatcagtgcggatttccggctggtgacagaggaacagttcccaacgacgcttcatcattttaccggatcaaaagaccacaatatcaaaatgcgccagcttgccaaagaaaaaggcgaaagaatcagtgaatacggcgtcgaaaccgttgaaactggagaaattaaaactttctcaagcgaaaaagagtttttcgcccatttcgggcttccgtttattccgcccgaactgcgggagacaggaagagaagtcgaggactacagcgttgacatcggactcgtttccgccgaggatattcaaggagaccttcacatgcactcggcttggagcgacggtgctttttcgatcagggaaatggcggaagcatgcatggcaaaagggtaccgctatatggcgatcacagaccattcccaatatttaaaagtcgcaggcggtttgacgcctgagcgccttcgcatgcaggcgaaggaaattgatgaactgaataaggaatttaccgattttcatatttttaaaggcgtggaaatggacatcctgcctgacggaacactggattatgacgacgagctgctggcggaaatggatcttgtcattgcttccatccattcaagcttttcacagccgcagcatgtcatcatgaagcggcttgaaaccgcgctgctgaatcagcacgttgacattatcgctcatccgaccggccgtctgatcggaagaagggcggggtatgaagtcgatattgaccagctgatcgaacttgcgaaaaaaacgaatacagcattggagctgaacgcaaatccagcgcggctcgatctcagaatggagcacttgatcaaagcgaatgctgccggagtgacactcgttattaatacggatgcccacaacacagcgatgcttgatgatatgaaaacgggcgttacggcagcgagaaaaggatggacgccaaaggccaatgtattaaacacccgctcctttgaagaagtccaggcatttttgtcgcgccatc

SEQ ID NO: 547 - DNA, 1012 bp, Bacillus licheniformis
atgggcaaagcaacaggatttatggaattcaagcgggaaaagcctgctgaacgcgatcctctcacacggataaacgactggaacgaatattcgtctccattttctgaggaagcatcaaaaagacagggagcgcgctgcatggactgcggcacccccttttgccaaatcggcatggatataggcggttatacgtcaggatgtccgattcacaatttaatccctgaatggaacgacctcgtttacaagggaaggtggaaagaagcgcttgaccgccttctaaagacaaacaatttccctgaattcactgggcgggtctgtccggcgccttgtgagggctcttgtacggtggcgatttccgatccggccgtatccatcaaagggatcgaacggacgattattgacaaaggatttgaaaacggatggattcagccgcgaattccgaaaaaacggagcggcaagaaaatcgcgatagtcggctcagggcctgccggtcttgcaagcgccgatcaattgaaccaggcggggcattcggtcactgtttatgagcgcagcgaccgcccgggaggcctgttaatgtacggcatcccgagcatgaagctcgaaaaaagcgttgtcgaacgccgcatcaaactgttgacacaggaaggcgtcgactttgtcaccaatacggaaatcggcaaagatattacagccgacgaactaaaagaacagtacgatgcgattatcctttgcacaggggcccaaaaacagcgcgatctcttgattgaaggccgtgaagcaaaaggtgtccactttgccatggactatttaacaggcaccattaaaagcatgctcgattcgaattttaaagataagcagtttatcaatacgaaaaataaagacgtcatcgtcatcggcggcggtgacacgggggcagactgcgttgcaacggccctgcgccaaaaagcgcgaagcgtcgtccaattcggcaagcatccgaagctgcccgatacaaggaccgccgaaaatatgg

SEQ ID NO: 548 - DNA, 800 bp, Bacillus licheniformis
atgctgaaacgagacggtcatgttcattctcccttttgtccgcacggatcaaaagacgaattcagatattatatagaagaattgtgcaaaaaaggcttccaatccgtatcctttactgagcacgcgccgcttccgccttcatttattgatccgactccggagaaagacagcgccatgccgatctcccagctgggccgctatattgaacggctgaccgaactgaaggaagaatacagaggacagcttgacattttgatcggtcttgaagtcgattatatccgcgcctttgaacatgaaacgaaagcttttctcgatcagtacggcacacatcttgacgacagcatcctgtccgttcattttttgccggctggatcttcatacatctgtcttgactacgatgaaaaagcgtttcagcagctgatcgactgctacggcagcacagagcaggtttatctcgcctattatgacgaaatctattcttccattgtatcaccgttgggagcatttaagccaaaacgaatcggccacatcacgcttgcgaaaaaatttgtgaagctgtttccgtatacgatgtcggaaagcgttagaaaatcggtctcctcctgtctggatgaagccgcaaaacgcggacttgaacttgactttaatacggccggcctccgcaagccttatgcaggcaacgtctatatggaagaatggatgataaaagaagcggaacaaaaaaacatcccgcttgtctttgggtctgacgcccaccaagcagaggatgccggatttggttacgaacattttgagagccg

SEQ ID NO: 549 - DNA, 660 bp, Bacillus licheniformis
ttcggatctccatctttatcaagggaatttccctcttccaaaaggcttccagctcggccatgaaccgatgggaattgtagaagaaacaggacctgatgtaacaaaagtgaaaaaaggagaccgggttgtcatcccgtttaccgttgcctgcggacattgcttttattgcgaaaacaagctggaaagccagtgcgacaatgccaatccccattatgattcaggcgggtattttggctactcggaaaaattcgggaatcaccctggcggacaggctgaatatttaaaagtgccgtttggcaatttcacgccgtttgtcattcctgaatcatgcgagatggaggacgagtcgcttctgtttttatcagatgtcctcccaaccgcgtattggagcgtgcttcacgcaggcgtcaaaaaaggggacactgtcattgtgctcggctgcgggccggttggattaatggcgcagaagtttgcctggatggaaggggcgaagcgggtcattgcagtagactacttggactaccgcctaaagcaggctgaggcattaaaccgcgttgaagtatttgactttacaaaatatcctgatatgggcgagcatttaaaggagattacaaaaggcggggcggatgtcgtgatcgactgcgtaggatggacggcaaa

SEQ ID NO: 550 - DNA, 882 bp, Bacillus licheniformis
gggatgcatgggcgaaaagcagggttaaaccgccttattgttgcggccacaattaccgccgaagtagtcaagtgggggaaaatgtgactacggtaaaagaaggggagtatgtttcggcagaaacgcacatcgtttgcggaaagtgcctgccgtgtttgaccggaaaagagcatgtctgcaaaaaaacgctgattctcggtgtcgatacagacggctgttttgctgaatatgtcaaaatgcccgccgcaaacatttggaaaaacccggccggcatgcctgaggatctcgcttctattcaagaaccgctcggaaatgccgtgcatacggttctgacgggaatgacggctggagtgaaagtcgctgtcgtcggctgcggaccgatcggactgatggccgtggcagttgcaaaagcgtctggggcggcgcaggtgatcgccatcgataaaaatgaatacaggctcgaccttgcattgcaaatgggggcaaccgatatcatctccgttgaaaaagaagatccgctcaaaaatgtaagcgctttaacaaatggtgaaggggcggacttggtttgcgaaatgtcaggccatccgacggcaatccgccaaagtttaaaaatggcggcaaacggaggacgggttcatgtcttaagcttgcctgagcatcccgtatgcatcgacatgacaaatgatatcgtctttaaaggattgacggtccaaggaattaccggccgcaaaatgtttgaaacgtggagacaggtcagcggtctcctccaatccggcacgattcaaatcaagcctgtcatcactcaccgtttcccgatggaagagtttgaaaaaggctttgaactgatgagaaaagggcaatgcggcaaagtcgtactgatac

SEQ ID NO: 551 - DNA, 1014 bp, Bacillus licheniformis
atgaagcagattgtgtgtgaaaagccttatcgttttaaaatgacggatgtgaaaatgccggaactaaaggatggggaagcattggtccgcatcaaacggatcggaatatgcgggacggattttcacgcttattgcggaagacagccatttttctcttatccaagagtgctcggacacgaactgtccggtgaaattgtcagcatcgataattccggcggaacgctcaagccgggcgatcaagtgtcaattattccttatttggaatgcggggcatgcatcgcctgccggaacggacgccccaactgctgcgtcaatctgaacgtcctcggtgtccatacagacgggggaatgcgggaatacataaacgtcccggcagaccacctgctaaaaacagaaggattgacgctcagcgaagctgctgttgttgaatgtttaagcatcggcgcccacgctgcagaaagggcaaatatcaaaaaaggggaaacggtgcttgttgttggagcggggcccatcgggctcagcgtgatgaaattcgcaaaattgaagggtgcaaaagtcatcgcgatggatgtcagaaaagagcgcctcacatttagccgcagatgggctgaagccgatgaagtcgtattagggggagaacatgcggctgatgagatcaaacggttgacgaacggcgactttccgacggctgtctttgatgcgacagggcaccctgcatcgatgaacagcgcttatcagtacgccgcacacgggggacggctgatctatgtcggacttgtcaacgaccatctggctatgcccgatcctgaaatccacatgcgggagctgacgattttatccagccgcaacgcattaagaagagattttgagacggtgatgaaagccatcatggatggcggagcggatgcgaaccggtttgtgaacggacagatggcgtttcacgatgttgttgacggatttcaatcagcgcttgctccggaaaccaatcctgtgaaagtgttgatccatctgtaa

SEQ ID NO: 552 - DNA, 1015 bp, Bacillus licheniformis
atgtgaaagctgcggtgatgacgaagccttattcgattgaattgcacgacataccgcgttccgaaccggccagcggtgaagtccttgtcaagataaaggctgccgggatttgcggaagtgatgtgcatttttacgacggctcaaatccatatgcacagtaccctcagatctttggacatgagcttgcaggcatcattgaaaaaacgggggccggcgtgagggggcgatccgcaggcgaacgggtcgtaattgaaccggcgatcccgtgcggaggctgctacccttgtcggaaagggaggacaaacgcctgtatgaacatcgatatgatcgggtcggttcgcagaggagggttcgctgattttatcattgttccagaaacgcatgtccatccgattcctgagcaaatggattttgcaaccgctgctttgtgcgagccgttttcaatcggagcgcaggcggttcggcgggcagatattcaaacaggcgaaacgattgtcatattgggaatgggtccgatcgggttaacgattttggcgcaggtaaaaaagcgcttcgacgttcgtgtgatcgctgtcgatcctgtaagggaaaggcttgagcttgccgaggcattcggggcggatgccgttattcagcctggtgaagaggatgcagagcaaatgattctgaagctgacaggcggagaaggagcggggattgtgttcgaagcggccgggattcccgcgacgattgagcaatccgttcgtttggcggccgccgccgggcgcattgtcattgtcggcttaacggggaggaatgtgacgattccgggtcttcttctcacaaagaaagatattgaaatttatggaacaaaacacagcgtcaatcaatttcccggcgtcattcaatttttgaatgaaaaccctgaaatagcccgggcttttgtcactgagatcatgccttttatggaaatagaagaggcgttgaaaaaagcgaaaaactgtccccatcaggtcacaaagatcattttatctta

SEQ ID NO: 553 - DNA, 1140 bp, Bacillus licheniformis
atgggcaaagcaacaggatttatggaattcaagcgggaaaagcctgctgaacgcgatcctctcacacggataaacgactggaacgaatattcgtctccattttctgaggaagcatcaaaaagacagggagcgcgctgcatggactgcggcacccccttttgccaaatcggcatggatataggcggttatacgtcaggatgtccgattcacaatttaatccctgaatggaacgacctcgtttacaagggaaggtggaaagaagcgcttgaccgccttctaaagacaaacaatttccctgaattcactgggcgggtctgtccggcgccttgtgagggctcttgtacggtggcgatttccgatccggccgtatccatcaaagggatcgaacggacgattattgacaaaggatttgaaaacggatggattcagccgcgaattccgaaaaaacggagcggcaagaaaatcgcgatagtcggctcagggcctgccggtcttgcaagcgccgatcaattgaaccaggcggggcattcggtcactgtttatgagcgcagcgaccgcccgggaggcctgttaatgtacggcatcccgagcatgaagctcgaaaaaagcgttgtcgaacgccgcatcaaactgttgacacaggaaggcgtcgactttgtcaccaatacggaaatcggcaaagatattacagccgacgaactaaaagaacagtacgatgcgattatcctttgcacaggggcccaaaaacagcgcgatctcttgattgaaggccgtgaagcaaaaggtgtccactttgccatggactatttaacaggcaccattaaaagcatgctcgattcgaattttaaagataagcagtttatcaatacgaaaaataaagacgtcatcgtcatcggcggcggtgacacgggggcagactgcgttgcaacggccctgcgccaaaaagcgcgaagcgtcgtccaattcggcaagcatccgaagctgcccgatacaaggaccgccgaaaatatgggccggaacagccgcatgtccatacgctggactatgcctatgaagaggcgcaagcagtattcggaaacgatccgagacaatattcgatccaaacaaaaaagcttgtcgcagataaaaacggccatttga

SEQ ID NO: 554 - DNA, 321 bp, Bacillus licheniformis
atgaaaaaagtaaagaatgatcaagggaaatttgagttccacgaaattccgggaacggaaaaagtatggcctgctcaatacgtctttatcgccatcggctttgaaggaacggaacagccgctgcttgagcagttcggggtaaatacggtgagaaataaagttgacgcagcatacggggaatttaaaacaaatgtcgatggagtcttcgcagcaggggatgcgagaagaggacaaagcctgatcgtttgggcgattcacgagggacgcgaagtcgcccgtgaagttgacaaatatttaatggggagctctgtactgccttaa

SEQ ID NO: 555 - DNA, 4317 bp, Bacillus licheniformis
tacagaaaagacggttttcaaggaaaaacattctccgtattctgctaacctcagtgatgatactcagtttactcatgccaaacacccagacatatgcagaagaacaaaacgaacacccgctgatcagcctcagcatcttgggtacgacagatatccacgcccatatgatggattatgactactatgccgacaaagaaacggctgaattcggactggcacgaacggctcagctgatcgaaaagtaccggagccggaatcctaacacgattcttgtcgacaacggcgacttaattcaaggaaaccctctaggggaatacatcttcaaacatgaacgtgaatcgattatctccggaacgaaaacacacccgatcattgatgtcatgaacaaactgcaatatgacgccggcacgctcggaaaccacgaattcaactacggccttgaattccttgacggcacgataaaaggggccgaatttcccatcgtcaatgccaatattaaaacaccggacggaaagaacaaatatacgccatatcatattgaagaccggacgctgacggatgaaagcggccgaaagcaccagcttaaagtcggctatatcggcttcgttccgcctcagattttaacatgggataaaaagcacctggacggcaaaatcacagtgcaggacatcaccgaatcagcaaaagaaacgattccaaaaatgaaacaggaaggcgccgacgtgatcatcgcgatcgcccactccggaattgaaaatggcgaacaggcggcgggagccgaaaacgccgtatacgacctggctctcaagacggaaggaatagatgcgatcatctccggacatcagcacggtctgttccccggcaccgactatcccggtaacggcgtgatcgacaaccaaaaaggaacgatcaacggcattcctgtcgtcatgccgaagaactggggcagccatttaggaattatcgatatgcagcttgaactggacggcggcaaatggaaagtgaaagatgccagcgcaaaaacggaagcgattgccggaaatgtgacgtcgcgaaacgaaaccgtcgtttccgcgattaaagatacgcacgaaaaaacgctcgaatacgtccgcgcgccggttggccaaacagaagctgatattaacagctttttcgcgcaggtaaaagacgatccttcaatccagattgtcacagatgcacaaaaatggtatgcggaagatgtcatgaagggaacggaatacgaaaacctgccgattttatcagcgggcgcgccgttcaaagcaggaggacgcaacggtgctgattattatacaaacattaaagcaggaaaccttgcgatcaaaaacatcggcgatttgtatttgtacgacaatacgctctatatcgtcaaactgacgggaagcgaagtgaaggactggatcgaaatgtcggccgggcagttcaatcagatcgatccttcaaaatcgggtgaacaggcgctcctcaaccccgatttcaggtcgtataatttcgatgtcattgacggtgtgacctaccagatcgatgtcacacagcctgcaaaatacaatgcctcaggcggggtgaaaaatccgcaggcgaaccgcgtcaaacagttgtcttacaacggaaaacccgtccgcgacgaccaggaattccttgtcgtcacaaataattaccgcgcctccgggggcggcggattcccgcatctgactcaggacaaagtcgtttatgcggcggctgatgaaaacaggcaggtgctcatgaactacattatggagaagaaaacggtcaatcccgccgccgacaacaactggtcgatcgctccgattaaaggagccgacgtgacattcgagtcttccctccttgccaaaccgtttgctgaaaaagcgaatgacatcgattttgtcagggaatccgaaaacaaaggatatggcgtctataagctgaactttgacggttcagagcctccagttgatgatgaaaactggacattaaccgtcatgcacacgaacgacacgcatgcccaccttgatggagcggcaaggcgcgctgccaaagtgaaagaaatccgcagtgaaacagaaaacaatgtgctgctcgatgccggcgacgtcttttccggcgatctgtattttacaaaatggaacggactcgccgatttgaaactgatgaacatgatgggctatgacgccatgaccttcggcaaccatgaatttgataaagggcctaaagtgctcgcagactttctcagcggaaactatacagccgtcgacccgttaaacagacaccagctggaaaagcccgattttccgatcgtcagctccaatgtggatgtatcaaaagagccgaagctgcgaagctttcagaaagagcctgcagtcttagcagcgggaaaaaagaaagaaagcggcatctatccttatattctgcttgatgtaaacggcgaacaagtcggcgtattcggcttgacgacggaagatacgtcatatacatcaagccccggtccgaacattgcgtttcatgacgcttatcagtcagcagagaaaacggtgaaggaactgaaagaaaaagaaaaggtcaacaaaatcatcgccctcacccacctcggctacaaccgggatctggagcttgccaagaaagtgaagggcatcgatttgattatcggcgggcatacgcatacacttgtcgatcacttgaaagtggtggagaacgaagaaccgacaatcgtcgctcaagtgaaagactacggacagtttttgggaagggtcgatgtggtgtttgatgagaacggcgtcgttcaaacggaccaatcaaggttcaatttgatcgcgatcgacgacaaagtggacgaagaccctcctgggaaagaagtgcttgacggctttaaagaagatattgacgaactgaaaaagaaaaaagtaggctatgccgatgtcccgctggacggaaaacgcgagcatgtccgctcaaaagaaaccaacctcggcaattttatcgcggacggcatgctgaagaaagcaaaacaagccggcggagctgacatcgccatcacaaacggcggcggaatcagaagcggtattgccaaaggcgaaatcacactcggcgatgtgctgacggtcatgccgttcggcaacaccctttatgccgctgatttgacgggggcgcaaatcaaagaagcgcttgagcacggggtgagccaagtcgaagaaggcggaggcgcgtttccgcatgtttcgggtctatccttcacctttacactgagcaagccaaaaggtgagcgaatccttgatgtgaacctagtcaatgacaaaggggacgctgttccgctcgatttggacaaaacctaccgtgtcgctacaaataacttcatgggcggcggcggagacggctattccgtttttaaagaagcgaaaaacggtgtcgatctcggctttaccgattacgacatttttacagagcagcttgccttatacgattctgtttcaccgaacatcgagaacagaatcacagaagtgttccttcccgaccgtcaggcagacggctcttggacgcttgcggaaaagccgttcgaaacatacgcgaaaaacgcaaatcaggcgattgcctatttccctgacacagaaaaggaacacatcatgctgaatatgacaaaagcacagactgaccttgtcaaagaaagaaccggtgatccaagcatcaccctgaaaaacgatcgcattgcgatgcagcttccagccgttaatctggcaagcgaaaagacaaaaatcagcattaaaatcgccaaggatatcaaacaggcggtcacaaaggtatatgatttcaacattcagcagaatggtaaaacggtcagcacatttaaagagcctgtcggactgttgttccaagtcgatgctcctgataaacatttgagcgtctattatgtcgaccgcaaaaacaacagcttcacaaaagtaacaaacggctatacgaaaggccgtaccgttgcaggctatgtcgaccatttcagcgagtataccgtgatgaatgacaatgatgccgggtcgccttcccttccgacgggttccggcgatgatgacactccggatggcggcagcggcggtgaaccccctgcttcgcccggcgccggcagcggcggagacggatcaggcggtcatgacagcggcggagcagatgacggaaatgaaccttccgatggttcaaacggcggttttttgcctgacaccgcttcaaacgcctatcattggctgatgctcggcctgctgttgcttatatccggaagcggcctgtacctttaccaaaggaagcggcgcaagc

SEQ ID NO: 556 - DNA, 2229 bp, Bacillus licheniformis
atgtcgctactgcttgaaccaagtcaagaacaaattaaggaagagaaactttatcagcaaatgggtgtcagcgatgacgagtttgccatgattgaatcgattctcggaaggcttccaaactatacggaaatcgggattttttcagtcatgtggtcagagcactgcagctacaaaaattccaagccgatcctgaaaaagttcccgacaaaaggcgaacgcgtcctgcaaggaccgggggaaggcgcaggaatcgtcgatatcggcgacaatcaggcggttgtcttcaaaatcgaatcgcacaaccatccgtcagcgattgagccttatcagggagctgcaacgggtgtgggcggcatcatccgcgacgtcttttcaatgggcgcgcgtcccatcgctgttttgaactctctccggtttggcgaactcacttcaccgcgtgtgaagtacttgtttgaagaagtagtcgcgggcattgccggatacggaaactgcatcggcattccgaccgttggcggggaagttcagtttgacggctgctatgaaggcaatccgcttgtcaacgcgatgtgtgtcggtttaatcaaccatgaagatattaaaaaagggcaggcgaaaggcgtcggcaataccgtcatgtacgtcggcgcgaaaacggggcgcgacggcatccacggcgcaacgttcgcctcagaggaaatgtctgaccaatcagaagaaaagcgctcggccgttcaagtcggcgatccgttcatggagaagctgcttcttgaagcgtgtctggaagtcatcaaatctgacgctttggtcggtattcaggacatgggtgcggcaggcctgacaagttcaagcgcggaaatggcatccaaagccgggtctgggatcgagatgaaccttgacttgattccgcagcgcgaaacaggcatgacgccgtacgaaatgatgctttcggaatcccaggagcgcatgcttttggttatcgaacgcggccgcgaacaggaaatcatcgatatttttgacaagtacgatcttgaagccgttgctgtcggccatgtgactgatgacaagatgctgcgccttttccataacggagaaatggttgccgagcttccggtcgatgctcttgcagaggaagcgcctgtttaccataagccgtcaaaagtaccggattattacaaagagttccttgaaacagacgtccctgcaccaaaagtcgaagatgcgaaagaaacgcttctcgagctgctaaagcagccgaccattgcgagcaaagaatgggtttatgaccaatatgactacatggtcaggacgaacacggttgtcgcaccgggctctgatgcagccgtcctcaggattcgcggcacgaaaaaagcgctcgccatgacaacggactgcaatgcccgctacttgtaccttgatccggaaacaggcgggaaaatcgccgtcgcagaagcggcccgcaatatcgtctgctccggagcagaaccgcttgccgttacggataacctcaactttggaaatccggaaaagccggagatcttctggcagatcgaaaaagcggcagacgggatcagcgaggcgtgcaacgtgctcagcacaccggtcatcggcggaaacgtctctctctacaacgaatcaaacggaagcgcgatctacccgacgcctgtcatcggaatggtcggactgatcgaagatacggagcatattacgacacagcactttaaagcagcgggcgatttgatttatgtcatcggcgaaacattccctgagttcgccggaagcgagctgcaaaaactgaccgaaggaaagatttacggcaaagcgcctgcgattgacctggaagtcgaacaatcgcgtcaaaaagctcttctgaaagcgatccgctccggactcgttcaatcggcgcatgacgtctcagaaggcggcatcggcgtggcgctggcggaaagcgttatatcttctcaaaggctcggcgcccatgtgacgcttgcaggcgaacctgcattgttattcagcgaaacacaatcacggtttatcgtctctgtgaaaaaagaccatcaagaagcgttcgaaaagcttgtcaaagacgccgatctaatcggtgaagtaacgtcagacagcgtgctggctgttcaaagccaggaaggacaacaatggattcatgcgcagacagaagagctcgaaagcgcatggaaaggagctatcccatgcttgctgaaatcaaaggcttaa

SEQ ID NO: 557 - DNA, 3066 bp, Bacillus licheniformis
aagctgtcccatttatccaggacgatacggcgggaatcaatatctattccgctgcgcaaggcgattttccggaactaaaagagggtatgtctgtttcggtcacggggaaaatcacgacatacaaaggcttgacagaaatcgtacccgcaccgtcaggcattgaagtaaccggagaaggggcggcactgcccgaccctgttccgctgactattaaagatgtgctcgatcagggaaccgcagctgaatacgaaggccggcttgtgaggatgaaaggctttattgaaacaaagccggatgcgccggcaggcggcggctataatatcacaatgatcgatgaaaactatcatccgctcacactaagggtgatggaacaaacgaatgccgccgcttcgatagaacaaggacaatggtacgagattaccggcatattaagccgctatgattcggtgcagcttctgccgagaaaacaggaggatcttcggaaattagacggcgccgcgcatcctccccccgctgctgaaggggaatacgaaagcgttgtggaacgagtcgtcgacggggatacgatccacttaaaagagcctgttctcggatctacaaaagtccgctatgtcaacatagatacagccgaaacttatcataagccgaaaaatgaattagatgaaaaccagctgcagcacggaaacaaggcgaaggaatatttgcagtcgatattggccccgggagacaaagtcaccgtgaaagtgggcaaggaagcaaaagacagctacggccgcctgcttgcccaagtcatcactgaagacggcgtcaatacgaatttgcagcttgtccaaaaggggatggctgtaacctacttcatttggccggttggaagtgatgaagactatcaattgtttcaaaacgccgtcaaaaaggcgaaaggcgataaaatcggcatttggaatcccgctgatccgctcctcgaaatgccgtttgaatttcgcgacagggagcaaggcaaagggctgacgcggcatgtcggagactctgcggaaaatacgtatgtcgcgcctgaaaagtggcgggagattccggtggaaagacgaattttctttgcgtcggctgaagaagcggaagctgcgggctattcgaaaaaagagcaaagcggcaatattccgctgcgcctgttaagcatgaatgatctgcacggaaagatcgatcagcaatatcagctcgatctaaacggcgatggccggacggatggaacattcggcaggatggattatgcagcatcattgatcaaagagaaaaaagccgagcaggaaaacacgctgatcgtccacgcaggcgatatgatcggaggaagctcgccggtttcttccctgcttcaggacgagccgacagttgaagtcatggaggaaatcggatttgatgtaggaaccgtcgggaaccatgagtttgatgaagggaccgaagagctgctgcgcatgttgaacggaggcgaacaccctgaaggcaaagggacaaaaggttacgacggacaggatttcccgcttgtctgcgccaattgcaagttgaaggcaagcggggacagctttcttcctccatatgaaattattgaagttgaaggagtgcctgtcgcttttatcggcgttgtgacacaggcggccgccaatatggtcatgccagaaggaattcgctcaattgaatttacagatgaagcaaaggccgtcaaccaggctgcaaaagaactgagagcgaaaggtatccgggcaatagcggtgctcgcccatatgacagcttcacaggacggcggggttgtgaccggcgaatcagccgaacttgctaaaaaagcagatcccgagatcgatgtcatctttgccggccacaatcatgaagtggtcaacggccaagtcaatgatattttaatcgttcaagcatacgaatacgggaaggcaatcggtgtcgtcgatcttgaaatcgaccgggaaacgaaagacatcgttcacaagaaagcggaaatcgaatatgtgaatcaggaaaatctcaagcccgatccggcggtcggtcagatactggataaatatgagcggatggttgcgccgatcatcagcgagaaagtcggtgaggctgcgcacgatatggccggcggctattcaaatgacggagacacccctctcgggaatctgattgctgacggtatgcggcaagcgatgaattcagatttcgcattaatgaacgggggcggcatccgccaagatttaaaaaaaggaacgattacatggggagacttgttcaatatccagcctttcggcaatgtactcgtccggcttgaaattaaaggcagggatttatacgatattatagacgcgcaaatatccccatcttacggcccggattactcgatcagcggcttcgcttatacatgggacccgaaaacaaataaaaccgcggctatttttcttgaagacggaacaccgattgatttagaccaaacatatacgctgaccgtaaacaactttatggcatctgcttcaggaagcaagtatttgccgatttccaggcttggaaaaaatccggtcacaggtccggaagatatcgaagccacagtcaaatttgtcaaaagctttaaagaaccgatcgcttatactgccgaagggcgaatcaaaaaattagcagaagatgattcgcgtccgggagaacagcccggacgcggggctgatccagatgacaaagaaaaacccggaagcggaggcgctgatccgaatgacgaagaaaaaccgtctggtgataagggcgatggggggaaacccggcaatgacaccggagaaagtccggttcatgacggtaccggcaatgcttcaaggagcggcgctattcctgttgcgggcatgacgaccggtgaaggatcagatgcgcctgcggagaagatggacggtctgtcaaatgatgcgtttctgccagacgagcgtgaagagcgcaagctacccgatacggcggcagcttacggcggtttccttttatacggcttcctgacgtttatgttcggagcgattctttatatgcggaaaaggggtattgcgagac

SEQ ID NO: 558 - DNA, 1908 bp, Bacillus licheniformis
  misc_feature (1)...(1908): n = A,T,C or G
gaagaagagtttttaangccgctacacgtttgaagaaatcaaagaagtgttcaaagaggcttacgccaaaaaattcagattcccgtcctttatgagcgcttttaagttttacaatgattatgcgctgaagacaaacgacaagaaaaaaattcttgaacgctatgaagacagaatctctatcgtagctttattttttgcaaacggggataaggagaaggcgaaggaattcgtcagaatgatgatcaaccaggagtatcagccgagcacgccgacgttcttaaatgccggccgcaaacgccgcggagagctggtcagctgtttcctcttggaagtcaatgattccttgaacgacatttcgagagcgattgacatttcgatgcagctgtcaaagctcggcggaggcgtatctttaaacctttcaaaactgcgtgcgaaaggcgaagcgatcaaagatgtcgaaaacgcgacaaaaggtgtcgtcggcgtgatgaagcttcttgacaacgcattccgctacgctgaccaaatggggcaaagacaaggctcaggcgctgcgtacttaaacattttccaccgcgacatcaacgatttcctcgatacgaagaagatttcggctgacgaggatgtccgggtgaaaacattgtccatcggggttgtcattccagataaattcatcgagcttgcaagagaggataaagcggcatacgtcttctatccgcacaccgtttataaagcgtacggcgagcacctcgacgaaatggatatgaacgagatgtacgaccggcttgtggaagatccgcgcgtcaaaaaagaaaaaatccacccgcgcaagatgctcgaaaagcttgcgatgttaagatcggaatccgggtatccgtacattatgttccaggacaacgtcaacaacgtgcatgcgaacaatcatatttcaaaagttaaattttccaacctttgctcggaggttctgcaggcttcacaagtttcatcatacacagactacggtcaagaagatgagatcggccttgacatctcctgcaaccttggttcattgaacattttgaacgtcatgaaaaacaaatcgctcgagcagacagttaagcttgcaaccgattcgctgacgcacgtttctgaaacgacaaacattacaaacgcaccggctgtcaaaaaagcgaacaaagcgatgaaatccatcgggctcggagcgatgaacctgcacggattcttggcacagaacaatatcgcctacgaaagtgaggaagcgagggacttcgcgaacactttctttatgatgatgaacttctactcgattgaacgatccgccgaaatcgccaaagaaaaaggtgagacgtaccatgggtacgaaggttcagcttacgcaacgggtgaatacttcgaaaagtatgttacacaagatttctcgcctaaattcgaaaaagtggccaagctttttgaaggcatgcacatcccgacaaaagaagactggaagcagctgaaacagtttgtcaaagaacacggattgtaccacagctaccggctgtgcatcgcaccgaccggatccatttcatatgtacagtcaagcacagcatcggttatgccgatcatggagcggattgaagaaagaacatacggcaactccaagacgtattatccaatgcctggacttgcgccgagcaactggttctactataaggaagcgtatgatatggacatgttcagggttgtcgacatgatctcgacgattcagcagcacgttgaccaaggcataagctttacattgttcctgaaagatacaatgacgacacgcgatttgaaccggatcgatctttatgcccaccataaaggaatcaaaacactttactatgcaagaacgaaggatacagggcaagaaggctgcctttcttgtgtcgt

SEQ ID NO: 559 - DNA, 1542 bp, Bacillus licheniformis
atgacgaagttagtaaatgaaatgattcttgtgttggattttggaagtcagtacaaccagctgattacccgccgcattcgtgagtttggtgtatatagtgaattgcatcctcatacgttgacggcagaggaaatcaaaaaaatgaatccgaaaggaattattttgtccggcggtccgaacagcgtttacgacgaaggatctttccgctgcgacgaaaagattttcgaactggacatccctgttcttggaatttgctacggcatgcagctgatgacgcattaccttggcggaaaagtagaagcggcaagccagcgcgaatacggaaaagcaaacattcatatcgagggtgaaccggatctgtttaaagatcttccaaacgaacaagtcgtctggatgagtcatggtgatctagtagttgaagttccagaaggctttaccgttgatgcgacaagccatcattgcccgaactcagcaatgagcaagaaggataagaaatggtacggcgttcaatttcatccggaagtccgccattcagaatacggaaacgaccttttgaagaacttcgttttcggtgtttgtgaatgcgtcggcgaatggtcaatggaaaactttattgagattgaaatgcagaaaatccgcgaaacagtcggcgacaagcaagtactgtgcgcgttgagcggcggggttgactcctctgtcgttgcggtcttgatccataaagcgatcggcgaccagctgacttgtattttcgtagaccacgggctccttcgaaaaggtgaagcggaaggcgtgatgaaaacgttcagtgaaggcttcaacatgaacgtgatcaaagtggatgcgaaagatcgcttcctgaacaagcttaaaggcgtctcagaccctgaacaaaaacgcaaaatcatcggtaatgagtttatctacgtgtttgacgatgaagcggaaaaactgaaaggaattgacttccttgcacagggaacgctatacactgacattatcgagagcggaacagcgacggctcagacgatcaagtcgcatcacaatgtcggcggccttcctgaagacatgcagtttgaactgatcgaaccgctgaatacgctcttcaaagacgaagtgcgcgcgctcggaaccgagcttggcatccctgacgaaattgtttggcgccagccgttcccaggtccgggcctcggcatccgcgttcttggagaagtgacggaggaaaagcttgaaatcgtccgcgaatcagacgcgatcctccgcgaagaaatcgccaaagctgatcttgaaaaagatatttggcaatacttcaccgttcttcctgatatccgcagcgtcggcgtcatgggagacgcaagaacttatgactatacgatcggcattcgcgccgtgacatcgattgacggcatgacatcagactgggcgagaattccttgggatgtccttgagaaaatctcgacacggatcgtcaatgaagtgaagcacattaaccgcgtggtttacgatattacgagcaagccgcctgcaacaatcgagtgggaataa

SEQ ID NO: 560 - DNA, 1539 bp, Bacillus licheniformis
atgacgatcaaacgcgcattaatcagcgtatctgataaaacgaacattgtcccttttgtaaaagaattgacagagcttggcgttgaagtgatttcaacagggggcacaagcaaacttcttcaggaaaacggcgttgacgtcatcggcatttctgaagtgacgggctttcccgaaatcatggacggccgtctgaaaacccttcatccgaatattcacggcgggcttcttgccgtacgcggcaacgaaaagcacatggcgcagctgaatgagcagggtatccagccaatcgaccttgtcgttgtcaatttatatccttttaaagaaacggtttctaaagaagatgtcacattcgaagaagcgattgagaatatcgacatcggcggccccggcatgcttcgcgctgcagcgaaaaaccaccaggacgtggcggtcatcgtcgatccccgcgattacagccctgtgctgaacgacttgaaagaaaacggcagcgtctctcttgagaaaaaacgcgagcttgcggcgaaggtgttccgccacacggcagcatatgacgcgttgatcgctgactatttaacaaatgtaaccggtgaaaaagagcctgaacagttcaccgtcacttttgagaaaaaacaatcgctccgctacggcgaaaatccgcatcaggaagcagtcttttatcaaagcgcgctccctgtcaaagggtcgatcgcttcagctgaacagctgcacggaaaagagctttcctacaacaacatcaaagacgcggatgcggcacttcaaattgtccgcgagttcaccgagccggctgcggttgccgtcaagcatatgaacccttgcggcgtcgggacgggcaacacgatcgaagaggcgtttaacaaagcatacgccgctgacgaaacatcgattttcggcggcatcatcgccctgaaccgcgaagtggacaaagcgactgctgaaacgcttcacaaaatctttttggaaatcattatcgcgccggcattcagccaagaagcgcttgatattttaacatccaagaaaaaccttcgcctcttgaccctcgatgtcaatcagcctgtgaaaaacgaaaaacagctgacatctgttcaaggcgggctcttgattcaggatctggatatgcacggctttgacgacgctgacattacgattccgacgaaaagggagccgaccgaacaggaatgggctgacctgaagcttgcttggaaagtcgtgaagcacgtcaaatcgaatgcgattgtcctggcaaaggacgatatgacgatcggcgtcggcgccgggcaaatgaaccgcgtcggctcggcgaaaatcgcaattgagcaagccggggagaaagcaaaaggaagcgcgctcggatcagatgccttctttccgatgcctgatacggtcgaagaagcggctaaagccggtgtgacggcaatcattcagccgggcggctcggttcgtgatgaagattcaattaaaaaagcggatgaatacgggatcgcgatggtgttcaccggaatccgccatttcaaacattaa

SEQ ID NO: 561 - DNA, 1397 bp, Bacillus licheniformis
atgcggcgtatttgggatttgggggcatgaagaagcaccgcaaattacgtactacggccttcacagccttcagcacagaggccaggagggcgccggcatcgtcgcgacagacggcgaaaaaatgtccgcccacaaaggccaggggctgattaccgaagtttttcaaaacggtgagctcaaaaaggtgaaaggaaagggagcgatcggccacgtccgctatgcaacggcgggcggcggcggcttcgaaaacgtccagccgttccttttccattcgcaaaacaacggcagccttgcgcttgcgcacaatggaaacttagtgaacgccactcagctaaaacagcagcttgaaaaccagggcagcatttttcaaacgtcttcagatacggaagtgctcgcccatttaattaaaagaagcggccacttcgagctgaaagatcaaatcaaaaacgctctttctatgctgaaaggcgcttatgctttcctgatcatgacggaaaaggaaatgatcgtggcgcatgatccgaacggactcagaccgctatctgtcgcaatgcttggcgacgcgtacgtcgtcgcttctgaaacgtgcgcatttgatgtggtcggcgcgacatatctgcgcgatgtagaaccgggcgagatgctgatcatcaatgatgaaggcatgaagtcagagcggttctccatcaacatcaaccgttcgatctgcagcatggagtacatttatttctcaagacctgacagcaatattaacggcattaacgtccacagcgcgagaaagaatctcggcaaaaagctcgccgaggaatcaggcattgaagcagatgtggtgacaggcgttcctgactcaagcatttcagcggcgatcggctatgccgaagcgacgggaattccttacgaactcggattgatcaaaaaccgctatgtcggcagaacgttcattcagccgtcacagtcgctcagggagcagggcgtgagaatgaagctgtcagccgtccgcggggtcgttgaaggaaagcgcgtcgtcatggtggacgattcaatcgtgaggggcacgacgagccgcaggattgtgacgatgctgcgcgaagccggagcgacggaagtgcacgtcagaatcagttccccgcctattgcccatccgtgcttttacggaattgacacatcgacgcacgaagaactgatcgcgtcctctcattcagtggaagaaatccgtcaggaaatcggcgccgatacattgtcattcttgagcattgaaggactcctttccgggatcggaagacagtatgaaggtgaaaactgcggccagtgcatggcctgttttacaggaaaatatccgaccgaaatttatcaggatactgttcttcctcacgtgaaagaaatcgttttgacaaaat

SEQ ID NO: 562 - DNA, 1296 bp, Bacillus licheniformis
atgatcgaacgttattcaagaccggaaatggctgcgatttggacagatgaaaacagattccaagcatggcttgaagttgaaatactggcttgtgaagcttgggctgagctcggcgtcattccgaaagaagatgtgaaggttttaagggaaaaagcgtcatttgacatcaaccgcatcttcgaaatcgagcaggacacgcgccatgatgtcgtcgcatttacccgcgccgtatcggaaacgcttggcgaagagaaaaaatgggtgcactacggactgacatcaacagatgtggtcgataccgctctttcttatctattaaaacaggcgaacgagattttgctcaaggacattgagaggtttattgacatcttgaaagaaaaagcaaaggaacataaatatacggtgatgatggggcgcacacacggcgtgcatgcagaaccgacgacattcggcttaaagctcgccctttggtatgaagagatgaagcgcaacctggaacgcttcaagcaagcgaaagaaggcatcgaagtcggtaaaatctcaggcgccgtcggaacgtacgcgaacatcgatccattcgtcgagcagtacgtatgtgagaagctcggcttaaaagctgcgccgatctcaacgcagacgctgcagcgcgaccgccacgccgattacatggctgcactggcgcttgttgcgacaagcatcgagaaattcgccgttgagatccgcggcctccaaaaaagcgaaacacgcgaggtcgaagaatttttcgcaaaaggccaaaaaggttcatctgccatgccgcataaacgcaacccgatcggttcggaaaacatgacgggaatggcgcgcgtcatccgcggctacatgctgaccgcttatgaaaatgtaccgctttggcatgaacgcgacatttcgcattcatcagcagagcgcatcattctgcctgatgcgacgatcgcgctgaattacatgctgaaccgcttcggcaacattgtgaaaaacttgaccgtgttccctgaaaacatgaagcgcaacatggaccgcacactcggattgatctactcccagcgcgtccttctcgctctcattgataccggcatggcgcgcgaagaagcgtatgacaccgttcagccgaaagcaatggaagcatgggagaaacaagtgccgttccgccagcttgtcgaggctgaggaaaaaattacgtcccgactgtctccggaacaaattaacgactgctttgattacaattaccacttgaaaaatgtcgactacatttttgaacgtttaggcttggcatag

SEQ ID NO: 563 - DNA, 1715 bp, Bacillus licheniformis
ttggacaaagagatgttcattcgccggcttggcgccgccagtcatcgcaaaaaagcggaaactgtaattaaaaacggaaaaatcatggatgtttttaatcaggaatggttggagacggacattgccatcacagacggggccatcgtcggcttgggcgaatatgaggggggaaatatcattgacgctgagggacaaatgatcgttcccggctttatcgacggtcatgtccatattgagtcctcgatggtgacgccgcccgaattcgctaaagcggtgattccccacggtgtgacaaccgttgtcaccgatccccacgaaatcgcgaatgtctcaggtgtgaagggtcttgagttcatgttggagcaggctgagatgaccaggctgaacatttattttatgctcccttcttgtgtgcctgcggcaccattcgaaaaatcgggtgcgattttgaacgccgcggatttacatcctttttacagccgcgaagaggtgctcgggcttgcggaagtgatggactatgtggccgttgaagctggagagccggatatggtgcaaaagctcattgatgccgataaagcgggcaagcggatcgacgggcatctggccggcttgtcagccgggtttgtcaatgtctacagagcggcgggcgtgcttacagaccatgaggtcacaacacctgaagaggcgcttgaacgagtgagaagagggatgtacgtcatgctgagagaaggttctgcggcaaagaatacgcgtcatgttttacctgcggtcaacgagaaaaatgtgagacgcttctttttctgtacggatgataagcatctggacgaactggtcgatgaaggaagcattaactaccaggtcaagcttgccattcaagaggggcttgacccgtttctcgcatatcaaatgggcagcctgaatgcagcggaatgcttcgggttaaagacgaagggagcggtcgccccgggttatgacgcagatcttcttttcatcagcgattttgagaacgtgagcattacaaagacgatgattaacggcgtgatctggagcgggacagagcaaagccaatcgacgggcggcaaagcggcatccggtctgcttcaatctgtgcatctgtctgatttacatgagaacgatctgcaaattccgatcgttcaagagaatgaaatcagggttattgacattatccccaatcagctcgaaacaaagctgtccctggccaagccgaaaagcggagctttttttcagccggatctggaaagcgatctgttgaaaattgcagtggttgagcgccatcgcggcgttaaagaaatcggactcggcgtagtcagaggcttcggtttaaaagaaggcgccatcgcgacaaccatttctcatgattcccacaatttaatcgctgtcggtacaaatgatcaagacattttaaaagcgattgaacgcctcggagaaatcggaggaggcctcaccattgccaaaggagggaaggagcttcaatccgtcgcactgccgatcgccggcctcttgtcggacaaaccgcttgagacggtcaacgaaagcttgaaatctctccacgcggcaataacagagacaggattttcaggagcgtttaatccttttctgacgctttcttttttagcgcttccggtcattcccgacattaaaatgacaacggaaggattgtttgatgttaaagcgttcaggcatatcccggttca

SEQ ID NO: 564 - DNA, 1287 bp, Bacillus licheniformis
aagtgttgaatgaagatcaaatcttatcgatcgattaccgaaaacattggggagaacacccggatgtcatccagggaggagaaatgacaggctggccgcgccttttggacggcgatgatctgatccttcattgcatgcagtgcacgaaaagaaggagaaagcggatcgagggccattttccgggggcatcggaaaaaacgctgacgaagatgaagcttttcggcgctgacgccgatcatgaagccatgactggaaaggaagtgctgaagcggcttgaacttggttaccacgtcggcttgaggcagtcttccatccgccctgatttgcgaaaaattttgcgcgagctgcacgaagaaggctttcaccattatgaccatatgttttatacaacggacggcgcaacgccgaacttttataaagaaggcatgacaaacaagctgattgaaatcgccatcgaagagggcgtgccgctgatcgacgcctataatatggcttcgtttaatatcgcgaagtattaccatatggaggacatccttggggtggttgcaccgggcagatacgcgacgctcaacattttgaatagccctgatgaaccgaatccggagacggttttggcaaaaggtcggctgatcaaatcaggcggcataaatatgaatgcgttttcagttccggattggcaaaaagggggtcttgtccctctgaacctttcatatgatctaacgatggatgatttgcagttttccatgccgctcggcttgaaaatgaggaattccgtcattatggagccttatacgattgagattgacaactctgtgaaccagctttcttttgatcatgatgaaagctatctctcgctgttcgacaaatacggaaagtggcgtgtcaatacgatgctgaaaggctttgcaacccgcatccaaggtttcgtcagctcctattcgacaacgggagacattatcgcgatcggcaaaaacaaggaagacatgcttttggccttcaaacggatgaaagaaatcggaggaggtatcgtattagcggaaaacggaaaaattctgcacgaaattcctcttcatttaagcggcggcgcatcaattgagacgtatgaaaaggtgcttgaaagggaaaaagcgttaaaagagcttctgtttgaaagaggctatacgttcgacgacccgatctacaccctgctctttttgcaaagcacccatctgccttatatcagggtgacgccgaaagggatctttgatgtgatgaaaaaaactgtactctttccatcgataatgcgtt

SEQ ID NO: 565 - DNA, 1265 bp, Bacillus licheniformis
gtgaacgtattgattatcggcagaggcggcagggagcacacgctcgcctggaaagcggcgcaaagccctcttgtcggcactgtatatgcggcgcccggcaatgacggaatggccgggaccgccgtactcgttgatcttgacgaaggcaatcacgaagggcttctcgctttcgcaaaggaaaacaatatcggactgacgatcgtcggtcctgaggtccctttaatcgaagggcttgttgatgcatttgaagaagcgggccttccggtgtttggaccgtcgaaaaatgcagctgtgattgaaggaagcaagcagtttgccaaggatcttatgaaaaaataccagattccgacagcagaatacgaaacgtttacatcttttgaaaacgcaaaggcgtatgttgaggaaaaaggcgctccaatcgttattaaagccgacgggcttgccgccggaaaaggcgtcacagtcgcgatgacagccgaagaagcggttcagtgtctgcatgactttttagaagatgaaaagttcggcgaagcaagcgcatctgtcgtcatcgaggaatttttgagcggtgaagaattttcgctgatggcttttgtcaaaggtgagaaagtgtatccgatggtgattgcacaggatcacaagcgggcatttgacggagacaagggcccgaatacagggggaatgggcgcgtattctccggtgccgcagatttcggatgcggtcgtcgaagacgccgttaaaacgattttggagccggcggccgaagcgatggttaaagaaggccgttcgtttacgggagtcttgtatgccgggttaatgctgaccgaaaaaggaacaaaagtgatcgaattcaacgcgagattcggggatcccgaaacccaggtcgtcctgccgcgtcttgaatcagaccttgtccaggtcttggttgatctcctcgcagacagagaagtggagctgaagtggaaggatacggcggcagtcaccgttgttcttgcatctgacggctatccggaaagctatgaaaaaggcgcgccgatcggcacgcttgagcctgacatggagcagaccgtcgtctttcacgcaggcacgaaaaaaagcggcgatcagtttgtgacgaacggcggccgcgtcgccaatgtcaccgcgtttgcagagacgtttgatgcggcaagggaagcagcctatcaagcggtggatcgagtaagaaaaccggggctgttttaccggatggacatcggctcgcgtgcgctcaaggcagcacagaa

SEQ ID NO: 566 - DNA, 1285 bp, Bacillus licheniformis
atgtcttatttaattaaaaacggcttcatgctcgacgaaaaaggcgaaaaagtacagcgcgatatcagggttgaaggcgatgcaatcagcgagatcggaagccttgaggccgcttcgggggaaacggtcatcgatgcggatggacttttcgtctcgccagggcttgttgaccttcacgttcacttcagagagccgggcggcgagaagaaagaaacgatcgaaacaggtgcaaaagccgcagcgagaggcgggtttacaactgtcgccgcaatgccgaatacccggcctgtccccgatacgaaagagcagatggagtggcttgtcaaccgcattgacgaaacggcatcagtgagagtgctgccgtatgcttcaatcaccatcaggcaaacaggtcgggaaatgaccgatttcgaagggctgaaagacgccggcgcgttcgcgtttaccgatgacggcgtcggcgttcaaacggcggggatgatgtatgaagcgatgaaaaaagcggcttcgattaataaagcgatcgtcgctcactgtgaagacaattcactgatctacggcggcagtgtacacgatggggaatttgccaaagccaacggtttaaacgggattccttcggtgtgcgaagcggttcacatcgcaagggatgtgcttcttgccgaagcggcaggctgccattaccacgtctgtcatatcagcacgaaggaatcggtcagggtcgtccgcgacgccaaaaaagcgggaatccgcgtgacggcggaagtgacgccgcaccatctgctcctttcagacagcgacattcccggccttgatacgaattataaaatgaatccgccgcttagaagtccggaagacagggaagcgctccttgaggggcttagagacggaacaattgattttatcgcaacggatcatgccccgcatacagaagaagaaaaacaacagacaatgagccttgcgccttttggaattgtcggcttggagacggcttttccgctcctttacacgcactttgtcaaaacaggcaaatggacgctgaaacagctgcacgattatatgacggtcaaaccttgcgaggcgttcgggctgccgtacgggaagcttgaagccggacggtccgcggatattacgctcattgatcttgaacgcgaagaaaaaattgataaaagcacctttctttctaaagggaaaaacacgccgtttgacggcatcagctgcttcggctggccggctatgacaatggcaaagggaaaactcgtttaccaagaggggagacttgtaaaat

SEQ ID NO: 567 - DNA, 1182 bp, Bacillus licheniformis
atgaaatatctcatcgggctcattggtttatttgtcgtcttagggcttgcatggctggtcagcagcggaaagaaaagagtgaaataccgcccggttatcgtcatgatcgtgctgcaattcgcattgggatatatattgctgaacacgggtgtcggaaactatctcgtcggcggttttgccaagggcttcggctatttgcttgaatatgcggcagaaggtgtgaattttgtctttggcggactggtgaatgtgaatgaatccacattcttcatcagcgtacttctaccgattgtttttatatctgctttaatcggtattctgcaatattggagaatccttccgtttattataaaatatattggtcttgcgctcagcaaaatcaacgggatgggcaaactggagtcatacaatgccgtggcttcggcgatactggggcaatctgaagtattcatttcgttaaaaaagcagcttggcctgctgcctaaacacagactttatacgctgtgcgcttcggcgatgtcgaccgtctcgatgtctatcgtcggcgcctatatgacgatgctgaagcccgaatacgttgtcaccgcgctcgtattgaacttattcggcggatttattatcgcttcgattatcaatccttatgaagtcgatcgagaacatgatatggtagaggtacaggaagaggaaaaacaatccttctttgaaatgctgggcgaatatattatggacggctttaaagtcgccgtcgtcgtggccgccatgctgatcggatttgtcgcgatcatcgcaatgattaacggcattttcagcgccgcactaggtatatcattccaggaactgctcggatttatttttgcgccgtttgccttcctgatgggtattccatggcatgaagcggtgaatgctggaagtatcatggcaaccaaaatggtctcaaatgaatttgtcgcgatgcagtctctcgcacaaggcagcttccatttcagcggccgcaccgaagcgattgtttccgtcttcctcgtctcatttgccaatttctcatcgatcggtattatcgccggtgcggttaaaggactgaatgagaaacaaggaaacgtcgtcgcgcgcttcgggttgaaattgctgtacggcgcaacgctcgtcagtttcttgacagcgaccgttgtaggattgatctattga

SEQ ID NO: 568 - DNA, 1305 bp, Bacillus licheniformis
atgagtcagcaaaaagtgaaccttggtgtcagagaagtaccaaaacctttgaattggatatctttcagcctgcagcatctgtttgccatgttcggagcgacgatccttgtgccgaagcttgtaggcttaagcccgggcgtggccctcattacaagcgggcttggaacgcttgcgtatctcttgattacaaaaggacagatcccggcttacttaggttcatcctttgcatttattgccccgattatcgcggcaaaagccgccggaggccctggcgcggccatgatcggcgcatttatggcaggcatcgcctacgggctgatcgcccttctcatccagcagcttggaacggactggctgatgaggcttctgccgcctgttgtcgtcggtccggtcattatcgtcatcggactcgggctggcaagcacggctgtcaatatggccatgtatgaagattcgggagcaaaagtgctcgtctacagcgccaagcattttggcgtcgcaggattcacactcgcgctcaccataatctgcgcgattttcttgagaggatttttcagcctgattcctgtcttgatcggaattatcggcggatacttgttcgccctgacccagggaatcgtcgacttccagatggttcttgacgccaaatggtttgctgttccggacttcgtgcttccgtttgtcgactatacgccgagcgcggcggctgtcggaatcggaatcgccatggtgcccgtcgctttcgtgacaatgtcagaacatatcggacaccaaatggtattaagcaaggtcgtcggccaggattttattaagaagcccgggcttcaccgctcgattttcggcgacagcgtcgcaacgatgcttgcatcatgcatcggcggacccccgacaacgacttacggagaaaacatcggcgtactcgccatcacaagagtattcagcgtatttgtcatcggcggagcggctgtcattgcactgtgcttcggatttatcggcaaaatttcggccctgatcagctctgtcccttccgcagtcatgggaggcgtttccttcctgctgttcggtatcatcgcatccagcggactgcgcatgctgatcgataataaaattgacttggaaaacaagcgaaacctgatcatctcatccgtcattctcgtcatcggagtgggcggcgcatttatcaagatctcagggtttgagctgtcaagcatggcgcttgcggcgatcgtcggagtggttttaaaccttgtcctgcctgaatcaaagggagatcaggacggaattgaaatagaagagcatatttaa

SEQ ID NO: 569 - DNA, 1133 bp, Bacillus licheniformis
aacaaacgatttttccgggagcgacaatcggcattatcggaggcggacagctgggcaaaatgatggccgtcgcggccaaacaaatgggctataaaatcgcggtggttgatcctgttccttcatcaccgtgcggccaggtcgccgaccttgagattacggctagctataatgacggggaagcgatacggaagcttgccgaagcgagcgacgtgatcacttacgaattcgagaacatcgattatgacgcgctgaactggctgaaggagcacgcttaccttccgcaggggagcgagcttttgctccttacgcaaaacagggagaccgagaaaaaagcgattgcatcagcgggctgtaaagtcgcgccgtaccggatcattcacgaccgggcggaattggaagcgtccgtagcggagctcggtcttccggcggtgctgaaaacttgccgcggcgggtatgacggaaaagggcagcacgtcctgaaagaacaagcacaaatcggggaagccgcagctcttttacagcacggcacatgcattttggaaagctgggttcctttcaaaatggaattgtccgtgatcgtgacaagatcggttcacggagagacaaccgtctttccggcggcagaaaacatccataaacaaaatattttattccagagcatcgtcccggcccgggtcgatgaggcgattcaggaacaagcggcagcacttgccctcaggcttgccgaaaagcttcagcttgtcggaacactggccgttgagcttttcctgaaggaagacggcggccttctcgtcaatgaactggcgccgcggccgcataattccggccattacacccttgatctttgcgaaacgagccagtttgaacagcatattcgtgcggtctgcgggctgccgctcggtaaaacggatcttctgaaggaagggatgatggtgaaccttctcggggacgaagtgtacatggctgaagaagatcccgaacttttaaaagaagcgaagctttatatatacggaaagcatgaagtcaaaccaggccgcaaaatggggcacatcacatttttaagaacacccgacaatgaatggatcgggcagatgacagaaaagtggattgaaagagatggaggacgaaaacaa

SEQ ID NO: 570 - DNA, 2985 bp, Bacillus licheniformis
atgtctgtttcggtcacggggaaaatcacgacatacaaaggcttgacagaaatcgtacccgcaccgtcaggcattgaagtaaccggagaaggggcggcactgcccgaccctgttccgctgactattaaagatgtgctcgatcagggaaccgcagctgaatacgaaggccggcttgtgaggatgaaaggctttattgaaacaaagccggatgcgccggcaggcggcggctataatatcacaatgatcgatgaaaactatcatccgctcacactaagggtgatggaacaaacgaatgccgccgcttcgatagaacaaggacaatggtacgagattaccggcatattaagccgctatgattcggtgcagcttctgccgagaaaacaggaggatcttcggaaattagacggcgccgcgcatcctccccccgctgctgaaggggaatacgaaagcgttgtggaacgagtcgtcgacggggatacgatccacttaaaagagcctgttctcggatctacaaaagtccgctatgtcaacatagatacagccgaaacttatcataagccgaaaaatgaattagatgaaaaccagctgcagcacggaaacaaggcgaaggaatatttgcagtcgatattggccccgggagacaaagtcaccgtgaaagtgggcaaggaagcaaaagacagctacggccgcctgcttgcccaagtcatcactgaagacggcgtcaatacgaatttgcagcttgtccaaaaggggatggctgtaacctacttcatttggccggttggaagtgatgaagactatcaattgtttcaaaacgccgtcaaaaaggcgaaaggcgataaaatcggcatttggaatcccgctgatccgctcctcgaaatgccgtttgaatttcgcgacagggagcaaggcaaagggctgacgcggcatgtcggagactctgcggaaaatacgtatgtcgcgcctgaaaagtggcgggagattccggtggaaagacgaattttctttgcgtcggctgaagaagcggaagctgcgggctattcgaaaaaagagcaaagcggcaatattccgctgcgcctgttaagcatgaatgatctgcacggaaagatcgatcagcaatatcagctcgatctaaacggcgatggccggacggatggaacattcggcaggatggattatgcagcatcattgatcaaagagaaaaaagccgagcaggaaaacacgctgatcgtccacgcaggcgatatgatcggaggaagctcgccggtttcttccctgcttcaggacgagccgacagttgaagtcatggaggaaatcggatttgatgtaggaaccgtcgggaaccatgagtttgatgaagggaccgaagagctgctgcgcatgttgaacggaggcgaacaccctgaaggcaaagggacaaaaggttacgacggacaggatttcccgcttgtctgcgccaattgcaagttgaaggcaagcggggacagctttcttcctccatatgaaattattgaagttgaaggagtgcctgtcgcttttatcggcgttgtgacacaggcggccgccaatatggtcatgccagaaggaattcgctcaattgaatttacagatgaagcaaaggccgtcaaccaggctgcaaaagaactgagagcgaaaggtatccgggcaatagcggtgctcgcccatatgacagcttcacaggacggcggggttgtgaccggcgaatcagccgaacttgctaaaaaagcagatcccgagatcgatgtcatctttgccggccacaatcatgaagtggtcaacggccaagtcaatgatattttaatcgttcaagcatacgaatacgggaaggcaatcggtgtcgtcgatcttgaaatcgaccgggaaacgaaagacatcgttcacaagaaagcggaaatcgaatatgtgaatcaggaaaatctcaagcccgatccggcggtcggtcagatactggataaatatgagcggatggttgcgccgatcatcagcgagaaagtcggtgaggctgcgcacgatatggccggcggctattcaaatgacggagacacccctctcgggaatctgattgctgacggtatgcggcaagcgatgaattcagatttcgcattaatgaacgggggcggcatccgccaagatttaaaaaaaggaacgattacatggggagacttgttcaatatccagcctttcggcaatgtactcgtccggcttgaaattaaaggcagggatttatacgatattatagacgcgcaaatatccccatcttacggcccggattactcgatcagcggcttcgcttatacatgggacccgaaaacaaataaaaccgcggctatttttcttgaagacggaacaccgattgatttagaccaaacatatacgctgaccgtaaacaactttatggcatctgcttcaggaagcaagtatttgccgatttccaggcttggaaaaaatccggtcacaggtccggaagatatcgaagccacagtcaaatttgtcaaaagctttaaagaaccgatcgcttatactgccgaagggcgaatcaaaaaattagcagaagatgattcgcgtccgggagaacagcccggacgcggggctgatccagatgacaaagaaaaacccggaagcggaggcgctgatccgaatgacgaagaaaaaccgtctggtgataagggcgatggggggaaacccggcaatgacaccggagaaagtccggttcatgacggtaccggcaatgcttcaaggagcggcgctattcctgttgcgggcatgacgaccggtgaaggatcagatgcgcctgcggagaagatggacggtctgtcaaatgatgcgtttctgccagacgagcgtgaagagcgcaagctacccgatacggcggcagcttacggcggtttccttttatacggcttcctgacgtttatgttcggagcgattctttatatgcggaaaaggggtattgcgagactatga

SEQ ID NO: 571 - DNA, 1029 bp, Bacillus licheniformis
  misc_feature (1)...(1029): n = A,T,C or G
ggccatcaacttgatngcttcctccttttcgtggctgatcgcttgngcaagcgacggcatcgcttttgcttttccgtccgtgatgggcaatgaaaccgttgactttttctcaggcgccttgctgccgattatttttgttgtgacattttttgatatactggcttatttgggaattttaacatggatgattgataagatcggctgggtaatttcgaaagtctcacgccttcctaaattagaaagtttcttttcgattcaaatgatgtttctgggcaatactgaagcgctcgccgtcattcgcgggcaattggctgtattaaaggataaccgcctgctgacgttcggcattatgagcatgagcagcatcagcggatcgattctcggttcttatttaacgatggttcctgcgacatacgtatttaccgccatcccgctaaactgcttaaatgcgttgatcttggccagcattttaaacccggtggaagtcactaaggatgaagacattatttacgtaccgccaaaagaagagaaaaaggactttttctcaacgatttcaaacagcatgatggtcggaatgaatatggtcatcgtcattctcgccatggtcatcggatatgtcgctttaacctcatgtttgaacggtattttgggcttgatcgtagacggtttgacgattcaaaagatcttttcttatatcttcagtccgttcgcattcctgcttggactggcgccgggcgacgcgatgtatgttgcacagctgatgggcatgaaactcgccacaaacgaattcgtcgcgatgatggatttaaaaacgcagctagacgcgatttcaccccatacagccgccgtggccacaacatttttgacgtcgtttgccaacttcagtacgatcgggatgatctatggaacgtacaattccttatttaacggagaaaaatcggcgattatcggaagaaatgtgtggaagctcctcgtcagcggaatagcagtgtcgctgttgagcgcggggattgtcgggctgtttgtttg

SEQ ID NO: 572 - DNA, 939 bp, Bacillus licheniformis
atgatgcttgaaatcaatttgccgggccttcaattgaaaaatccgatcatgccggcctcaggctgcttcggattcgggagagaatttgcgaacttttacgatctttcgcgtctcggtgcgatcatgattaaagcgacgacgagcgagccgcgcttcgggaatccgacgccgcgcgtcgccgagacgcaagccggcatgcttaatgccatcggcctgcaaaatccgggtttaaaggctgtcatggaacgcgaattgccgtggctcgaacagttcgatacaccgattatcgccaatgtcgccggctcgcagatcgaggattatgttgaggtggctgaagaaatcagcaaagcgccaaacgttcatgcgctcgagctgaatatttcctgtcccaatgtgaaaaccggaggcatcgccttcggcacgcagccggaaatggccggcgagctgacgaaagcggtgaaagaggttgcgagcgtccccgtctatgtgaagctgtcgccgaacgtcgcgaacattaccgacatcgctcttgccatagaagaagcgggagcggacggtttgacgatgatcaacacgctgatcgggatgcggctcgacttaaaaacgggaaagccgattttggcgaacaaaaccggcggattatcaggacctgccgttaaaccggtggccatcagaatggtgcatgaagtcagccaaaaggtcagcattccgatcatcggcatgggcggcgtccagtcagccgaagatgtgcttgagtttttgctggcgggtgcgagcgcagtcgccgtcggcacggcaaacttcgttaatccgtttgcttgtcccgacatcatcgacgatttgccgcgcgttttagaaaaatacggataccgttcgttgaacgagtgtatcggaaggagctggaaggatgaacaatacgccgcccatcatcgcgcttga

SEQ ID NO: 573 - DNA, 1159 bp, Bacillus licheniformis
ttgaaactgctttttggggctttacaatggacggcatttattattgcgtccgcaatcgtggtgcccattgcaatcgggcagtcattcgggctgaaccagggagagaccgcggggttggttcaaagcacttttttcgtgctcggcacaacggcttttatccaatgtttattgggacaccgcctgccgattaatgagagtccggctggcctctggtggggcgtctacacgatttatgccggtcttacagggaccgtattcgcgactcacatcgaaacgctccaggggctgcagggagcgatgctgctaagcgcggttttcttctttatttttagtttatttaaagtcattgataagctggctgtgatgtttactcctgttgtgacaggcatttatttactgctgctggtcatccagcttagcgatccgatcgttaaaggtgtcatggggatcggctaccggaaaaacgaggtcgatatacccgtgtttttgctggcggttgtgattatgctggctacgtttctgatgagccggtcaaacgttccgattctcaagcaatattcaattttaattgcgcttttcggcggctggatcttatttgccgtattcggcgtggcgaaggcgcccgagcgtgcgaaccagctgttccaccttccggatatttttcctttcggcatgccgatgtttgacagcgggctggttgttacttcgttgttcattacagttttgttaatcgtcaatatgctcgcaagcatacgggtggttgaaggagcagtcaaacagtttgagaagctggaagagaggaagcgggcccgtccggccgggtttatcgcctctgtcagccatttgctgagcggactgctcggagctgtagggaccgtgccgatatccggagctgcagggtttattcaaacgacgaggatgtcttccaaaaaaccgtttttgctcgggagtctgatcgtaatcgtcatcagcttcttcccgctggtcatgaatacttttgccagcctgccgtctccggtcggttttgcggtgaacttcgtcgtgttttcaacgatggtcggcctggcatttgccgaattcgattcttatgaaaaggacgaggccggccgcatccgctttgttaccgggattgcgctccttgccggtgtgggggtgcttg

SEQ ID NO: 574 - DNA, 1360 bp, Bacillus licheniformis
atgaattttgattcaattatcaaaaatggattagtcattctagaaaatggtgaacaagaagtcgaagtagggatcaaagatggcaaaatcgcagcaatcggtcaggatttgggtacaagtgcaaaaattatcgatgcaaaaggatctattgtatctccaggtatgattgatgcacatgtgcatatcacagagccgggcggcggctatcgtgatgaatgggagggctatgacacaggaacacgtgccgctgcaaaaggcggtgtaacgacgtttattgaaatgccattaaatcaagtgccagcaacggtagatgaggaatctattcaagaaaaatttaaagccggaaaaggaaaattatcagtagacgttgcgagttacggcggtttagtaccatttgacttagatgggggtattcaagaattagatagcaatggtgttgttgcatataaatgttttttagcaacatgtggcgaccgttctatagaaggagatttcatgaacgtagatgactattccctctacgaaggcatgaaacaaattgcgaagacaggcaaaatattatctatacacgctgaaaatgccgcaattaccgataagttaggggaaatagcatctaaaaatggggaaacttcattgcgtgcttatgtagattctcgacccgtatttactgaagtagaaccgattagaaaaattattctatttgcgaaagaaacgggatgtcgtgtacacatcgttcatatagcttgtgaagagggcgtagacgaaattgtcaaagcacaacaggaaggggtcgatattacatgcgaaacatgtacacactatttatatttctataaagaagaactagatcatatcggaccggttgtaaaatgctctccgccaatccgtgagcaatcacgcttagaaggcatgtggaatcgggtattaaacggagatatttcattcgtaacatcagaccattcaccatgtaccccggacttaaaagctacggataatgcatttgaagcttggggaggtatcgcaggtttacaaaataatgtcgatgtattatttgatgaaggtgtgcaaaaacgtaatatgccattatccaaatttgcagccattattgctacaaaccctgcgaaacgttttaatctcgcatcaaaaggcagtattgcagtagggaaagatgcggatttcgtatttattaagaaagatgcaccttatgaattaaaggctgaggacttagcatatcgacacaaaattagtccgtatattggccgcaaaattggtgctcaggtagtgaaaacaatccttcgcggtgtcgaaatctatgataaagaaaaaggaatttcaaatgaaaaagtaggaagatttattc

SEQ ID NO: 575 - DNA, 903 bp, Bacillus licheniformis
atgaacgcatatatgaaacagcagttatcgcaatatcaggaaatcaataacgataaggcccgccttctggtcagctgtccggatcagcctggaatcgtcgccgccgtttcttcatttttatttgagaacggtgcgaatattattgaatcgaaccagtatacgacagaccctgaaggaggccggttctttctgcggattgagtttgaagttcaaggcatccgcgaaaagatcgaacagatgaaagcggcattcgcctctgtggcggagtccttccaaatgacgtggagcatgaatttggcgagcgaactgaaacgcgtcgctatcttcgtttcaaaagagcttcactgcctgcatgaactgctatgggaatggcagagcggcaatttgatggcggagattgcagcggttatcagcaatcatgaagatgcaagagaaactgttgaatccctgaatattccgttcctttacatgaaagcgaacaaagacattcgtcaggaagtggaaaaacagcagctgaaatggcttgaagagtatcgtgcggatgtcatcgttctcgcccgatatatgcagattttaacgcctgattttgtctcggctcatccgaacaaaatcataaatattcaccactccttcctgccggcttttatcggggcgaatccgtataaacgggcatatgaaagaggcgttaaactgatcggagcaacatcgcattatgtgacaaacgaattggatgaagggccgatcatcgaacaggatatcgaacgggtcgaccacagagacaatgtggaagcattgaaaaacatcggccgaacgattgagagaagcgttttggcaagagcggtcaaatggcacttggaagaccggattatcgtgcatggaaacaagacgatcgtctttaattaa

SEQ ID NO: 576 - DNA, 882 bp, Bacillus licheniformis
agatgcggatacgctctactccattcctctcgaccttcaaaaacaaggcctggacagcctggtttgcagccacttgaagctggattgcagagaagccgatatggaagagtggaaagaactcgtcaaaaaggtgaaaaatctgtccaaaacggtaacaatcgctttggtcggtaaatacgttgagctcccggatgcttacatttcagttgtagaatcgcttcgccatgcgggttatgcgtttgatgcagacattcaagttaaatggatcaatgcggaagaagtgacggaagacaacgttgccgatcttgttcaaaatgcggacggtattcttgttccgggcggattcggagaccgcggtgttgaagggaaaatcacgacagtcaaatatgcccgcgaacaaaagattccgttcttcggcatttgcctcggaatgcaggtggcatcgattgaatacgcgagaaacgtgctcggccttgaaggagcgcactcagccgaaatcgatccgtctacaccgtatccgattatcgaccttctccctgaacaaaaggacattgaagacctcggcggaacactgcgcctcggactttatccgtgcaagcttcaagaaggatcgaaagcatatcaggcatatgaaaatgaagtggtgtatgaacgccaccgccaccgctacgaattcaacaatgagttcagacagcagatggaagaagccggttttgtattttccgggacaagccctgacggccgtctcgtagaaattatcgagcttaaagaccatccatggtttgtcgcgtctcagttccatcctgaatttacgtcaagaccgacaagacctcaggctctgttcagagacttcgtacatgcttcgctaaagacttcggaaaa

SEQ ID NO: 577 - DNA, 1062 bp, Bacillus licheniformis
agaagagcttgttacggcttcctgttggtacaaccctggatgaagcataaaaaattcttcataatacaagatcgaaaaactccctcttttagatgatcaaggtgttttaaaagggctaagttacgattaaagacattgaaaaagtaatctaattcccgaattcaacgaaagatgttcactgccgcctattggttggagcagcggctggtgtaacaggcgacacaatgacacgcgttcacaaatgcttgtggcaagcacaatgtcagatgtgtatcgttccttagataccagggcacggccattcacaaggagtattggataccgttaagaaaatccgcgacacttatcctgaattaaatatcattgccggtaacgtcgcaactgccgaatgaacaaaagcgcttatcgaagctggagcaaatgtagttaaagtcggtatcggaccggggtcaatttgtacaacccgcgtagtagccggtgtcggtgttccgcaagtgacagcgatttacgattgtgcgactgaagcaagaaaacacggcgctgcgattattgcagacggcggcatcaagtattccggagatattgtcaaagccttggctgccggcggtcatgccgtcatgctaggaagccttcttgccggaacatctgaaagcccgggcgagactgaaatctatcaaggcagacgctttaaagtttatcgcggcatgggttctgtagctgcgatggaaaaaggaagcaaagaccgctacttccaagaggaaaacaaaaaattcgttcctgaaggcattgaaggccgtacgccttataaaggccctgttgctgataccgtttatcagcttgtcggcggcttgaaatccggcatgggctactgcggaacgaaagatttgcacgcattgagggaagatgcgcagttcatccgcatgacaggagcaggcctgcgggaaagccatcctcacgatgtgcaaattaccaaagaatcgcctaactataccatttcctaatcaaatatgacaaaaattaaaccgtagacagagtgatactctgtctatttttttttgcttc

SEQ ID NO: 578 - DNA, 867 bp, Bacillus licheniformis
attgaaaaaaggactggtgatcacaatgagaatggttgatatcatcacaaaaaaacaaaatggagaagaattgacaacagaagaaattcaatttttcattaaaggctacaccgacggcagcattcctgactatcaagcgagcgctctggcgatggccatctattttcaggacatgacggacagagagcgggccgatctcacgatggcgatggtcaactcaggcgaaacgatcgacctttccgcgattgaaggtatcaaggtcgacaaacactcaacaggaggcgtcggcgacacgacgacgctcgtacttgcaccgcttgtcgcggctctcgacgtacccgtcgccaaaatgtcgggacgcggcctcggacacacagggggaacaattgacaagctcgaagcgatcaaagggtttcacgtggaactttccaaagatgaattcatcgagctcgtcaaccgcgacaaggtcgccgttatcggccaaagcggaaacttgacgcctgctgacaaaaaactgtacgcccttcgcgatgtgacaggcacggtcaattcgatcccgctgattgccagctcgatcatgagcaagaaaatcgccgcaggggcggatgcgattgtccttgacgtcaaaacgggcgccggcgcatttatgaaaaccgatgaagatgcagtcaaccttgcaaaagcaatggtccgcatcggaaacaatgtcggccgccaaacgatggccgtcatctccgacatgtcccagccgctggggtttgccatcggaaatgcgcttgaagtgaaagaggcgattgatacattaaaaggcgaaggtcctgaagacttgactgagcttgtcttaacattgggcagccaaatggtcgt

SEQ ID NO: 579 - DNA, 752 bp, Bacillus licheniformis
atgttaaaaatcgcagatcgtcaattttcatcaagattattgctcggtacagggaagtatccgtcatttgagattcaaaaagaggccgtcagcgcatctgaatcggagatcctgacgtttgccgtcagacggatgaatatttttgaagaatctcagcctaattttttggagcagctcgatttaagccgttatacgcttttgccgaatacggcaggagcaaaaacggctgaggaagccgtccggatcgccaagcttgccaaagcaagcggtctttgcgacatgatcaaagtcgaagtgatcggctgtgaccgttcgcttctgccggacccggtagaaacgctgaaggcgtcagaaaccttgcttgaagaaggcttcattgtactgccgtatacatcggatgatgtcgtcctcgcgagaaaacttgaagagctcggcgtgcacgccattatgcccggggcctctccgatcggttcgggacaaggaatcatcaatccgctcaacctgtcgttcatcattgaacaggctaaggttcccgttatcgtggatgccggaatcggttctccgaaagatgcggcatacgcaatggaactcggtgctgacggggtgcttttgaacacggcagtgagcggggcgaaagatccggtccaaatggcgaaggctatgaagtttgccgttgaagcgggcaggctcggatatcttgccggacgaattccggaaaagaactacggcatcgccagcagccctgaagaagg

SEQ ID NO: 580 - DNA, 752 bp, Bacillus licheniformis; identical to SEQ ID NO: 579

SEQ ID NO: 581 - DNA, 807 bp, Bacillus licheniformis
atgattgcaaatgccgcagactatattaaaagcaaaacggaaatcaaacctgcggtcggcctgatattgggatccggccttggcgtgcttgccgatgagatagaagacgccgtccgcattaaatatgaagacatcccggactttcctgtttccactgttgaagggcatgccggacagcttgtcatcggcagacttgaaaatgtgcaagtcgtcgcgatgcaagggcgttttcatttttacgaagggtattccatggacaaggtaaccttccctgtccgtgtcatgaaagagctggggatcgagactttaatcgtgaccaatgccgcaggcggcgtcaatgaatcgttccgtcccggcgatttgatgatcatatccgatcatatcaattatatgggaacgaacccgctgatcggtccaaacgattcctcgctcggcgtcagattcccggatatgtcgtccgcatatgataaggaactgcgcctcttggcgaaaaaaacagccgaagaattgaacatcagcgtacaagaaggggtttacacagccgttacaggacctacatacgaaacgcctgccgaagtgcggttcctcagaacgatcggatcggatgccgtcggcatgtcgacggttccggaagtcatcgtggcaaaacatgcgggccttcgcgtgctcggcatttcgtgtatatcaaacgcggcagccggaatcctcgatcagccgctctcccatgatgaagtgatcgaagtcaccgaaaaagtaaaagccgacttcttgcggtttgttaaagcggcagtcgccaaaatcggctaa

SEQ ID NO: 582 - DNA, 885 bp, Bacillus licheniformis
acatggccggcggtgaaggcagcagcgatttcggcgagctgtccaatcttgctttagctttttccgttttactagtcatcgtccttttatatcgttttacatcaggatttatcaagtcaatttccattttaatcggcttgatcgcaggaacagccggcgccgctctaatgggaaaagttgattttacagaagtcgcaaacgctggctgggtgcagatgattcatccgttttacttcggcgcccctgtttttgaagttaccccgatcttgacgatgtccctcgtgctgatcgtcagccttgtcgagtccacaggcgtctactttgcattgggcgatttgacggaccgccgcctgacagaaaaggatttaggaaaaggatatcgcgccgaagggattgccgtgctgttgggcggggttttcaacgcctttccttatacggcgtattcgcaaaacgtcggtctcgttcagctgacaggagttaagaaaaacagcgtgatcgcgcttgccggagcttttctcattttgttggggctgtttccgaaagccgctgctttaacgacgatcattcctaaacctgtgctcggcggcgctatggtagcgatgttcggcatggtgatcgcctacgggatcaaaatgctgagcagggttgatttcggcaagcaggagaacttgttgatcgtagcgtgttcaatcggaatcggcctcggcgtgacggttgtaccgcaaatgtttcaaaaccttcctgacgccgtcaagcttttgacagagaacggaattgttgcgggaagctttaccgccattctcttgaatgcgatctttcacattcatccgttttctcgtcatgctgaacagcctgaagcagtttctgctgagaaatctgccgttt

SEQ ID NO: 583 - DNA, 724 bp, Bacillus licheniformis
gtgaatattgtgaaaaatgaacttttatacgaaggaaaagcgaaaaagatttaccggacggatgatgacaacactttgtttgtcgaatacaaaaactcagcgacggcttttaacggagaaaaaaaagccgagattgacggaaaaggccgtttaaataacgaaatttccagcctgattttcacaaggcttcacgagaagggaatcaacaaccactttgttgaacgaatttctgaaacggagcagctcattaaaaaagtgacgatcatcccgcttgaagtcgttgtccgcaatgtcgttgccggaagcatgtccaaaaggctcggcattccggaaggcacggagctggggcagccgattatcgagttttactacaaggatgacgcgctcggtgatccgttgatcacagaagaccatatccggattttaaaagcagctgagcctgaacaggtggagaaaatcaaatcgattacgagacaggtaaacgaagagctgcagacgattttcgcggcttgcgatgtcagattgatagatttcaagcttgagttcgggctcgataaagacggcgaggtcctgctggccgatgagatttccccggatacgtgccggctgtgggatcaagaaacgaatgaaaagcttgataaagatgtgttcagaagaaatctgggcggattgacggatgcatacgaagaaatattcaaaagacttggaggcatgtaatatgtac

SEQ ID NO: 584 - DNA, 930 bp, Bacillus licheniformis
agcccgtttattttaaccatgacggaggcgtcgatgatctcgtctctttatttctgctattgcagatggaaaatgtcaaattgatcggaacatccgtcataccggcggattgctatttggagcctgctctcagtgccagtcgaaaaatcattgaccgcttcggttcgtaccaggtcgagactgcggcatccgattcgagaggggtgcacccgttcccgaaggagtggcgcatgcacgccttttatgtcgacgctctgccgattttaaatgaaaaaggcgaagtccggactccggtgtcagaactgcccgcccaccttcatctgattgaatgcgtgaggcagagccccgaaccggtgacactgctgtttaccggcccgctgacagacttggcgagggcccttgaggaagagccggcgatcataaagcacattgcaaagcttgtctggatgggcggcaccttccttgagaaaggaaatgtggaagagcctgagcacgacgggacggcggaatggaacgctttttgggacccttacagcgtgaagacggtattcgagagcgacattcagatcgaaatggtcgcgcttgaaagcacgaaccaggtgcctttgacaaacgaaatccgctcccattgggcgagcctcagaaagcatatcgggatcgactttatcggccaatgctatgcgatgtgtccgccgcttgtccataacgaaacgaattcgacatactacctttgggatgtgctgacgacgctgacgctcggcacagtcgatatgacacgctcgcgcagcatcaaggcggttgtccatacacaaagcccgcgccaaggaacgacagaagagcatcctgacggcagaatggtcaaagtcgttgatcaagtcgacagggatcaattttttgcgtattttgaagagttgatgaaaagagccgacc

SEQ ID NO: 585 - DNA, 581 bp, Bacillus licheniformis
gtgacgaaaatttacgatgcagcaaactggtcaaagcatgaagatgattttacccaaatgttttacaaccaaaatgtaaagcagttttggcttccggaagagattgcgcttaatggagatcttctgacatggaagtacttgggtaaaaatgaacaggacacatacatgaaggtgctcgcggggctgacgcttctcgatacagagcaggggaacacgggaatgccccttgttgctgagcatgtggaagggcatcagcgcaaagcggtgctgaatttcatggcgatgatggaaaacgcggtccacgccaagtcctattcaaacattttcatgacgctggccccgacagagacgatcaacgaagtctttgaatgggtcaaacaaaacaaatacctgcagaaaaaagctcagatcattgtcgggctctatgaaaaaatccgccagggcgataaaatctcgctgtttaaagcgatggtcgcatccgtttatttagaaagcttcctgttctacagcggcttctactacccgctttatttttacggacagggcaagctgatgcaaagcggcgaaatcatcaacctgat

SEQ ID NO: 586 - DNA, 696 bp, Bacillus licheniformis
atgaaaatcgcagttatcggagcaatggaagaagaagtcacgattttgcgaagcaaactcgaacagacgaaccgggaagtcatcgcaaactgtgaatttaccagcgggttttatgaaggaaaagaggtcgtgcttttaaagtccggcatcggcaaagtcaatgcagccatgagcacgacgattctgcttgaccgctttaaaccggacgttgtcatcaacaccggatcagccggcggctttcatcattcgcttaatgtcggagatatcgtcatctcgaccgaagtccgccatcacgatgtcgatgtcacggcatttgattatgaatatggacaggttccgaatctgccggctgcatacaaagccgacaatgcattgatccaagcggcggaagacgaagcgtctgaactggggcacattcaggttgtcaaaggaacgatagcaacaggcgattcctttatgagcgatcctgaccgcgtcgcattcatccgcggcaagtttgaagacctttacgcggttgaaatggaagctgcggctgtcgcgcaggtttcttatcaatttaatacgccgtttgttgtcatcagggcgctctcagacatcgccggaaaagaatctgaaatttcatttgaccaatttttggaacaggctgccaagcattcgacagatcttgtgcttcgcatgattaaaagaatcaattaa

SEQ ID NO: 587 - DNA, 629 bp, Bacillus licheniformis
atgacgattgcaaatctcattgatcatacagcattgaaaccgcatacacaaaaatccgagattaagaaattaatagaagaagcgaaagcataccaattcgcttcagtctgcgtcaacccgacatgggtcgaatttgccgccgaagagctgaagggaacggaaatcgacgtttgcacggtcatcggttttccgctgggcgccaacacgacagagacaaaagcgtttgaaacaaaagacgctatcgcaaaaggcgcgacagaggtggacatggtcatcaacatcgccgctttaaaagacggaaacgatgactttgtcgaggccgacatccgcgcggtcgttgaagccgcaaaaggtaaagcgcttgttaaagtcatcattgaaacgtgtctgttgacagacgaagaaaaagagcgcgcctgccgcctggctgttgctgccggtgccgactttgtcaaaacctcaaccgggttctcaaccggcggagcgacagcggaagatatcgccctgatgcggaaaaccgtcggacctgacatcggtgtcaaagcatccggagggattcgtacaaaagaggacgttgaaaccatgatctcaaacggcgcgacccggatcggtgcaagcgcaggcgtttc

SEQ ID NO: 588 - DNA, 1776 bp, Bacillus licheniformis
atgaacaaacactatatatgctactttttaggagagattaggatgacaacaggctttaaagaacagggattattgcaattgacagaaacatttcatgatatcgtcgggtatggaaatcacgatattatgcaggaaaatgccaacgtagacggccgctccccgatggggcaaatgagccggtttgcatccgagagttccagacattatgcgctccattacttaatgtcgccggaaatcaagaaagcagtcgatgacaactttatataccctcacgatttagactatatgccgagcgggacaacgacttgctgtcagataccattggtccggctgttaaaggagggattccacactggccacggctccctcagggaaccgaaggacattatgagcgcattgtcactcgcatctatcatttttcaatcgaatcaaaatatgcagcatggcggccagtcattcccaatgttcgattacgatctggcgccttacgtccgcaaaacgtacgaaaagcatcttgcgaaaatcaaacaatacccgacaactttgacagaagaagagataagggaaagagcgtgggaagaaacggacaacacaacttaccaagcgtgcgaagcatttatacataacgccaacagcatgcattcgaggggcggcggacaggtgccgtttgtttccattaattacggcacggatacgtcaagggaaggccgccttttgatcaaaaatattcttaaggcgacaaaagcaggcctcggcaaaggtgagacgccgatttttccgattcagatcttcaaaatgaaagaaggcgtgaacgttgatcaaacagaccctaactatgacttgtaccggcttgcattggaaacgagcgctgaaaggctgtttccgaacttcagctttatcgactcgcccgtgaacaaacctttttatgacggaacgccggaaagcgaaatcgcttatatgggatgcagaacgcgcgtcatgtccaatattcatggaaaagaaaacagcgtcggcagagggaatttgtcattcacctcgatcaacattgtgaaaatagcgctgctcagcgaaaacgttgaacagttttttgccttgttaaaccgctacatggatttaacgattcaacagctgcttgaacggtacgcctttcaatgcaagaaaagagcaaaggactttaaattcctgtattcacaaggcatctggcatgaaagcgagaagcttgaacctgaggacacgctcgaggatgtgctaaagcacggaacattgagcatcggatttatcgggctggctgaagctttgactgcattgaccggaaaacatcacggagaaagcgaggagtcgtttgaactcggcaaaaaaatcgtccagtcgatgagagataaggccgatgaagccacagaaaaacacaaattgaacttttccttgatcgctacgccggcagaagggctttcagggaaatttgtcaaaaaagacaaagtggagttcggttcgatccgcaatgtcacagaccgggtgtactatacgaattcgtttcacatccctgttcactataagctgactgcggtcgaaaagatcagaaaagaagcgccgttccacttaatgtgcaatggagggcacatcagctacatcgagctggacggagacccgaaaaaaaacattaaagcgatggacatgcttgtgaccgccatgcgccggtcaggcatgggctacgcctcgatcaaccatcctgtcgaccactgcaaggcgtgcggatttaccggaatcagtggctgtttc

SEQ ID NO: 589 - DNA, 617 bp, Bacillus licheniformis
gtaaagggacacaggctgaacggattgttgaagattttgggatacctcatatctcaacaggagacatgttccgcgctgcgatgaaagaagaaacggatctgggactcgaagccaaatcatacattgataaaggtgagcttgttccggatgaagtgacaattggtattgtcagggagagacttggcaagaatgattgtgacggaggttttcttctggacggatttccgagaacagtcgctcaagctgaagcacttgaggaaattcttaaaggacttggcaagtcgattgaccatgtcatcaacattcaagtcgataaagatgcattgatggaacgtctgacaggacgcagaatctgcaaaaactgcggtgcaacttatcatttagtctttaatccgcctgcaaaagaaaatgtatgcgacaagtgtggaggagagctttatcagcgtgaagacgataatgaagctaccgtatccacgcggttagaggtcaacatgaagcaaacccagcctttactcgatttctatgaagataaaggatatctcgtaaacattgacgggcagaagcacatcaatgaagtttacgctgatataaaggagcttctcggaggccgggacaaa

SEQ ID NO: 590 - DNA, 674 bp, Bacillus licheniformis
atggaaaagaaattatgcattgcaatagacggccctgcggcagccggaaaaagcaccgtggcgaaaatcgtggccagaaaaaagtcgtatatttatattgatacgggtgccatgtacagggcgattacgtatctagcgctggaaaagggcgttgatttaaacgacgaagcggcgctgacggccttgttaaaagaatctgccatcgatctcacggtttcgcctgaaggagagcagaaggtttatatcgcaggcgaagatgtaacagaggcgatccgcacggatagcgtgagcaaccaagtctccatcgtcgccaaatacgccgggatccgcgaagaaatgacgaaaaggcagcagcagctggctgaaaaaggcggagtcgtcatggacggccgcgacatcggaacccacgttctcccgaatgcggaagtgaaaatatttctcttggcgtccgtcgaggagcgggcaaaacgccgctttgaagaaaacgtcaaaaaagggtacaatgtaaattatgaaacgcttgcagaagaaatcaggcgccgtgacaaactcgattcagagcgcgagatttccccgttgaaaaaagcggacgatgcgcttgaaatcgacacgacttcattgacgatcgatgaagtggccgaaaaaattctgcagattgtagacaaaaaggctca

SEQ ID NO: 591 - DNA, 711 bp, Bacillus licheniformis
agccgatcccgtcaaaattgaagagatcgtaaaaggcgtcgcagaaggctgcgtacagtcgggatcagcgcttgtcggcggagaaacggcggaaatggccggggctttatacagaggatgaatacgatatcgccgggttctcggtcggagctgccgaaaaagatggcatcgtcacgggcgaaaatatcagcgaagggcaccttttaatcggactttcttcaagcggccttcacagcaacggcttctctctcgttcggaaagttcttcttgaagatgccggtctgaaccttgatgagacgtatgcaccttttgaacggcctcttggcgaagagcttttagagccgacgaaaatctatgtcaagcctgtccttgaagcggtgaaatcaggcaaaatcgccggcatggcgcacgtgaccggcggcggttttatcgaaaacctgccgcgcatgatgcccgatggcctcggcgttgaaatcgacatcggctcctggcccgttcctcctatcttcccgttcattcaggagaaaggcggcctgaaatccgaggaaatgtttaatgttttcaatatgggaatcggctttgttcttgcggtgaaagaagaggatatgacagacgtgatccaaacgctcgaaaacaacggtgaaaaagcctatctcatcggcagagtgaaagccggaagcggcgttgtgtttggcggtgccggtctttcat

SEQ ID NO: 592 - DNA, 566 bp, Bacillus licheniformis
gtggaacggatttcttgggatcaatattttatggcgcaaagccatttgctggcgcttcgcagcacgtgtacaaggcttgctgtaggagcgacgattgtcagggataaacgaattatagcgggaggctacaacggatcgatcgccggaggcgttcactgtgcggatgaaggctgctatatggtggacgggcactgcattagaacgattcacgccgagatgaacgcgattcttcagtgtgcaaaattcggtgttccgaccgaaggcgctgaaatatatgtcacacattttccgtgcattcaatgctgtaaatcgatcattcaggcaggtattaaaacgatatactatgcgaaggattacaaaaaccatccttacgcggttgaacttttcgatcaggcttctgttaaagtggagcaggtagagctcgatgagatgattatcgacttgaaaaaccaggaaaagttggcgtttgtagccgatctgatcaaacagctggctgataaaggccttgaggaagaggagatcaggaaaatacacgaagaggccaacaaactgtttacaagctacgt

SEQ ID NO: 593 - DNA, 786 bp, Bacillus licheniformis
atcccatttatcagacatagaaatcgcacaaagaacggaattaaaaccgattaccgaaattgcacggaaactcaatataaatgacgaagaaatagagtgttttggttgcacaaaagcgaaaatttctttgaaaatttttgagcgtttgaaagaaaaacccgatggccaggtgattttggtaacctccatcaacccgacaccggccggcgaagggaagtcgactgtcaccgtcggattgagccaggcgctctggcagattggcaaaaaatcgatcgtggcgatgagggagccttcactcggtccgacaatgggcttgaaaggcggggctgccggaggagggtattcccaggttcttccgatggaggacatcaaccttcactttacgggagatatgcatgcgatcacagctgcaaacaacgctttggcggctttcatagacaatcatattcatcagggaaacgaattaaacatcgatatcagaaaaatcgtctggaaaagggcgcttgatctcaatgacagggcgctgcgtgaaaccgttgtcggcctgggcggaaaagcgaacggatttcccagggaagacggctttgacattactgtcgcttcggaaatcatggccgttttatgcctggccagagacttggccgatttaaaaaagcgcctggcttcgatgatcgtcgcctacacagtcgacggacagccggtaacggccggcatgctcggtgtgcagggagcgcttgccctcctgttaaaagatgctatcaaaccaaaccttgttcagactgtgaa

SEQ ID NO: 594 - DNA, 640 bp, Bacillus licheniformis
gtgggagggaaccaaggcatgaaaacagacattgcaaaccatttattaaaaatcaaagcggttttcctgcgcccgaacgaaccgtttacatgggcgagcggcattctgtcgcccatctactgcgacaaccgtttgacgctttcatatccggaagtaagagatgatatcgcttcagggcttgccggactgattcaagacaaatttcccggagccgagatgatcgccggtacagcgaccgcgggaatccctcatgccgcgcttgccgctgacaggctgagcctgccgatgtgctacgtcagaagcaaaccgaaggcgcacggcaaaggaaaccaaattgaaggggccgttgtaaaaggacagaaagtcgttgtgatcgaagatttaatttcaacgggaggaagcgttcttgaagccgccgccgccctcacagaggcgggatgtgaagtgctcggcgtcgccgccattttcacttacgggcttccaaaagccgccgccgccttcagcgaagcaggcgttgaataccacacgctgactgattacgatacgctgaccgaggctgcgcttgccggtggatatattactgaacaggatgccgccaaactgaaagaatggaaagcggatcctgaaagcaagtcttgga

SEQ ID NO: 595 - DNA, 813 bp, Bacillus licheniformis
tgtcatcctctttcacacctggcatttggacgatcagcgcgtcgcggagcttttcccggaaatcgacctgatcctcggctcccacacccatcacttgttgaagaagggatgatgaaagacgggcgttatgctggcctgcgcggaaaagtacgggaactatgtcggtcatgttgaactgacatataacggagcgcttgagaacatcacagcaaccgtcatgaagacggcagattggaatgaagaatcagaggagacgattcgttttctgaaggaaaaagagagagaagccggacatctccttgaagaggaaattgcgacattggacaacacccttgaaaccgcctggttccgcagaagcgcccttccgcaaatgctggcagatgccttaaaggaatggtgtgaggcggaaatcgggatggtcaactcaggcattgtgctggagtctctttcacaaggtccggtgacgaaagccgatgttcaccgcatctgtccgcatccgattaatccggtcaaactgaagctgacgggacgagagctgaaagaggtcatcctccatgcatcatcagaacaaaccgagaagctgcgcattaaagggctcggttttcgcggcgaagtgatggggaagatgctgtatgccggccttgacccggaaaagctctccgtcaacggagcggacattgaagatgatgcgttctacacgctcgccacgattgatatgtttacactcggaacgctgtttcctgttatccgcgatgcggaagatattgactactttatgcctgaattcctgcgcgatctgctcgcctggaagct

SEQ ID NO: 596 - DNA, 489 bp, Bacillus licheniformis
caattgtgccggattacccgaaggaaggcgtacaatttaaagatattacaacattgatggacaaaggcgacgtctatcgctacgcgacagatcaaattgtaacgtatgcgaaggaaaaagagatcgatctcgtcgtgggacctgaagcgagaggatttatcatcggctgccctgtcgcatatgcgcttggggtagggtttgcgcctgtccgcaaagaaggcaaactgccgcgcgaagtcatcaaagtcgaatacggattggaatatggaaaagatgtcctgaccatccataaagatgccattaaaccggggcagcgcgtcttgatcactgacgacctgcttgcaaccggcgggacgattgaagcaacgatcaagcttgttgaagagctcggcggcttcgtggccggaatcgctttcctgatcgaactgacatatcttgaaggaagaaataaactggacggatatgatattttaaccttgatgcaatact

SEQ ID NO: 597 - DNA, 891 bp, Bacillus licheniformis
aaatgaaacacttgaccgcaatgaatgagcttagtcttgaggatattcacgagctgattgaagaggcgagagagctgaaaaaaggcaagtccgattccgttctctccggaaagttcgctgccaacctgttttttgaaccgagcacaagaacgcgcttcagcttcgaagtggctgaaaagaaactcggcatgaatgtgttgaacctggacggtgtttcaacgagcgtacaaaaaggagaatcgttgtacgataccgtcaagaccctcgaatccatcggcgctgatgtatgtgtgatcagacactctcatgatcattattacgatgaactcatcggacatgtcggcattccggtgatcaatgccggagacggctgcggtcagcatcccactcagtctttgctcgatttgatgacgattcacgaggaatggggcagatttgccggactgacggtatccatacacggagatatcaagcacagcagagtggcaaggtccaatgccgaagtgctgacaagactcggagcaaaggttcttttctcaggtccagacgaatggcgggatgaagacaatccatacgggacatatgtgtcgcctgacgaagcggttgcacattcggatgtcgtgatgcttctccggattcagcacgaacggcatgagaaaaaggcggcagaacgcgattatctcgaaacattcggattgtcgctcaagcgggcggagctcttgaaaaaagacgcggtcatcatgcaccccgcacctgtcaaccgaggcgtcgagattgacagtgcactggtcgaatccggccggtcgaggatttttaaacaaatggaaaacggagtatatatcagaatggcggttttaaaaagagcgcttctaaacggcgaaaacaaaaaaa

SEQ ID NO: 598 - DNA, 617 bp, Bacillus licheniformis
atgaatacagcccctttcattgctgtcgaaggccccatcggcgcgggaaaaacaaccttggccagcatgctctccgaaaagctctcactctctttggtcaaagaaatcgtcgaagaaaacccttttcttgataaattttatgatgaaaaagatgaatggagctttcagcttgagatgtttttcctctgcaatcgctataagcagcttgaagataccgagaaaaagtatttgcatcatcacatgcccgttgtttcggactatcatatttataaaaacctcatttttgccgaacggacgctggaaggcaaaaaacttgagaaatacagaaaaatttatcagctgcttacagaagatctgccgaaaccaaacgtcatcatttacataagagcgagtcttccaactttattggaacggatcaaaaaacgcggacggccgtttgaacaagaaatggacaagcaatacctggaacagcttatcaatgattatgaggcggccattaagcaatttaaagaatccgatccgccaatacccgtcattgaaattaacggagatcaggaagacttcgtaatctcagaagccgttttcaatcgaattgccgatcaagtaaaggagtatat

SEQ ID NO: 599 - DNA, 667 bp, Bacillus licheniformis
gtgaaatttgcggtgattgtgctgcctggctcaaactgcgatatcgatatgttccacgcgattaaggatgagcttggcgaagaagctgaatacgtctggcatacagaaacaagtcttgatgaatatgacggcgtcctcattccgggaggattctcatacggtgattatttaagatgcggcgcgatcgcccgcttcgcaaatattatgccggccgtcaaaaaagcggctgaagaagggaagccggtgctcggcgtctgcaacggatttcaaattttgcaggagctcggtcttttgccgggcgcaatgagacgcaacaaagatttgaaatttatctgccgtccggttgaactgatcgtccaaaacaatgaaacgctttttacatcttcctacggcaaaggcgaatccatcacgattccggtcgctcacggcgaaggaaacttctactgtgatgaagaaacgcttgccggattacaagaaaacaatcaaatcgctttcacatacggaacggatatcaacggaagcgtcgccgatattgcaggcgtcgtcaatgaaaaaggcaatgtattaggcatgatgcctcacccagaacgcgcagtcgattctctgctcggaagcgccgacggtcttaaactgtttcaatctatcgtgaaaaattggagggaaactc

SEQ ID NO: 600 - DNA, 585 bp, Bacillus licheniformis
atggaaaagctaaaacgaaaaattgcagagcagggcacggtgttgtctgacgaagtgctgaaagttgattcatttttaaatcatcaaatcgatccggaattaatgcttgctgtgggtgaagagtttgcttcgcttttccgggaggaaggcgtcacaaagattgtgacgattgaatcctcaggcatcgcacctgccgtgatggccggcttgaagctgggcgtgccggtagtatttgcaagaaagcgtcaatcgcttaccttgacggaaaatctgttgacggcttctgtctattcatttacaaagaaaacggaaagtacggttgccgtatcagccagccacctttcaaaggatgacaaagttctgatcatcgacgattttttggcaaacggacaagcagctaaagggctcgtttccatcattgaacaggccggcgctaaggtgtgcggaatcggaatcgtcatcgagaaatcattccagacgggcagggaggaacttgaaaatcttggaatcagagtcgaatcccttgcgcgtattgcctctcttgccggtggaaaagttacctttttacaggaggttgggtcatga

SEQ ID NO: 601 - DNA, 489 bp, Bacillus licheniformis
atgcagcctcttcttggtgttatcatgggaagcacatctgactgggaaacgatgaaacatgcctgcggcatactcgatgaactgggaattccgttcgaaaaaaaggtcgtttccgcacatcggacgcctgatttaatgtttgaatatgccgaaaaggctcgggaaagaggcttgaaagtcatcattgccggagcgggcggagccgctcacctgccgggaatggtcgcagccaaaacgacgctgcccgtcatcggtgtgccggttcagtcaaaagcgctgaacggtctcgattcgctgctttcaatcgttcaaatgccgggcggagtacccgttgcgaccgttgccatcggcaaagcgggagcggtcaacgcaggactgcttgcggcgcagattttgtcagcttttgacaaagagcttgccgaaagattggacgaacgaagggaaagcatcagacaaaccgtgttggaaagcagtgatcagcttgtataa

SEQ ID NO: 602 - DNA, 467 bp, Bacillus licheniformis
atgagtgtatatgatattccgaaagatgctatcattactgttgcaggaacggtaggagtggggaaatccacattgacaaaagagcttgcaaaaaggctcggatttaaaacctctcttgaagaggtcgtgaataacccttatttggaggctttttaccaagactttgaacgctggagctttcacctgcagattttcttcttggcagagcgcttcaaagaacaaaaatacatttacgaatcgggcggcggatttgttcaggaccgttcaatttatgaagatacaggcattttcgccaaaatgcacgccgataaaggcacaatgtcaaaagtcgactataagacgtatacgagcctgtttgaagcgatggtcatgacgccttacttcccccgccccgacgttttagtctatttagagggcgatttggaaacgattctcgaccgcatccaaaaacgcggacgggaaatgga

SEQ ID NO: 603 - DNA, 537 bp, Bacillus licheniformis
gcatgttttcgggcgaatcagaggagctcatccgccggatcaaaagggcgacgtttgcgaacaggaaagtcaaagtgtttaaaccagccattgataatcgctacagcagcgaatcggttgtatcgcataatgggacatccattgtgtgccatgccatcgcatctccggaagaaatttttcaatacataagcaaagaaacggatgtcatcggcgtcgatgaagtgcagttttttgacgaaacgattgtcggcacgttaacttctctggctgatcagggctaccgtgtgattgcagcaggccttgatttggatttccggggcgagcctttcggcgtcgtgcccgatctgatggctttaacggaaacggtgaccaagctgcaagccgtgtgctcggactgcggatctccagccagccgcacgcagaggctgatcaatggaaaaccagcatcttaagacgatccgggcaattttggttggggcctccgaagctatgaagcgcgctgccgccaccatcatgaagtgcctggaaacccgaaat

SEQ ID NO: 604 - DNA, 505 bp, Bacillus licheniformis
atgaacggtttatttattacttttgaagggcctgaaggtgcggggaaaacaacaatccttcaggctgcggcagaccaattgacgaaaaacggccattctgttcttgcgacaagggagccgggcggcattgaaatatcagaacgaattcgcgaggttattttaaatccaagccatacagcaatggatcccaaaacagaggccttgttgtatgcggccgcaagaaggcagcacctagtcgaaaaagtaaaaccggcgcttgaagaagggaaaatcgtcttatgcgaccggttcatcgacagctcgcttgcttatcaggggtatgccaggggactcggcattgatgaagtattttctgttaatcaattcgcgatcggcagcctgatgccgaatgtgacgatttatttcgacattgacccggaagagggaatcaaacgaatcgatttaaatgatgcaagagagaaaaaccggcttgatttggaaaaactccactttcatcagcttgttc

SEQ ID NO: 605 - DNA, 553 bp, Bacillus licheniformis
  misc_feature (1)...(553): n = A,T,C or G
atggaaaaaccaaagtataatcgtatcgtattaaagcttagcggagaagcccttgcgggtgaacagggaaacggcatcaacccgaccgtgatccagtccatcgccaaacaggtgaaagaaatcgccgagcttgatgttgaagtggcggtcgtcgtcggcggcggcaacctgtggcgcggaaaaacgggcagcgatctcggaatggaccgcgcaacagcggactacatgggaatgcttgcaacggttatgaattcccttgcgctgcaagacagccttgaaacgctcgggattcagtcaagagttcagacatccatcgaaatgaggcaggtcgctgagccatacataagaagaaaagcgattcgccatcttgaaanagaagcgcgtcgtcatcttcgctgccggtacaggcaatccatacttctcaacggatacgacagcagcgctcagagcggctganatcgaagccgacgtcatcttaaatggccaaaatatgtcgacggtgtatacaatgccgatcctagaactgacgaaacagncgtaaatatgaaaaatt

SEQ ID NO: 606 - DNA, 1146 bp, Bacillus licheniformis
atgctgattcttgcggtatatggcttttttcaaggagtaatgggtgcgaaatacggaatatcgactaccgttcttgcccgtctggcctttggtcgctacggatcgagcctttttggaattgtcttggcgctgacgcttggaatcggctggttcggctggcaggttgctttctttggcacgaccatttccgaaatgtttccgggtgtttggcttgcaaagcctgaggtcgccatcgtttggggcggcattttaatgatccttaccgcgtttataggatatcgcgggcttgccgctttaagctttatcgctgtacctttagtcgtcattttttccatatggggaatcataagtgctgtcaattactcaggaagctggcataacttgctgacatttcacccgacaggggatcctctgacgatatttgccggaattacaattgtcgttggaaatgctgcattgggcgcggttgtttttcctgatgtgacgagatatgcaaaaggagcggtttcaggaggaataggcgcttctgtaggttatttccttggaggagtgttctgtcttgttgcgggagcggcaatggcgattgccgcgaatgttccggatatcgggtcaacaccgaatattcctgccgctatgagcaagcttggcctgggctttttagcatttttaatcatcgtttttgcacaatggacgacaaacgataacaatttgtataccggttcgctagggcttcgcaatgttgtgaacattcctaagaaagcacttgtggcgatcatgggcgtgatcggaattatcattgcattactaggtgtccaaaatatgtttgtgccatttttaacattcttaggcttgtatgttccgccgattgcgggagtcatgatcgccgatcattggatcacagcacctgtcatcaagaaaaaacaatatcaattcggggctggaacaacttattcgaagctgaatgttgcggcgattctttcggtgatcatcggaggttttaccgcttcaaagataacgttcggcatcgggccgattaactctactatacttgcatttttgatttatatcatctttacgtttattttcacaaaattaaatctccgttacgaaatcggagaagcgacagaggaatcgtctggtttttaa

SEQ ID NO: 607 - DNA, 789 bp, Bacillus licheniformis
ttatgtcgtgactgaagcgggatttggcgctgatttggggccggaaaaattcatgcacatcaaaacgagagccggcgggttcacaccgggggcggtagtgatagtcgccaccgtcagagcgctgaaaatgcatggcggaacgcctctcgccgatttgaagcaaaaagacctggaagcattaaaaaggggaattgccaaccttgcgaagcatatcgaaacgatagatgccttcggtcttccatacgttgtggctgtcaacagattcgtacaggacacggaggacgagcttgaggccgttcttggctggtgcagagacaacggacatccggctgcactttgcaatgtttgggaagagggcggaaaaggcgggactgatctcgcaagggaagtcattcatgtcatggagcaaaaagacaacaggttttcctatttatacgaattaaccgactcgatcgaagacaaattagccaagatctcccgcaccgtttatggcgccgaaggggtagagtttaccgaaaaggcgaaaaaacagctgcttgaattgaaaaagaacgggttggacggactgcctgtctgcgtggcgaaaactcagtattctttatcagatgacccgggtaaaatcggcaggccgcaagattttagcatcaccgtccgcgaattaaaaccatcgaggggcgcgggatttatcgtcgctttgacaggcagtattttaacaatgccggggctgccgaaacaccctgccgcgcttaagatggatgtcgacgaaagcggcagagccaaaggtttatt

SEQ ID NO: 608 - DNA, 584 bp, Bacillus licheniformis
atgaagtttcgtcgaagcggcagattggtggatctgacaaattatttgttgacccatccgcatgtcttagtgccattaaccttcttttcagaacggtatcaatctgctaaatcatccattagtgaagatttaaccatcattaagcagaccttcgagcagcagggaatcggaacgcttcagaccgtgccgggagcagccggcgggcgttaaatacattccaaagggtaaaacgcgatgaagcggaggaatttgtaaagtcgctcggtgaggtcattgatcgattcggaacggatattgcccggcggatatttgtatttaaccgatatccttggaaagccctctgtattaacgaaggccggcaaaatttttgcttccgctttttcagcagggagatcgatgtcgtgatgacggtggcgacaaaaggcattcctttggcatatgcggtagccagctaccttgatgtgccgacagttggtcgtcagaaaagacaataagggaactgaagggtcaacggtcagcatcaactatgtgtccggatcatccaaccgcattcagacgatgtctcttgcaaacgaagcttgcag

SEQ ID NO: 609 - DNA, 328 bp, Bacillus licheniformis
atggggaaaaaaccggtagttatcggcatagcgggaggctccggatcaggaaaaacgagcgtcaccagatccatttatgaacagtttaaaggtcattcgatcttaatgctcgaacaggatttatattataaagatcagagccatctgccgtttgaagagcggctgaatacgaactacgaccatccgcttgcatttgacaatgactatttgatcgagcatttaaacgaattgctcgcgtacaggccgatcaaaaagccgatttacgattacaagctgcatacgcgttcagaggaagtcgtgcacgtcgatccgaaagatgttattattt

SEQ ID NO: 610 - DNA, 354 bp, Bacillus licheniformis
gtaaaactgtttcattaagcattcagcacgtccttgccatgtatgcaggagccgttgtcgtaccgctgatcgtcggcggcgctctcggtctgacgccggctcagctgacataccttgtatctgccgacattttgatgtgcggtgtggcgacgctgctgcaagtttggaaaaaccgctttttcggtatcggtttgcctgttgtattggggtgtacgttcacagccgtttctccgatgatttcgatcgcctcgacatatggtattccagcgatctatggaagcatcatagcaggtggtgtgattgtcgtcatcatttcttttttattcggaaagcttgttaagtttttccctcccg

SEQ ID NO: 611 - DNA, 417 bp, Bacillus licheniformis
  misc_feature (1)...(417): n = A,T,C or G
ttgtaaaaagcggcaatgtagaagatgtaattctgcaatgacgttcatcaactgattcacaaatcaacagagtggcattcggctcgatcgactttgcgccctgcgcggacttcggcctgctaaaagctgcttatgacgctgcaagtgagcggaacatcccgggtacggcagggaatgtgtntacggcggatcaattctataacgacgacagccaaattgagaagcttgccaaacacggagtgcttgcggtcgagatggaaacgacggcgctttatacattggctgcgaaattcggccgaaaagccctctccattttaacggtcagcgatcacgtcattaccggcgaggaaacaacggcagaagaaagacagacgacctttaatgatatgattctgctggctctggatactgctttgt

SEQ ID NO: 612 - DNA, 495 bp, Bacillus licheniformis
  misc_feature (1)...(495): n = A,T,C or G
cgcgaatgatcgatcacactgcattgaagccagataccgtcaaatccgaaatcgaagcgctttgcaaagaagcgcgtgtttacggttttgcctccgtttgtgtcaacccttgctgggtgaagctttgcgccgagcttcttaaagagtcagaggtgaaagtatgtacagttatcggctttcctttaggtgcagcgtctccggaaacaaaagcctttgaaaccaggcaggcaattgcagacggtgccggtgaagttgatatggtgatcaacatcggtgcactaaaagaccgcgatacgggaacagtggaacatgacatcagggcggtgacagacgcggccgacggcaaagctcttgtaaaagtcatcatagagacgtcgcttttgacggatgaagaaaaaaggctggcttgtgaactggccgtaaaagcaggcgccgactttgtcaaaacatcgaccggtttttncggcggcggtgcgacagtccgggatataaaaa

SEQ ID NO: 613 - DNA, 255 bp, Bacillus licheniformis
atcagggatctccgatgaagaatatcaggttcggacgaagtgggattcagacggaacgccggctcatacgctgagcatcatgagcgaaaaaatgcggtttgacaattcagaagtgccgattttgacgacgaagaaggtggcgtggaaaacggccattaaagagctgctttggatttggcagctgaaatccaatgatgttcaagttctgaatgatatgggggttcatatttgggatcaatggcgtcttgaagacgg

SEQ ID NO: 614 - DNA, 870 bp, Bacillus licheniformis
atggacatgaacgcacagcaagaaggacaaacggcaaacgcgcgagccaacacggcgacccggaaaggcccacacaacggccgaagagacggcgaccaaggacagaaacacaaggaggcggacccgaggcagagagaacaaaaacaattcgacacgcacacggaaaccgcggagtgcagcgaggggagagcgaggcggggggaaggaccaagcacaaaggccgggcggacggaccgccgggcacgccacgacccacagaaacaaggggcacgggaccacaggcggacacgtaaacgcgccccaaggagaacgagcgccaggccacccagagacgacgaacacacgggcagcgcaggacccaacgacgccgaagacgcggccggcacgggcccgagcacccgcccggggcgaggcgccagggaacccacaccccacaccacaaaagcgaaagagacaaaagaccaacaaccccagaaacgaacccaggcaccgaagcgacgcgaaaccccacacaccagccgcagcacaagccaaccagacacgggaagaccgcgccaggcccccacgccccgatccccaccccccagcacacccgcacccacaccgcccccggtcacccacacaccgtcaccaacaccacccagcacaccacaccacatcctccgccacagccccgcgatcgcagaaaacgtcggaacgcccgaagatgttagagagcttgaaaacgccggagccgacgctacactaagtcggcatcggtcccggaaaagtctgcatcacaaaaatcaaaaccggttttggaacgggcggatggcagctggctgcgctgcgctggtgcgcaaaagcggcaagcaagccgatcattgctga

SEQ ID NO: 615 - DNA, 361 bp, Bacillus licheniformis
atgacggaaaagctccatatctaccatacgaacgatttgcacagccattttgaaaactggccgaaaatcgtcgattacattcagacacaaagacagaaacatgaagagcagggggaagaagtgcttttgttcgacctcggcgatcatgtcgacagattccatccgatatctgaggctaccttcggaaaagcgaatgtggagctgttgaaccggctgcagtatgatgctgcaacgatcggaaacaatgaagggattacactgccgcatcaggagttggatacactttatgacaacgctcagtttcctggtcgttggctccaatttgtttgacgggaaaagggaagaagccccgcttgggcag

SEQ ID NO: 616 - DNA, 435 bp, Bacillus licheniformis
gcaaattttcaaaagaaggcttaacatttgatgatgtattgctcgttccggctaaatcggaggtacttccgcgcgacgtcgatttatcggtagagcttacaccgtctctcaagctgaatgttccaattattagtgcaggcatggatacagttacagaagctcaaatggccatcgcgatggcaaggcagggcggactgggtattatccacaaaaacatgtcaattgaacagcaggctgagcaggttgacaaagtcaaacgttcagagcgcggcgtcattacaaatccgtttttcctgacaccagagcaccaagtttttgatgcagagcatttgatgggcaaatacagaatttccggtgttccgattgttgacaatgaagaggatcagaagctggttggaatcattacaaaccgtgatctgcgatttatttctgatt

SEQ ID NO: 617 - DNA, 282 bp, Bacillus licheniformis
tgtcaaaggatcggacacttccggcggacatcaccgatcaaaaggtgatcctcgtcgatgacgtgctttacacgggacggacggtcagagcggccatggatgcgctcgtcgatgtcgggcggccttcatccatccagcttgcggtgcttgtcgaccgcggccacagagagctgccgatcagagccgactttatcgggaaaaacatcccgacgtcgaaaaccgaaaaggtcatggttcaattggaggaagttgacggacgcgaccttgcggcgatttataaaa

SEQ ID NO: 618 - DNA, 375 bp, Bacillus licheniformis
aagatcgaaacgtaaggggcttacaattaatcggagccaagctgatgaaggtctcagaagagacggcaggcgagcattataaagaccatacggggaaaccgtttttcggcgaacttgtcgactttatacttcaggcccggtattcgccatggtatgggaaggcgaggacgcaatcgcggtcgccagacagctgatcgggaagacgaaccctaaggaagcgcttccaggtacaatccgcggagacttcggcatgtttgtcggaaaaaatatcattcacggttcagattctcctgaaagtgcagcacgcgaaatcaacttgttttttaaagaggacgaacttgttgaagacgagaaattaatgaatcaatggattta

SEQ ID NO: 619 - DNA, 271 bp, Bacillus licheniformis
atgaaaaaattcgcggtatttgcatcaggaagcggaacgaattttgaagcaatcgaaagaagaatgagagaagagaactgggatgccgaaattgtcctcgtcgtctgtgacaagcccgatgcgaaagtgcttgaaagggcggaaaaagccggaatcccgtcgttcgccttccagccgaaatcgttcgacaataaagctgcatttgaacaagtgatcgttgaacagctccgccttcacggagcggaatggattgtgctggcggggtatatga

SEQ ID NO: 620 - DNA, 378 bp, Bacillus licheniformis
aagaattgattgcagaagctttaaaagcaagggaattggcatatgttccgtatcgaaattcaaaagtcggcgctgcattttaaccgaaaacgccaggtgtacaaaggctgcaacattgaaaatgctgcatacagcctgtgcaactgcgccgagcggacagcgctgtcagggcttattcagaaggggaaaaatcctttaagatgcttgccgttgctgcggatacgccgggtccggtgtcgccgtgcggcgcctgcagacaggtgatttccgaactttgttcgccaaacatgcctgtcatcttaaccaatctgaatggccaagtcaaagaaatgacggttcaagaattactgccaggagcattttcatcggaggacttac

SEQ ID NO: 621 - DNA, 591 bp, Bacillus licheniformis
atgaaggaagtcatcattgccacgaaaaacgaagggaaagtcagggaattcaaagcgatgcttgaaccgaggggctacgatgtcaaatctttactggacatcggctatacacccgaaatcgaagaaaccgggcagacttttgaagaaaacgctgtgattaaagcggaaacaatttcgaaagaaaccggaaaaatcgtgattgccgacgactccggcctgtctgtcgactatctcggcggcagccccggcgtatactcggcccgctatgcaggagaagagaaaaacgatctcgccaatctgaaaaagctattgaaagagctcgaaggggtggaaaaagaagaccgttccgcgaggttcagatgcgcgctcgcaatatgcattcccggacaggaaacgaaaacggtcgaaggttctgtggaagggtacattaccgaagagccgcgcggcacaaacggcttcggctacgacccggtttttctcgtcaaagacaaagatcaaacgatggccgagctctcaagcggcgaaaagaacaaaatcagccacagagcggaagcgctgaaaaagctgtccgctttattggatcaagcgtaa

SEQ ID NO: 622 - DNA, 186 bp, Bacillus licheniformis
tcggggtgtgccccatttattcccgtcacatggccaatttaatcattcagatgaaacgcgagcagtatgaagcgccaaagttatggatcaacccggatatcaaaaatttttatggctttacaatcgatgattttaaattaatcgactataagcacggcgtcaagctgacatttgaagttgccgtat

SEQ ID NO: 623 - DNA, 164 bp, Bacillus licheniformis
cctacaaagaagttcaggacgtccgcatcggcaaatacatggagctcacaatcgaaaaatcggaccgcgaccttgacgttctcgtcaaagaaatgtgcgaaaaacttttggccaacacggtgattgaagattacagatacgaagtcgaggaggttgtcgcacag

SEQ ID NO: 624 - DNA, 363 bp, Bacillus licheniformis
cagtagttgttgtaggtacgcagtggggtgacgaaggaaaaggcaaaatcaccgatttcctttccgaaaatgcagaggtaatcgcacggtaccaaggcggaaataacgcaggacatacgattaaattcaacggggtaacgtacaaactgcatttgattccatccggtattttttataaggataaaacgtgtgtgatcggcaacggaatggttgttgatccgaaagcattggtaacggagctggcttatcttcatgagcgggacgtcagcacggacaacttgagaatctccacagggcccatgtcattctgccgtatcacttaaagcttgatgcggtcgaagaagagcggaaaggggccaataa

SEQ ID NO: 625 - DNA, 168 bp, Bacillus licheniformis
ggctcgaagtcgcgaaggaagaaatcgaactgatggacgcctatgactatgttgtcgaaaatgacagcattgagcttgcgtgcgaaagaatcaaagcaatcgttctcgccgaacatttacggcgcgaccgagttgctccaagatataagaaaatgctggaggttgaat

SEQ ID NO: 626 - DNA, 253 bp, Bacillus licheniformis
atggacatcaagctgtatgtcgatacggacgccgacctgcggatcatcagaaggatgctcagagccaaaaaagaaagagcacgttcgatcgattctgtcatcgagcagtacatctcagtcgtcagaccgatgcataaccagtttgtcgaaccgacgaaacgctatgccgatatcattattccggagggcggccaaaaccgcgtcgccatcgacctgatggtaacaaaaatacaaactattcttgaacaaaacg

SEQ ID NO: 627 - DNA, 201 bp, Bacillus licheniformis
atcgaagagaggggcacagaaggacccaatattctttgttaccggaggagttgtatcctcgcttggaaaaggaataacggcgtcttcgctcggccgcctgctgaagaacagaggtttgaatgtcaccattcaaaaatttgacccgtagatcaacgtagacccgggtacgataagcccgtatcagcccggtgaatggtttgt

SEQ ID NO: 628 - DNA, 237 bp, Bacillus licheniformis
ctgaaagctataaaaacgccggggttgatattgaagccggatatgaagccgtaaaacgaatgaaaaaacatgtggaaagaacgaagcgaatcggcgcaatgggcggacttggcgggtttggcggcatgtttgacctgtcggaactgccgtacaaacagccggttctcatttcgggaacggacggtgtcggcacaaaactgaagctcgcttttgcgatggacaagcatgacacgatcg

SEQ ID NO: 629 - DNA, 102 bp, Bacillus licheniformis
gctgcgcgcataatatatcgctgatacatatttggaaaacgttgaatgttataacgaagtacggggaatgtacgggtttaccggcacttataaaggaaagcg

SEQ ID NO: 630 - DNA, 300 bp, Bacillus licheniformis
tctttcggcttaccggaattaaattcattcaacatcctatcggtcggtcttgccggcgtttcccggcatggtcagcggtcggacaagcgttacacagcaggcgtgaaagtggccaggcatctcggttcactccgttgacgaaggcatggacacccggtaacgattatcgcccagcgcgccggtgagcttgaaaaaagctgaacactggcgtctgttgaagaaaatgatactcaaattggagcatgaactttatcccgaagtaatcaaagagcttcttgaactaaatggcagaggtgaaaa

SEQ ID NO: 631 - DNA, 261 bp, Bacillus licheniformis
atgtttttgcgtttttgttcagggtgtgagacggcctttaagcttgttcaggaagcgatctttcgcatccactttgatcacgttcatgttgaagccttcactgaacgttttcatcacgccttccgcttcaccttttcgaaggagcccgtggtctacgaaaatacaagtcagatggtggccgttcgctttatgtgtcaagagcgcgacggtataggagtcaccatttttgctgtgcgagacacgtatttgataaagaggtga

SEQ ID NO: 632 - DNA, 1285 bp, Bacillus licheniformis; identical to SEQ ID NO: 566

SEQ ID NO: 633 - DNA, 437 bp, Bacillus licheniformis
atgtctaaatatgaagacgacaatttgaagattttttctttaaactcaaatccgggtcttgcgaaggaaatcgcggatatcgtcggagttgagctgggaaagagttctgttaaacgctttagcgacggtgaagtccaaattaacattgaagaaaatatccgcggctgcgactgctatgtcatccaatcgactagcgcgccggtgaacgagcatatcatggagcttttgatcatggtggatgcgctgaaacgcgcgtcggcgaaaacgattaatatcgtgatgccttactacggctatgcccgtcaggaccgtaaagcgcgttcccgcgagccgatcacagccaaactcgtggcaaatctgctggaaaccgccggagctacccgtgtgattgcacttgaccttcacgcgccgcaaatccaaggtttcttgtatatacc

SEQ ID NO: 634 - DNA, 450 bp, Bacillus licheniformis
aggatatcgtgattgtgtcccctgacccggcggtgtgacccgtgcccgcaaattggcggaccgcttgaaagcgccgattgcgattatcgacaaacgccgacctaagccgaatgtagccgaggttatgaatatcatcgggcatatcgaaggaaaaacagccattttaattgatgatattattgatactgcaggaacgattacgctggcggccaatgcgctcgttgaaagcggcgcagaggaagtgtatgcatgctgtacacatccggttctttccggtccggcgatcgaaagaatcgacaattccaaaattaaagagctcgttgtgaccaacagcattgagcttcctgaagaaaagaaaatcgcgaaattcaagcagctttctgtcgcaccgcttctggcagaagcaattattcgtgtgcatgagaaacaatctgtcagcttcctgttcga

SEQ ID NO: 635 - DNA, 411 bp, Bacillus licheniformis
cgactgtattttctgcaaaatcataaacggggaaatcccttgtgcaaaggtatttgaaaatgaacatgtgctggcttttctcgacatcagccaagtcacaaaaggacacacgcttgtgattccaaaagttcataaaaccaatatttacgaaatgacacctgaagtttcacgagagttttttgaagcggttccgaaaatcgcgcaagccatcaaagacgaatacgagccgatcggcttgaaccttctgaataacaatggcgaaaaagcgggacagtccgtcttccattatcacatgcacattattccccgctacggcaaaggagacggattcggagccgtctggaaaacccatgcggatgactattcaccggaagacttgcagaacattgcagcttccatcaacaaacacct

SEQ ID NO: 636 - DNA, 402 bp, Bacillus licheniformis
atgtatattttgtgaaatagttagtcggaaaatttcaagttttgaggtttataaaactgactatgtgacagcatttcttgatataaatcctgttacaaatggccatacattaatcataccaaataagcatattgaaagactggatcatataaacgatccccatctatctaatgaaataatggattctttaattaaagttcctcaattattaattcagtcaggtatttgtgatgactacacgatactctcagacaacggtcactttgctcagcaagatattaaacacctgcattttcatgtcataccgagacatatgaatgaaaagtttgaattcaaattaaacaccgactttactgcagctaagaagagtaacttactttcgatatggaaaaagattgtagg

SEQ ID NO: 637 - DNA, 492 bp, Bacillus licheniformis
tcctgatcttaaacgtatggagcggctggaaagacatcggcggcgactggaacttatttggtttgcatttaccgggtcttttgtcatttgttttcttttgggggattcatcttctcgtcctccatcacggaatggagtcgattagaaggtttgaagtctgggccggcccgctcgtttatctcgtctttggcgggatggtgtggtgggcggtcgatattgcaggggggctcggtccgatttattcgcagccgggaaaatttcagacattcagcgaattaatttggccatttcttgccggtgtgacggggattatcggcatttgggcgacgctcattttgaacattcccgattttacgaggtttgcagcctcccaaaaagaacaaatcagaggacagttttacggtttgccgggcacattcgttctgcaagcatcaccgtcacctccggctcacaggctgccttcggggagccgatttgggacgtggtcgatat

SEQ ID NO: 638 - DNA, 183 bp, Bacillus licheniformis
tcaagaaaaaattcaaacagacctcacgctctcaaacagcgacttgcagcctctgaagccggaggaacgcacatggaaagcggttaatttcgcatcgatctggatgggctgcatccataacatcccgacttatgcaacggttggcggactgattgcgatcggactttctccgtggcaagtgct

SEQ ID NO: 639 - DNA, 473 bp, Bacillus licheniformis
atgacacaagacgagttttatatgaaagaagcggtcaatgaagcgagaaaagccgaagaaaaaggcgaagtgccgattggtgctgtactcgttctggatggggaaattatcgcccgcgcccataatctgagggaaaccgagcaaaggtcggttgcccacgcggagatgctcgtcattgaagaggcatgccggaagctggggacctggcggctggagagagctgttctttacgttacccttgagccatgtccgatgtgtgccggagcggccgttctttccagaatcgacaaaaaggtgttcggagcgtctgatccgaaaggcggctgtgcagggactttgatgaatctcctgcaggaggagagattcaatcatcaggctgaagtcgtgagcggcgtaatggaagaagaatgcggcaggatgctgagcgattttttcagaaagctccgcgcgaaaaagaaagcagaaaagcaaag

SEQ ID NO: 640 - DNA, 301 bp, Bacillus licheniformis
atgaatcatgaagcatttttgcagcgcgccatcgaccttgcggtggagagcgtgaaaagcggcacaggcggaccttttggcgctgtgatagtcaaagacggccaaattatcgccgagggaaaaaacaatgtcacaacaagcaatgatccaaccgcgcacgcggaagtaacggctattcggctcgcctgtgaagcacttggcgattatcagctgaacgactgcattctttatacaagctgtggaccgtgccccatgtgcctgggagccatctactgggcgagaccgaaggaagtttactttc

SEQ ID NO: 641 - DNA, 1322 bp, Bacillus licheniformis
atgcaaaaaacgctttttcaaaatgctacgattgtgacgcttgatccgcagcttcatacgctcgaaaaaggggacatgctgattgaaggctccgtcattctggacgttgccgagtcgattgaagccggagacgctgagattgtggatgcctccaatatgctgatcatgcctggatttgttgatacgcaccgccacgtatgggaatctgtgatccgcggaatcggagccgactggtccctgcaaacctatttaaaccggatttattatgggaattatgggtcgatgagaagacctgaggatgattgggccgcgaactatttaggagcgcttgaggcgctcgatgcaggcgtcacgactttgctggactggacgatgattgagtcgcctgatcatacggaccagctgattgccggactgaaagacgccggcattcgcgcagtattcgcctttggaacatctggtgacgccgaatattgggacagagacagcgatctttcgaatatggacgaagcgaaacgggtaaaaaaagcatattttcaatcgaaggatcagcttctgacgatggggcttgcaattcgaggtccggagttttcttcatggaagacatctgtctttgaaatcgaaacggcccgggaactggatgccttatgcagcatgcatattgcttttggcaactggggagcgaaagatcgttcgattgaaaagctgaatcaagccgggctgcttggtcccgatttaaacatggtgcatgccaatgcgatgagtgaagaagaaatgaaaatgcttgcggctcacggaagctcgatatctgtgacaccagaaattgagatgatgatggggcacggctatcctgttacagggctctctctaaaaaacggggttcttactgcgcttggggttgatgttgtcacatcgaccgggggagaccttttcgcacagatgaaatttgctcttcaagcagaacgcgcaaagcacaatgatgaactgctgagagaaggaattatgccggggcccgaattgagcatatcggccgaacaaatcctgaaagcggctaccattgacggggcgcgcgccctaaagctcgatcataaaatcggctcgctttccccaggcaaagaagctgactttatcatggtgaaaacggacagcgtcaatttgctccctttcactgatgcggcgggggccatcgtccaatgcacgcacaccggaaatgtagattccgtatatgtcgcaggaaaagcggtgaaacgaaacggccggctggttgatgcagatcttgaaaaggtgagacaaaaagcgctgaagcaagagatcatatttta

SEQ ID NO: 642 - DNA, 2553 bp, Bacillus licheniformis
aaaaacacagcttccactcgttgggggaaaaggattgcatttaggggaattatcaaaaattcaagggatacaagtgccagacggattttgtgtcacaacagcaggatttcaaaaagccatcaaacaaaacaaatcgttccaagccttgttggatcaactgacaatgcttaaagttgaggatcgagatcaaatcggtgaaatcagcaggaagattcgacataccattatggaaatcgaaattccttccaatgttgtgaaagaagtggctcgctatctctccctgcttggcgatgaacatgcttatgctgtgcgttccagcgcgacagctgaagatttgccgcacgcctcttttgccggtcaacaagacacttatttaaatatcatcggaaaagatgcgatcttgcagcatatcagcaaatgttgggcttctctatttacggatcgagcggtcatctaccgcatgcaaaatggatttgaccatcgtcaagtttattcatccgttatcattcaaagaatggttttcccgcaggcttcagggatattatttaccgctgatcccattacttcaaaccgaaaactgctatccatcgatgccggttttggtcttggggaagcactggtctccggcttggtctctgccgattgttataaagtgcaaaacgggcaaatcgtcgataagagaatagcagccaagaaattggcgatttatgggcgaaaacaaggcggaacagagacaaagcggattacgcctgatcagcaaaagacgcaagcccttactgacgggcaaattttacaactggcacacatcggaagacagatcgaagcacatttcggccagccgcaagatatcgaatggtgtttggaccgcgatacattttatattgtccagagccggccgatcactactttatacccgatccctgaagcgaatgatcaagaaaatcacgtctatctatctgtcggtcatcagcaaatgatgacggatcccataaaaccactgggattgtctttttacctgttcattactccagcacctatgcgcaaggccggcgggaggttgtttgttgatgttgcgcctaggcttactacacgtatcggccgggaaactttattaaataccgtaggatccgatccgctcataaaaggcgcactcatgaccgtaatagagcgagattatataaaattgtcaccaaatgatcaaacagcaccgattcctgacagagggaatacggatatgctggcgcaattcgagaacgatccgacaatcgtttctgatttgattaagcgcagtgaaacatcgatagaagagttaaaacaaaatatccaagcgaaatcgggatcggatttgtttgattttattctggaagatatccggcaattaaagaagatattatttgacccgcaaagtacggcagtgtttatggctgctataaatgctacatcatggatcaatgaaaacatgaacgagtggttaggcgaaaaaaacgcagcagatactctttctctatctgtaccgggtaatattacttcggaaatgggtctggcgctaatggatgtcgcggatgtgattcgcccttatccagaagtgattgattatttgcagcatgcaaaagatgataactttttggatgagctggtgaaggttgatggcggacaggaagctaggggcgccatctatgcttatcttgacaaatacggaatgcgctgtgccggagaaatcgatattacaagagctcgttggagtgaaaaaccaatgacacttgttcccatgattctgaataacatgaagaactttgagcctaatgccggcaatcgaaagtttgagcaagggcggcgtgttgctttggaaaaagaacaagagttaatagagcgattgaagccattacgggatggtgaacaaaaagccaaagaaacaaaacgaatgatcgacctcatccggaatttcatcggctaccgggaatatccaaaatacggaatggtcagccgcttcttcatttataagcaggctttactgaaagaagccgatcaactcgtacaagcgggcgttattcatgaaaaggaagatatatactacctcacttttgaagaatttcacgaagccgttcgcacaaaaaaaatagatgacaagatcatcagcatacgaaaagacgagtacaaattatatgaaaaactaaccccgccacgtgtgatcacgtctgatggtgaaatcattacaggtgattacaaacgagaaagtttgccggcgaatgcgattgtaggtctacctgtttcttccggagtgatagaaggaagagcgcgtgtcattttaaacatggaaaatgccgatctggaagacggagatatattagtcacctcctttaccgatcctggctggacaccattatttgtatccataaaaagcctggtcactgaagttggcggactgatgacccatggagcagttatcgcacgcgaatatggcctgccggcagtggtcggagtggagaatgctacccaactgataaaagatgggcagcgaattcgcgtgcacggcacagaagggtatatcgaatt

SEQ ID NO: 643 - DNA, 2387 bp, Bacillus licheniformis
atgttctcaagtaaagaaagctttaaacaatgctttttgaaacgtgttgaacggttgtgcggaaaaagctttcgggactcttcaacgcttgaccagtatcagacgctcggcatcatggtcagggaacatatcagcgcaaactggatcgagaccaatgaaaggagccgctccaaccaaaataaacagacctattacttatcgattgagtttctcctgggcagactgctcggccaaaacctcctcaatctcggggttcgtgagattgtcaaagaaggtcttaccgagcttggcatttgtcttgaagacatcgaagaggccgaaatggatgcaggccttggcaacgggggattgggcaggctcgcggcgtgctttttggattcactggcttcgctcgaccttcccgggcatggaatggggattcgctacaagcatgggtttttcgaacaaaaaatcgtcgacggtcatcaagtcgaattgcctgaacaatggctcaaacatggttacgtatgggagatccgcaacgccgatcaggctgtttgtgttcgtttcggcgggcgggtcaagatggcgcaggaaggagggcgcctccgcttttggcaggaagatgcggaagtgatgacagccgtgcctcacgacatcccaatcatcggctatgagaccaagacggtcaacacccttcggctgtggaatgcggagccttgctcgctccatcatgaaccgaatattttgaagtataagcgcgagacagaagctgtatctgaatgcctgtatccggatgacacgcatgacgaaggcaagattctccgtttgaagcagcagtattttttagtatcggcaagcctgcaaagcattgtgaaacgctataagaacactcacccgtcactgcatgattttcaccaaaaagtcgcgatccatatcaatgacacccatcccgctttggcggtgccggaattgatgagaattttgcttgacgaagaaaaaatgacgtgggatgaagcgtggcatgttaccgtacatacgatctcatatacgaatcatacgacgcttgccgaagcgctggaaaaatggaggatcgatttaattaaaccgcttctgccgagaatttatatgatcattgaggagatcaatgagcggttttgcggctggctgtgggaaaaatacccgggtgaatgggaaaggatcgaaaagcttgccgtcatcgcccacggcgaagtgaaaatggcccacttggcgattgtcggcagctacagtgttaacggtgtcgccaacattcattcgaccatattaaaagagcgggaaatgaacgacttttattccgttttcccttttaaattcaataataaaacgaacggcatctcacatagaaggtggctgttaaaggcaaatccgccgcttgcgaacttgataactgaagcgataggagacaggtggctgaaagatccggaaagccttctggatcttcgtccatttgcgaacgattccgcgtttctcgagtcgtttcagcgcattaaaagggaacgaaagcagcttttggcagacatgatgaaaggcagcgtcggcttcgccgtcaaccctgacagcatcttcgatgttcaagtcaagcgtctccacgcttataagcgccagcttttaaatgtgctccatatcatgtatttgtacaacaggctgaaggaagacaaaggctttgccatttatccgcaaacctttattttcggagcgaaggcatcgccgacttatcattatgccaaaaaggtcatcaagctgatccattcagtcgcagataaaatcaatcatgatccggatgtcagacattcgatcaatgtgatctttctggaaaattaccgggtatcaaccgccgagcgtatttttccggcgtcagatgtcagcgagcaaatatctgcggccagcaaagaagcctccggaacagggaacatgaagttcatgattaatggggctttgacgatcggcacgcatgacggcgccaatattgaaatgcttgagagggtggggacagagtgtatctacacgttcggtttaaaggcggatgaagtgctggactacgcggaaaaaggcggctatctgtcaagggaatactatcagcatgatgcaaggatcagacaaacggccgatcagctgatcaatggttttttcgaaggagaagccggcgaatttgagccgatttatgactcgctgatcgcttataatgatgaatactttgttttaaaagattttgcttcttatattgtagcgcaggagcggattcaaaaagactacttgaataagcgtctttgggctgaaaaagccgtcacaaacatcgcgcatgccggatatttttcaagcgaccgcaccatccgggagtatgcggacgacatttgggaaattaagcc

SEQ ID NO: 644 - DNA, 1703 bp, Bacillus licheniformis
atgagccaatggtggaaagaggcagtcgtgtatcaaatttacccgcggagtttttatgattccaacggagacggcttcggtgatttgcagggggtgattcaaaagctcgattacatcaaaagccttggagccgatgtcatatggctgtgtcctgtgtttgattccccgcaggatgacaacggctacgacatcagcgactatagaagcatatacgaaaagttcgggacgaacgatgatatgtttcaattgattgatgaagtgcataaacgcggaatgaaaatcattatggatcttgtcgtgaatcacacgtctgatgaacatgcctggtttgccgaaagccgcaagtcaaaggacaatccttaccgtgattattatttttggaaggatccaaaggcggacggttcagagccgaacaattggggatcgatcttttcagggccggcatggacgctcgatgagcggacaggacagtattatcttcactacttttcgaaaaagcagcctgacttaaactgggagaatgaagcggttcgccgcgaagtatacgatttgatgacattttggatggacagaggcgtggacggctggcggatggacgtgatcggttccatctccaaattcgtcgactttcccgattatgaaacagatgacagccgtccatatgtcgtcggccgctatcattcgaacggcccccgtctgcacgaatttatacaagagatgaaccgggaagtgctgtcccgttacgactgtatgacggtcggcgaagcaaacggctcagatgttgaagaagcgaaaaaatacacggatccaagcagacatgagctgaacatgatttttacatttgaacatatggatattgataccaaacagcattctccgaatgggaaatggcagatgaagccgtttgacccgatcgctttaaaaaagacgatgacgaggtggcagaccgctttaatgaatgtcggctggaatacgctttatttcgaaaatcatgatcagccgagggtcatatcccgctggggcaatgaccgcgagctccgcaaacaatgcgccaaagcatttgcaacagttctgcacggcatgaagggaaccccgttcatttatcaaggtgaagaaatcggcatgacaaacagcgagatgccgctcgaaatgtatgatgatctcgaaatcaaaaacgcataccgcgaacttgtcattgaaaacaaaacgatgacagaggaagactttcgaaaagccgtggcgaaaaaagggcgggatcatgcgagaacgccgatgcaatgggatgacgggaaatacgcgggctttacggatggagagccttggctggcggtaaatccccgctatcaagaaatcaatgtgaaagagtcgcttgccgatgaagattcgattttctattattatcagaagctcatcgggctgcgcaaacaaaataaagtcatcgtgtacggagactatcggctgctgctcgaggaagatccgcgaatctttgcgtatatccgcgaatatcggggcgaaaagctgttagtcgccgtgaatttatcagaagaaaaggcgctgtttcatgcttcgccggaattgcttgaggacagatgggatgtgctgttgtcaaactacgcccgagagcggcttaatataagcggcagtatcgacatggagccttatgaagctttcatgatgatcagccgggcaaaggattacacatc

SEQ ID NO: 645 - DNA, 2020 bp, Bacillus licheniformis
atgaaaaagagaatgattcagatggggatcataggggctatgatgttcccggaagccttttccgcagctgctgccgacccggactactataacgaggatcatcggcccaagtatcatttcacgccggaagcaaactggatgaatgacccgaacgggatggtgtattacgcgggggaatatcatctgttttatcaatatcatccatatggcttgcgctgggggccaatgcattgggggcacgcggtaagcaaagatttagtcaagtgggagcatttgccggtcgcactgtatccggatgaaaaaggaacgattttttcgggcagcgctgtcgccgatcggcataatactacagggtttcaaacagggacggagaagccgctcgttgccatttatacgcaggaccggagcggggaacaagtgcaaagcatcgcctacagcaatgacaaaggcaggacatggacgaagtactcaggcaaccctgtcattccaaatccgggaaaaagagatttccgcgatccgaaagtcatttggcatgaacagacaaaaaagtgggtgatgttgcttgcggggggcgatcgaattctgatctatacatcgcctgacttgaagcggtggacatatgcgagcgaattcggcgaaggagagggcagccatggaggcgtgtgggaatgtccggatctgtttgagcttcctgtagagggcaggccgaatgaaacgaaatgggtgatgcaagtcagtgttggagacggtgctgtctcaggaggatcaggcatgcaatatttcgtcggcagttttgacggaacaacctttaaaaatgaaaacccgccgaatcgcgtactatggacagattacggcaaagacttctacgcagctgtcagctggtctgatatcccgaagtcagacggacgaaggctttggttagggtggatgagcaattggcaatacgcaaacgatgttcccacttccccgtggagaagcgcaatgtcgatcccgagagaagtaaaattgaaagcgttttccgaagggcttagaatgattcaagctccggtagcggagctgcagtcgatacggggagcatcgcaaacgtggaaaaacaagatcatttcgcctcgaaacggaaatttgctgaaagggctgtcaggcgatgcttatgaaatcaatgcggaatttcaagtaaataccggagctgcggccgaattcggctttaaagtccgaacaggggaaaacgagtatacgaaaatcggctacagcaaaaacagcgcttcactgttcgtcgaccggagccaatcaggaaacgtctcctttaatccgaactttaacactggaaagcatgcggccccgctggaaccggtcgctgggaaggtgaagatgcgcatttatgtcgaccgctcttcagtcgaagtattcggcaacgacgggaggcaggtgatcaccgacattattttgccggaccaatccagcaaagggctagaagtatacgcatcaaacgggtttgtcaagctgaattccatgacggttcatcctctgaaaaaagtatggggagcgtcgccctttcaatcaaatttgaccggctggacgaccgtaaacggtgtatgggccgatacgattgatggaaaacaagggcgctctgaaggagattcgttcattttatcttcagcaaaagcaacagatttcacatatgaagcagatgtcgcgataaaggatggaaatggaagaggggcaggggctctcgtgtttcgggccgatcaggatgttaaaaacggataccttgccaatgtggatgccaagcatgacgtggtgaagtttttcaaatttgaagacggctcggcctctgttattgccgaacaccgcacaccgatagaaaccggccggaaatatcacctgaaaacggtggcccgcggtgcaaacttttatatttaccttgatgatcaattggtgataagcgcccgggattcaacgtttgccgatggagccttcggtttgaatgcatgggatgcgaccgcagtcttccaacatgttt

SEQ ID NO: 646 - DNA, 1797 bp, Bacillus licheniformis
atgaaaatcgtgttgatcaacaaaagcaaaaagtttttcgttttttctttcatttttgttatgatgctgagcctctcatttgtgaatggggaagttgcaaaagccgattccggaaaaaactataaaatcatcggctactatccatcatggggtgcttatggaagggattttcaagtttgggatatggacgtttcgaaagtcagccacattaattatgcctttgctgatatttgctgggagggaaggcatggaaaccctgatccgacaggccccaatcctcaaacgtggtcatgccaggatgaaaacggagtgatcgacgcgccaaatggaacaatcgtgatgggcgatccctggattgacgcacaaaagtcaaatcccggggatgtctgggatgaaccgatccgcggcaactttaaacaattgttgaagctgaaaaagagccaccctcatttgaaaacgttcatatcggtcggggggtggacttggtctaaccgcttttcagatgtcgcggcagatcctgcggcaagggagaatttcgccgcttcggccgttgagtttttaaggaaatacgggtttgacggggtcgatcttgactgggaatatccggtcagcggaggattgccggggaacagcacacgtccggaagataaaagaaactacacgctgctcctgcaagaggtgcgcaaaaaacttgacgctgcagaagcaaaagacggcaaggaatacttgctgacgatcgcatccggcgcaagtcccgattatgtaagcaacactgagctcgataaaatcgctcaaaccgtggattggattaacattatgacctatgactttaatggcggatggcaaagcataagcgcccataatgcaccgctgttctatgatccaaaagcgaaagaagcaggcgttccaaacgctgagacctacaatattgaaaacactgtgaaacgctacaaggaagccggtgtcaagggtgacaaattagtgcttggaacaccgttctacggaaggggctggagcggttgtgaaccaggggggcacggagaatatcagaaatgcggaccggctaaagaagggacatgggaaaagggcgtattcgatttttcagatcttgaaaggaactatgtgaatcaaaacggctataaaaggtattggaacgatcaagcaaaagtgccgtttttgtataatgcggaaaatggcaatttcatcacttatgatgatgaacaatcattcggccacaaaacggattttattaaagcaaacggattaagcggagcaatgttctgggatttcagcggcgattccaatcggacgcttctcaataaattggcagccgatttagattttgcaccggacggaggcaatccggagccgccttcatcggcacctgtgaatgtgcgtgtaaccggaaaaactgctacaagtgtcagcctggcgtgggatgcgccgagcagcggagcaaacattgcggaatatgtcgtgtcatttgaaaaccggtcgatatctgtaaaagaaacatcagcggaaataggcggcttgaagccgggtacggcctactcatttactgtttcagcaaaggatgcggatggaaagctccatgccggaccaacggtagaggtcacgacgaattctgaccaagcctgttcatatgacgaatggaaagagacgagcgcatacacaggcggagagcgggttgcatttaacggaaaagtgtatgaagcgaaatggtggacgaaaggcgaccggcctgatcaatccggtgaatggggcgtatggcggctgatcggaggctgcgaataa

SEQ ID NO: 647 - DNA, 2622 bp, Bacillus licheniformis
atgggacactatgtattgggctttcatgagatcgatcgaaccgatttgccgcttatcggaggaaaagggctgaacttgggcgaattgtcaaaaatggacggcatccaagtgcctcccggtttttgtataacaacaaaagcatatgaaaagatgatcggtgaaaacgataaggtcagtgaacagattgatcagctgtctcttttaaaagtgaaggacagaaaacagattaacgatcttgcccttcagatccgcaatggtattgaaagggccgaaatcgccgaagagatcaaagaagcggttaaaagcgctcactcaaatgctggcggcgatgcatatgcggtccgatcaagcgctacggcagaagatttgcctcatgcctctttcgccgggcagcaagatacgtatttaaatataaaaggaatagaggcgatcttgaagcatatcagcaaatgctgggcttcactgtttacagagcgggccgtgatctaccggattcaaaacggttttgaccaccgcaaagttcaattatcggtcgtcgtccagcagatggtgttcccggatgcgtccggcattttgtttacggcagatcctattacatccaaccggaaggtcacctcgattgatgcaagctttgctttgggagaggcgcttgtatctggtacagtttcagcagacaactacaaggttcgtgaaggcgcgatcattcaaaaaacgatttccgagaaaaagacggcagtctattctttggaaagcggcggcactgaggcgcgcgaagtcgaagcgggctgccggaaagagcaaacattaacagatgaacagatcatccggcttgaaaaactgggaaggagaatcgaagcccatttcggttttccgcaggatattgaatggtgtctggctgatggcgaatttttctttgtccagagccggcctataacgacattgtttcctcttccgaaacagagcgatgacaagcttcgcgtctatatgtctgtcgggcatcagcaaatgatgacagaaccgatcaatccgcttggaatatcgtttttcgggttgatctcggattatgagctgacttgtgccggcggaaggctttttattgatttatcacacgatttggcatcttttgcagggcggaaagtcgtcctcagtacggcggggaaaaatgatcctttcatgcatagcgctcttgtgaattttttgaaaagaaaggagcttgtcaaaaccctgccgaaagggaagcggatgtttagattaggggctgaagggctgtcatggtcgctgccgggtgatgcgctgaagatttaccggaaaaacgacacagatgtagtcaaacggctcatgtcgaaagcggaagcatccattcaagaggctgaacagcgattgaaaaacgcatcgggtgaaacgttatttgcacagatagaagaggatcaaaaaagcttgaaaaaagttctctatgattcagagagcatggctgtaattatggttggtttatatgccgtttactggctcaatcgaaaaatggagaaatggcttggcgaaaaaaatgtcgccgataccctttctcaatcggtattgtacaatgtcacatctgaaatgggattggcgcttttggatgtatcagatgctgccagaggataccccgaggttcagaagtatttagcatatgccaataatgaaaccttttttgaagatctcaaacagcttgacggcggtcccgcctttatcggcgcattgcgggcattccttgagaagtacggcatgcgctgcaccggtgagatcgatataaccaagacccgctggagcgaacgtccttccattcttgctccaatcattttgagcaacatcaagaattttgagcccggcgcgcgaacggctaagtttgaacaggggcgattggaagcggagaaaaaggagagggatttgttaagccgtctgcaacaactaaagggaggcagacaaaaggcaaaaaggacaaagaagatgatcagcgtgctgcggaattttatcggctatcgggaatatcccaaatacgctctgatcaaacgctatttcatatataaggaagcgttgatgaaagaagccgctgttttacagcaaaagaagctgatacaagcgaaggaggatatttattatttgtcctttgatgaattgaaagaagccgtgtgcacaaaccgtctcgatgtgaagaagatcgaggaaagaaaagcggaatatcggcattatgaaaaattgacgcctccgcgaatcatgacttcagaaggcgaggtcatcaccggagaagccttgggggatcacattccggcaggagcgttggcgggcgttcctgtttcatcggggatcatcgaaggaagggcaagagtgattctgaaattggaggaagccgatatcgaagagggggatatccttgtcacgccttttacagatccgagctggacaccgttatttgtctcaatcaaaggtttggtgactgaagtgggcggcctcatgacacacggcgctgttattgcgcgggaatacgggcttccggcggtggtgggggttgagcatgcgacgaaagaaattaaagacggacagaagatcaggattaacggatcggaaggatatgttgaaatactcgaatga

SEQ ID NO: 648 - DNA, 1719 bp, Bacillus licheniformis
atgcttgaattaaaaggaataagcgcttcagccggtattgcgattgcaaaagcatatcggcttgaggagcctgatctaacggttgaaaagaaaaacatctctgattctgatgcggaagtaaatcgttttgaagacgccatcgagcgttctaagaaagagcttgaaaccattaaaaaccatgctttgaaagagcttggcgaagataaagcggaaatcttttctgcacatttgttagtattaagcgatcctgaactgttaaacccgattaaagacaaaatcaaatctgattctgtcaatgcggaattcgctttaaaagaaacggccgacatgttcgtcaccatgttcgagtcgatggacaatgaatatatgaaagaacgcgccgcggacatccgcgatgtcaccaagcgtgtcacagggcatcttctcggcgttgagattccgaatccgagcctgatttccgaagaagtcatcatcgtggccgaagacttgacaccgtctgatacagcgcaattaaaccgcaactttgtaaaagggtttacaacagatatcggcggacggacgtcccactctgccatcatggcgcgctcgcttgaaattccggccgttgtcggcacaaaagcggcaacgaaaggcatccaaaacggcgtaacagttatcgttgacggcatcaatggcgatgtcatcgttgatccttcccaggaaacaatcagcgaatacgaagaaaagcatcaagccttcctggcgcaaaaagccgaatgggcaaagcttgtcaacgaaccgactgtaacgagcgacggccatcacgtggaacttgccgctaatatcggtacacctgatgatgtaaaaggcgttttggaaaatggaggagaagcagtcggcctttaccgaactgagttcctttacatgggcagagaccagcttccgacagaagaggagcaatttgatgcctataaaaccgttcttgagcgtatggaaggcaaatccgttgtcgttcgtactcttgatatcggcggagacaaagagcttccatatttagaactgccaaaagaaatgaatcctttcttaggatacagagcgatccgtctttgccttgatgagcaagagattttcagaacgcagcttcgtgcgctgcttcgggcaagtacatatggaaacttaaaaattatgttccctatgatcgcgactgtaaacgaatttaaagcagcgaaagcgattcttttagaagaaaaagaaaagctgaaagctgaaggccaacaagtttccgacgacattgaagtcggtatgatggttgaaatcccttcaacagcggtcatcgctgatcaatttgctaaagaagtcgatttcttcagcatcggaacgaatgacctgattcaatacacgatggctgctgaccggatgaatgagcgggtatcttatctttaccagccatacaatcctgcgattctccgcctgatcacgcttgtcattgaagcggctcataaagaaggaaaatgggtcggcatgtgcggcgaaatggcgggagatgaaattgcgatcccgatcctgctgggtcttggattggacgagttctcaatgagtgcgacgtcaatcctgccggcaagaacgcaaatcagcaagctttctaaaaaagagacagaatcgttcaaagagcaaattctgtctatgagcacaacagaagaggttgtacaattcgtaaaagaaaccttcaacctggcataa

SEQ ID NO: 649 - DNA, 2355 bp, Bacillus licheniformis
aagaaacctatatgtttacatttatgaaagaagagaataatgtgctggattttcatttgaatgacggtcatgcacatgcgaaaatattcattcttgaagaagatataattcggattttgctgacggagggagaagcgttaacgcttgaaaaaacgtggagtgtcgcgcctggacagatcgatgtgccatgggagggacgccatcgtttagacatgagcggatttacattgcctcaatacgaattccagcaagtcaaagatgtttttatcgtgaaaaccggcaaggtcaagcttcatgttcaattgaacggctttaggatcagctggttttatcacaatggttctgaatggatcaatgttgcaaacgatcggcaaacacaagggtataattttgaaggggcttttggaaagggcgtgtaccattatttacaacgcgatgtccaggaacaatattttggatttggcgagaaaacgggaaacgtcgataaacacgggaaacgctaccggatgttaaatatcgacgcgatggggtacgacgcagagcggtcagatccgctatacaaacatatcccattctatattacacgtcataagaaaacaggcatctcctatggaatgttctatgataatctatcagcttccatttttgatatgggttcagagcttgataactatcatggactgtaccgctattatcaggccgaaaagggggatttagactactacttcatagccggtccgaaaataaaagatgtagtcgaaacattctcttggctgacaggcaaaacgatcttgccgccaaaatggagcctgggctattcaggctctacgatgagctataccgatgcgccaaatgcacaagaacaattaaaaaatttcgttcgtctttgtgaagaacatgatatgttatgcgattcgtttcagttatcgtcaggatacacatctatcggtgataaacgttatgtctttaactgggatgagatcaaaattcctgctccaaaagagatggtgcaacacttccatgagaagggcgtccgtttatgcgccaacattaaaccgtgtttgctaaaggatcatccgtactttgatgaactacaagaaaaagacatgttcattgtaaacagagaaacacaaaaaccggaaatggcccaattttgggatgatatcggagcttatttagacttcacgaagcgccaaacgttcgactggtggaaggctcaagtaacagaaaagctgttggaatacggaattgattcaacttggaacgataataacgaatttgaaatatggagtcaaaatgccaagtgtcacggcttcggcaaagaagtggaatttgaactgatccgagcgcttcacccgcttttgatgatgaaagcgtctttcgaggcgcagctagaatacaacccggaattacgcccgtacctgatctcaagatccggctgtcccggcatgcaccgttatgcacaaacttggaccggtgacaaccgaacaagctggaaaacattaaaatttaatattaaaactggcatcggtttaagtttatcaggcatttacaatttcggccatgatgtcggcggattttcaggactggcccctgaaccggagctattcgtaagatgggtgcaaaacggtatcatgcatccgagatttaccattcattcgtggaacgatgacgggacagttaatgaaccatggatgtttccagaaacaatcgatgaaatccgtgaactcattaagtttagacataagatcatcccttacatttacaccgcgctatatgaggcgcacgaacattatcagccgatcattcgaccgacattttatgattttgaacatgatgagaaaacatttgaagagaacgatgaatttatacttggtgaatctttgctcgttgcatctgtcgtcgaaaaaggaatgacggagcgggaagtatatttaccgaaccatgaaaaaggctggtatgatttccatacgggaacatggtatgaaggagggaagacagtcgttctgccggcaccattacattatactccgctattagcgaaagcgggagcgatcgttccggtaaatgatgcaaaagtgacattccaaacaaagaaccaagatgaaagaggatttttgttattcccattcaaaggaaaaggaaaatcgacttatcgtttgtatgaagatgatgggttaacaaatgaatatactcatacatttgcctttatacatgtcgatatggagacaacagaagacgggatcaaactttcaatacaaaaggaaggaacatacgagttatcgtatgatcaactcacttttcacgtaccaaatggagaaaagagaaaactgatcgtaaatggcacagaactgg

SEQ ID NO: 650 - DNA, 1480 bp, Bacillus licheniformis
ttgattcaggcaaagacgcatgtgttttggtttgtgacaggcagccagcatttatatggcgaagaggcggtacaagaggtagaagagcattccaaaatgatctgcaacggattaaatgacggagatttaaggtttcaagtcgagtacaaagcggtggccacttcgctggacggcgtcagaaaactgtttgaagaggcgaaccgggacgaagagtgcgcaggcatcatcacctggatgcatacgttttcaccggccaaaatgtggattcccggcctttccgagctgaataagccgctgctccattttcatacccagtttaaccgggacattccgtgggataaaatcgacatggatttcatgaatattaatcagtctgcccacggcgaccgcgaatacggttttatcggagcgagattgggcattcctcgaaaagtaatcgccggatattgggaagacagagaagtaaagcgctcgatcgacaaatggatgagcgcagcggtcgcatatattgaaagccgccatatcaaagtcgcccgatttggggacaacatgcggaatgtggcggtaacagaaggagataagattgaagcgcagattcagcttggctggtctgtcgacggatatggaatcggcgatctcgtcacggagatcaatgctgtatcagaacagagtctaagcgagctcatctccgaatatgaggagctttatgagtggccggaaggcgaagcggcaagggaatccgtcaaggagcaggcgcggattgagcttggattaaagcgctttctttcgagcggaggctatacggcctttacgacaacctttgaagacctccacggcatgaagcagcttccgggtttggctgttcagcggctgatggctgaaggctatggctttggaggagaaggagattggaaaacggctgcgcttgtcaggatgatgaaaatgatggccggcggaaaagaaacgtcatttatggaggattacacgtaccattttgaaccgggcaatgaaatgatcctcggctcccacatgcttgaagtgtgcccttcgattgccgaacacaaaccgagaattgaagtccatccgctgtcaatgggtgcaaaggatgatccggcgcggctcgtgtttgacggaattgcaggtcctgcggtcaatgtctcccttattgatttgggcggacgtttcaggcttgtcatcaataaagtggaagctgtgaaggttccgcatgatatgccgaatcttccggtggcgcgcgtactttggaagcctcagccgtctctgagaacatcggctgaagcgtggattttggctggcggtgctcaccatacatgcctttcgtaccagctgacagccgagcagatgctcgattgggccgaaatgtcgggcattgaagcggtgttgatcaatcgtgatacaacgattttaaatcttcgcaatgaactcaaatggagtgaagctgcatatcggcttcgcaagtttt

SEQ ID NO: 651 - DNA, 1960 bp, Bacillus licheniformis
ctgtaccatggcgcttgcttttatcccgaattgtgggatgaggatgtgctggatgaagatatcaggatgatggagcgaatcgggatcaatgttgtcagaatcggggagtttgcctggtcaaggatggagcctgaaaaaggaaggatcgatgtcggattttttgcagacgtcatccgaaagctccgcgacaacaaaattgaaacggtcatgtgcacgccgactgcgacgccgccgatctggctgacccacgggcacccggaaagaatgcatgtgaatgaaaaaggggagacgatgggacacggttcgaggcagcatgcctgcacaaaccatccctatttcagagagcgggcccggctgatcatcaaacatatcgccaaagagatcggagaactgccgggattgatcggatggcagcttgacaatgaattcaaatgccatgtcgcagaatgcatatgtgaaacgtgccgcacattatggcacaaatggctggaagaccgctatcagacgattgaccgtctgaatgaggcatggggtacgggcgtatggagcgaaacgtatcagtgcttcgagcaagtcccgcagcccggaccgaccccgtttttgcataattcttctttaaggacaatgtatcagctgttttcgatggacaagatttctgaatttgcgcgtgaacaggctgaggtgatcagagcatactccgatgccccgatcacccataatagcagcgtcatgttcggcgttgatcatgaagaccttttcaagagccttgattttgcctcgtttgatacgtacgccagccaggaaaacagtcaagcctttttgtttaattgtgatttatggagaaacatcaaaaaaggacggccgttttggattatggagacgagcccttcctacagcgcttcgcttgaaagctatgcggcgcctcatcaaaacggctatttgaaagctgaagcggtttcttcttatgctcttggcggagccgcgttctgctattggctgtggcgccagcagagagccgggtctgaacagccgcacggatcagtgctcagcgcatggggggagcctgatgtgggatatgaaaatgtgctcgaagccgagcgggcaagacgagaggttgaacacatcatgctggctacggctcctttgcaggctgaaacagctgtcgtctattcggaccgtgcgaaggtgtttttgaaaacggagcctcatcggggtcttcattacagaacgctgatcaccgagttttatgaccgattattaaagatgggcattcacagggatgtcattcttgaagggagcccgctggacggctacaaactgctgtttacgccgtttattcattatcttccccctgcttttatcaaaaaagccgaagcatttgcacaaagcggcggcatttggattgcgggtccgctgacgggcggaagaacagagcaccatacgattcacactgattgcggattggggcctttagaaaaatgttctggtgttaaaacgctgtttacattcccgatggatgagcggaactcaagcggaacggcgtttggcgtaaaggcgccgctgagcttgtggagcgctgtttttgaagccggcggcaccaaggctgtcgggatgattgagaaaggcccggcgtcaggcaaagcgttcatcacggaacacaaatgcggaaaaggcaaaatcgtcatgctcgggtcgatgccggcaggcgaagcgggggacatcatgatgaaaaagctgatcagccattatgccgaagaagcgggcgttgagcagaaaaccgatgtcactcccggaacagtcgtcgcgccccggaaaggagcagacggtcttgtctgggtcgtgatcaatatggacggcaaaggaggcgcagtgacacttgacggcaacggaaccgatcttttatccggcaggcccgtaaccggacgcgtaacactcggcccgcacgactaccgcgtgattt

SEQ ID NO: 652 - DNA, 1676 bp, Bacillus licheniformis
atggcaaatcagcggctatttgagatcgaccagtggaaaatcaaaacaaacaaatttgaaaaggaacataaacggcttcaggaaagtctgacatccttggcgaacggatatatgggaatcagggggaattttgaagaaagctattcaggcgaaagtctcaaaggcacatatatcgcaggggtttggttccctgacaaaacgcgtgtcggctggtggaaaaacggctatcccgaatatttcgggaaagtgatcaatgcgatgaatttcatcggaattgatgtatatgtagacgacgaaaaagtcgacctcagccaaaacgacatcgaatcgtttgaattggagcttaatatgaaagaaggcatcttgcggagaagcgctgtcgtccgtgtgaatcaaaaggctgtcaaaatttcgtccgagcgctttcttagcctcgatgtcccgcaactgtgcgcgatccattatgaagcggaatgcctgagcgatgaagcggtcatcacgcttgttccttatcttgatggaaatgtcgcaaatgaggatgccaatttcgaagagcggttttggcaggaagaagcgaaaggcgccgaatctcatcgcggccatcttgtgacgaaaacgattgagaatccgtttggaaccccgcgttttacggtggctgcttctatgtgcaatgtgacggaaggatatgtcagcgagcattttcaaacggatgcaatgtacgcggaaaaccgctactgttacgaagtgggaccgggaacaaaggcttctttaaagaaattgatcattgtcacaacgtcccgggattttgaagaagcagagcttttagtacagggcagggcgcttttggcggatgttcttcggcagggatatgaagaagcgaagcggaggcataccgaacattggatggaaaggtgggcaaaagcggacattgaaattaaaggggatgatgagcttcagcagggcatccggtacaacctctttcagctcttctcgacatactacggagccgattcacgcttaaacatcgggccgaaaggatttaccggcgagaaatacggaggagccgcctattgggatactgaggcgtacgccgttccgatgtatttggcgacggcagagccggaggtgacgaagaatctgcttttgtaccgctatcatcatttggaggcagcaaaacggaatgccgccaaactggggctgaaaggagccctttatccgatggtcaccttcacaggcgatgaatgccacaatgaatgggagatcaccttcgaagaaattcaccgcaacggcgcgatctgttatgcgatctacaattatgtcaattatacaggcgaccgggactacatgaaagaatacgggatagacgttctcgtcgaaatcagcagattttgggcggaccgcgtccacttctcaaaacgaaacaataaatacatgatccacggcgtcacagggccgaatgaatatgaaaacaatgtcaacaacaactggtatacgaacttgattgcgtcatggacgcttgagtacacgctcgaaaacctcgctatcctcccggaggaaaaacgccgccggcttgatgtacgggaagccgaaatcgagaaatggaaggatatcatcgagcgaatgtactatccatacagtgaggaattaaatgtttttattcagcatgatactttcct

SEQ ID NO: 653 - DNA, 1877 bp, Bacillus licheniformis
atggctggtgtgagtgcctcggatattaaagcgcatctctttcatgaaggtcggctttatgaaagctacaggttcttcggcgctcatcagacggaacaggacggccgccaaggcttccgtttctgtgtttgggccccgcatgcgaaggaggttcgaatcgccggaacgtttaacggctggtccggtgtcctgcaccgaatggaaaagcgtcatcaggaaggcatatgggaactgtttatccccggtattggagaaggggagctgtataaatatgaaatgattacagccgcaaatgaaacgaaattgaaggctgatccttatgcttttttttctgaagtgaggccgaaaacggcatcggtcacttatcaattggccggataccaatggggcgaccggaagtggcaaaagaaaaagcagcaaaaagccgtgtatgaaaaaccgatttccatctacgagcttcatatcggttcgtggaaaaagaaagcggatggacgttttttcacataccgggaactgagcgaaacggtcattccttacgtcaaagaacacggattcacacatatcgagctgatgccgctgacagagcacccgtttgaccgttcatggggctaccagacaacagggtactacagtccgacgagcagatatggcgaaccgcatgacttgatgtatttcatcgaccagtgccatcagcatgagatcggcgtcattatggattgggtttccggccatttttgcaaagatgaccacggcttgtatttgtttgacggtatgcctctgtatgaatataaacacgagcatgacagggaaaattgggaatgggggaccgccaattttgacctcggaaaacgagaagttcacagttttttaatctcgaatgcgttgtattggatcgagatgtatcatatagatggatttcgagtcgatgcggttgcgaacctcctgtattggccaaaccgtcctcagcctgaagcgaacggctttgcgatcgaatttattcaaacgttaaatgaacaggtttttgcaaaagatccccactttttgatgattgcagaggactccacagactggccgcttgtgacgcatccgacctatgaaggcggtctcgggtttaattataagtggaatatgggttggatgaacgatgtattaacctatatggaagcttccccagaacaaagaaaacacctgcatcatcttgtttcattctccttaatgtatgcctactcagaaaattacatcctgccgttctcccacgatgaagtggtgtaccgcaaaaagtctctgcttcataagatgcccggcgattattggcagaaattcgcccagtaccgcctgctgatcagttattttatgatgcacccgggaaaaaagcttctttttatgggcggtgagtttgctcaatttgatgaatggaaagacgaagaagagctcgattggtttttggacgattttgacatgcaccgcaaagcccgaatgtttacaaaggaggctctacacctctacaaaaaaagccgtatcctgtatgaaaatgatcatcggcagcaaggattcgagtggattgacgttaacaatgcggaacagtcgattgtatcgtttatccgctatggaaaacagcccggtgaagcgctgattatcgtctgcaatttcacgccttccgtctatcacgaatatcgggtcggcgtcccttttcaaaccgaatatatcgaagtgcttaacagcgatgatgcaaaatacggaggttcacaccaaatcaacccaaaacgccttcaggcaagaaaaggcgttctgcacggcaaaccatacagcatcagcatgacagtccctccgctgggagctgcggttttcagagcagtcaaaaagagaggagcgaaaaa

SEQ ID NO: 654 - DNA, 1762 bp, Bacillus licheniformis
atgatggaatatgcagcgatacatcatcagcctttcagctctgatgcctattcttacaatggacggacattgcacatcaagatccgtacaaaaaaggatgatgccgaacacgtccgcttggtttggggcgatccttacgaatacaccggcggaacatggaaagcgaacgagcttgcgatggcgaaaattgccgcacaagcaacccatgattaatggtttggccgaagtgggcgcctccattcagagcgtctgcaatacggatttatcctgacaggcgctgatgatcgagacactttttacggaagcaatggtgcatgtccgtttgccgggaaagcggcggatataggcaaacactgttttaaatttccgtttgttcatgaggcagacacgtttgatgcacctgactgggtcaaatcaaccgtctggtatcaaatttttccggagcgctttgccagcgggcgggaagatttgtctccggaaaacgctttgccatggggaagcaaagatcctgaggcgcacgattttttcggaggggatttgcaggggatcatggacaagctggactatttggaagacttgggggtaggcggaatctatttgacgccgatctttgccgcgccttccaaccataaatacgacacattggactattgctccatcgatccgcattttggcgatgaggagctctttcgcacgctggtcagccggattcacgagcggggaatgaaaatcatgcttgatgctgtttttaaccacattggcagcgcttcgcaagagtggcaggatgttgtcaaaaacggtgaaacgtcccgctataaagactggttccatattcattctttccctgttaaagaaggcagctatgatacatttgcgtttactcccgagatgccgaagctcaatacggccaacccggaagttcaggcttatttgcttgatattgcgctgtactggatccgcgaatttgatatcgacggctggcgtttggatgtggcaaatgaagttgatcatgcgttttggaagaaattccggcaagccgtcacggcagaaaagcccgacatttttatattgggcgaaatctggcatcaggctgatccgtggcttagaggagacgaatttcattcggtcatgaactacccgttcacagaaccgatgattgactattttgcagacggatcgatttcagcttcgcaaatggccagccgcatcaattcgcatttaatgagcgggatgaagcaggtcaatgaggtgatgtttaatttgctggacagtcatgacacgaagcggattttgacaagatgcggaggagatgacaaaaaggtgcgctctcttttggcattcatgtttgctcagacaggctcgccgtgcatttattacggaacggaagtcgggcttgacggcggcgatgatccattgtgccggaagtgcatggtttgggaagaggaaaaacagaatcaagagatgctcgcatttatgaaacggctgatcgctttgcgaaaacaagagaatgatgtattgacttatggcgcgcttgagtggaagctggttgatgaccaaaacgattttgtcagtttttctcgaacgcatgaaggaaaagagctgatctacttcttccaccagggcagcgaggtgcgccgtgtcagattgcgggatttgaagattgcaagcgataaaagaatatacgatgcgtggacggaagaagcgcttcagcatgatgatgtggtcgacattcagccaggcggatttttcattttgggggcgg

SEQ ID NO: 655 - DNA, 1683 bp, Bacillus licheniformis
atggcaagggcatggtggaaagaggcagtcgtttatcaagtgtatccgcgcagttttatggattcgaacggggatggcgtcggagatatcaacgggatcagagagaagcttccgtatatcagggagctcggggcagatgccatttggatttgtccggtctttgattctcccaatgcagataacggctacgacatcagggattatcaaagcatcatgccggaatttggcacgatggacgactttgacgaactattaactgaagcgcatcagctcggaatgaaactgatcatcgatcttgtcatcaatcatacgagcgatgaacatccttggtttatcgaatcaagagcagagcggaattccgggaaacgggactggtatatttggcatgacggaaaggacggaagcgaaccgaacaactgggaaagcatattcggcggctcagcctggacttatgacgaaaaaacagagcaatattatctgcacctttttcacgaaaagcagcctgatctgaattgggaaaacagtgatatgcgaagcgctctttatgacatgatcaactggtggcttcaaaaaggaatcgacggattcagggttgacgcgatttcgcacattaagaaaaaagaagggctgccggatctgccgaatccggaagggcgccctttcgtgccttcatttgcttatcatatgaatgtcgaagggattatggcgttattgcaggatgtaaaagagaatacgttcgccgggtatccacatatcatgacagtcggcgaagcaaacggtgtcagcgctgaagaagcggaggactgggttggagaaccaaacggtatattcagcatgatttttcaatttgaacacctcgggctttgggatattgaaggcggagaacccgatatccccgaactcaagcggattttgtcaaactggcaatctgctcttgaaggaaaaggctggaacgcgctttttatcgaaaatcatgatcagccccgggccgtttcagtttggggagatgacgggaaatacagaacagtcagcgcgaaggccttagctgcaatgtattttttgatgaaaggcaccccgtttatttatcaagggcaggaaatcggaatgacaaacgcgattttcttagatatagacgattatgatgacgtctcgattaaaaattattaccggattcaaaaagaaaagggccgctcacacgaagacatcatgaaggcggtatggaaaaagagcagggatcacgcgcgcacgcctatgcaatggactgatcggccaaatgccggctttaccaaaggggaaccgtggctgcgcatgaacgaaaattacaagctgatcaatgtcgttcatcagcagcatgacccccggtcggtctatcatttttataaacggttaatcgcaatcagaaaacggtatgacgtcttcatcgacggatcatataaactgcttctggctgaggatcggcagatttttgcatacttgcgaaagcttgaagaagaaaccgccatcgtgatcgtgaacctcagcgcacgccaggcgttttaccatcatcccgcatatccgttatgttcgaacggactgctgctgtcaaacttggatatcaacgcgcacaagcacctcacatctttcatgatgagaccctatgaggcgcgcgtttatttgatcagacaggaaatcggcgatttgtaa

SEQ ID NO: 656 - DNA, 1499 bp, Bacillus licheniformis
gtattatgccaaaaatttatacgacccaagcaagatacatgcttcacgggggagactacaatccggatcagtggcttgaccgtccggatattcttgcagatgacatcaagctgatgaagcttgcccatacgaatacattttcagtggggattttttcatggagcgcccttgagccggaggaaggcgtctatacgtttgaatggctggatgatatttttgagagcattcaccggaacggcggccggattatattggcgacaccgagcggcgcccgtcctgcttggctgtcgcaaaagtatccggaagtgctgcgcgtgaatgctgaacgcgtcaaacagctgcacggcggaaggcacaatcattgcttcacttcatacgtataccgtgaaaaaacgaaagagatcaaccgcatgctggctgaaaggtacggcagccagcatgcccttttgatgtggcatgtttccaacgaatacggaggagaatgccattgtgatcaatgtcagcacgccttcagagactggctgaaaaagaagtacaaccatgatattaaatctttgaatgacgcatggtggacgcctttttggagccacaccttcaacgattggtcacagattgaatcgccgtctccgatcggggaaaatgcggtgcacggcttgaatttagactggcgacgcttcgtcactgaccagacgatctctttttttcaaaatgaaatcgttccgttaaaggaaatcacgccgaatattccgattacgaccaattttatggcggacacgcatgatttaattccgtttcaagggctggactacagcaagtttgccaagcacctggacgtgatcagctgggacgcgtatcccgcctggcacaacgattgggaaagcacagcagatttggccatgaaagtcggctttatcaatgatttgtaccgcagcctgaaacagcagccgtttctcttaatggaatcgacgccaagcgctgtcaattggcacgattttaataaagcgaaacggccgggcatgcacctcctgtcttctgtgcagatgatcgcacacggatctgacagcatcctctattttcaatggcggaaatcccgcggctcatcggaaaaatttcatggtgcggttgtcggccatgacaattgttccgagaaccgcgtgtttaaagaagtggcaaaagtcgggcaaacccttgaagcgctgtctgaagtcaccggaacgatccggcctgcggatgtcgcgattctctacgattgggaaaaccattgggcgctccaagatgcacaaggattcgggatgaaaaccaagcggtatccccaaaccctgcacgagcactaccgcgcgttttgggagcgtgatattccagtcgacgtgattacgaaggaacaggatttttcatcgtaccggctgctgatcgttccgatgctttacttagcaagcgaagaaacaatcgcgcgccttaaggcatttgctgccaacgggggcacattggtgatgacctat

SEQ ID NO: 657 - DNA, 1689 bp, Bacillus licheniformis
atggaaacgaaagaaaatccatggtggaaaaaagcagtcgtctaccaaatttatccgaaaagctttaaagatacaacaggaaacggtgtcggcgacatacgcggcatcatcgaaaagctcgactacatcaaggagctcgcctgtgatgtcatttggctgacgccgatttatcaatcgccgcaaaacgacaacggctatgacatcagcgactattacagcatccatgaagaatatggaacaatggccgactttgaagagcttcttgaagaggcccacaagcgcggcataaaggtgatcatggatcttgtcgtcaaccatacatcaacagagcacagatggtttaaagaagcggcgtccggcaaagaaaatctgtaccgcgacttttatatttggaaagacatgaagccgaacggcgctccgccgacaaattgggaatcgaaattcggcggctcggcgtgggagtttcatgcagagagcggacagtattatctccatctctatgatgtgacacaggcggatttgaattgggagaatgaagcagtcagaaaaaaagtgtacgagatgatgcatttctggtttgaaaaaggaatcgacggcttcagacttgatgtcatcaatgtcatctcaaaagaccagcgtttccctgatgatgacgagggggacggacgcagattttatacggacgggccgagggttcacgagtttttgaatgaaatgaacagggaggttttttcaaaatatgacagcatgacggtcggagaaatgtcatcgactacaatcgcagattgcatccggtatacaaaccccgaaagccgtgagctcgatatggtgtttaactttcatcatttaaaggccgactatccaaacggggaaaaatgggcgcttgcggattttgattttctaaagctgaagaagattctttctgaatggcagacggaaatgaataaagggggcggatggaacgcattgttctggtgcaaccacgaccagccgcggatcgtctcacggtacggggacgacggaaaataccgcaaaaagtctgcgaaaatgctggcaaccgcgattcatatgcttcagggaacgccatacatttaccagggagaagagcttgggatgaccaacccgaaattcgatgacatctccctttacagggatgtcgaatctctcaatatgtaccgtatcctgaaagaagcagggaagccggaagccgaaatcatcgaaatcttgaaagcgaaatcccgtgataattcgcggacgccggtgcagtggaacggagaagaaaatgccgggtttacggcgggcacaccgtggattccggtgcctgacaactacaaagaaatcaacgcagaagaagcgctcaacgatcctgattcgattttctaccattataaaaagctgaatgagctccgcaaggaattcgatatcattacaaccggcgattatcagctcatactggaagacgatcaagagctttacgcgtatttgagaaacggagcggatgaaaaactgctggtgatcaataatttttacgggaaagagaccgagtttcagctgcctgacgatattgatattgaaggctatgatgccaaggttctcatttccaatgacaccgatcttcccgagtcatttaaacgcttcacagtgaaaccatatcaatcgattgtttatcatcttgccaaaccatgctaa

SEQ ID NO: 658 - DNA, 1404 bp, Bacillus licheniformis
caaaacaacaaataggtgtagttggtttagcagtaatgggaaaaaacttggctttaaacattgaaagccgcgggttttcagtttctgtctacaacagatcaagcgagaaaaccgaagagtttctgaaagaagccgaaggcaaaaacgttgtcggtacatacagcattgaagagtttgttgaatctcttgaaaaaccgcgcaaaattcttttaatggtcaaagctggaacaccgacagacgcaacgattcaatcgcttctgcctcatcttgaaaaaggcgacattttgattgacggcggaaatacatattataaagatacgcagagaagaaacagggagctggccgaaagcggcattcacttcatcggcaccggcgtttccggcggtgaagaaggcgctctgaaagggccgtctatcatgccaggcggacaaaaggaagcccatgagcttgtcaagccgattcttgaagctatttctgccaaggtggacggcgaaccgtgtacgacatacatcggtcctgacggcgccggccattatgtaaaaatggttcataacggcatcgaatacggcgatatgcagctgatctcagaatcctactttattttgaaacacattgtcggtctgtcatcagatgagcttcacgaagtcttttccgagtggaataagggagagcttgacagctatctgatcgaaatcacggctgatattttcacgaaaaaagacgaggaaaccggcaagccgcttgttgacgtcatcctcgataaagcaggtcaaaaaggcacaggaaaatggacaagccaaagcgctcttgacctgggcgttccgcttccaatcattacggaatctgttttcgcccgcttcatctcttccatgaaagaggagcgcgtcaaagcgagcaagcttctggcaggacctgaagcgaaacctgccgctgagaacaaagaagagctgatcgaagcggtcagaaaagcgctcttcatgagcaaaatctgttcttacgcccaaggctttgctcaaatgaaagccgcatcagaagaatacggctgggatttgaaatacggcgatatcgcgatgattttccgcggaggatgcatcatccgcgcggcgttcctgcaaaaaatcaaagaagcgtatgaccgcgatccagagcttgacaacctgcttcttgacccgtacttcaaaaatatcgttgaaagctatcagggagccctccgcaaaacgatttctcttgcggttgaacaaggaattcctgtaccttgcttctcaagcgctctcgcttactttgacagctaccgcactgcaaccctgccggccaacctgattcaggcgcagcgcgactactttggcgcccatacgtatgagcgtacagataaagaaggcattttccacactgagtggatgaaat

SEQ ID NO: 659 - DNA, 1915 bp, Bacillus licheniformis
atgaaaagatttcttcaatgcgcgttgattgcattgctgttatcgtctctcgctttgcagccggccgctcgcgaagcagaagcaaaacagcgtccggaacaaaacatcaaacaaatggtcagcagcatgtcgcttgaagagaaaatcgggcaaatgctgatgcctgactttagaaactggaagaaaaaaggggaatcgagcgccaaaggattaacagaaatgaatgacgaagttgctggaatcattgaaaaataccggctcgggggcgtcattctttttgctgaaaacgtcacaggcacagagcagactgtacggttaacggacggcctgcaacaagcgagccctgacattccgctctttatcacgatcgatcaggaaggcgggattgtcacgagactcgaatcaggcacaaacctggccggcaatatggcagtcggagcatcgagaagcagcaaaaacgccttcagatcaggaaaaatcatcggaaaagaattatcatcactgggcattaacgtgaatttcagtcctgtacttgatgtcaacaacaatcccgacaaccctgtcatcggcgtccgttctttcagttccaagcctgagctgacttcaaagctcggcatccagatgatgaagggccttcaggacgagcaaatgatcgccacagcaaagcactttcccggacacggcgatacagcggttgacagtcattacggattgccgcttgttccgcataatgaaaaaaggctgagaagtgttgaacttgcgccatttcaaaaggcgatcgatgcaggtattgacatgatcatgacagcgcatgtccagttccccgcctttgacgatactacctataaaagcaaaaaagacggcgaggacatcatggtgcctgctacgctttccaaaaaagtcatgacagaccttctccgcaaagatctcagctttaagggcgttgttgtaacagacgctttaaatatgaaagccatttctgataatttcggacaggaggaagccgtcgtcatggctgttaaagcaggagtcgacatcgcactcatgcccgcgcaagtcacatcgcttgagaccgaaaaaaatctggcgcgtgtattcgaagctcttctgacagccgttaaaaatggggatatccccatggaacaaatcgatcagtcggtggagcgaatccttcaattaaaaatagaccgaggcatcatagatcacaccggctccgaaccgcttcagaaaaaaatcaaatacgccttgaaaacggtcggcagcagcaaacacatgaaatacgaaaagaaaatggcaagggatagcgccactatccttaaaaacgacaaaagcaccctgccgtttaaaccgaaaaaaggggacaccgtcctcattctcgctccatatgaagagcaaacagcagcaatcgcaaagaccatcagcaaaataaggaaaaacatcaaggtagtcgaataccgctttgcagaaaaaacgtttgaggaagagattcaaaagaaaattgacgaagccgattatgtcatcacaggatcatacgtcatcaaaaacgatccggttgtgaacgacggtgtcattgatgacagcattcaagactcaagcaagtgggcaaccgcttttccgcgcgccgccatgaaatacgcgcaggccaacggaaaaaaattcgtcttaatgagcctgagaaacccttatgacacggcaaattttgaagaagccgaagccgtgattgcggtatacggctttaaaggctatgcaaacggacgcttcaggcagccgaatatcccggccggagtggaagccattttcggaaaggcaaagcctaaaggaacattgcccgtagacattccttcagtcacgcgccccggggaaaccctttacccgtatggctacggattgaatattaaaaacggcaagccgcttc

SEQ ID NO: 660 - DNA, 1809 bp, Bacillus licheniformis
ttttttggctacaccgagcggtgccagaccggctttggatgtccaaaaagtatccagaggtgctgagaacggagcgcacagggtcagaaaccttcacggaaagcggcacaatcactgctatacgtcgcctgtctaccgccggaaaacggcgatcataaacggaaagctcgcggagcgctatgcgcatcacccggccgtcatcggctggcacatttctaatgaatacggcggagaatgccattgtgaactttgccaagacaagttcagagagtggctgctggcgaaattcaaaacgctggaccgccttaatgatgcatggtggacatcgttttggagccatacctatacagattgggacgagatcgagtcgccggctccgcacggcgaggatgccgttcacggtctgaatttggactggaagcgttttgtcacggatcaaacggttgatttttgccggcatgaaatcgcccacgtccgttcgtttaaccctgatctgcctgtgacgacgaattttatgggaacgtatgccggattgaattattggaagtttgccgatttgcttgatgtcatctcgtgggattcttatccggcatggcacaacagccggcaggaagacagccggcttggagccgatattgcttttgttcatgacatcaatcgctctcttaaaggcggccggccgttcatgctgatggaaagcacgccgagcatgacgaactggcaggatgtcagcaagctgaagcgccccggtatgcatgaattgtcgtcattacaggcagtcgctcacggatcggacaccgttcagtattttcaatggcggaaaagccgcgggtcaagcgaaaaatttcacggagcagtcgttgatcatgaaggatcagagcatacgcgcgtttttcaggaagtgaaaaagctcggggagaagctcgaaaagctggaagacgtcgcagggacgacagtcgaacccgaggccgcgattatatttgactgggagaatcgctgggctttggaagatgcccaaggtccgcgcaatatcggaaagcattatgaacggaccgccaaatcgttttatgaaccgttttggcgggaaggcgtaccggttgatgtgattcatatggaggccgatttctcccgctataagcttttggtcgccccgatgctctacatgctgcgagaaggcaccgctgaaaggattgaacagtttgttcaaaacggagggacatttgtcgccacttattggtcgggcattgttgatgagaatgaacttacgttcctgggagggtttcctggaggcttaagaaaaacgctcggcatttggtctgaggagatcgatgctcttcatgacggacagaaaaataccattgtgatggatgaagaaaacaggctcggattaagcggaagctatgaagccagcgagctttgcgatctgattcatttagaaggggccgaagcgctcgctgcgtacgaggatgatttttacgcgggccggccggcgctgacggtcaatttgttcggagacgggaaggcctactatatcgcttcaaggaatgaggcggcgttccaagaggcgtttatatccaggctcattgaagagtgcgggattgccaaagtgctcgatacagagctcccgaaaggcgtcaccgcccagctccgcacagacggccgccacgattatattttcgtgatgaattttacagcggaaaacagaagtgtctcgcttccggaggaaacaaatacggacgttttaaagggaacccggaaaaaaggcgcgctcaaactgccgccttacggaacgagcattttacggagaag

SEQ ID NO: 661 - DNA, 2103 bp, Bacillus licheniformis
gaaagccgcttcatcttttttatcttgtatgctgctcctcgcgctttttatcccgaaccggcagatttccgcagagacttcaagcgaaagaccggactgccgtccggaagggctatgggactcgggcgttgaacatgtgccgtattgcgatgtatacgacaaggacggccgtgaaaagctggccaatcagttagaccggagaatcatcggttactttacgagctggcgtacgggaaaaggaaatcaagatcgttatttagtaagcgatatcccctggaagtacttgagccacattaattatgcgtttgcccacatcggggaagatcatcggatttcagtcggagaagaggcagatgagaacaacccgtccatcgggatgacttggccggagcatcccgatgtaaaaatggatcaaaccttgccgtataaggggcattttaaccttatccatcaatataaagatagatacccggatgtgaaggttttggccgctgtcggcggttgggccgaaaccggcggctatgtcgacaaggacggaaagcgaattccaagcggcggcttttactcgatgacaacgaatggagatggatctgtaaaccacaagggtattcacacctttgcggaatcggtcgttgcgtttctcagaaaatatgagatcgatggaatcgatattgactatgagtaccctacatcgatgcaggatgcagggaatccggcagattggaacatcgccaatccgcggcgcaacgggttaaataaaagctttgaggcattgatgaaaacattaagagaaaagcttgatcaagcgtccgctgaagatggaaagtactacatgctgaccattgcagcaccatcctcggcatatttactgagggggatggaaacgtttaagccgcttcgatatgtcgattatgtcaatatcatgtcctacgatcttcatggagcctggaatgagtttgtcggaccgaacgcttctttattcgataacggcgaagatgccgaactcaagcagtccaacatttatactacgccggaatacgaagggatcggatatttaaatacggactgggcttaccattattttagaggggcagtagaatcgggacgaatcaatatcggtgtgccttattatacgagaggctggaaaaatgtgaccggcggagcaaatgggctgtggggaagagccaaaagcgcagattgccctcagggactcaggcaatgcggtgacggagcaaccggaatcgataatatttggcacgataaagatgagcaggggaatgaaattggagcaggggcaaacccgatgtggcacgccaaaaaccttgaaaagggcattgctggttcttatctggaaaggtatggattgagcaaggctgatttgacaggcgtttataaaaggcattatgacgcagggctggcagcgccttggctttggaatccagaaaagaaagtatttctatcgacagaggatgaggaatcgatcaaaacgaaggcggattatgtcattgataaaggaatcgggggtgtcatgttttgggatttgagcggtgattatgactggtatcccgaacgaaacggcagtaaaggagaatacggtatcggcaataccttaacgagaacgatgtatcataaattctcggatacaacaccatacgataatcgactcagcacatcacctttgcctgatgaatcactagatgcagaagtagagttgacgaactttccgttaggagatcaaaattacccgatccacccggtgatgaagctgatcaacaacagcgatgtcacgattacgggaggttcttttatcgaatttgatgcgccgacatccacttcccctcggtttagaagctggagcggcgatcatgttgaagtgatttctaaagggcatacgggaccgaacattggcggactgacagtagatttccaccgcatcagagtgactctatcaatctggaaaaccattaaacctggtgaggaagcggagtttcagcttgactattatttgccgatcagcggaacttcaaatttcacgatatcaatagatggcaaaaagtacaggcttaaaggaaattaagtatacggccgttagatgtgacagcc

SEQ ID NO: 662 - DNA, 1353 bp, Bacillus licheniformis
atgacgcatgtccgttttgactactcaagagcattgccattctttaaagaacaggagcttacatatctgcgtgacttcgttaaagtcgcccaccataccattcacgaaaaaacaggtgcgggcagcgactttttaggctgggtggatcttccgactgactatgataaagaagaattcgcccgcattaaaaaatgcgctgaaaaaattcaaaacgattccgatgttttgctggttgtcggaatcggcggttcatacctcggcgcaagagcagcgatcgaaatgctgaatcattcattttacaatgtgctgccgaaagaaaagcggaaaacgccgcaagtgattttcatcggcaacaacatcagctcttcttacatgagagacgtgatggatcttcttgaagacgctgatttttcaatcaacgtgatttctaaatcaggcacaacgacagaaccggcgattgctttccggatcttccgcaagcttcttgaagaaaagtatggaaaagaagaagcgaaacgccgcatttatgcaacgacagataaagagcggggcgcattaaaaacgcttgctaatgaggaaggttttgaatcattcatcattcctgacgatgtcgggggccgcttctctgtgctcacagcggtcggcttgcttccgatcgcagtcagcggagccgatatcgatgaaatgatgaagggcgcccgcgatgcgagcaaagacttctccacatcagagcttgaagacaatccggcttatcaatatgcggtcgtcagaaacgtcctttataacaaaggcaaaacaattgaaatgctgatcaactacgagccgggccttcagtacttcgcagaatggtggaagcagctctttggtgaaagtgaaggaaaagacgaaaaaggcatttacccttcttcagccaacttctctactgatcttcactctcttggacaatacgtacaagaaggaagaagagatatgttcgaaacggtgctgaacgttgaaaagccaagacacgagctgacaatcgaagaagcggacaatgatcttgacggcttgaactaccttgccggcaaaacagtcgacttcgttaataaaaaagcgttccaaggcacaatgctcgcgcacacggacggtaacgtgccgaacctgatcgtgaacgtacctgaaatgaacgcttacacgttcggctatctcgtgtacttctttgaaaaagcctgcgcaatgagcggatacttgctcggcgtcaacccgtttgaccagcctggagtggaagcatacaaagtcaacatgttcgcccttctcggcaagcctggcttcgaagagaaaaaagcagagcttgagaagcgtttgaatcaataa

SEQ ID NO: 663 - DNA, 1494 bp, Bacillus licheniformis
agtggctcgctgcacccgctgtctttttgctccttatcgggtgcagtgcaaatgagacgtcgaatcaagacgggaaaggaaaagagaaggatgccattcatattatggctccgctcctctcgccggaaagtccgggagaaaacagtccgtctttaaaagcgctcgaaaaatacacgaaaaaacaaattaaagtgacatgggttccgaactcttcctataatgataaattcaacatcgtcatggcctcgggggatttgccgcaagccattgtcgtcacggacaagtcgccgggttttatcaagtctgtcaaatcaggcgcgttctgggagctttcaccttatttaaaagactacccgaaccttggaaaggccgatgagaaagtgatgaagaacagttccattaacggcgagatttacggcatttacagggcgagggacctcatccgcgcttcgattatcatcagaacggactggctcgaaaatgtcggcctggagatgccgaaaacaatcgacgaattttacgacgtactgaaagcgtttaaagaaaaagaccccgacggaaacggaaaggacgatacgtacggcatggtagtcccgaaatggatggggctaggcaacgggagcccatgggatattatgcagacatggttcggtgctccaaaccgctacggagtagacgaaaaaggggaactcattccggacttcacaacagaagaatatatggaagcgctgcgttttttcaaaaagctgtatgatgaggggctgatcaataaagacttcgccgtaatggattcagcgaagtggaacgatccggtcgtcaaagggaaagctggtgtgatcgtcgataccggttcgcgggcatcgcagatacaaagcgcaatggaggaagccgatcccggaaacaaggatgtgatcgatgtcatcggaacggtcaaaggcccgaaaggaacgtatacattcccgacatcaggatacgccggaatgattgccatcccgaaagcgagcgtcaaaacggaaaaagaactaaaagaagtgctcggcttcttggacaaaatgaacgatgaagaggcacagatcattgccaataacggcgtaaaagggcgcaactataagcttgaaaacggtgcgtacacgtcccttgaaaaaaacaacaaaaaactgctttacgagcacgagggtcttgcgcagttcagcatgggcattccggaacaaagatactatgtggaaaagcaagaatcaaagctgtttaaacaccgtgaacagattcgcaaagaaggggagaaaatcgccgtattcaacccggcagaatcgctcgtttcagatgtatacacccaaaaaggggcacagcttgacaacatcatcctcgatgccaaaacacagtttatcatcggcgacatcgatgaaaaaggctttcaagacgccgttgagctttggtataaaagcgggggcgaagatttgatgaaagaactgaacaaacgctacaaggagactaaat

SEQ ID NO: 664 - DNA, 1293 bp, Bacillus licheniformis
atgccatacattgttgatgtttatgcacgtgaagtattagactcccgcggtaacccgacggttgaagttgaagtatacactgaatcaggagcttttggacgcgcgctggttccaagcggagcttccactggcgaatacgaagctgttgagcttcgcgacggcgacaaagaccgctaccttggaaaaggcgttttaacagccgttaacaacgtgaacgaaatcatcgcacccgagcttatcggctttgatgtgactgagcaagtatcaatcgacaaattgctgatcgaacttgacggaactgaaaataaaggcaagctcggcgccaacgccatccttggtgtatcaatggccgttgcccgcgcagctgcggatttcttgcagattcctctataccaataccttggaggattcaactctaaaacgcttcctgtaccgatgatgaacatcgtaaacggcggagagcatgcggacaacaacgttgacattcaagaattcatgatcatgcctgtcggtgcggaaaacttccgcgaagcacttcgcatgggagcacaaattttccacagcctgaaatcagtcttgaaagaaaaaggcttgaacacagctgtaggtgatgaaggcggattcgctccaaaccttggatctaacgaagaagcgcttcaaacaatcgttgaagcgatcgaaaaagcaggattcaaacctggcgaagaagtgaaattggcaatggatgctgcatcttctgagttctacaacaaagaagacggcaaataccatcttgcaggcgaaggcgttgtaaaaacgtcagctgaaatggttgactggtacgaggagctgacttctaagtacccaatcatctcaatcgaagacggccttgacgaaaacgactgggaaggccacaaacttctgactgagcgtcttggctcaaaagttcagcttgtcggtgacgaccttttcgtaacaaacacgaaaaagcttgctgaaggaatcaaaaacggcgtcggcaactctatcctgatcaaagtaaaccaaatcggtacattgactgaaactttcgatgcgatcgaaatggcgaaacgcgcaggctacactgccgttatctctcaccgctccggtgaaactgaagacagcacaatcgctgacatcgctgtggcaacaaacgcaggacaaatcaaaacaggtgctccgtctcgtacggaccgtgttgcgaaatacaaccagcttcttcgcatcgaagatcaattggctgaaactgcgcaataccacggtattcaatctttctacaacttgaataagtaa

SEQ ID NO: 665 - DNA, 1935 bp, Bacillus licheniformis
ctgtcgcaacaatacgaacactctccatagacgcgattgaaaaagctaaatccggtcaccccggcatgccgatggggactgctccgatggcttatgcgctttggacaaaaatgatgaatgtcagccctgaaaatccgaattggtttaacagggaccgttttgtgctttccgccggacacggatcaatgcttttgtacagcatgcttcacttaagcggatatgacgtttcaattgaagacctcaaaaatttccgccaatggggaagcaaaactcctgggcatccggaattcggacatactccgggtgtagatgcgactacaggtccgcttggccaaggaatcggaatggctgtcggaatggcgcttgctgaacgtcaccttgctgaaacttacaaccgtgacgactatcgcgtcgttgaccattatacatacagcatttgcggtgacggagacttgatggagggaatttcatccgaagcggcttcgcttgcgggacatttgaacctcggccgtctcatcgtgctttatgattcaaatgacatttcgcttgacggcgaactaaaccgctcattctctgaaaatgtaaagcagcgctttgaagcgatgaattgggaagtgctttatgttgaagacggcaacaacattgccgaaattacggcggccatcgagaaagcgaaacaaaatgaaaagcagccgacattaattgaagtgaaaacaacgatcggtttcggttcttcaaaccgtgcgggcacatccggagtccacggcggtccgctcggatcagaagaggcgaaattaacgaaggaagcgtatgagtggacatacgaagaagatttttatgttccttccgaagtgtacgagcactttaacgaaacagtgaaggaagcgggcaagaaaaaagaggcggaatggaacgaactgttctccgcatacaagaaagcccacccggaacttgccgaagagcttgaactggcgatcaaaggcgagcttcctgaaggatgggatcagaaagtacctgtatatgaaaaaggaagcagccttgcttcacgtgcatcctcaggtgaagtgttaaacggaatcgctcaacaagtgccgtttttctttggcggatccgcggacttggccggttccaacaaaacgacaatcaaaaacggcggagatgtttcagcgaaggattacgccggcagaaatatctggttcggtgtaagggaatttgcgatgggagcagctttgaacggaatggctcttcacggaggcctccgcgtattcggcggaacgttcttcgttttctccgattacttgagaccagcgattcgtcttgctgcattgatggggcttcctgtcacctatgtatttacacatgacagcattgccgtcggtgaagacggaccgactcatgagccgattgaacagctggcatcacttcgtgcgctgccgaacttgtccgtcatcagacctgccgacggaaatgaaacagcagctgcttgtaagctcgcgcttcaatcaaaagaccagccgactgcgcttgtgttgacacgccaaaacttgccgacaatcgatcagtctgctgaaacggcttatgaaggcgttaaaaagggtgcatatgtcgtttcaaaaagccaaaacgaaaaaccggaagcgatcttgcttgcgagcggatctgaagttggccttgcgcttgatgcacaaagcgagctgcaaaaagaaggcattgacgtatccgttgtcagcgttccgtcatgggatcgatttgacaagcagccggctgaatataaaaacgctgttcttccaactgatgtgacaaagcgtctcgcaattgaaatgggatcgccgctcggatgggagagatatacaggcactgacggggacattctcggaatcgaccagttcggtgcatcagctcctggcgaaacgatcatgaaagaatacaggtttt

SEQ ID NO: 666 - DNA, 1410 bp, Bacillus licheniformis
ttggcaaaacgaaaactatatccttctatcccaggctctacgaaaacggacaaatcgggaatgaattcgcggttgtcggagtcggcagacgcccttggacaaatgaagactttcgcagtaccgtacagcaatcggtttcgaagtttccgttaaacgaaaaggatgtggacgagtttacatctcacttctactatcatccttttgatgttacaaattccggctcataccgggaattaaacgaacttatagagaagctggaaagtacatatgatattccgaataaccggatgttttacttagcgatggctcctgaatttttcggaacgattgcaaagttcctaaaatcagagggtgtcacttcaacaacaggctggtcaaggctcgttatcgaaaagcctttcgggcatgatctgccgagcgcaaaagccttgaaccaggaaatccgtgaagcttttacagaagatcaaatttatcggattgaccattatctaggaaagcaaatggtgcagaacatcgaagtcatccgctttgccaacgcgatttttgagccgctttggacaaacagatacatctcgaacattcaaattacgtcaagtgaagatttgggtgtggaagacagagcgagatattatgaaaaatcgggtgcgcttagagacatggtgcaaaaccacattcttcaaatggtggcgctgcttgcgatggaaccgccgatcaagctgaacacggaagagatccgcagcgaaaaagtgaaggttctcagagcccttcgtccgattcaaaaagacgatgtcgaccaattttttgtgcgcggccagtatgacgcaggagtcgtcgacgaaaaacatgttccggcttatcgcgatgagcaaaacgtagcaaaagattcgaatacggaaacgttcgttgccggcaaactgctgatcgacaacttcagatgggccggtgtgccgttctacatccggacaggcaaacggatgcagaaaaaatcaacgcagattgtcgtccaatttaaagacattccgatgaatctttattacggaaacggcaacacgatgcaccctaatctgctggtgattcatattcagccggatgaaggcatcacccttcatttaaacgcaaggaagcttggaggcggcacttttgcccagccgatcaagctcgactactgccataactgcggggacggcatcaacacgcctgaagcttatgaaaagctgattttggactgcttgcacggagacgcgacaaactttgcccactgggatgaagttgcgctttcctggagttttgttgatgcgatttctcaaaactgggaggaaaacaaaaccctttcccctaactataaggcgggctccatggggccgaaagcttctgacgacctgctcgcaaaagacggctttcattggtggc

SEQ ID NO: 667 - DNA, 1172 bp, Bacillus licheniformis
atgttttttagaaatatcggaatgattgagtatgaaggggccgattcggaaaatccttacgcatttaaatattacaaccctgatgaatttgtcggcggcaaaacgatgaaggaacaccttttcttcgctgttgcgtattggcatacctttgatgcggacgggaaagaccctttcggcgacgggacgatgttccgggcgtggaaccggctgacacatcctttggataaagcgaaagccagggcggaagcggcttttgaattttttgaaaagctcggcgtgccctatttctgttttcatgatgttgatattgtcgatgaaggagcaacattgcgtgaaactttcacgtatttggatcaaatgtcgtcttttctcaaagaaatgatggagacaagccatgttcagctgctttggaatacagccaatatgtttacgcatccgagatatgtccacggggccgcaacttcttgcaatgcagacgtctatgcctatgcagctgcaaaagtgaaaaaaggcctggacatcgccaaagagcttggagcggaaaactatgtgttctggggcggaagagaaggttatgaaacattgctgaatacagatatgaagcttgagctcgaaaacttgtcttcattttatagaatggcagttgagtatgcgcgtgaaatcggttttgacggccaatttttaatcgagccgaagccgaaggagccgacgaagcaccaatacgattttgatgcagccacaacgatcgcttttttagaaacttacggtttaaaagaccattttaaacttaatcttgaggcgaaccatgcgacattggccgggcatacatttgagcatgaactaagggtggctgccttgcacgatatgctgggttccattgatgccaaccagggcgatttgctcttgggctgggataccgatgagtttccgaccgatctgtattctgcggttctggcgatgtatgaaattttgaaagcaggcgggtttaaaaccggcggcatcaacttcgatgctaaagtaaggcgcccgtcatttgccgatgaggacttgtttcacgctcatatcgcaggaatggatacgtatgcagtcggcttgaaagtcgcctcccgtctgcttgaagaataagcgctcgatcaggttatcgaagaacgttatgagaactatacgaaagg

SEQ ID NO: 668 - DNA, 1258 bp, Bacillus licheniformis
atgattcatcagcgactacgcccatttccagatcatttcctatggggatcagcatctgcagcctaccagatcgaaggagcctggaatgaagacggcaaggggctttcggtttgggatgtgttcacaaagattcccggaaaaacgtttaaaggaagcaatggagacattgcggtcgaccattaccaccgttttaaagaagatgttgctttaatggctgagatggggttaaaagcataccgcttttcagtcagctggccgaggatttttccgcagggcaggggagaagccaatgaatcgggtttgagattttacgatgacttgattaatgagctccttgctcatgatattgaacctgttttgacgctttatcattgggatcttccccaggctttaatggatgaatacggcggctttgaatccagaagaattatagaggatttcaatgcgtattgcgttacgctctataagcggtatggaggcagggttaaatattgggtgtcccttaacgagcaaaattacaactttaatcacggctttatcacagcgatgcatcccccgggtgtgaaggatagaaaacgcttctatgaggctaaccatattgcatttctagcgaatgcaaaggcaatcgattcttttcgccggtatgttcccgatggaaaaatcggaccgagttttgcttattcgcctgcatatcccctctccagccgtccggatgatatcctcgccttcgagaatgccgaggaatttacaaactattggtggcttgatatgtactgccggggaacatatccggacatccctttaaagtatctgaaggaaaaaggctgggcgccgacaattgaagatggggatatggagcttttagcaaaaggaaaacccgattttgtcggtgtgaattattatcaaaccatcacatatgaaatgaatcctcttgacggggtatcggaaggaaagatgaatacgaccggccaaaagggaagcaatcaggaaacaggcatgccgggtttatacaaaacaaaaaggaaccctcatcttgagacatcgaattgggattgggccattgacccgatcggtctaagaatcggacttcgcaggatttccagccgctatgggcttccgcttttcataacggaaaacgggctgggggaattcgataaggttgaaaatgacggcacgattcatgatgactacagaattgcctacttgcgtgcgcaccttgaacaatgcagacaggctttaaacgacggagtcgatttat

SEQ ID NO: 669 - DNA, 1548 bp, Bacillus licheniformis
ggttcgcaaagcatcggcgggccttgccgcatacataggagcgaacggcggcgaagcaaaaaagcgcggcgttgtgatcgcgtacgattcccgccacaaatcgcctgaatttgcaatggaagctgctaagacgctcgcagaaaacggcgttcaaacgtacgtgtttgacgaactgcgcccgacacctgaactttcctttgcggtaagagaactgaatgcgtttgcaggtattgtcatcacggcgagccataacccgcctgaatacaacggctataaagtgtacggagaggacggcgcgcagcttccgcctgctgatgccgacaaactcaccggctatgtcaatgcgatagaaaacgaactggaaatcgaagccggagatgaagctgctttaaccgaaaaagggctgattaaaataatcggcgaggaaatcgatcaagcgtatctcgataaactgacatcgatttctgtcaaccctgatctggcaaaggagaccgaagtcaaagtcatcttcaccccgcttcacggcacggcaaacaagtctgtcagacggggcctgaaagctctcgggtatgaacatgtcacagtcgtccccgaacaggagctccctgaccctgacttttcgaccgtatcttctccgaatccggaagagcacgccgcttttgaatatgcgatcagactaggagaagaaaatggagccgacattctgatcggaaccgatccagacgcagaccggctcggcgtcgctgtaaaggatcaagaaggccgctacgtagtgctgacaggaaatcaaaccggcgcgctgctcctgcattatctgctgtcgcaaaaacagcagaaaggcatgctgcctgataacggcgtcgttctgaaaacgattgtgacgagcgaaatggggcgcgacatcgccgcttctttcggactggacacgatcgacacgctgaccggctttaaattcatcggagaaaaaatcaaacaatttgaagcatcgggcgaatatgctttccaattcggttatgaggaaagctacggctacttgatcggcgacttcgcaagggacaaggatgccgtccaggccgcactgcttgccgttgaagtatgcgccttctataaaaagcagggaaaatcgctttatgacgggctcctcgaattgtataaatcgttcggcttctatagagaaggcttgaagtccctgaccttaaaaggaaaagagggagcggagcaaatcgcagccatcctcagcacattcagagaacagccgcctctttccatcgccggaaaagatgtcgtatccgccgaagactatttgacagggaagcggacgctgctaaaggaaaacaaaagggaaacgatcgaccttccgaaatccaatgttttgaaatatttccttgaagacggctcatggttctgcctccgtccatcaggaacagagcctaaagtgaaattttatttcgcggtcaaaggccgaaccaatgaagaaagcgaagcgcttctcaatcaattgacagacgaagtgatgaaaaaaatcgacgatattgtaaaagcgacctc

SEQ ID NO: 670 - DNA, 1308 bp, Bacillus licheniformis
atgaacaaagaccaaacactagcaaaccggagccggaaggcagcgctgttatcgataattcccggtgctggccagattgcaaaccggcagttttcaaaggggatcctttttctagtcatcacaggcttgtttatttgtgagttagcgattttcggttatcaggcgctgatcggtctcgtgacgctggggactgtccccggagaagaccactcgctgtttctcttgatagagggcacgctgcaattgattttgacgctcgttttcttgatgttttacatctttaatctgtatgatgcccggaagaccgccgcgatgaaggcggcgggtttgaaaatcagcgagacggctggggacatgatcagaaatgcaggtgacaaagggtttccgtatttatttacgctgccggcatatctcatgatggtgtttgtgattatttttccggtgctggtgactctgtttatcgcgtttacaaactacgatttttatcatattccgccaaacagtctcatcgactgggtcggctttaaaaatttcatgaatatctttttccttggctcgtatcggcaaacattcgccgatgtgctgggctggacgatcatctggacgatctgtgcgacgacgctgcaaattgttctcggcatcgtgacggcgctgatcgtcaatcagaactttattaaaggcaagcggatgttccggatcatcttcctgcttccgtgggccgttccggcatttattacgattatgagcttcgccaacattttcaacgactcggcgggcgcgatgaacgtccaggtgatcccgcttttgaaccagcttccgttcgtcgacatcccggctgtcgcatggaagaccgatccgttctggacgaagacggctttgattatgatccagacgtggctcggttttccctacatttatgtcatggtgacgggggtgcttcaggcgattcccggagagctttatgaagcggcaaagattgacggcgcgacatttattcagcgctttaaacacattacgctgccgatgattttatttgcgaccgcaccggtgatgattacccagtatacatttaatttcaataacttctcgatcatctatttatttaatgaaggcggtccggggagtgcgggggccggagccgggtcaaccgacatcttaatatcctggatctataagctgacgacggggacgtcgccgcagtattccgtggcggctgctgtcacactgctcatttctttcattgtcatcggggtttccctgattgcttttaagaaatcgaatgcctttggcaatgaggaggtcatgtag

SEQ ID NO: 671 - DNA, 2379 bp, Bacillus licheniformis
agccgctaaaagccaggctgatgaatatgagtatccctttcaagatcccagtctccctgtacaaaaaagagtcagcgacttgctttcacggctgacccttgaggaaaaagtgtcactgatgcatcaatatcagcccgccgttccccggctgggcattcccgcttttaaaacgggcacagaagcgcttcacggcgtcgcctggctcggggaagcaaccgttttcccgcaggctttcgggctcgcgcacacatgggaccgctatttaatcaaacaaatcggctcggcggtcggtgatgaagtccgcggcttccaccaccttgatcccgcggcaaacggagtcaacgtctgggcgccggtcgtcgatctgctgcgtgatccaaggtggggaagaaatgaagaaggctattccgaagacccctttttaaccggggaaatagcaaccgcctatgcctccgggttaaggggcgatcatcccttctatttgaaaacagttccaaccttaaagcattttcttgcctataacaacgaaacagaccggggattcagctcctcaagcatcgatcccaggaacatgcacgagtattatttgaagcccttcgaaacagcaatttccaaaaaagccgcgtatggactgatgccggcctacaattctgtcaacgataaaccggccattttgagcccgctgctcgacagtacagtcaaacgtagatgggccggagacgatttcttcatcgtcagcgatgcctttgatccttccggaatcgtcaatgaccacaagtattatgacagccacgaaaaagcccatgcccacgccgtaaaagccggcattgacaactttacggatcagggggaaaatcccgagctgacgagaaacgccttaaccggtgccttaaagcaaggccttatttctgaaaaagacctcgatcaagccttggccaatacgttcagcatccgttttcgcacgggcgaatttgatccggacgaactcaatccgtacagccgcctgacagatgacgtcatcaacagtccaaagcatcagctgctggcgaaaaaagcggctgaaaaagccattgttttactgaaaaacgaccaggatctgcttcctttcaatgcccggaagaatgaaagcattgcagtcatcggcccgttcggaaatgcgctttacgaagattggtacagcggaacgatgccgtatcggaaaaccccgcttgacgaaatcgcggacaaaatcggcaaagaccgcgtctcctttgctgaaggtctggaacaaagcggcttcaaatccgcgctgaccggaaagtttgtaactgcaggccgggacggcaaacaaccgctcacagcagcggctgataagcttgagaaaagcgcggcattcgatgcggcggattggggagaaagcatcttcaccctccgcgcccaagcgaacggcctctatgtctcgcttcaggatgacggccggctgatcgctgatcagaaacagccgaacggccggaccgttaaagaaacatttcagttcgaacagcagtctgacgggacatttgccatcaaaaatacggcaaacggcaaatatctcaccgccggtaaagacggcacattaacagccgccgccgaaaagccggcaacagcagcggaaaagttttcaaagacgatcatcaagagcggtacggatgaagcggttcagctggcaaaatccgcggacaaagccatcgtgtttgtcggcaacaatccttacatcaacggccgggaaaccgaagaccggaaagatattacactccctccggcccaggaaaatctgctgaaagctgtttctaaagccaataccaatacggtgcttgtcgtaacgagcagctatccgtttgctctcaactgggcaaaagcgcacattcctgcgatcatatattccgctcacggaggccaggaggcgggaagcgcattggcggacattctctatggagatgtaaatccgggcggacggctgacgcaaacttggcacacctcagtcaaagaactgccggatatgatgaattacgatatcatcaaagggaaaagaacctataaatatttcgtaggcaagccgctgtttccgttcggccacgggttatcctatacagcgtttcgctacagcgatttaagcctttcctctgacagcatcaaaaaagacggatctgtcacgattcgcgtcaacgtcaccaatacaggcggaagaaaaggagatgaagtcgttcagctctatacctctcccctgtttaaaacacgggttaaacagccgaacctggacctgaaagattttcagcgggttgaactggcaccgaaagaaacgaaaaccgtgacattcaagctgaaacagacagaccttggtttttgggatggcctagagaa

SEQ ID NO: 672 - DNA, 1293 bp, Bacillus licheniformis
aacaaattcaataccgttttccaaatggcttctggtgggggtcggcggcttccgccactcagactgaaggagcggcggccgaaggaggcaaaggaaagaacatttgggatcactggtacgaaaaagagccaaaccgattttttgacggagtaggccctgagaagacttcgcgtttttacgagacttacagagaagatattcagctgatgaaagagcttggccaccactcttttcgtttctccatttcgtgggctcgtctgtttcctgatggaaaagggcggctgaacaaagaaggagctgccttttataaccgagtcatcgatgaactgcttgcggctggcatcgagccttttgtcaacctttatcattttgacatgccgcttgcgctccagcaaatcggcggatgggaaaacaggcaagtcgtcgatcactttgcttcatacgcggaaacgtgcttcaggctgtacggggaccgagtgaaaaaatggtttacccacaatgagccgatcgttcctgcagaaggcggctatctatacgattttcactatccgaacatcgtcgactttcaaaaagccgtccaggtcgcataccatgaaattctttcaaacgctaaagctgtcgaagcttatcgcagactcgggggcgacggcaaaatcggcatcattttaaatttaacgccgtcctacccgcgaagccagcatccggcagatgtaagagcatctgaaatagccgacgctttctttaaccgatcgtttcttgatcccgccgttaagggtgagtttccgcagcttttaacagatatattaaaagaagaaggctatttgcctgtcatggaagaaggagacttggagctgatcaaaaatcacactgtcgatctgctcggcatcaattattatcagccgagacgggtgaaagcgaaggagcacctgcctcatccggacgcgccttttatgccggaacggttttttgaccattatgaaatgcccggacgaaaaatgaaccgccaccgcggctgggagatatatgaaaaaggaatctatgatattttaatcaatgtcaaagaaaactacggaaatattgaatgctttatttctgaaaatgggatgggcgttgaaggagaagaacgtttccgcggcgaagacggcatgatccgcgatgactacagaatttcgtttataaaagaacacttaaaatgggtgcacagagccattcaggaaggagcgaatgtcaaaggctatcatctttggaccttcatggacaactggtcatggacgaacgcctataaaaaccgct

SEQ ID NO: 673 - DNA, 1254 bp, Bacillus licheniformis
tgcagcatcgcaaaaaagctttactattatcaattattcccggtctgggccaattctacaataaacaatggataaagggtctgttattccttcttttaggcgtctcgttctttgcggtttttggcgatttgctgaatatggggctgtggggcctgtttacgcttggaaccgaagtgccgcgcgacaactcgatttttctattggcaaaaggcattattgctgtgattgtcacctgttttgggctggctgtctattacgccaatttgcgggacgcctaccaaaacggaaagaggcgcgatgaacaaaaggagctcagttcactcaaggaacaatatcataatttaatagctcagggatatccgtatctcatcagcgggccatcgctgttcatcctggtttttgccgttgtttttccgattttgttcagctttgcattagcttttacaaactataacctctaccattctccgcctgcccgccttgtcgattgggtaggaattaaaacgttttccgaaattttcaccgttgatatttggcggtcgacctttttggatgttttagcttggaccattgtttggacgcttgtcgcttccacgctccaagtcgggttgggaattttgttggcggttgtcgtcaatcagaaggaagtccgctttaaaaaaattttccggacgattcttgtcttgccttgggccgtgcccggttttgttaccattctcgtgtttgccggcctttttaatgacagcttcggtgctttcaatcatcaaatcctcgccgcattcggcatcgatccgattccttggatgacgaatgccaattggacgaagctggcgcttattcttatgcagggctggctcggatttccgtatgtgttcattgtaacaaccggtgttctgcagtcgattccggatgacctttatgaagcggcgacgattgacggagcgtctgcgttttcgaaattcaggcatattacactgccgctgattttaatcgcgatggcgccgattatcattacgcaattcacttttaattttaataacttcaatattatttatctattcaatggaggcggtccggctgttcccgggtcaacagcgggaggaaccgacatcctggtgtcctggatttacaaattgacgatgcagtcgagccagtactctttagccgccgcattgacgatcctgctgtcggtctttgtcatctcaattgcactgtggcagttcagacggacaaattctttcaaagagggggctt

SEQ ID NO: 674 - DNA, 1299 bp, Bacillus licheniformis
atgactaaaattgcttttatcggagctggaagcacaatttttgcgaaaaatgtgctgggggactgtctgatggttccggcggtcaacggatttgaatttgctttgtatgatatcgatccgaagcgcctcaaagaatctaaagatatgcttgagcatttaaaaaaccgctataatgacacggtatcgatccgcgcctatgacgacagaaaggaagctttggcgggagcgaaatacgtgatcaatgccattcaggtcggcggctataaaccgggcacagtcatcgattttgagattccgaaaaaatacggcctcaagcagacgattgccgatacggtcggaatcggcgggatattcagggcgctgcggacgattcccgttttattggatatggcaaaagacatcgaaagcgcggcgcccgacgcctggctcttaaattacacaaacccgatggcttctttaaccggtgcgcttctccgctacacggacgtgaaaacggtcggtctctgccacagcgttcaagtatgcacaaaagatcttttcaaatccctcggcatgaagcatgaacgaatcgaagaaaaaatcgccggcatcaatcatatggcctggcttcttgaagtcaagcaagacggaagagacttgtatccagaaattaaaaagcgggcaaaagaaaaacagaaaacgaaacatggtgacatggtcaggtttgaactgatggataaattcggctactatgtgaccgaatcgtccgaacataacgcggagtaccacccttattttattaaaagccgttatcccgaactgattgaagaactgaatatcccgattgacgaatatttgagaaggtgcgagaagcagattcaaaattgggaaaagatgcgcggcgaaatcgtcggcaatcggcatttaacccacgagcggtcaaacgaatacggctcaagaatcatagaagcgatggaaaccggccagccgtttacattcggcggtaatgtcttgaataaaggattgattacaaatcttccggaaaaagccgtcgtcgaagtgacgtgcgtcgctgagcggaaccggatcactccgtgctacgcgggcgagctgccagaacagctggctgctttaaatcgcaccaatatcaatacacagctgttaacgattgaagcggcaacaacaaaaagaaaagagcacatttaccatgctgcattgcttgatccgcatacggctgcggaattatcgatggatgatatcgtaagcatgtgcgatgaattgatcgaagcacacggcgactggctgccggaatttgaataa

SEQ ID NO: 675 - DNA, 1394 bp, Bacillus licheniformis
gtggaatacgtaatcggggtcgatctcggcaccagcacggttaaaatcatccttgtcaatcagcggggagagctgtgcggcgaggtctccaaaccgttttccatcattgagccccattccggttattccgaacaggatcccgcagaatgggcggacaaaacgaaggaagccattaaggaattggtcgggcatttcccgggaaaagcatctcagattaaaggggtcagcttttccggacagatgcatggattggtacttttaaacggcaaaggagaggttttgcgaaacgcgatcctgtggaacgatacacggacaaccgaacaatgccggctgattaacgacaaaatcggaaaggagcgcctgctcgagatcgcgaaaaatccggcgctcgaaggttttacccttccgaagcttttatgggtgaaagaatatgaaaaagagctgtttgaaaaggcggccgtttttttgctgccgaaagactatgtcaggtacaccatgacggggcgtcttcacagcgaatattcagatgcggccggaacgctcctgctagatgtgagacatcaaacatggagcggggaaatctgcagaaagctcggcatcccggagtccttatgtccggatttgattgaaccgggcgcttgtgtcggcggcctcagaccggaattcgcggccgaaaccgggctgtctcctgaagtcaaggtgtttgccggcggcgctgataatgcatgcggcgctgtcggcgccggtattttaaaagaaggaaccgccctttgcagcataggcacctcgggggttgttctcacatatgaatcaaaccgtgatcaagagtttaatggcaatattcattttctgaaccatgcagcccccgatgcgttttattcgatgggagtgacgctttctgcaggacgcagcttcagctggtttaaagatgtatttgccgggcaggcgtcatttgacgaattaatcagcgatattggccattcccgtcccggggccgggggactgctgtttaccccttacttgtcaggggagagaactcctcatgccgacgcagatattcgcgccagcttcatcgggatggacagcgcacatacacgggcggactttgtcagagccgttattgaaggcattacattctcccttcatgaaagcattgaacaattccgtgccgggggaaaagacatcagccgtgtgatttcaatcggaggaggcgccaaaagcaatcaatggctgcaaatccaggcggatatcttcaacgccgacatcatcagactgacaagcgaacaggggccggcatacggtgcagccatgatcgcggccgtcgggtgcggctggtttccgtcgcttgaggcttgtgcagaccgattcgttctcatcaaagaaaccttttcgcc

SEQ ID NO: 676 - DNA, 1317 bp, Bacillus licheniformis
taaaacgtattcgattgtcattgcaggcggaggaagcacatttaccccggggattgtattgatgctcttggacaatctggatgatttcccgatccgacagctgaaattgtatgacaatgatggagagcggcaagacaaaatagccggcgcctgtgaagtgttggttaaagaaagagctccgcatattcaatttttagcgacgaccgatccggaagaggcgttttccgatgttgatttcgtcatggctcatatcagagtcggtaaatatgcaatgcgtgagctcgatgaaaagatccctctgaaatacggagtcgtcggccaggagacgtgcggacccggagggattgcgtacggaatgaggtcgattggcggcgtgcttgagctcattgattatatggaaacctattcgcctgacgcgtggatgctgaactattcaaacccggctgcaatcgtcgccgaagcgacaagaaggctgcggccgacatcaaaagtgctgaacatttgcgatatgccgatcggtatcgaagacaggatggctcagattctcggactgtcttcgcggaaggagatggttgtccgctattacggccttaatcattttggctggtggacgtcaatttgtgataaagacggcaacgatctgatgccggcgatcaaagagcatgtcaggaggttcggctatattccggaacaggagcatgaaaaggctgaggcgagctggaatgacacgttcaaaaaagcgcgggaagtatttgaactcgatcctgagacgcttccaaatacgtatttgcaatattatttttatcctgatgatatggtgaaaaaatcaaaccctgaatttacccgggcgaacgaagtaatggaagggcgggagaaattcattttcggcgagtgtgaaaaaatcgcaaaagcccaatccagcgccggcagcaaaatcgaaattgatgatcatgcttcatatattgtcgaccttgcgcgcgcccttgcattcaataccggtgaacggatgcttttaatcgttgaaaataacggagcgatccaaaacttcgattcatcggcgatggtagaggtgccttgcattgtcggcaagaacggtccggagccgatcacaatcggcaaaataccgcagttccaaaaagggctgatggaacagcaggtgtcggttgaaaagcttgtcgttgaagcctggattgaaaaatcgtatcaaaagctttggcaggctctgattttgtcgcggactgtgccgaatgcacgaacagccaaactgattctcgatgatctgattgaagcgaacaaaggctattggccggagctctc

SEQ ID NO: 677 - DNA, 1318 bp, Bacillus licheniformis
gtgaacaagtttaatgcatttttagaggagaagatcatgccggttgccggcagaattgccgcccagcgccatttgcaggctctcagagacggcattattctgaccatgccattaatcattatcggatcgctgtttctcattttagccaatttgccgattccgggatatccggaattcatggcggggattttcggcgatcaatgggctgagaaattaagctatccggttaatgtcagctttgacattatggcgctgatcgccacgtttggcatcgcctaccgtctggcggagaaatatgatatcgatgccctgtcatcgggcgccattgccgtagcagcttttctgcttgcgaccccctaccagattccgttcacacccgaaggcgcaacagaggaaattttagtgtcaggcggcatcccgatttcattaatgggaagcaaaggtctgtttgtcggcatgctgatcgcgatgttctccactgaggtttaccgctgggtcgttcaaaaggatattgtcgtcaaaatgccggacggcgtaccgccggctgtcagcaaatcatttatcgctctgattccgggattcgccgttatcggctcgatctgggcggcccgccttttaattgaaatgacgccgtttgaaagcctccataatgtcgtcaacgtccttttgggaacgcctctttccgtccttggcggcagtctcggcggaagccttattgccgaaactgtgaaaatgctgctgtggtcctgcggccttcatggagcaaacattgtcggcggagtgatgtcgccgatctggtacggagcgatggacgaaaaccgtctcgctttccaagccggagaagcgctcccgaacatatttacgacgcagttttttgagatttggatcaacatcggcggcagcggcgctactttggctttggtcattacgatgtttcttagggcgcgaagcaagcaaatgaaacagctcggcagactcgccatcggccccgctgtttttaacatcaacgaaccgattatcttcggcatgccgatcgtcatgaacccgatgctgctgatcccgttcatcgtgtcgccgctgctgatgataacggcaacctatattggaatgagcacaggtcttgttgcaaagccggctgggattgccgtgccgtggacgatgccgcccggcttttccggatatttggcaacaggagggaaaatttccggagcggtcatgcagctgatcaatctgttgatctcgtttgtcgtatactatccgttctttagaatgtgggataaacaaaagctgaaagaagagagcgaactggagaccggaa

SEQ ID NO: 678 - DNA, 1374 bp, Bacillus licheniformis
cgaacaaacaaaccgaaacagtcgccgtcactcaagagaaattaagtttaaaagaaaaggtttcttacggttttggagattttgggaacggatttatgtttgaccttggacagctctatcttctgaagttttttacggatgttgccggcattccggcggcggcagccggaggcatttttcttgtgagcaaacttttcgccgcttttgtcgatccgattgtgggaacatcgatcgactacaggaagaatatcggcccgaaaggcaaattcaggccgtatctgctatacggaagctttgtgcttgcgattttgacgatattgaccttcatctcgccgaatctgtcaccgacgggcaaactcatctacgcttatgcctcatacatgctttggggtctcggctattcctttgtcaacatcccttacggctcgctcggggctgccatgacgcaaaactcggtggaacggacttcgcttgcttcctttcgccaagccggctcgctgggcgccctgtttgtgacgagcattgttgtcatcccgatgattgtcaggtttgacaaccctgcggttgcctatccggtcgtcatggggctgatgtcttttctgggtgtgttgtttttctacatttgctacaggaactgtcaggaacggatcgtcgtaaaagatgagaagtacaaacaggaaaaagtgacattcaaagcgatttcaaagacgttttttacgaacaagccgctccttacgctaatattcatgacaatttttacgatttcagcctataaccttaaatccgcgatgctgatttatttcgcgcagtataacctcgggaacgccgaactgatggcctacatgaatttcatcatcatcggctcatcctttatcggcgtcatcatgctgccgaagctcgtgaagctttttgggaaaaagcataccgccattttggggctcgcggtttctgtctgtgccgatctgatcaattttttcgcaccgggcaatgtctttgtttttacgattctcgcaagcatcgccttcatcggcatcagcattccgaacggaatcacctgggcattcgtatcagatgcgatcgattacggcgagtggagaacaggggaacggaaagaaggaacggtatactcgctgtttaatttttcgagaaagctggctcagtcgctctccggcttcctgtcagggatcggtctcagcatcatcggctatgtgccgaatgcggcccaaaaagcggggacgctgctcggcattaaagcgattctccttttgtatccggcagcagcgctgacggcggccattctcgttctcggctacctgtaccgtttgacggatcagaagcacgccgaaatggtcgcggaaatcaaagcgagaacat

SEQ ID NO: 679 - DNA, 1311 bp, Bacillus licheniformis
tgcttttggccggcggactgcttggctgttcgaacagcggagcagaccaggcttcttcgaaggaggagaaagtcgatttgaactcgcctttggacttgagctggatggtgatcctttaccatcagcagccgccgaaggacacggcgattaaaaaaatcgaggaactcaccaatactaagctcgatttaatgtgggtgcctgatgcggtaaaagaggaccgtttaaactcagcgctcgccgccggaaacctgccgaaagtcgtcaccattcaggacattaaaaattcatctgtcatgaatgcattcagatcggggatgttttgggaagtcggaccttatttaaaggattatccgaatttaagcaagatgaacaagctgatcaataaaaacgcttcaatcgacggaaagctttatggcatctacagggagcgcccgttatcaagacaggggatcgtcatccgtaaagactggcttgacaaccttggactcgatatgccgaagacagttgatgaactttacgaaacagcgaaggcatttacagaaaaagatcctgatcaaaacgggaaaaacgatacgatcggctttgccgacagaaacgatttgatctacggcgcctttaaaacattggggtcctatatgggcatgccgactgattgggaggaaaaagacggcaagttcacgcctgacttcatgacaaaagagtacatggatacgatgaaatatatgaaaaagctgtatgatgaagggctgatcaacaaagactttccggtgacgagcaaaacgcagcagcaagaaatgttttcacaagggaaggccggcatttatgtcggaaatatggttgatgccgtcaatctaagagaccagtctgtcgatgataaaatggaacttgagatcatcaatcggatcaaagggccggacggaaaggaacgcgtctgggcatcaggcgggcataacggaatctttgccttcccgaaaactagcgtcaaaacagaaaaagagctgaagaggattctggcctttttcgaccggatcgccgaagaggatgtttacagtctgatgacatacgggatcgaaggcgttcactataaaaaagaagggaataaacaattcaaacggatcgacgagaaactgaaagactggcaggcggaaattcagccgctcgtttctctcgtcggcattgataagcaatatttgaaaaatacgggcgatccgctccgcacaaaatatgaagagctgacagaggacaataacgaaatcatcgtctcaaacccggccgaaagcctgtactcaccggccgcatctgaaagaggcg

SEQ ID NO: 680 - DNA, 1297 bp, Bacillus licheniformis
gtgaaaaggttcctttcatctatctttatggtcacggtcgctgtatgtttgcttttatcggggtgcaaggcgagtcctgcctccgatcaagcggacggcaccgaactgacattttggacattcaacggccttcatgaacagttttatgctgagatggtgaaagaatggaacaaaaagtatcccgagcgaaaaatcaaattaaatacagtggtgtatccgtatggacagatgcatgacaatttatctatctcgcttttagccgggaaaggggttccagatattgccgatgttgagctggggcgctattcgaactttttgaagggctctgacattcctcttaccgatttaacgccgcttgtggaggacgaacgcgacaagtttgttgaagcgaggctgacgctctacagcaagaacggcaagctttacggacttgacacacatgtcggaactaccgtgatgtattacaacatggaaatgatgaataaagcaggcgttgatccggacgacatcaaaacatgggaagattacagggaagcgggcaaaaaggtcgtcaaagctctcggaaagccgatgacgacgattgaaacgaccgacccgaattcatttctgccgctggtttcccagcagggatccggttactttgatgagcaggggcggttgacattaaacaatgagacaaacgtgaaaacgctcgaatttttaaagactttaattgagaaagacaaaattgccgtcacaacgcccggaggcaatcatcacagtgaagagtattacggatttatgaaccaaggcggcgcggcgtctgtcttaatgccgatctggtatatgggccgttttttggattatatgcctgacttgaaagggaaaatcgcgatcagaccgctgccggcatgggaagaagggggagaccgctcagcgggaatgggcggaacggccaccgtgattccaaaacaggcgaaacaggtcgatctggccaaggatttcttgaaatttgccaaagcgtcaaaagaaggcaacatcaagctgtggaccgtgctcgggttcgatccgctcagatgggatgtgtgggactcggacgaattgaaaaaaccaaatcaatatacagaatactttcaaaacggacaacacatcttttccgtgcttcttgacataaaggatgagatcaatccgctttaccttactgaggattatgcgaagacttccgatctcgtcaacagaaacatactgtacgaagcgctcaaaacgaagagcaaaacaccgaaagaagcattggacaaagcagcagctgaagtgaaag

SEQ ID NO: 681 - DNA, 1374 bp, Bacillus licheniformis
ttttgaaaggccataagtttgctttaaaagacatcgctgaaaatgaaaacgtcatcaaatacggctttccgatcgggcacgccactgaaatgattcagacgggagagtgggtgcacacgaaaaatgtgaaaacgaatttgggcggtgtcgaagaatacagctacaagccgaagtttacggaaaaccgctatcaaaaagaaccgcttacatttaaaggctttaaacgaaaagacggaaaaaccgggatcagaaacgagctatggatcgtcccgactgtcggctgtgtaaatggcattgcagagctgatcatcaaagaatttaaggctgaggtcggctccatcgccccttttgaaagcgttcacgtattaaagcatcagtacggctgttcacagcttggcgacgatcatatcaacacgagaacgattttggcgaatgccgtcaaccacccgaatgcaggcggtgtccttgtgctggggctcggctgtgaaaacaacagcattcacgaattccgcgaagcgctcggcgattacgatcacagccgggtcaagtttctgctttcccaagaggtatcaaacgaagtcacggaaggcgtcaaactgttaaaggaaatttataagcatgcaaaaggtgaccaccgcgaagatgttccgctttctgaactgaaaatcggtttgaagtgcggcggatctgatggattttccggcattaccgcgaacccgctgctcggccggctctccgattttctgatcgcccaagggggaacggcggtgttgacagaagtgcctgaaatgtttggggcagaaacgctattgatggagcgggctgaaaatgaggaagtgtttcataaaattgtccgcttaatcaacgattttaaacagtactttatcgatcacaggcagcccgtctatgaaaacccgtctccgggaaacaaagcgggcggcattacgacattggaagataaatcgctcggctgtacgcaaaaagccggcacttcaaaggtggcggatgtccttgaatacggggacgttttgaaaaagaaagggctgaacctgctgagtgctccgggaaatgaccttgttgcttcatccgcactggccgctgcagggtgtcaaatcgttttatttacgacaggacggggaactccttttggcacctttgtgccgacgatgaaaatttcgacaaatacggcgatttatgaggcaaagcgccattggatcgattttaatgcgggaaaggtgctcgaagaccgatcagaagatgacgttttgaaggagctgacagcgtatttgatcgaagtcgcaagcggcaggcagctgaacaatgagataaacgatttcagggagcttgcgatatttaaaacaggcgtcacattat

SEQ ID NO: 682 - DNA, 1070 bp, Bacillus licheniformis
  misc_feature (1)...(1070): n = A,T,C or G
atgggcaagtattttggtacagacggtgtaagaggcgtggcaaacagtgaacttacacctgagctggcctttaaagtcggacgctttggcggatatgtcctaacaaaagataaggagcgtcccaaggttctgatcggccgtgacacgcgcatttcagggcatatgctggaaggggcccttgtagcaggccttctttcgataggagcagaagtcatgcgtctcggcgtgatttcgacgcccggagtcgcatatttgacgaaggctatggacgcggaggcgggtgtgatgatttccgcttcccacaaccctgtccaggacaacggaattaagtttttcggcggcgacggctttaagctttccgatgaacaggagcttgaaatcgagcgtctgatggatcagccggaagatcacctgccaaggcctgtaggcgctgatctgggcatggtgaacgactactttgaaggcggacagaaatatttgcagtttcttaagcagtctgctgatgaagacttcacaggcattcatgtcgcgcttgactgtgcgcacggggcgacatcttcgctggcgacccacctgtttgccgatcttgacgcagatgtatcgacgatggggacttctccgaacggattaaacatcaatgacggagtcggatcaacccaccctgaagccctggcagaatttgtgaaggaaaagggagctgacgtcggcatggcgtttgacggggatggcgaccgcttaatcgctgtcgacgaaaaagggaatatcgtagacggcgatcaaatcatgtacatatgcgcgaagtacttgaagagcgaggggcgcctgacggacaataccgttgtctccacggtgatgagcaacctcggtttctacaaagcgcttgaagcggaaggcattaaaagcgttcagacagcggtcggcgaccgctatgtagtggaggcgatgaaaaagggcggatttaccctcggcggagaacagtcgngacacctgattttccttgattacaatacgacaggcgacggactgctttctgcgatcatgctgatgaacacgattaaaatgacaggcaa

SEQ ID NO: 683 - DNA, 1234 bp, Bacillus licheniformis
atgcatgaagcaggaaggagctacagaatgagtgaacttttggcaacatatatcttggccgatccaggctgtgacgcagaaaagcgggccgagcaaatcgcgatcgggctgacggtcggatcgtggacagatctgccgctcttaaagcaggagcagctgaaaaagcataaaggacgcgtcgtcaacgtcgaagaaacagaaagcgagctgggggaaaaacaggcaacggtcaccatcgcctatccggaagccaattttacaaacgacattcccgctgtgctgacgaccgtttttggaaagctgtctctcgacggaaaaatcaaattggcggatttggagttttcgcggtcttttaagcaatctttgccgggtccaaaattcggcgtatacgggatccggaaaaaaatcggcgaatttgaaaggccgctgttgatgagcatttttaaaggcgtcatcggccgcgatatggaagacttgaaggaacagctgaggcagcaggctcttggcggagtggatttgatcaaggacgatgaaatcctattcgaaacaggcagtgccccctttgaaaaacgaatcacggaaggaaaaaaagtgcttgaggaagcctttgaagaaacagggcgcaaaacgctgtatgccgtcaacctgacgggcaggacaatggagctgaaagcgaaagcgagaaaagcagccgagctcggagctgatgttttgctgcttaatgtgtttgcctacgggctcgatgttttgcaaagctttgcagaagacgatgacatcccgctgccgattatggcgcacccggcagtaagcggcgcacttacttcatcgccgcattacggtttttcccattcgctcttgctcggcaaactgaaccggtatgcgggtgccgatttcagcctgttcccttctccgtacggaagcgtcgctctgccgaagcgagatgcgcttgccatatacgatgaatgcacgaaggaagacgtctttaaaccgacattcgcggtgccgtcggccggcattcaccccggcatggtcccgctcttgatgaaagactttggcattgaccacatcatcaatgcaggcggggggattcacggccatccaaacggggcggcaggcggaggaagagcgtttcgggcggtcattgatgccgtcttagaagcggagcctgtcgaagagaaagcaaagcgctctcccgatttgaagctcgcccttgaaaaatggggaagggttgagg

SEQ ID NO: 684 - DNA, 1314 bp, Bacillus licheniformis
cgttaaaatggttcaaagatcgactggggcatcaatgtcttccgcccgggccatgtacacagctgaaggcggctatattgacaatccgtcggttaaaaacaaagtgaagcaagccgttgaagcggcaaaagaactcggaatctatgtgatcattgactggcacatactgagcgatggcaatccaaaccaaaacaaagcgaaagcaaaagaattttttaacgaaatgtcaagactttatggcaagacgccaaacgtcatttttgaaattgccaacgagccgaacggcgatgtcaactggaatcgcgacattaaaccttacgccgaagaaatcctgtccgtgattcgcaaaaactctccgaaaaatattgtgattgtcggaacaggcacctggagccaggatgtcaatgatgcggcggacaatcagctgaaagacggcaatgtcatgtacgcgctccatttttatgcgggcacgcacggtcagtctttgcgggataaagccgattatgcactcagcaaaggagcgccgattttcgtcacagaatggggaacgagcgatgcttcaggaaacggcggggtctaccttgaccaatccagggagtggctgaaatatttagacagcaaaaaaatcagctgggtaaactggaacttatccgacaaacaagagtcgtcagcagctttaaacccaggcgcctctaaaaacggaggatggtcgcaatccgacttgtccccatcaggcaaattcgtcagggataacatccgcagcgggtcaaacggttcgtcaggagactctggatcgaattcgaaagggtcagatcaaaaagaccaaaaaaaggatcaggataaaccaggtcaagacagcggcgctgcagccaacacgatagcagtacaatacagagcgggggacaacaatgtaaacggcaaccaaatccgccctcagctcaacattaaaaacaacagcaaaaaaaccgtgtctttaaatcgaatcactgtccgctactggtataaaacgaatcgcaaaggacaaaattttgactgcgactatgcccaaatcggctgcagcaaaatcacgcacaaattcgttcaattaaaaaaagcggtaaacggagcagacacgtatcttgaagtaggatttaaaaatggtacattggcgccgggggctgatactggcgaaatccagatccgtcttcacaatgacggctggagcaattatgcccaaagcggcgactattcattttttaattcaaacacgtttaaaaatacgaaaaaaatcacgttgtatgagaacggaaagctgatttggggcactgaacctaa

SEQ ID NO: 685 - DNA, 1380 bp, Bacillus licheniformis
atgattcataaagaaatcgctgtacgttttatacagcttcttggcggagaagataatgtcatcagtgcagctcattgtgcgacaaggcttcgtttggtgattaaggacgaagcaaaaatcgaccaggaaaaggtcgaagagctggaaggtgtaaaaggagccttttcaagctctggtcaataccagattattttcggaacagggcttgttaataaagtgtatgaacagtttgccaaagagctgaatcttgaccaaaaggaaacggttcagcacagcgatgccgcaaagggaaaaatgaatcctttagcgcgatttgcgaaaacgctgtcaaatattttcgtgccaatcatcccggccattgttgcaagcggtttattaatggggctgttgggaatgatgaaggcatttcagtgggtcgatcctgatgcggcgctgtataaaatgcttgatatgttctcgagcgcggcatttattatccttccgatcttgatcggtgtcagtgctgcgaaagagtttggcagcaatccttacctgggggctgtacttggaggaattttaattcacccgagcttgttcaatccttggggacttgcaactgcatcaccggatgtgatggacttttacggactcaaaatcgagatgcttggctatcaaggaaccgttgttccaattttgcttgccgtatatgtgatgagtaaaatcgaaaaaggcgtaagaagaatcgttccaaatgcgatcgatctattagtaacaccgtttgtcacgattatttcaacgggattcattgcttttatcgcgatcggtcctttaggaagaatgcttggtacagggatcacgaacattttaacatatgtgtatgacgttgccgggcctgttgccggactgattttcgggggaacatactcgctgatcgttctaactggtgtccaccacagtttccatgcgattgaggccggccttatcgctgatatcggcaggaactacctgctcccgatctggtctatgtccaatgtagcccaaggcggggcaggaaaagccgtattctttttggcaaagcgtgcaaaaacaaaagaaattgctttacctgccgctttctcttcttttctcggcattaccgaacctgttattttcggtgtcaacctccgttaccgccggccgtttatcgcggcaatggccgggggagcgctgggagctgcatacgttgtctttatgaatgtggcagccaacgcatacggtttgaggggccctccgatgaatgcgattgtcgccccgcttggaatgggcaacatgatccactatttaatcggaatggcgatttctgtgactgtcgcatttatcacagcctttatcttaggcattaatgaagacgagaaaaagtga

SEQ ID NO: 686 - DNA, 1233 bp, Bacillus licheniformis
cggatgcagttcaaacactgaagaggcggccggtgcggacggcaaaaagaaggttaccttaagggtcgcatggtggggcggacagcctcggcatgattatacatcaaaaatcattgagctgtatgaaaaggaacatccgcatgtcaaaatcgaagcggagtttgcgaattgggacgattattggaaaaagcttgccccgatgtccgcggcagggcagctgcccgatgtgattcaaatggatatggcgtatttatcccaatacggcaagaaaggccagcttgaagatctgactccgtatgtcaaagacgggacgatcaataccgaatcgattgatgaaaagacgatcaaaggcggaaaaatcggtgatcagctatacggcttcccgctcggtgtgaatgtactgtcggtgattaccaatgacgacttgctaaaagaagcgggcgtcgagattgacgatggcagctggacgtggaccgattttgaaaacctggcgctagaggtcgaagagaagacgggacaatacggttcaaacggcatgcatccgcccgatgtctttttcccgtactacctcaggacgaagggcgagcgcttctataaagaggacggcacaggccttgcttattcagacgacaagctgtttgtcgattacttcaagcggcaggtgaagctcgtcgatgaaaaagcttcgccgacgcctgatgaaagcgcgcaggtgaaggggatggaagacgattttatcgtcaaaggccgaaccgctgcaacatggaattattcaaatcagtttgcggcgttcgcgcagcttaccgatgcgcccctgtcattaaagctgcctcctgaacaggcgaaggaaaaggcgctgtttttaaggccgagcatgctgttttcaattccgaaaagctccgaacagaaaaaagaagcggctgcatttatcgacttctttattaacaatgaaaaagccaatgccctgatcaaaggagaaagaggcgtaccggtctcctccaaaatagcggaaacagtgaagtcagaactgagcgaagaggagaaaaagattttcgaatatgtcgaacgggctacggagtacgcgggagaagcggaaccgcctgagccgatcagcagcgccgaagtcatcaagctgctaaaagacacgtcagaccaaattttgtttaaaaagatcacgcctgaagaaggagccgcgaagttcagaaaagaagcggacgccatactgaaaagaaa

SEQ ID NO: 687 - DNA, 1008 bp, Bacillus licheniformis
atggcagtaaaagtcggtattaatggttttggtcgtattggacgcaatgtattccgcgcagcattaaataatcctgaagttgaggttgtggcagttaacgatttgacagacgctaacatgcttgctcacctattacaatatgattcagtacatggaaaattggacgcagaggtttctgttgacggaagcaaccttgttgttaacggtcaaacaatccaagttacagcagagcgcgatccttctaaactaagctggggagagcaaggtgttgaaatcgttgttgaatcaactggtttcttcacaaaacgcgcagatgcggcgaaacatttggaagccggcgcgaaaaaagttatcatctcagctcctgcgagtgaagaagatattacaatcgttatgggtgttaacgaagataaatacgatgcggctaaccaccatgttatctctaacgcatcttgcacaacaaactgccttgcgccgtttgcaaaagttctgaacgacaaattcggcatcaaacgcggtatgatgacaactgttcactcttacacaaacgatcagcaaatcctggatcttccgcacaaagactaccgtcgtgcgcgtgcggcagctgagagcatcattcctacaacaactggtgctgcgaaagccgtttcccttgtacttcctgaactgaaaggaaaactgaacggcggagcaatgcgtgttccaacaccaaacgtatcacttgttgacctggttgctgaacttgacaaagaagtaacagcagaagaagtaaacgcagcgcttaaagaagcagcagaaggcgaacttcaaggcgttcttggctacagcgaagagccgcttgtatctaaagactacaacggcaatacaaactcttctacaatcgatgctctttctacaatggttatggaaggcagcatggttaaagttatttcttggtatgacaacgaaagcggatattctcaccgtgttgttgaccttgccgcttacatcgcaaaacaaggtctttaa

SEQ ID NO: 688 - DNA, 1186 bp, Bacillus licheniformis
atgcatattaaaatgaaggacatttttaaagcctttggccaaaaccaggtgctgtccggcgtttccttcgagcttcaagaaggtgaagtccacgctttaatgggagaaaacggcgccggaaagtcgacactcatgaatctgttgactggacttcacaagctggacagcggaacgatcgagatcgacggaaaagaaacgtatttttcagatccaaaggaagccgaacagaacggaatcgcctttatccatcaggagctgaacatttggcctgaaatgaccgttttggaaaatctgtttatcggcagagagctttcttccaaacttggatttttaaacaacaagaaaatgaaagcgctagcaaaagagcagcttgaaaggctcggtgtctcaatttctcttgaaaaagaagccggagactgttccgtcggccagcagcaaatgatcgaaatcgcaaaagcccttatgacagacgcgaaagtgatcatcatggatgaaccgacggcagcgttgacagaaagagaaattgaaaaactgttcggcgtcattagagcattaaagaaaaacggcgtctccatcgtctatatatcccaccgcatggaagaaatcttcacgatttgcgacaggatcacggtgatgcgcgatggaaaaacggtggacacgaaacggattcccgacaccgactttcatgaagtggtgaaaaagatggtcggacgggagctgaccgaacgctatcctgaaagacagccaaatccgggacgcgtcgtcctcgaagtcaagcaggcatccaaaaaaggagtcttccaaaatatcagcttttccgtccgctccggcgaaatcgtcgggatttcaggactgatgggtgccgggcgcaccgagctgatgagagcggttttcgggctcgatccgcttgactcgggagacattttcatcgaaggcaaaaaagcggcgctcaaaaaaccgagcgatgccgttcaaaagggaatcggctttattaccgagaaccgcaaggatgaaggacttgtgctcgacacgtccatcagagaaaatatcgcccttccgaatctcgccagcttttcgccgaaaggatggattgacaaaaaaagcgagcaggaatttgtcgatcttctgatcaagcggctgacgatcaaaacggaatcgccggaaacccacgcgcgaaacctttcca

SEQ ID NO: 689 - DNA, 1176 bp, Bacillus licheniformis
aaacgggccaaaccgtcgacatctggaatcaggacggcggaacaagcacagagcaggcatataaaaatgtgccgttctatttgtcaaacaaagggtacggtgtttttgtcaatcatcccgagctcgtctcgtatgaaatcggttctgaagtcgtatccaaagcgcagttttcggtcgaaggagaatcgctcgactattttgtcatcagcggcgccgaaccaaaggatgttttgaaacgctatgccgcgttaacgggaaaaccggcgcttcccccggcctggtctttcggcctctggttgtcaacatcgttcacaaccgactattccgaggagaccgtgacccgcttcatcgacgggatgaccgaacgcggcatcccgctcagcgtgtttcattttgactgcttctggatgaaagaatttgaatggtgcaatttcgaatgggatgaacgatattttaagcagcctgaagccatgctcagccgcctgaaagaaaagggcctgaaaatatgcgtctggatcaacccttacatcgcgcaaaaatcaaagctttttcaggaaggaaaggaaaacggctacttcttgaaaaacagccggggggatgtatggcagtgggaccggtggcaggccggaatggccatcgtcgacttcacaaatgaaaaagcgcgtgactggtattgttcaaagcttgaaagcctgctcgacatgggggtcgactgctttaagaccgatttcggagaacggattccgagtgacgctgtttactttgacggatcagatcccgaaagaatgcacaattattattcttatttatacaacaagaccgtatttgacttgttgaggcaaaagcgcggcgaacgggaagcggtcgtgtttgcaaggtctgcgacggccggcggccagcaatttcccgtacactggggcggggattgttttgccagctatgattcaatggctgaaagcctgcgcggcggcctgtcgctttctctttcaggcttcggcttctggagccatgatatcggcggatttgaaagcacggcaacagccgatttgtataagcgctggaccgcattcggcctcttgtcgacgcacagccgcctgcacgggagcgagtcataccgcgttccgtggctgtttgacgaaaaagcggacgatgtcatgcggcattttgtcaaactga

SEQ ID NO: 690 - DNA, 1374 bp, Bacillus licheniformis
atgttgggatttcttcaaaatatcggccgcgcgctcatgctgccgattgccgttcttcctgctgcgggcctcctgctcgcactgggacgggaagacctgttaaacattccgtttatcgctgcttcaggacaatcaattcttgaccaacttccgattatctttgcgataggcgttgcgatcggattgtcaaaggatggccacggggccgccgctctgtccggagccatcggttattttgtcctgacaggcggcttagcagccatcaataaggacctgaacatgggagttctcggcgggattattgcaggcgttgtcgccgccgtcatgtataaccgctttaaagatgcaaagctgcctgactggctcggtttcttcggcggaaaacgcagtgttccgattatgacagccttctgttccatcattcttgcaggcattttcggcttcgtctggatttatgcacagcaggcaattgacgccattggaggatggatcattcatgcgggggcattaggggtcgggatattcggtcttttaaacaggctgcttttgccgctcggccttcatcacatcttaaacaacatggtctggatggtctttggagaatttgcaggcaaaacgggtgacatgaaccggttctttgccggagatccaagcgccggcgcctttatgacagggttcttcccgatcatgatgttcggtcttcctgcggcgtgtctggcgatgattgccgctgcgaaaaagcatcgccgcaaagcaacggccgggttgctgatcggattggcgttcacatcatttttaaccggaatcacagagccgattgagttcacattcatgttcctgtcgccgcttctcttcggtattcatgccttgttaaccgcaagcgccatgaccgtgaccaatatgctcggcatccatcacggctttaccttttcagccgggacgatcgactatctcttaaactttggaatcgccacaaagccgctgctcttgcttccgcttggtcttgtttacggcattatttatttcatcatcttttatttcttgataacgaagctcaatttgaaaacgcctggacgagaagatgacgatgagcaggaaaacaccgctgtcagccctgacacaggatcgtctaaatacgaaacccttgcggacaaatacatcgaagcgcttggcggaaaagaaaacatcgagacgctgaacaactgcgtgacccgcctccgcctcaaggtccgcgatgcttccaagctggatgaaagcgcgatgaaatccatgggagcgaagggattcgtcaagctcaatcagcacgaggtgcaggtgatcatcggtacagacgtcgaattcttggcgaatgaaatgagaaaacgtacggaataa

SEQ ID NO: 691 - DNA, 911 bp, Bacillus licheniformis
atgactagttatatgttaggcatagatatcggtacgacaagcacgaaagcggttttattcagtgaaaaaggggacgtgatccaaaaggaaagcatcggctacccgcttcacacgccggacatctcgaccgctgaacaaaacccggatgagatctttcaggccgtcatccagtcaacggcgaaaatcatgcagcagcatcccgacaaacagccgtcattcatttcattcagcagtgcgatgcacagcgtgattgcgatggacgaaaacgacaagccgctcacctcctgcatcacttgggcagataacagaagcgaaggctgggctcataaaatcaaagaagaaatgaacgggcacaatatctacaaacggacgggaacgccgattcacccgatgacgccgctaagcaaaatcacgtggattgtgaacgaacatcctgaaaccgctgccaaagcgaaaaaatatatcggaatcaaagaatatattttcaaaaaactatttgatcaatatgtcgttgatcactcattagcttcggcgatgggaatgatgaatctcaaaaccttggcctgggacgaggaagcacttgcgattgccggcatcacgcccgaccacttatcaaagctcgttccgacaacagcaattttccataattgcaatccggaactggcggcgatgatgggaatcgatccgcaaacgccgtttgtcatcggcgcaagcgacggcgtgctgtccaacctcggcgtcaacgcgattaaaaaaggcgaaatcgccgtcaccatcgggacaagcggcgcgattcgcacgattatcgatgagccgcaaaccgatgaaaaaggcagaatcttttgctatgccttaactgaaaaccattgggtcatcggcgggccagtcaacaacggcgggatctcctcgcg

SEQ ID NO: 692 - DNA, 966 bp, Bacillus licheniformis
atggaaagaagcttatcgatggaacttgttcgtgtgacagaagcggctgcgctaaagtcagcgcgctggatgggaagaggtaaaaaagacgaagccgacgacgctgcgacaagcgccatgagggatgtgtttgacaccattcctatgaagggaacggtggtaatcggagaaggggaaatggacgaagcgccgatgctttatattggagaaaagctcggcaacggctacggccctcgagtagacgtagcagtagaccctctcgaagggacgaacatcgtcgctagcggcggatggaacgctctcgcagtcattgcggtggctgatcacggaaacctgctgaatgcgcctgacatgtatatggataaaatcgctgtaggtcctgaagctgtaggctgcatcgatattgaagcgcctgtgattgataacttgaaagctgtggcaaaagcaaagaataaagatgtggaagatgttgtagccacgattttgaaccgtccgcggcatgagaaaatcatccatgagcttcgcgaagcaggcgccagaatcaagctgatcaatgacggggacgtggccggtgcgattaacaccgcttttgatcatacaggcgtcgatattttattcggctcaggaggcgctccggaaggcgtactctcggctgttgcactcaaagctctcggaggggaaattcacggaaagcttcttcctcaaagtgaggaagaactgagacgctgtgaaaagatggggcttgatacgggcaaagtgctccgcatggaagacctcgtcaaaggagacgatgcgattttcgccgcaactggcgtcacagacggagagctcctgaaaggcgtgcaattcaaaggatctgttggaacgacccacagcgtagtcatgagggcaaaatccggtacggtacggtttgtggacggaagacacagtctcaagaaaaaacctaacctagtcatccggccataa

SEQ ID NO: 693 - DNA, 1013 bp, Bacillus licheniformis
atgaatcaggaaacgagaacgctttttcaaacgcttacggagctccccggcgccccgggaaacgaacatcttgtccgtcgcttcatgaaaaaagagcttgaaaaatatgctgatgagatcatccaggacagacttggaagcgtgttcggcgttaaacatggacctgaaggcagtccaaaaattatggtggccggccatatggatgaagtggggtttatggtcacatcaattacagataacggcctgcttcggtttcaaacgctgggcggctggtggagtcaggttttattggcccagcgggtggaaatccacacggacaacggaccgatccccggcgtcatcgcgagcacgcctcctcatcttttgacagatgagcagaggagacgtccgatggatatcaaaaacatgatgattgatatcggggcggatgacagggaagatgccgaacgcatcggtgtcaaaccaggccagcaaatcgtaccgatctgtccgtttaccccgatggcaaatgaaaagaagatccttgcgaaagcatgggataaccgctacggctgcggactcagcattgaattgctgaaagaactgcaaggaacagaacttccgaacaatctttactcaggtgcgaccgtccaggaagagctcggaacaagaggcgcgcaaactgcggccaatatgatacagcctgacttgtttttcgcgcttgatgcaagtccggcaaacgattcgagcggcgacaaaaatcaatttggccagcttggcaaaggagtgctgttgaggattttcgaccggaccatggtgatggacagcgaaatgagaaattttgtgctggatacggcagagacaaatgacatcccgtatcaatattttgtttctccgggaggaaccgacgccggccgtgttcacatctcaaatgaaggcgttccttcggccgtgattggcatttgttcaagatacatccatacatctgcttccattatccacgttgagatctaccttgctgcaaaagaattgct

SEQ ID NO: 694 - DNA, 1192 bp, Bacillus licheniformis
atgacctctgttcatgataaaaaacgcagtatattagcgcttttagccttggcggccagcgcatttgccatcggcacgaccgaattcatcagcgtggggcttctgcctttaattgctgaagacatgaatatttcggtgacgacggcaggactgaccgtatcattatacgcactgggcgtaacagtcggcgcacctgttctgacgtctgtcacatccagtatgccgagaaaagcgctgctgctggtgattatgctcatttttatgatcggcaacgggcttgcggcatgtgccggaagcatcggtgttttattaaccgcccgcgtgatttcggcgttttctcatggcgtatttatgtcaatcggttcaacgattgcggcaagcctagtcccggcggataaaagagccggagcgatatcgatcatgtttaccgggctgacgattgcaatgattaccggagttcccatcggcacgttcctcggtcagcagttcggctggcggattgcttttgcggcgatcgtcgctgtcggcgcactggcgtttatcgccaacagcttacttgttccgggcgatttgccgaaaggcgtccgaacgtctttcaagagccagttgaagcttgtgaccaatgggcggctgctgcttttattcatcattacggcgcttggttatggagggacatttgttgtctttacgtatttatccccgctgcttcagcatgtgacgggctttaaacaggaagctgttgccgtcattttgcttgcttacggcattgccgtcgcgctcggaaatattatcggaggtaaagcggccaacaaaaaaccgcttactgcattattctatatgttcatcgcccaggcggctgtgcttctcatcttaacggcggctgctccttatcaggcagcgggctttatcgtcatcatgctgatgggatttttagccttcatgaatgtccccgggctccagtcctatgtggtgattctggctgaacggtttgttccaggggcggttgatgtcgcatcagctgtcaatattgcggcgttcaacgtcggtatagcgatcggttcttatacaggaggcgccatcacacaatcgatcggattgattcacactccatgggtgggagctttgatggtgctcggcgccgtcgtgctgacaggctggagcagggcgctggaacgaaatgatcaaaaacaaa

SEQ ID NO: 695 - DNA, 857 bp, Bacillus licheniformis
atgaaattagcattggatccatcgatgtatcgtgatgatttgactttggaagaaacggtctataaaacggcggagcttggctacgaatatatcgaactatcgccgcgcgaagatttttgtccattctataaatatccgaaagtcgattcagctaaaatcaaacaattaaagcggcttttaagagataccggtgttaagctttcatcgctccttccgctttaccactgggcaggtcctgatgaagatcgccgtcaggccgccgtgcgcaattggaaaagggcaatcgaaattgcggtcgagcttgaagtcgatttgatgaacagtgaattcagcggttcaaaatacgatcctttaacaagtgaagaaaaatttatcaaatccatggatgagcttctgccaatctttgaaaaagaaggcattaaactcaatcttcaagcccatccatacgattttatcgaaacgcacaaaggtgcgttggatatgatccgcgcgcttgacaaggattggattaatcttgtctactcgactgcgcatacattcttttatgatgacggcaaaggcgacatcgagacaatgtttgacgaagccggcgaccgcctcacacatgttttattcgcagatacgtataatcataaagcggctcatggccttcgctacatcgtcaatccgcctgacgcaaaagtaacggttcaccagcatttggacattggtcaaggcgaggtcgattttgatatgatcttcagaaagctgagagagatgaagttcgacggaattgcgacgaacgccgtttttgcttgggtcgatgaaagagcggatgaatcaagcagattcatgcttgaaaaattgaaacaagaatt

SEQ ID NO: 696 - DNA, 1041 bp, Bacillus licheniformis
agagcttcaggatcaaatcgaagaaatcggcgtcggcgagatcgcaacattgtcagggccgctactattcaatggaccgagacaagcgctgggaccgcgtcgaaaaagcgtaccgcgccatggcatacggagagggaccgaaatatcaaaatccgctcgatgtcgtgaaagattcttatgaaaacggaatttacgatgaattcgtgattccttccgtcattacgaaagaaaacggcgaacctgttgcgacaatcaaggacaacgatgcggtcattttctacaacttcagacccgaccgtgcgatccagatttccaacacgttcaccaatgacgacttccgcgacttcgaccgcggagacaagcatccgaaaaaccttcatttcgtttgcttgacacatttcagtgaaacggttgacggatacgtggcattcaaaccggtcaatctcgacaacacagtcggcgaagttttatcccaaaacgggctgaagcagcttcgcatcgctgaaactgaaaaatatccgcacgtcacattctttatgagcggcggacgcgaagaaaagttcccgggcgaagagcgaatcttaatcgactcgcctaaagtcgcaacatatgacttgaaacctgaaatgagcgcatatgaagtaaaagatgcgcttgtcaaagaaattgaggctgaaaagcataacgcgatcatcctcaactttgccaaccctgacatggttggacattcaggaaaagtcgagccgacggtcaaagcaatcgaagcggttgacgagtgcctcggcgaagtcgttgatgcgattcttgcaaaaggcggctacgcgattattacggccgaccacggtaacgcagacgtgctgattaccgaagaaggcaagccgcacaccgcacatacgacaaacccggttcctgtcatcgtcacaaaagaaggcgtgacattaagagaaggcggaatcctcggggatctggcgccaactcttttagacttgctgggtgttgaaaaaccgaaagaaatgacaggatcgtcattaattcaaaaat

SEQ ID NO: 697 - DNA, 882 bp, Bacillus licheniformis
cgaaggcgcgggtcattttgtcaaaatggtgcacaacggcatcgaatacgcagacatgcagctcatcgccgaagcatatacgtttttaagagaaaagcttcttttgccgatagatgaaatcgctgacattttcgacacgtggaatcaaggagagctgaacagctatttaatcgaaatcacggcggagatcctgcggaaaaaggatgagaagacgggcgctccactcatcgacgtcatcctcgacaaaaccggccaaaaaggcacgggcaaatggacgagcctgcaggccgtcgacaacggcattccatcatcgattatcacggaatccctgtttgcccgttacctgtcatcattaaaagacgaacggacagctgcggaaaaagtattggccggacctgcaacagaagaacggcgcctggatcaaaacgtgtggatcgaccgcgtcagacaggcattatatatgggcaaaatctgcgcctatgcacaaggcttcgctcaatacaaaatgacatctgacctgaacggatggaacctgccgttaaaggacatcgccctcatcttccgcggcggctgcatcatccgcgcacaatttttaaatctcatcagcgaggcgttcgacaaacagccggacctgtccaacctgctggtcgcacctgacttcgctgaaaaactaaaagaataccagtccggcttgcggaaggtcgtctgcgaaggcatcagctcaggcatctcattcccgtgcctaagcactgccctttcctattacgacggctaccgcacaggccgctcaaacgcaaacctcctgcaggcccagcgcgattatttcggcgctcacacgtatgagcggacggatatggaaggcgtgtttcatacggactggta

SEQ ID NO: 698 - DNA, 1046 bp, Bacillus licheniformis
atgaaaatggttttcagatggtatggagaaggaaacgactccgtcacccttgagcagatcaggcagattcccggtgtggagggaatcgtttgggcgcttcatcatcagccgccgggtgaagagtggccattggaagaaattttagaagtgaagcggcagtgtgaacagcacggttttcacattgaagttgttgaaagcgttaacatccatgaggatataaagcttgggctgccgacgagagatctgtatattgaaaaatacaagcgaacgattgaaaatttggccaaagccggcgtaaaagtgatctgctataattttatgcctgtatttgactggctgcggaccgatttgtacaaaaaggctccagacggttccaccgctttgttctatgagcacgcaaaggtgcacacaatcgacccttttgcgcttgtcgatcaaatcgccaagcatcccgaattcacgatgcccggctgggaaccggagcggcttgagcatctgacaaggctgtttgaagcctatcaaaatgtgacggaggaggatctgtggagccatcttcactattttcttgaacgcatcattccaaccgccgcacgctgcggaatcaaaatggcgatccatcccgatgatccgccgtggccggttttcggactcccgcgcatcatgacttcaggagaaagcatcgggcggctgctacagcttgtcgatcatccggcgaatggcgtgacactgtgcagcggttcattgggcgccaaccccgaaaatgatatttccgccatgatccatgcgtatgccgaccggattccatttgcccatatccgaaacgtcaaagtctacgaaaacggcgattttatcgaaacatcgcacagaacaaaagatggcacagttgacatttgcgggattgtcaaagcctatcatgaaacaggtttttcaggctatgtgcgtccggatcacggccgccacatttgggatgaaaagtgcaggcccggctacggtctgtatgacagggcgctcggtatcatgtatttatggggcatatgggattcgct

SEQ ID NO: 699 - DNA, 1209 bp, Bacillus licheniformis
tatgcagacaccggtgcaaacggataaagaccgcgctcagcccggctactttcagctgtttcgcgatatgtataagcagaatatccggaaatacagcatggtcattgcgctcgtgtttattatgctgctgtttcaaatattgacagacggaattttgctgagaccgctgaacattacgaacctgattttgcaaaacagctacattctcattttagcgattgggatgccgctcgtcatcatcacgggacacattgatctatcagtcggttcagtcgccgcttttgtcggcgccgtctccgcgatgatgatcattgaaaacgatatgccgctgtttgcggcggtcgtcctgtcgttgcttctgggagcggcaatcggcgcctggcagggtttttggatcgcttatgtcaagattccggccttcatcgtgacgctggcgggaatgcttttgttcagagggctcacgatgatcgtgctggaggggaaatcgatcgctccgtttcctgtgtccttccaaaaaatggcgtccggttttattccggactggctgaacggaggcacgttccatttgacgacgattgtcgccggagcgggtgtgtcgattctttatctcgtatatcagcttcagcagagaaacatgcagaagaaattccaatttgacttgcagggaaaaggtctgtttacagttaaggtgttttttatcatcgccattatcaacctttttacctacattctcgcgacttatgaaggtatacctctcattttgatcacattgttcgtcttaatcgccgggtatacattcgttatgaaaaaaaccgtcatcgggcggagaatctacgcgatcggcggcaatgaaaaagcagccgagctttcaggaatcaaaacaaaacggctcacctttatggtcttcgtcaatatgggcgtcttagcagccctttcaggcttgatttttgccgcccgtctaaacgcggccactccgaaagcaggaaacctgtttgaacttgacgccattgcggcctgcttcatcggcggggcttcggcttacggcggtatcggcacgatcggcggggccatcatcggcggtcttgtcatgggagtcatgaacaacggtatgtcgctgctcggcctgggcatcgactggcagcaggcgataaaaggcctcgtccttctgattgccgttgcatttgatatttacaataagaataaaacttc

SEQ ID NO: 700 - DNA, 940 bp, Bacillus licheniformis
atggcaaagcttgatgaaacattgatgatgctaaaggaattaactgatgcaaaaggaattccggcgaatgaaaaagaacccagacaagtcatgaaatcgtacatagaaccgtttgccgacgaggttacgacagacagactgggaagcttaatcgcaaaaaagactggacaggctgacggaccgaagattatgattgccggccatcttgatgaggtcggttttatggttacgcggatcgatgacaggggctatctccgctttcagacggtcggaggctggtggagccaggtcatgctggcgcagcgtgtgacggtcgtgacaaagaaaggcgacatcaccggtatcatcggttcaaagcctcctcatgtcctgtctcaggaggcgagaaaaaaatcggtcgatattaaagatatgtttatcgacatcggggcgtcgagcagggaggaagcgatggaatggggcgttcttccgggagaccaggtcgtcccttactttgaatttacggtgatgaataatgaaaaaatgctgcttgccaaagcatgggacaaccgtatcggctgcgcgatcgcaatcgacgtgctgaaaaacctgaaaggagccgatcatccgaatgtcgtctacggcgtcggaaccgtacaagaggaagtagggctgagaggcgcgaaaacagccgcgcatacgatcaagcctgatatcgctttcggtgtcgacgtgggaattgcgggtgatacgcctggtattaccgaaaaagagtcggcaagcaaaatgggaaaaggcccgcagatcatactttatgatgcatcaatggtgtcccataaagggcttcgcgactttgtaacgaatgtggcagatgaagccggcattccgtatcaatttgacgccctctcaggcggaggaacagattcaggatcaatccaccttaccgcgaacggagtgcctg

SEQ ID NO: 701 - DNA, 963 bp, Bacillus licheniformis
atgcggcacatggaaatcaccgcaaaaacagggaagcccgctgttaagacagaaaagaaaccgactgggctagaggccgtaaaacgggataaatggctttatcttctgcttgttcccggtgttttatattttctcatatttaaatattggccgatgtggggcgtattaatcgccttcaaggattattcgccttatctcggattttggcagagcgaatgggtcggattcgagtattttaaagatttctttatgaatcctgacttcttccgtctgctccgaaacacgcttatgctggccgctctcgatttgatctttgcatttccggccccgctcattgtcgctcttttactgaatgaactgcggcacgccatctataaacggtgcattcagacgtttatatatgttccgcatttcgtctcatggacgatcgtcgtcagcataacgtttgtctttttcacggttgatacgggcgtgatgaataaagtgctgcaaagcataacgggccgagagattgcgtttctctcagatcccgaatggttcaggccgatgattgtgctgcaaagcatatggaaggagacgggctggggaacgatcctgtttctggcggcgctcgcttcggttgaccaagagcagtatgaagcggcagtgatggacggtgcaggaaggttgaggagaatgtggcacattacccttccggccatcagaagcacgatcgtcgtgcttctcatcttaagaatcggcagctttttgaacatcggcttcgaacagatttttttaatgaccaattccttaaaccggagcgtagctgaaatcttcgacacatatgtctatgttgtcggaatcacgcagggcgcatacagctacagtacggcagtcggtcttttcaaatcggttgtcgggatcatcctgatattctgcgccaactatatcgcgaaaaagtttgaccaggacggtctgttttaa

SEQ ID NO: 702 - DNA, 1437 bp, Bacillus licheniformis
ggaaaacgattgagcaaatcggggcagcctcattctcattcatgatcccgattttagccggttacatcgcctacagtatcgccgataaaccggggcttgtgccgggaatgatcggcggatacatcgcagcgacgggaagcttttacggcagcgggagcggtgcagggttcctcggcggcattatcgcgggctttctagccggatatgcggcgctggccatcaaaaaattaaaagtgccaaaagccatacagccgatcatgccgatcatcgtcataccggtggtttcctcgctcattgtaggcttggcgttcgtattgctgatcggcgcgcctgtcgcgcaaatctttgaatcattgacggtttggctggctggtatgcagggctcaagctcgattctgctggcattaattttaggggcgatgatctcatttgatatgggcggccccgtcaataaagtggcattcttgtttggctcggccatgatcggtgaaggcaactatgaaattatgggaccgatcgccgtcgccatttgtattcctccgatcgggcttggaatcgcaacgtttttagggaaaagaaaatttcaggcgcaagaaagagaaatgggaaaagcagcatttacaatgggattattcggcattactgaaggcgccatcccgtttgctgcacaggatccgctccgcgtcataccaagtattatggcgggttcaatgacaggttccgtgatcgccatgatcggtaatgtaggggacagagtcgcccacggcggaccgatcgtagcggtgcttggcgctgtcgatcatgtgttgatgttctttatcgctgttattgccggatccctggttacctctcttttggtcaatgtgctcaaaaaagaggtcacagctgcacccgcagggataagtgaagctgctgcagggaacgacattccccaaccgaacatcgaaatcgaagcggaaagcaaaaaaatcgaaaagccggaaattacaaagctcacagacatcatcgatacagatttgatcgaacctcatttgtcaggagatacgagagacgacattattgatgaaatgatccaaaaattgtcccggaaaggcgtactgcattcagaaagcgaatttaaacaagctatcatcaatcgcgaacttgagggtacaacggcgatcggtatgaatatcgcgatcccgcacgggaagtctgatgccgtcaagaagccgagtgtagcattcggcattaaacgttcgggcgtagactggaggagtcttgacggaactgacgccaaactgatttttatgatcgccgtcccgaaagaaagcggaggaaacgagcatctgaagcttctgcaaatgctctccagaaaactgatggatgacacctaccgggacaagcttctctctgcccaaacaaaagaagaagcatacaaacttctggatgaaatca

SEQ ID NO: 703 - DNA, 1088 bp, Bacillus licheniformis
atgttaaaactgtttaagccagcaccgccgattgagcggctgccggaagatcaaattgattcggaatataagaaattcagactgcaagtttttctcggcatcttcatcggttatgcggcatactatttaattcgcaaaaatttctcgcttgccatgccttatttgatcgaagagggcttttcaaagtcggcgctcggctttgccttgtccgctctatccatctcttacgggctgagcaagttcgtgatggccacgatatcggaccggagcaatccgaggatgttcctgcccgccggtttgatcctttccgctgtcatcagcctcttgatggggtttgttccttttttcacctcatcgatcgccattatgtttatcatgctgttcttaaacggctggttccagggcatgggatggccgccgtcagggcgtgtccttgtccactggttcagcgtcagcgaaaggggaaataaaaccgccatatggaatgtcgcccacaatgtcggcgggggactgatggcgccgattgccgttgccggcgtcgccatcttctcaggcataacgggatctgctacaggctatgaaggtgtgtttattttgccggccttggtcgccatcgccgttgccgtcatttcttactggctgatccgggatacgccgcagtctgtcggacttcctccaatcgaggaataccgcaacgattattcaagcaaatcgaagaaaacctttgaaaaggaattatcaacgaaagaaatccttttcaaacatgtattaaataataaatgggtgtgggcgatcgcacttgccaacattttcgtgtacttcgtccgctacggcgttctggattgggctccaacctatttaagcgaagaaaaaggctttgacatgagcaaatcaagcgtcgcttattttctgtatgaatgggcggggattccggggacattgctgtgcggctggatctctgacaaatggtttaaaggacgccgcggaccggcaggctttgtctttatggcaggtgttttgatcgcggtgcttgtgtactggttcaacccagccggcaatccgatgatcgacacggcatcattgatcgc

SEQ ID NO: 704 - DNA, 963 bp, Bacillus licheniformis
atgaaaactcaaccggctgtgaaaaaaagccttaatgttgattctgtaatgcaaaagctcggtccgtttctcggcctgatcattctcgtcgtcatcgtatcattgttaaatccgagctttttagaaccgttaaatattttaaacttgttaagacaagtcgccattaatgcgctgatcgcgtttggcatgacctttgtcattttaaccggcggcatcgatctttccgtcggagcgattttggcgctgtcaagcgcattgatcgccggaatgatcgccggcggcatcgatcctgttttcgccgtcatcatcggctgcctgatcggagccctgctcggcttggtcaacgggctgttaatcacgaaaggtaaaatggccccgttcatcgcaacacttgccacaatgacgattttccgcggattgacgatggtttatacagacggcaatccgattacagggctcggcaaccactacggcttccagcttttcggacgcggttactttttaggcatccccgtccctgcgattacaatggcagccgcctttatcatcctctgggtgatccttcacaaaacgcctttcggccgccgcacatatgcaatcggcggaaatgaaaaagcggccttgatctcgggcattaaagttccgcgcgtcaaaatgatgatttattctcttgcaggcctattatccgcgttggctggagccatcttgacgtcacggctaaactcagcccagccgacggcaggcacttcctatgaactcgacgccatagccgcagtcgtattaggcggcacaagccttgccggaggaagaggacgaattgccggcacactcatcggcgtcctgatcatcggaacgttgaataacggcttgaacctgcttggcgtctcttcctttttccaaatggtcgtcaaaggtgtcgtcattttgatcgcagtcctgctggaccgcaagaaatccgcttaa

SEQ ID NO: 705 - DNA, 1335 bp, Bacillus licheniformis
gctgtactcagcaaaaggcatcaacggaagaggacggggcgcttgaaatcaattggctcgtaccgctccacacaccgcagcctccgaaagagaaggcgcttgacatcattgaagacaaaacgaatacaaagctgaagctcatctgggttccggattcaacaaaagaagagcggatcaatacaacccttgcaagcggaaacatgcctaaagtaatgacattgcctgatcttgaagattcagcggttgtcagcgcgctgcgctcgggaatgttctgggaaatcggaccgtatttcaaagactatccgaatttaagaaaacttgataaaactatattgaaaaatatttcggttgatggcaaagtttacgggatttatagagaaaggccgatggccaggcagggagtcgtgattcggaaagactggctcgacaatctcggattggaaatgccggaaaccgttgatgacctttataaaatagcgaaagcatttacagaacaggaccccgatcaaaacggaaaagacgacacgttcggtctcgccgaccgcaatgatctcaccttcggagcgtttaaaaccctggcttcgtactttggcgcgccgaacgaatggggaacggacgaagacggaaatctcttcccctattttaagcatgaggcctataaagacgcaatggcatacatgaaaaagctttatgaagaaggcctgatgaacagggactttgcggtgacaagcaaaacgcagcagcaggatttagtgattcaggggaaagcgggaatctatatcggcgcgatgagcgatgccatgaacttgcgtgatcagggactcgctttgaaccccggctttcagcttgatatcgcaaaccggatcaagggccccgacggcaaggagcgcacatgggcgctcggcgggcatggcgggatgttcgccatttcgaaatcaagcgtcaagactgaaaaagaggtcagaaaaatcctcgcattttttgacagaatcgctgaagaagacctcaacaatttgatgttgtatggaatagaaggcgtacactatgaaaagaaaggggggagcggctattttcgaaagcaggaaaactaccatctgtgggaagcggaaattcagccgttaaaccagctgattggcgtcaataaacaagctttaaaaagcgctgaagatccgctccgcgccaaaaatgaaaagcttgaggaggacaaccgggcaatcgcagtccagaatccggccgaaccgctgtattctgccgcacagatggacaggggaacagaattgaagaaaatcattgatgacgccacatttcaatttattctcggggaaatcaatgaaa

SEQ ID NO: 706 - DNA, 1133 bp, Bacillus licheniformis
atgaaagaacaatgtgtggctatgcttttggcaggcggcaagggaagcaggctgaatgccttaaccaaaaacctcgcaaaacccgccgttccatttggcggcaagtacagaatcatcgattttgccctcagcaactgcgccaactcgggaattcatcatgtcggtgtgctgactcaataccagcctcttttattaaactcatatatcggaatcggcgagccatgggatcttgaccgcaatgacggaggggtctccattttatccccttatgctgaagcgtcggaagtgaagtggtacaaagggacggctagcgcgatttatgaaaaccgccattttttaaaggagcttcagcctgaacatgtactcatcctatcaggagatcatatctacaaaatggactacggaaaaatgctcgaataccacgcggagaaacaagctgacgccaccatcgcagtcattgaagtcagctgggcagaagccggccgtttcggcatccttcatacgaatgacaagatggagattacaagcttcgaggaaaagccgaaatatccaaagagcaatttggcatcaatgggtgtctacgtttttaaatggagcgtgcttgaagatgcgttggaacgcgatgaaaaaaattccgcgtcaagccacgatttcggaaaagatgtcattccggctcttctcgaagaaaataagaggctgaacgcttatccgtttaaaggatactggaaggatgtcggtacggtcagaagtttatgggaagccaatatggatctgcttggagatcatcctccgcttgacctgttcgaacggaactggcggatttattcagtctccccgaatctcccgccgcagtttgttgccgatctggcggaaatcaaagaatcgctcgtcagcgaaggatgcaccgtgtatgggtcggtcacccgttcggttatatttcagcgcgttgccatcggcagacattccgccatcaaacgttcagtcgtgatgcatgacgtttcaattggagagtatgttgagatcgaaaatgccattgtatcggcaggaattcgaattccggacggtttttgcgcgaagccggaagatggcgaagtcctgctgatcacagaggagtatgtcaaaaaacataaggt

SEQ ID NO: 707 - DNA, 939 bp, Bacillus licheniformis
ctgaaccgttatttttcgagcctgtttttaaagaaagaatatggggcggaacggctttagcctctttcggctatgacattccatccgaacaaacaggggagtgctgggctttcgccgcacatcaaaatggacaaagcgtcgtgaaaaacggcttgtataaagggctcacattaagcgaattatgggatgaacaccgtcatttattcggacatataaagggagaccgctttcctcttttgacaaaaattttggacgccgaccaagacctatccgtacaagtgcatccaaatgatgaatatgcaaagctgcacgaaaacggggagcttggaaagacggaatgctggtatatcattgattgcaaggaagatgcggagatcatttacggccaccatgccaagacgcgggaagaactggtctcaatgatcgaaaacggaaaatggaatgagcttttgcgccgcgtcaaagtgaagccgggagatttcttctatgtgccgagcggaaccgtccatgcgatcggaaaaggcattttgattttggagacgcagcagaattctgacacaacctacagactatatgattatgacagaaaagacgctgaaggaaacctgcgcgagctccatttgcaaaaaagcatagaagtgatcgacgttccgtcttcccctgatcgcgaaaccgttcaatacgaaacatcgggcgacgtcaagactgccgcactgattgattgtccttatttctcagtagaaaaatgggatgtaaaaggatcggcctgtttcaaacaggataaaccgtttcttcttgccagcgtcatagaaggggaagggcgcatcgcatctggcggccataacttttcatttaaaaaaggagatcacatgctgctgccctggggctttggagaatttacgctcgccggccatgcggaatgtatcgtctcaagcttat

SEQ ID NO: 708 - DNA, 888 bp, Bacillus licheniformis
gcgaaaaaaaagaattgacaatttggcgggttatgcctttatttccccgtttattatcggatttttgtgctttaccgtcattccgatgggagcctcgctgtttctgtcttttacaagctacgatctgttcaccccgcccaaatgggtcggctttgacaactataaggcgatgctgaccgatgatgaaaaatactggggttcgctgaaagttacgttttattacgtgctcgccggtgtgccgctgcgcctcgcgtttgcgcttttcatcgcggtgattttgaacagagccgaaaagggtgtgggcatttaccggacgctcttttatctcccgtccatcatcggcggcagcgtggcggttgcgattatgtggcgcaatgtatttggcaatgacggtgtcatcaatgggcttttgttcttccttggttttgacaagaagattttttggtatcaggacccgacaagcgcattgtggaccttgattcttttgtctgtgtggcagttcggctcttccatgctgatctttcttgccggattgaaaaatattccgccgatgtatcaggaagcggcaagcgttgatggtgcaaacaggtttcagcggttttttctcattacgctcccgcttctcagcccgatcatcttttttaatttggtgatgcagaccatttcagccttcatgacctttacgccggcctacattatttcaaaaggggaaggcggtccgcttgacgggacgcttctgtattccctctatttgttccagcgggcgttcaactttttccaaatgggctacgcttcggctatggcatgggtgatgctgatcctgatcggccttgtcacattcatattgttcaaaacttcatccttatgggtgcattacgaatcgaagga

SEQ ID NO: 709 - DNA, 1252 bp, Bacillus licheniformis
atgaaaaaaatcattttctcttttgttctcctgatcattttgtctgcaatacttgcgggctgctccggaaagaatgccggaaagagcggagatgtcacgctcacaatgttttcgacaatgacaaacgacagtgaaaaaaacacgctcagaagcatcgcagatgattttgaaaaagaaaatgaaggcatcaagatcgatatcagctttcccggcccggactatgaaaatatgctgcgcgtcaaaatggcggcaaatgacatgcctgatttgttcgatacgcacggctgggcgaagatccgctacggggaatacactgctgatttaaaagacatggattgggtgaagcatctcgatccaaacctcgatccgattttgaaggatgaaaaaggcaaagtatatgcctaccctttcaatcaggcaaaagacgggatcgtctacaatgccggtctcttgaagaaatacggtctcaagcctccgcagacgttggacgaactgatgcatgcgctggaaacgatcaaagaaaaaagcaacgggagcgtcattcctttttggtttgccggttcagataaaggcgctttagctcagttttatgatcagcttgccaccccgctgctcatcacagatgatcgccgcaatgaaaaaaaagctttggaaaacggcacattcgactggtccgactacacacttctcgcagaaacctttaaagagatgcaggaaaagcaattgatcaataaagatatcctgacggcaaaaccgtcgcaattggtcgaattgatggcgcaggaaaaaatcggttttaccctctcagtcacgtcgatcggccctgatacgagggaagtcaatccagatatccagttaggcgtgatgccgacgcctgccgtttatgaaggcgacaaaccgagctggattggaggagagcgccataccgttgctgtctggaaagactcagaacacctcgaagaagcaaagcggtttatcgaattcgccgcacagcccaaatacgtgaaaaagatcgccgaagccacctcatttcctcaggcattaaccaacacagaagctgaaaactactattctaagttttatgatcaatatgaagaaatcaaaatcgaaccgtactttgaccgcgtctatctcccgagcggaatgtgggacgtcatgggaacgacgggacaggaactattggccggtacgttaacgccgaagcaggtatcggaaaaaatgaaacaggaatacagcagattacaagaacaat

SEQ ID NO: 710 - DNA, 940 bp, Bacillus licheniformis
ttgaagactgttaaaacagatacagtgcattcgtttccgccggtgagcagaaaaagaaagatcagacgtttattatattcagcaaaagccgcaccctacatttttacagcaccttttgtactctccttttgcatattttttctttatccgcttatcagcgtcgtcatcatgagttttcaaagcattctccccggggaagtccgcttcatcgggacggagaactataaagcattaaacaatcctacattttataccgcactattcaacaccgtaaaatacaccttttggacattgctgattttaatacctgttcctcttattctggcagtctttttagattctaaactcgtaaagtttaaaaacgtgttcaaatcggctttattcatcccggctctgacttcaaccattgtggcggggattattttcaggctgatttttggagaaatggatacatccctggcgaattcgatattggctaagctcggaggttcgccgtacaactggctgaacaatgaacataccggcatgtttttaatggtgatgctcgcatcttggagatggatggggatcaatgtcctgtactttttggcgggcttgcagaacgttccgaaagaattgtatgaagctgccgaaatcgacggggcaggcacgttcaagaagttttaccatattacgcttccgtttttaaagcccgtcagcgtctacgtgctgacgatcagcatcatcggcggcttccggatgtttgaagaaagctacgtgctgtggcagaacaactctccgggcaacatcggcctgacgatggtcggatacatttatcagcaggggcttgcctacaacaacatgggctacggatcggcgctcggcatcgtgctcttgatcatcattttcatctgcagcctcatttcattaaagctgtctggatcttttaaaaaggagggct

SEQ ID NO: 711 - DNA, 887 bp, Bacillus licheniformis
atgggcaagacacaaattctatggggcatcgcccccataggatggcggaacgatgatattccggaaatcggcgcgggaaacacacttcagcatttgttgagcgacattgttgttgcgggctttcaaggcacggaagtgggcggcttttttccggaaccggccattctcaataaagagctcgagctgaggaatctaaggattgccggcaagtggttcagcagctatatcattcgggacggcattgaagaagcagccaaggaatttgcggctcactgccagtacttaaaagacgtccatgccgatgttgcggtcgtatcagaacagacgtacagtgtgcagggcttggataaaaacgtgtttaaagaaaagccttatttcaccgatgaagaatggcagcggctatttgaaggtttaaatcacctcggggaaatcgccggccgttacggactgaagcttgtctaccatcaccacctcggcacaggcgtgcagacagaggaagaggtggaccggctcatggcgggaactgacccggcacttgtgcaccttctgtacgatacggggcatgcctacatttcagatggaaattatatgaacattttagagaagcatattgaccgtattaggcacgttcattttaaagacgcgcgccttaagatcatggagaaatgcaagcgggaaggaaattcgttccaacaggcgtttctgcaagggatgttcacagttccaggcgacggctgcatcgattttagagaagtatatcaaacgcttttaaagcacggctattccggctggatcgtagtggaagccgagcaggatcccgatgttgccaacccgcttgaatacgcattgatcgccagaaagtacatcgatcgtcacttgttgaatgt

SEQ ID NO: 712 - DNA, 1042 bp, Bacillus licheniformis
atgagcgatgagaaaaaatatgccgggctggcaagactgattttacaacacatcggcggcccgtctaacgtcgcagatcatacccactgtatgacgcgcctgcgcatcacgcctgtcaacagtcaaaaaaccgacatcgactcgatcaaagcgcttgaaggcgtgatcggcgtagttgaggaggaaacgcttcagattatcctcggcacaggcgttgtacagcacgtatcagacgagttcgggaagctgcttaaatccgcagaacacgttgacttaaaagaatccgcagccaaacataaagcggagatttccaagaaaaacgcgacgcctttcaagctgtttctccggcgaatcgcaagcatttttataccgctgatccccgctttggtcgcctcaggcttgattaccggaatcaccaaagccgttatccaggctggctggctcgcggaaacctcacaaaccgcgattattttaacggtaataggctcaggtctatttacgtatttgggtatcctggtggggatcaatacggcgaaagaattcggcggctcccccgcactcggcggattagccggtattttaatcattaaccccgccgttggtgaaatttcacttttcggtgaagcgcttttgccgggacgcggcggtttaatcggcattttattcgcagctgcatttatcgcttttctcgaaaaacgggtcaggcgccttgtacctcactcactcgacatcatcatcacacctacagtctcccttcttatcacaggaatcgtcacctacgttgtcttcatgcctgtcggcggcttgatttccgacgccattacgtcaggtcttctcgccatcttagatcttgggggcattatcgccggctttgtactgggcgccaccttccttccgctcgtcgtaaccggacttcatcaaggactgacacccgttcatatggaattaatcaattcaatcggcgatgacccgctgctgccgattttggccatggggggcgcaggacaagtaggcgccgcttttgcgatctatttcaaaacga

SEQ ID NO: 713 - DNA, 876 bp, Bacillus licheniformis
tttcggggtgtttcccgaaggttttccggacgaattgatccacgaacttgaacagaaatccgggagaaaagtgattggaaacaagcctgcatcaggcactgcgattttggatgaactcggtgcggagcatatggaaaccggcgcgctgatcgtctacacctcagcagactccgttctgcagattgccgcacacgaagaagtcgtgcctctcgaggaattgtacaagatctgcgagatcgcgcgcgagctgacgcttgacgagaaatatatggtcggacgcgttattgcgaggccgtttgtcggcaagccgggcgaatttaaacggacgccgaaccgccatgattatgcgctgaagccgtttgacagaaccgtgatgaatgaattgaaagatgacagctttgatgtgattgcgatcggcaaaatctccgatatctacgacggcgagggcattacggaatcgctcagaacgaaatcgaatatggacgggatggacaagctggtgcaaacgcttgacaaaggttttactgggatcagctttgtaaacctcgtggactttgatgcgctgttcggacaccgccgcgatccggaaggatacggaaaagcgctcgaagagttcgacgcgcgccttcctgaagtatttgaaaagatgcgcgaagatgatctgctcatcattaccgccgaccacggcaatgatccggttcaccatggcactgatcatacaagggagtacgttccgcttcttgtatacagcaaaaaacacgaaaagcctggggcgcttccgctcgcagatacattcgcggacatcggcgcaacgatcgccgacaactttaaaacgaatatgccaaagtacggaaaaagctttttatccctgctgaa

SEQ ID NO: 714 - DNA, 883 bp, Bacillus licheniformis
atgtccggtgcggaaacgatccataacacaaaagcgggccgggtgttcgattggtttaatgtgatctttctcggctgctgcggactgataaccgtcttgccttttctgtatattatcgcggggtcatttgcgacggaggccgagctggcggaaaggagcttctttatctttcccgagacgttctcgcttgacgcgtaccgctatattttttcaacgccgacatttatcaggagcatgggggtgtctgtgcttataacggtcgtgggaacgatcgtccagctcttttttacatttacgatggcctatcctcttgcaaaacggcacatcaagggaaggaatctgcttttgaatctcgtcatttttgcgatgcttttcagcggaggaatgattccgacgtatatcgtcgtcaaatcactgggactgctcgattcctattgggcgctgattttgccgatggcgatcaacccgttcaatctcattattattaaaaacttttttcagcagcttccgaaagagcttgaggagtcggccaagattgacggctgttcagaaatcggcgtgttcttaaggatcgcactgccgctgtctaagccgattattgcgacttttgcgctgttttatgcggtcggcatttggaacgactttttccatgctttgctgtacatcaatgacagtgcgaaatggccgctgcaaatggtgctgcgccaagtgacgattctttcggatctgacggggacgacgaatgatatgatggaaacggtgccgcctgaacaatcgatcaaactggccgtcatcgtcattgcgacgcttccgattttagccgtgtacccgtttttgcagaagcattttgccaaaggcattctgatcgggtctgtgaagggat

SEQ ID NO: 715 - DNA, 1089 bp, Bacillus licheniformis
cgtcaataaggtcgataggatatactaaggtgtgatccacaaagatacggagccggataatcagaatcttcaaatggagggtagggaaggtatgcttttgatcggacattcaggatgcggcgagtggacgacgctcagtatgatggcaggcgcagaggaaattacggatggcgaatttacaatcgacggcaaacggatgaatgatgtcgctcctaaagaccgcgacattgcgatggtattccaaaactatgccctgtatccgcacatgaacgtctatgacaatatggctttcggcttgaagctgcggaagtttccgaaggatgaaatcaaacggcgtgtccatgaagcggccaaaattctgggccttgaacaatatttggatagaaagccaaaagcgctttccggcggacagcgccagcgcgtcgccttaggccgggcaattgttcgggatgcaaaggtgttcttgatggatgagccgctatcaaaccttgatgccaaattgcgcgtacaaatgcgcgcggaaatcacaaagcttcatcagcgtctgcagacgacgaccatctatgtcacccacgaccagacggaagcgatgacgatggctacgcggctcgtcgtcatgaaagacggaatcatccagcaggtcggggcgccgaaggaagtctacgaaaatccggaaaacgtgtttgtcggcggctttatcgggtctcctgcaatgaacttctttaccggcactctgaaagaagacatgtttacattcgacggcgtttcggttcgcgtgccggaaggaaaaatgaaagttctgcgcggccagggttatgtcggcaaggaaatcatcatgggaatcaggcctgaagatatccatgatgaacctgttttcattgaagcgtcaaaagactcgaaagtcgatgcgaaaattgaggtagccgagctgatgggcgcggaaacgatgctttattcgcaggccggcactcagccgtttatcgccagagtcgattcaaggaccgacgttcaggccggcgatacgattccactggcgcttgacatgaataaagctcacttttttgataaagaaacggagctccgcatccg

SEQ ID NO: 716 - DNA, 1491 bp, Bacillus licheniformis
caacagcaggcatcgctgaacaccttccggctgttgcaggcttcctcatggaaaaagagcttgaagtgctgggcaaagcgctgtcaaaccctgaacgtccgtttacagcgatcatcggcggcgcaaaagtaaaagacaaaatcggcgtgattgaaagtcttcttgagaaagtagacaacctgatcatcggcggcggtcttgcttacacgttcgtcaaagcgctcggccatgaagtgggaaaatccctgctggaagaagataaaattgaattggctaaatctttcatggaccgcgccaaagaaaaaggcgtgaacttctacatgcctacagacgtgcttgttgctgacgatttctcaaacgacgccaacacgaaaatcgtgccggtaagcgaaatccctagcgactgggaagcgcttgacatcggcgaggaaacaagaaaaacatatgccgacgtcatcaaaaacagcaagcttgtcgtttggaacggaccgatgggcgtattcgaaatcgacgcgttcgctaaaggaacaagagctgtcgctgaagcattagcagaggcaaatgatacatactctgtcatcggcggcggagactctgcagctgctgtagaaaagttcggcttggctgacaaaatgagccacatttcaacaggcggcggagcttcccttgagtttatggaaggaaaagaacttcctggcgtcaaagcattgaacgacaagtaagcaaaatatacagcataaggagtggagcacatgagaaaaccaattatagccggtaactggaagatgaataaagtgctttcagaagctgtcagcttcgttgaagaagtgaaatcttccattcccgcagcagataaagcagaagctgttgtctgtgcgcctgcactgttccttgaaaagctcacatcagctgtaaaaggcacagatctgaaagtcggcgcgcaaaacatgcattttgaagaaagcggagctttcacgggtgaaatcagccctgcggctttgaaagaccttggagttgaatactgcgtcatcggccactccgagcgccgcgaaatgtttgctgaaacggatgaaacggtcaacaaaaaagcgcatgctgcatttaaatacggcatcgttccgatcatctgcgtaggtgaaacgcttgaagagcgcgaagcaaacaaaacaaacgagcttgttgcagaccaagtgaaaaaagcacttgcaggtttaacaactgaacaggtagctgcttccgtgatcgcttatgagccgatctgggcgattggaaccggcaagtcttcaactgcacaagatgcaaacgaagtatgcgcgcacatccgcaaaaccgtggcatcagagttcggacaaactgcagcagacagcgtccgcattcagtacggcggaagcgtaaaacctgcgaacattaaagaatatatggccgaatccgatatcgacggcgctcttgttggcggagcaagccttgagccgcagtctttcgtgcaattat

SEQ ID NO: 717 - DNA, 1314 bp, Bacillus licheniformis
tgaaagtagttgttataggcggaggttccagctacacaccagaaatcattgaaggcatcatcaaacggcatcatcaatttccagtgaatgagattgtactggttgatatcgaggagggcaaagaaaagcttcgcatcgtctcagaactcgcgaagcgaatgatcagacatgcgggggttcccatcgaactgagccatacaatagatcgggcaaaagcattgaaaggcgccgatttcgtaacggttcaaatcagagtcggcggactgaaggcgagagctttagacgaaaaaattccgctcagccacggcctgatcggccaggaaacaaacggggcgggcggcatgtttaaagctttgcgcacaattccctttatgctggatatcgcccgcgatattcatgagatttgtcccgaagcatggctgattaactttaccaatccggcgggcatcgtgacggaagctttgctgaagcacggacctcatcaaaaggtcgtcggggtatgcaatattccttacaacatgaaaaatagcatcgcagaaattttcggcgtggatgtaaacctcgtcatgattgaattcgcgggcatcaatcattttgttttcggaaaaagagtttggatcgacgggatcgaccggacagaagagacgattgagcttctgttgaatgatcacttcggctactcgccttccaatattgcggcgctgccgtggaatcgccaatttttgcggtctttgcgaatgcttccgagcccttatcatcagtactattatcaacatgaagatgcgctcgcaaaagatatcgaagcgtacaataacaaagggacgcgcgcagaaaccgtcatggaagtggagcggcagctgtttgagagatacaaagacgccaagatccatgaaaagcctaaagaactggaaagccgcggcggagcttactatagtgaatcagcctgctcattaatgaactcgctttatcatcattcaatggatattcagaccgtgaacacactgaataaaggaagcataccagaccttccagatgatgcggtgatcgaagtcaacagtgtcattacaaaaagcggaccgattcccctgaccgtcggaaaactgcccgatgccatcagcgggccgatcatcttgatgaaaaaatttgaacaattagtgattgaagctgcggtcaccggcgactacgatacggcatacttagccatgatcaccaatccattggtctcttctgatcacaaagctcaaaaggtgctcgatgaaatgctcgaggctcataaacgttatctcccgcaattttttgaggaggtccgtgcac

SEQ ID NO: 718 - DNA, 1432 bp, Bacillus licheniformis
atggagaggctgtccaaacggataaggtctaagccgagccgccccgaacggattttgcaaatcggggaaggtaactttatgagggggtttattgactggcagattcatagattgaatgaagaaaccgattttaacggcagtgccgtcgtcgtgcctccgcgccgcggttcagtaacggcctttcaagaacaggatgggctttacacgctttatcttgaaggtttccgggaaggacgggaggttcgcgattctgctgtcattacatcaatcagcagagtcgtcagcagctatgagcattatgatgaatttatggagctggccgatctgccggatttgcggtttgtattttcaaatacgacagaggccggcatcatttatatcgaggaagaccgtctgtccgaccgtccgcagaaaagctatccagggaagctgactgcacttttatacagacgatacatgacttttcaaggaagcagggaaaaaggtctggtgatcctcccgtgtgagctgcttgaggataacgggaaaatactgaaagacattgtgctgcgctatacaaacgcgtgggcgcttgaacaagggttcatcgattggcttgaagaggcaaacgtgttctgcaatacgcttgtggacaggatcgtaccgggattcccgaaagaaaatgcacaccggcttgaagaggcggccggctatcacgattccttgatggtgaaggcggagccgtatcatttgttcgtgattgaagggccgaaatggcttcgagacgagcttccgcttcatgaggccggtctgaatgtcgagtttgtccaggatgtgacgccgtacaggataagaaaagtgagaattttaaacggcgcccataccgcgatgacgccggtcgcttatttggcaggccttgagacggttcgcgaagcggctgaagacgagcttatcggctcatttgtgaaagagctgatccagcgggaggtgctcgagacgatcgatatgcccgatagcgagcttgacaactacgtggaagagattctcgaccgctttaaaaacccgtttatccgtcacaagctgatcgatatttccttaaattcctttgcaaaattcaaagtcagaaatttgcccgtcttaatggaatatgcggaacgaacaggcaaacttccggctcgaaccgtatttgctttaagcgccttaatttatttttaccgaggccaacgggatggggatgatggggccattccgctgtctgacgacgatgaggtgctggctttcctcaaacggctctggacggaagagacagacgtttcgaacatcgcattccatgttcttgggtttgaaaaagtgtgggggcaaaatctgaacgacatgcccggattgacggacaagacggctgaatatttaagggacatgaaacaaacgggaatgaggaaggcgctggaaaaaa

SEQ ID NO: 719 - DNA, 831 bp, Bacillus licheniformis
aaatacgcggttcaccgggatgctgaacaaggttttgacctatatatttttggcgtttttaagcatcgtgattatttatccgcttttgatcacagcatcatccgcattccgggtcgggaatgtagcggcttttacactcgatttttcgggcgcatggacattggaccactttaagcggctgtttgaagagacgctttacctcaattggtacgggaatacacttgtgatcgctctgtctgtcatggtgttccaggtgacgattgtgacgcttgccggctatacgtacagccgctaccggtttgcgggccgaaaaaagagcctcattttctttttgatcattcaaatggtgccgacgatggcggcgctgaccgctttttacgtcctggccatgctgatcggagctttggaccaatattggtttttaactgcaatctatatcggcggcggaattccgatgaacacatggctgatgaagggctactttgatacagtgccgagagaaatcgatgaagcggcgcgaattgatggagcggggcacctgcggatctttgcttcggtcgttctcccgcttgtgaaaccgatgcttgcagtccaggcgctgtgggcgtttatggggccgttcggcgactatctgctggcgaaatttctgcttcggtcgccggaaagcctgaccatcgccgtcggtttgcagacattcatctccaatccgcagcagcaaaaagtcgcgctgtttgcagctggggcgattcttgcagctctgccgatttgcatcttgttcttctttctccaaaagaactttgtgtccggtttgacatccggcggaacgaaggg

SEQ ID NO: 720 - DNA, 833 bp, Bacillus licheniformis
atgaagctatgctttaatgaagcaacgacgttggaaaattcaaaccttgcaaaagacctcgaatactgtgagaagcacggatacgattatatcgaaatccggacgatggataagctgcctgagtacttaaaagaccatgctctctcagagttagccgagtattttcaaactcatcatattaagccgctggccttgaatgcccttgtctttttcaacaaccgcgatgaaaaagggcaccgtgaaatcatcgaagaatttaaaggcatgatggaaacgtgcaaaatgcttggtgtgaaatacgtggtcgcggtaccgcttgtcaccgaacaaaaaatcttaaaagaagatattaaagcaagctccgtcgaagtgctgacagagctgtcagacatcgctgagccgtacggcgtaaagatcgctgtcgagtttgtcggtcacccggagtgtacggtcaatacgttcagccaggcctatgacatcgtcatgaccgtgaaccgcgataatgtcggccttgtttttgacagcttccatttccatgcaatgggctcaagtcttgaggatttaaaaaaggcggacggcaagaaaatcttcatttatcatatcgatgacacggaagactttccaatcggatttttaagagatgaagaccgtgtttggccgggacagggagccatcgacttggatgcccacttatcaactttgaaagacatcggtttttcggatgtcgtatcagttgaattgttcagacctgaatactataagctgagcgcggaagaaacgattcgaacggccaaagaaacaacagttgaagttgtttcaaaatacttcaagat

SEQ ID NO: 721 - DNA, 905 bp, Bacillus licheniformis
atgaaactaaaagtttcgtttcgaaatgtttcaaaacagtatcagctttatgaaaaacaatcggataaaattaaagggctgttttttccgaataaggataaaggtttttttgctgttcggaatgtctcctttgacgtgtacgaaggggagacgatcggatttgtagggattaacggatcgggaaaatcgacgatgtccaacctgctggcaaaaatcattccgccgacaagcggtgaaatcgaaatgaacgggcagccttccctgattgcgatttccgcaggattaaacaatgcgctgacgggcagagacagcattcgtctcaagtgcttaatgatggggctcacaaataaagaaatcgatgagatgtatgacagcatcgttgaattcgcagaaatcggcgagtttatcaatcagccggtcaaaagctattccagcggaatgaaatcccggctcggctttgcgatctcagtgcatatcgatcccgatattttaattattgacgaagcgttatcagtaggtgatcaaaccttctatgataaatgtgtcgacagaattaccgagtttaaaaatcaagggaaaaccatattctttgtcagccattcaatcggtcaaattgagaaaatttgcgatcgggtcgcctggatcgataatggcgagcttcgcatgtttgatgacacaaagacggtcgtaaaggaatataaagaatttatcagctggtttaaaaagctttccaaaaaagagaaagacaaatataaaaaagagcagttagccagccgcaaacaggtcttgtccgaagaagatctggctcatctcgaaaaagacaagaataaacaaaaatctttggcaaatatcattccgattgcaggtttgtccatcctggtcgtattggctgccggagcgatgtt

SEQ ID NO: 722 - DNA, 1033 bp, Bacillus licheniformis
atgcaaatgacgtttcgatggtatggagacagcgacccggtcacattagagtatattcgccaaattcccggcgttactggaattgtttcggccatttatgatattcctgtaggggaagcatggccttatgagaaaattgtagagttaaaagaaaaaattgaaaatcatggtttatcgttaagtgtcattgaaagtgtacctgtccatgaagatattaaattaggtcttccgacaagagatcaatatattgaaaactataaaacgacgatacgcaacttggcaaaagccggtgttaaaatcgtttgttataatttcatgccggtctttgactggacccgttcttctttagactatgcactagaagacggttctacagcattaatttatgaagaagaaaaagttagacaaatgaatccattacatggtgaactaaaacttcccggttgggacacaagctatgaagatggacagctaaagaatctttttcaacaatatcagcacatgacggaagaggatttatgggaaaatctttcgtattttattaaagcggttataccggcggcagaaaatgaacaagtcaaaatggcgattcacccggatgatccgccatggcctatctttggactgcctcgaatcataacgaacaaagagaatttggagcgattgattcatctctatgacagctcctttaacggtttgtgtttatgcagcgggtcactgggtgtgaagtcaacaaatgatattccggaattgattcgttatttcggaaaaaaaggaaaagttaactttgtgcacctgagaaacattaagatcatcggggaaaagtcatttcaagaatcctcccaccgttcagaagacggttctttagatatgtatgaaatcgtaagagcattaagagatatagattttgccggaccagccagaccggatcatggaaggatgatttggggagagaccggaaaaccgggttatggtttatatgaccgggcgcttggtgcagtgtatttaaatggaatgtgggaaacattgacga

SEQ ID NO: 723 - DNA, 930 bp, Bacillus licheniformis
ggaaattcaaggtgtgacaagagatccaatcgatctatacggaacctgccatgagatcgcaggtgacaaacggcaaggtctacggcctgccgaaagcggtcgaaacgacgatgctctactataataaagatttaatttctgaaaaagaactgccgaaaacgctggatgaatggtatgagtattccaaaaaaacggctgacggcaaaaaattcggcttcctggcgctgtttgaccagatttattatgcacagagcgtcatgggagggtacggcggctacatttttaaaagcgatgccgacggcacttatgatccggccgacctaggcttgaacaacaaaggtgcagtcgaaggcgccgagtacattcagaagttttaccaagaggggctgttccctgccggaattattggggagcagggcatcaatgtgctggaatcgctgtttacggaaggaaaagcagcagcgatcatttcaggcccgtggaacctggaaccgttcaaaaaagcgggtatcaattacggggttgccaagctgcctaaactgtccaacggcaagcatatgagttcttttgtcggcgtgaagagctacaatgtaagcgcttattcgaagaatgccgatctagccgaacaattagtcgtcttcctcgccaataaagaaaactcaaagaagagatatgagatcacaaaagaagtacccgcagtcaaagaactggcggatgatcctgccgtcacaaaaagcgaagcggctcaagccgttgccgagcaatctcagtactcagagttgacaccgaatattcctgagatgaatgaagtatggacgccggcggatgcggctctgcaaacaattgcaaccggaaaagccgaaccgaaaaaagcgcttgatcaagccgcggaaacgatacaaggacagatcaaagcgaagcacagcggca

SEQ ID NO: 724 - DNA, 2513 bp, Bacillus licheniformis
atggagaaatacgtgctgtatttcaatgaaatcgatcaatttgacttgccctctgtcggcgggaaaggggcgaaccttggggaaatgacaaaagcgggctttcccgttcctcagggattttgcatatcaactgaagcctaccgtgcgttcatacaaacaagcggcatcatcgacagtctgttcgatcagcttgaacagctcaaacatgatgatcttgaacagattcggactgtggggaaacaaattcgtgagcatcttgctcagatctccatgcctgacgagatcaaatcggcgatattggagggcatagatacgaccggcaaagataaagcctatgccgtccgctccagcgcaacggctgaagacctgccagatgcttcattcgcgggacagcaggacacctttttgaacgtctgcgggaaagatcagcttcttgaagcggtgaaacaatgctggtcctcgctgtttacagacagggcgatttcctaccgagcgaaaaacggtttcgaccaccgctctgtctttcttgcggttgtcgttcaagagatggtttttcccgaggtttccggaattatgttcacggcggatccgatcacggggcaccgcaaaacggtatccatcgatgccagcttcggcttgggtgaagcgttggtgtccggcgtcgtcagcgctgatctgtatcagattcggtctggtgaaatcgttaaaaaacaactctctaagaaagaatcggccatttactccgtaccagagggaggaaccgtccagaaaaccctctctccggaaaaacaacaaacacaggctttgccggatccaagaatcattgaattagcagaactggggcgcaaaatcgaggctcactatggcaaggaacaggatatcgagtgggcttttgccggcggcaggttttacattcttcaaagccggccgatcacatccctttacccggtcgtacgcttttttgatgataggccgcacgtattgattaattttggctacatccaaatgatgaccgatccgctgaaaccattgggtgtatcggttatcagccaagtcctccgatttttaaaaaaagatccttcggcacagccgattcttcgcgaagcgggaggaagagtctttgccgatattacgggtgctctctccctcaaattcgtccgaagccggctgcttaaagtattgagcggcatggatcagttgatggcatcagctgtatcggaggtagtcaagcgcaaagaacatcagctatattccacatccacaaaaggcatttttcatattgccgggaatttggcgccgattttgattccggcagcattaaaagttgccggaatcctgctcatgagaaatccggataaagccgagaaaaaagcggaattgatcattgaagcgatcgtgacggacaccgaagagcagcttagccggacttccggtgctgagacgatccgcgtcatccaaaaaggaatgggaaacatgttgcaagacgtgctttcaaaagtcgctgtgtatgtcttgagcggaatgattgcagccggattgctcgaaaaaaagctgaaaaagaagctgggggacgagaaaagcgctattttgctggggaaattgtataaatccctgccccataatgtcacaacggaaatgggtctagagttaggagatctttccgatcaggcgagaaagtatcctgctgtcattgactatttcaagcgtgcaaacagcgaaaattttatggaagaactgctcaaaatccccggcggcgccgaaatgaaacgcagtttagacgattttctcaaaaagtacgggatgcggtgcgtgggagaaatcgatttgacaaggccgagatgggccgaggccccggttcagctcgttccgtccatactcagccatattcggacgattgccgccggggaacacagaaggaaatttaaacaaggtgaaaccgaagcggaagaggcaaaaaaggagatcatctctcaatttcgttttccagaaaaaaagagagtctcccggctcgttcatatgtaccgaagcttgatgggaatgcgggagcatcataaatttacacttgtaaaactgatgtttttatacaaaaaagcgattcttaaagaagcccgcaccctcgttggaaaagggattttgaattgtgaagaagatgtcttttactttacgcttgaggagcttatcgccctattggagaatcgcggcatcggggatattccggaattgttaacagacagaaaacggcagcatacgtccaatcaaaagctcacatctccacgcgtgatgacgagtaaaggggagatcatcacaggaaagctgcgaaatgaaaaaagtcctgaaggcgctctcacaggtacccctgtttccgcgggaatcatcgaagggaccgccagagttgcaaagagtcctgaagacgcgaagctgaatcaaggggacatattagtggcgccgtatactgatccgggctggactccgctctttacgtcagcggtcggactgattacggaagtaggcgg

SEQ ID NO: 725 - DNA, 801 bp, Bacillus licheniformis
tacattcggcacgggtatcggcaatggaatccgcgtcatcaaatcgacagacggaaaaacatggagcgcagcgccaagcatatttgcaactccattatcatggtggaaaaagtacgtgccgaaccatgaagaaaaccaatgggcgcctgatatcagctattataatggacgctattggctttattatgcggtatccgcgttcggctccaatacttcggcgatcggactggcttcaacagaccgaatctcatccggaaattggcgcgacgacgggcttgtcatccggacgacgacctctaacaattataatgcaatcgaccctgagttagtgattgataaagaaggaaatccgtggctgtccttcggctcgttttggagcggcatcaagctgacaaagcttgataaaaaaacgatgaaacctacagggaaggtttattccatcgcatcaaggccgaacaacggaggagcggttgaagcgccgtctatcacatataaaaacggctactattatttattcgtttcgttcgataaatgctgtcaaggtgtgaacagcacgtataagatcgcttacggccgctcgacaaaaatcacggggccttactatgacaaaagcggcaagaaaatgacggaaggcggaggcacaatcctcgactccggaaacgaccagtggaagggcccgggcggcgcggatatcgtgaacggcaacatcatcgtcagacatggttatgatgcgcttgacaacggggcgcctaagctgctgatcaatgatttaaactgggattctaaaggctggccgaagta

SEQ ID NO: 726 - DNA, 837 bp, Bacillus licheniformis
tgaagaaaagaagattctttcggctccttctgacctattctctgttggcttttatgacagccgttatcatataccctctgctttggacggtgggggtcagctttaatcccggcaacagtttggtcagcacttctatcattccggcaaatccgacattggatcactataaagaattattcgccggcaaagagagcctccaatacgggcaatggtatataaactcgctgaaaatcagcatctttacgatgatcggatcggtcatcagcgtttcttttacagcttatgctttttcacggtttcgttttaaaggaaggaaaaacgctttagttttattcttgctgctgcaaatgattcctcaattttcggctttggttgcgctcttcgttttagcgcagatgcttggaatgatgaacagccattggctgctgattttgctgtacatcggcgggctcataccgatgaacacgtatttgatgaaagggtatatggactccattcccatcgatttggatgagagcgctaagattgacggcgcaagcaatacaaggattttcctgcagattattatgccgctatccaaaccgatgatcgcggtcgttgccatgaacggattcaccgggccgctcggggatttcgttttgtcttcgacgatattgcggacaccggagtcgtatacattgccgatcggtttatacaatttagtcaatgaggtgatgggagccagctatacgacgtttgccgccggcgctattttgatcagcataccggtagccgtcatctttatcatgctgcaaaagaactttgtgtcaggattgacggcaggcggaacgaaaggat

SEQ ID NO: 727 - DNA, 861 bp, Bacillus licheniformis
ctgctggaagccgcgtgtttgacatattgaattattcatttttaacagggttcggattggtttgtgtgctgccgttcatccacgttattgcagcctcttttgcgacagtcgaggaggttatttcgaaaaagtttattttaataccgacgactttttcgctggatgcgtacaggtatattttttcaactgacattgtgtacaggagcttaatcgtttctattcttgtcacagccgtagggacggcggtcagcatgtttctttcctctttaatggcatacgggctgtcgagaaaggagctgatgggaaggcgcgtcctgatgttcttggtcgtgttcacgatgctgttcagcggagggatgatcccgacctttctcgtcgtaaaatcgctcggattgctcgatacctattggtctctgattcttccgaccgccatcaatgcgtttaacttgattattttaaagaacttttttcaaaacataccgtcaagcctcgaggaatccgccaaaatcgacggctgcaatgacatcggcatcttcttccgcatcattcttccgttgtctttgccggcgatcgcgacgatttcgctgttttacgccgtcacctattggaatacgtacatgcaggcgattctgtacttgagcgatgcgacaaaatggccgatacaagttttgcttcgccagattgtcatcgtatcaagcggtatgcaaggggatatgacggaaatgggagcagccgcggcgccgccggaacaaacgatcaaaatggcggtcattgtcgttgcaaccatacctgtgctgctcgtgtatccgtttattcaaaaacactttgcaaaaggcgctcttttagggtcaattaaaggat

SEQ ID NO: 728 - DNA, 1026 bp, Bacillus licheniformis
atggcgaattcacgcgacagctatttcgacaacgcaaaattcctattgatttttctcgtcgtcttcggacatataatcaggtcctatattcatgacaatgatgcactgcttcatatttataaatttatttacacgtttcatatgcctgcttttattctcatatcaggctattttgcaaaagggttcaatcggcccggatatgtcaaaaaaatcgcctggaagctgatcgttccctatttgattttccagggaatctatacgctgttttattcctttatcgatgatcaaagcttaactgccgcaaatccgtttgaaccgcaatggtcgctttggtttttgctgagcttgtttttttggaatctcctgttgtttccgttcacaaaactgccggcgaaatgggcgtttgccgcaagctttgcgattgccgttcttgtcgggtatatcgacatgatcagcaacacgctcagcctgtcccgcacgtttgttttctttccggtctttttggcgggctattatttgcaaaaagaccattttaaaatgctgaaaggctggaaaggaaagcaagcggctctagccgttttagcagcaacgttcgttttctacttttttgcagacttcgattactcctggctgttcggttccaagccttattcggaattcggcgatgtcgggataaaaagcgggttaaaccgggtggcgcttctcgttataacatttgcctcaaccttcgcgttcatggcgctggtgcctgaaaggcggtatttctttaccctctggggaacgcgcacattctatgtctacctgctgcacggctttatcatcaagtcgttcagaaagacgggcgcggaagaatggcttgccgattatcagagtctgacgctattgttcatcgccacggcaattttaaccttctgcttatcaagcggatttgtgaaaacggtcgcccagccgttcatcgaattaaaaatgacgaatttaataaggctgttgaaaaaagacaacggatataacccttatttaaaataa

SEQ ID NO: 729 - DNA, 1107 bp, Bacillus licheniformis
aaaagtttcctgaaggttttttatggggcggagcggttgccgcaaaccaagtggaaggcgcctataatgtcggcgggaaaggactctcgacagccgatgtgtcgccgaacggcgtcatgtatccattcgatgagtcgatggagtcattgaacctgtatcatgaaggcatcgatttttaccaccgctacaaagaagatatcgctcttttcgccgaaatgggatttaaagcattccggacatcgattgcctggacgcggatttttcctaacggcgatgaaactgaaccgaatgaagagggactcgaattttatgatcgcctctttgacgagctattaaaatacaatattgagccagtggtgacgatttcccactacgaaatgccgctcggtctgattaaaaaatacggcggctggaaaaaccggaaagtgatcgattgctatgagcattatgcgaaaacggttttcacccgctataaagaaaaagtaaaatactggatgacattcaatgaaatcaacatggttctgcatgcgccgtttacaggcggaggccttgtgtttgaagaaggcgaaaacaagttaaatgcgatgtaccaagcggcgcatcatctatttgtcgcaagcgctcttgccgttaaagcggggcacgacatcattccggacgctaaaatcggctgcatgatcgccgcaacgacgacatacccgatgacgccaaagccggaagacgtgctcgctgcgatggagaatgagagaagaacgctgtttttctcggatgtacaggcgcgcggggcttatccgggctatatgaagcgcttctttaaggaaaacggaattacgattgaaatggctgaaggtgatgaagacatcttaaaggaaaacaccgtcgactatatcggtttcagctactacatgtcaatggtcgcaagcacgagtccggaagacttggcaaaaacggaaggcaacctgctcggcggcgtcaaaaatccgtaccttgaatcgtccgaatggggctggcagatcgatcctaaagggatccgcattacgctgaatacattgtacgaccgctatcaaaagccgcttttcattgttgaaaacgggctcggcgcccgtc

SEQ ID NO: 730 - DNA, 863 bp, Bacillus licheniformis
gtggctttcgtttccatgaaagaacttcttcaagaagcaaaggaacatcattatgcaatcggtcaatttaatattaatggccttcaatggacaaaagcgattctagaggcagcggaagaagaacggtcacctgtcatcgcagccgcttcagatcggctcatcgattatttgggcggatttaaaacggtttccgcaatggttgcggctttgattgaggaaatgtcgatctccgttcccgtcgtgcttcaccttgaccatggcaaaagtccggagcgctgcaagcaagcgatagacgcgggttttagctcagtcatgatcgacggctcgcattcaccaatcgatgaaaatatcgccatgacaaaagaggtcgtgtcatatgccggggtccgcaatgtttcggttgaagcagaggttggcaccgtagggggcatggaagacgggcttatcggcggagtgcagtatgccgacatcggtgaatgcgagcggattgtcaaagaaaccggtatcgatgctttggcagccgcgctcggctccgttcatggaaaatatcaaggcgagcctaatttgggatttaaggaaatggaagaaatctcacgggtaacggacattccgctcgttctccatggagcttcgggcatcccggctgatcaaatcgcaagaacgatccgtctgggccatgcgaaaatcaacattaataccgaatgcatggtggcctggactgagaaaacgcgcagcatatttaaagacaatcccgatttatatgaaccccgcgcctatatgacgccagggatcagcgcagtcaaagaaacggttaaacataagatgagagaattcgggtcatccggaaaagcggtatgcaccca

SEQ ID NO: 731 - DNA, 854 bp, Bacillus licheniformis
atgccctttagtatcaatgacgaaaatgtgaataaagcaaaagaaaacggatatgctgtcggacaattaacttaaaataaccttgagtcactcaagcgattttacaagccgctgaagaagagaaatctcctgttatcctcggtgtatcagaaggtgcgggacggctatatgggcggttttaaaaccgttgttgcaatggttaaagcgctgatggaagaatacaacgtaacagtgcctgttgcgattcacttagaccacggttcaagctttgaatcttgtgcaaaagcgattcatgcgggattcacttccgttatgatcgacgcttctcaccatcctttcgaggaaaacgttgcgacgacttcaaaagttgttgagctcgctcatttccacggcgtatcagttgaagctgagcttggaactgtaggcggacaggaagacgacgtaattgcagatggcgtcatctacgcggatcctaaagagtgccaagagcttgttgagcgcacaggaatcgactgccttgctcctgcattaggttctgttcacggtccttacaaaggcgaaccaaaccttggatttaaagaaatggaagaaatcggaaatacaactggtcttccgctcgtacttcacggcggtacaggcattccgactgccgacattaagaaagctatttctttaggtacggcaaaaatcaacgtcaacactgaaaaccaaatcgcttccgcgaaagctgttcgcgaaacgctggctgcgaagcctgaagagtatgatccgcgcaaatacctcggacctgcacgcgaagctatcaaagaaacagttatcggcaaaatgcgcgaatttggttcttcaaacaaagc

SEQ ID NO: 732 - DNA, 927 bp, Bacillus licheniformis
atgatgagcgaattagctaaagaaaaaagtctgactattgtgaaaagtaaaaggagatatgtgaggaaaaatggatcgctctggtggatgtatcttcccgccttggcgcttgtatccgtctttatgatttatccgtttgcgagcggcattaaaatcacgttcacgaactggaacggtttctcacagtcgtatgactggatcggctttgcccaatataaacggatgctggccgacccggcgacatggcttgtcgtcaaaaacaccctcctgtacggattgggcagtacggttttccagaatgtcatcggtcttctctatgccctcctgctgtttaaaagcatcaaaatgaaagcgctgacaagaacggttgtctatttgcccgtcatcatcagcccgctgatcatggggtatatctggtacttcttcttctcctatgaaggaggcgccttgaacgatttgctgaaactatttggagcaggtcctgtcaacgccttgagcagcccggaaatcaatccgtggatcatcgtatttgtcaattcctatcagtttgtcggtatagcgatggtcatttatttagcaggtctcggaagcgttccgaaagatttttatgaagcggcgcaaatcgacggagcaagcggttttcagcaattttggaagattacgctgccgctgttgatgccttctgtcacgatcaacatggtaatcaatatcatcggcggactgaagctgtttgatgtcattttagcgctgacaggcggcggtccgggaaatgcttcgcaatcgatgtcgacttttatgtacgatctgtattttaagaggcaggatgccggctatgcagccgctcagggggttttcatggcggtgttgatactgctaatcagctttacggctctcatctattttaagcgcaaggaggtcgaagcctag

SEQ ID NO: 733 - DNA, 843 bp, Bacillus licheniformis
atgcgtcctgccggaggcctcaacattgcgaaagtagctctgtttctgctgtttgcgatattaagctttttgtttgtgtttccgctcttctgccttgtactcggctcgctcaagccatcttcggaattgctgcgcttcggcctgaatttaaagctgagccctgaaatcctgagccttgacaattacacttacttgtttaacggaggcagcatttattttcaatggttttcgaacagcttgattctcgtggtgatatccaccgtgctgacgctcttgttttcttcaatggtcggatacgggcttgccgtctacgactttaaaggaaaaaatctcttgttcgtagccgtgctcctgatcatgatggtgccgatcgaaattctcatgctgcctttgtttaaaatgacggtttctcttcatattgtcgacacatacgccggtgtgatcctgccgtttatcgtctcgcctgtagccgtgtttttcttcagacagtatgcgctcggcctgccgagagatttgcttgattccgcgagaatggacggctgcacagagttcggcatttacttcaggatcatggcgcccttgatgaagccggcatttggagcgatgatcattcttcaatccttaaacagctggaacaacttcttatggccgctgatcgttttgcgatcgaaagaaatgtttacgctcccaatcggactgtccgctttgctcagtccgtacgggaacaattatgacatgttgatttcgggttctgtgctggcgattctgcccgtgattctcatcttcctgttcttccagaagtactttatatcaggtttgacggcgggcggaatcaaaggctga

SEQ ID NO: 734 - DNA, 1098 bp, Bacillus licheniformis
ggcgcggccgaacatgaacgtattgacgcgatttgccaaaacgctgtcagacatctttgtgccgatcattcctgcaatcgttgcgagcggattgctcatgggtctcattagtgtgcttaaagaattcagcctcggcgcttatggcggcccgctgatgaaaatgctcgacattttttcaagctcagcgtttgtcattttgcctgtgctgatcgggttcagtgcggctaaacagtttggagccaatccatttttaggcgccgtcatcggcggtattttgacccatcctgatttgctcgatccttcaatgctcggcagccaaaagccggaatccatcgaagtattcggccttgaagtccctttgatcggataccaggggacagtcattccgattctcttatccgtctacatgatgagcaaaatcgaaaaattcttgaaaagaatcgtccccagttctttagatttgatcgttgccccgtttattacagtcatggcttccgggtttgccgcgctgtttatcatgggcccgctctcactgatgatcgcccatttcataagcgactgtctcgggtttgtttatcattttgcgggggcgtgcgccggatttttatttggcgggctttacgccttactcgttttgagcggcctgcaccacagtttttatgtgattgaagcgtcgctgctcgcagatcccgaatacggggtcaattttctgcttccaatatggtcgatggccaatgtcgcgcagggaggagcgggactcgccgtatttttgaaaacaaagaatgacggcatcagaaagattgcgattccggcttctctcacggcctttttgggaatcgtcgaaccggtcatgtttggcgtcaacctgaaactcgtcaggccgtttatcggcgcatcgatcggaggcgcactcggaggtgcatacgccgtcttcacacacgtggcggcaaattcttacggattgtccggcatcccgatgatttcaattattctccctcttggcaccgccaatctcattcattatttaatcgcttttgcgattgcggtgatttcagcatttattgcgactttgtgtcttggctttaaagatgaaaaaga

SEQ ID NO: 735 - DNA, 882 bp, Bacillus licheniformis
taagcggatcagcattttaactgtttgtcttggaatcttcatcatgatatttctttcagtccgggaaacagaaaaaaagggagaatctccggatacaccggaatatcgtgcagctttccatttgacaacccctgacaaatggaaaaacgaccctcaaaaacccgtctatttcaatggagaatatcattactactacctctataaccgagactatccggacggcaatggaacagagtggcgccacgcagtatcagatgatctcgtccactggcaggataaaggggttgccattccgaaatatacgaataaaaatggcgatccctggtccggttctgtcgttgtcgactcaaaaaacacagccggcttcggcaaagggacgatcgtggcggttatgacgcagccgtcggccaatgacgggaaggaagagcaatttttatggtacagccaaaatggaggaaaaacatttaaaccttacggtgaagagccggtcttgcctaatccgggcaccgtcgatttcagagatccgaaagtgatctgggatgaacaggatgataaatgggtgatggcgctggctgaaggaacgaaagtcggcttttacgaatcgcaaaaccttaaggaatggcgttatacaggtagttttcaaacagaaaatatcggcatcatcgaatgtccggatctgtataagatgcgggcggatgacggaacatataaatgggttcttggagcaagcgccaacgggaaagggaccggcaagccgaatacttatgcatactggacaggcagcttcaacggcaacgaatttacggcagacgaagcagaaccccagtggcttgattacggatttgactggtatgcggacgtgacatttgaggacggcgaaac

SEQ ID NO: 736 - DNA, 915 bp, Bacillus licheniformis
atgaaaaaaacattaacggttttcaccgcattggcgcttctgtttctgtccgcctgctcgctggagccgccggaatgggcaaagccgaataaagaaaaaggaacggatattaaaatcggtttatctgtctcaactttgaaaaatccgtttttcgtttcattaaagaacggagttgtcaaagaagccaaaaaacaagggatagaagtgattgtcgtcgatgcacaggacgattcggcaaagcagacgaatgatgtcgaagatcttctgcagcaaggcgttgacgctttattgatcaacccggcggactcctccgccatctcaactgcagtccaatcggccaattcgcttggcattccggtcgtcacccttgaccgctccgccgaaaacggaaaagtagaaacgctcgtcgcttcagataacgtaaaaggcggacaaatggcagcggactttattgtggagcagctcggcaaaggcgcaaaagtggctgagcttgaaggcgtccccggcgcatcggcaacaagggaacggggctcagggtttcataagaccgctgatgacaagctgaatgtgatcgccaagcaaacagccgactttgaccggacaaaagggttgaacgtcatggagaacctccttcaaggaaaccctgatattcaagcggttttcgcacataatgacgaaatggcgctcggcgcgattgaagcgatcagaagctcagggaaagagattcttgtcgtcggcttcgacggcaatgaagatgcggttaaagcggttcaggccggagacatgtcggcaacgatcgcccagcagcctgaattgatcggcaagctcgccgtacaagcggcccgcgatattttgaacggcaaaaaagttgaaaaaacgatacccgcaccgctcaaactggaaacgaaaaagtaa

SEQ ID NO: 737 - DNA, 741 bp, Bacillus licheniformis
aagcgaagatgacgattgacaaggaatataaggtggcagagattgataagcgaatttacggctcctttatcgagcatctcggcagagccgtttatgaaggcatttatgagcctgatcatcctgaagctgacgaatcaggctttcggaaagatgtcattaaactagtcagagaactaaaggtgccgtttatcaggtatcccggcggaaactttgtatctggatataactgggaggatggagtcggacctgtcgaacagcggccgacaagacttgatttggcgtgggcgacaaccgagccgaacttaatcggtacgaacgaatttatggattgggcaaagcttgtcggggcagaggtgaatatggccgtcaacctcggaacgagaggaattgatgccgcacgcaacctagtagaatattgcaaccatccgtcaggatcgtactacagcgacttgagaaaatcccacggatataaggaaccgcataaaattaaaacatggtgcctcggcaatgaaatggacggtccatggcaaatcggccataaaacagcggccgaatacggaagacttgctgctgaagccgcgaaggtgatgaaatggacggacccgtcgatcgagcttgtcgcctgcggaagttcgggaagcggaatgccgacattcatcgactgggaaacgaccgtgcttgaccatacgtacgaacacgtcgagtacatctcgcttcactcgtattacggcaaccgcgaca

SEQ ID NO: 738 - DNA, 924 bp, Bacillus licheniformis
tatgtatttgtacattttttccattcggctttacagagtacgtcgttatgggtatattgacttccatttcaaaggatctctctgttccgatttcgtctaccggcctattggtaacggcatatgcgggaagcgtctgtctgacggggccgatcgtcaccatattttcggtaaaaatgccgcgcaaaccggtattgatcggcttgatgagtgtgtttgtactgtcgaatgcgctcagtttcctggcgccgaacttcaccattttgttggtctcaagaatcctatccgcatccattcatggtgcattttttgcaacgacaatggtgttcgtcagcgaaatggcaccgcccgaaaaacgggccgccgctgccgcttcaatgaacggcggcttgaccatcgccctgatgctcggcgtcccgtttggttcttatttaggcgatcttttcaactggcggatcgtttttctgatgatcgcatgcctcggattgatcggcctcgccggcatttggctgacggtgccgcacagaaaaccgaaagttgtccctaaattgatccatgaatgggatgtgtttaaaaataaacaagtccttttttcttttgctatcacgatctttggctattcgggcgtattcatcgcctacacgtttattgaaccgatgctgcggcattctgccggtttcgacagtctcggcattacagccgcccttttcgcctacgggtttggcggggtcgtcggcaatttctacgccggaaaggtgccgtttcacctgttaacccgctccatgatcggggtgatgatcgcgctcatggcgatccttgcggcctttccttttgtcagcggacatcctgccggcgccatcatcgtgacgtttttattcggagccggcgcgttcgcgttcggaacggtgccccttttgcaaaacaaag

SEQ ID NO: 739 - DNA, 1068 bp, Bacillus licheniformis
  misc_feature (1)...(1068): n = A,T,C or G
gggaaagttgaaaaaaaaaaaaagggggaaatggccggggtttaggtttaattttccggggaataagggaaaaagaggccaacgaaattgtaatttggcattgaggcaggggggtgatttttattggcggcatccttnggtgggcctttcgttcgaatgttccttgaaattccgggaaattttttgaagggcaacaatgggggcagatatttcaattcaatcccaaaattggaaaaccaggaaggggttgaacaaattggagccaatattgaagtatcagacgttcggatgtttgcgctggagaactgggtgtagaaatccctgccgaagaagtgccgctcgttcaaaaagaaaggatcaaaaatgcaatgcgcttggcaagctgttcatcacggntacccanatgctggacagcatgcagcgcaatcggcgccgaacacgcgcggaagcgagcgacgttgccaatgaaataaaagacgggactgacacaataaagctttcaggtgaaacggcagcgggaaattatcctgttgaagccgttcagacgatgcacaatatcgcttcccgttcagaagaagcgctcaaccataaaaagatcctttccgcacgaagcaagcaagtcagcatgtcaattacggatgcgatcggccaatctgtggcgcatacggcaatcaaccttgttgtgaatgccatcgtcacaccgacggaaagcggccatacggcgagaatgatttccaaatatcgcccgcaggcgccgattgtcgcagttacggtaaacgatgcggtgtcaagaaagctgtcacttgtgttcggggttttcgcaacaagcggacaaaaccacagctccactgacgaaatgcttgaaaaagcggtgcaaaaatctctcgatacaggcatcgtacgccacggcgacttgatcgttatcacggccggagctgtcggtgaagccggtacaacaaacttgatgaaagtgtatgttgtcggagacgtggtcgcaaaaggccagggcatcggacgcaaatccgcatttggtgaagtggtcatcgctcaaaacgcacaagaagcggc

SEQ ID NO: 740 - DNA, 1025 bp, Bacillus licheniformis
atgaataatcaaatgttgggaattattgatgcagctgtgaaccagcactctcttcaggacttaacggccggccgctcgatcggagccgttccgtttgcaggaaggtaccggctgatcgattttgcgttgtcaggcatggttcatgcaggcattcggagtgtcgctgtattctccaagtccccgtaccgctccttgatggaccatttaggatcgggaaaagagtgggatttaaacaggaaaagggagggccttttctttcttccatcttcacttccccatgatgagcatgttgggcttggatcgtttcggcaatttgcggagcatctcgattattttcaaagaagcactcaacaatatgctgttgtggcaaatagctatacggtcggtcacattccttttcaagaagtgctcaaacaacaccttgaatccgggtgtgatctgactgaaatttgtcacgaaggaaagcctttaggaatgtatgtcactaagaagagtctgttgtgggagatggttgaagggcattgccctgaaggagcccaatcttttgaagaagtctgccggaaagagcgcggctctctatccgtcaacagctatgagcactcgggatataccgccgtgatcgattcccccgaaagctacctttttcatagtttgaaccttattcagcctgtgttttgggagcaagtctttcatatgggccagcctgtctacacaaaaataaaaaacgatcctcctgtaaaatacgctaaaaacagcagggtaaagcaatcgattatcgctaatgggtgcgtaatcgaaggtgaggttgagaattcggtcttgttcagaggggttcacgtaggaaaaggaacaaccatcaaaaacagcgttgtcatgcaaaaaacaaggatcggagaaaactgccggcttgagcacgtcatctgcgacaaggacgtcaaaatcggccatcatatcgaaatgtccggcaccatgagcctccctttcatattaaaaaaaggagccatacaaggagcgctgatgaactc

SEQ ID NO: 741 - DNA, 758 bp, Bacillus licheniformis
atgaaaacatacaaaggatacttaattgatcttgatggaacaatgtacaaagggacggaaaaaatcgaagaagcatgcgaattcgtgaggaagctgaaagaccggaacatcccgtatctgtttgtcacgaacaactcgtcgcgcacgccgaagcaagtggcggacaagcttgtttcatttgatattccggccgaagagagccaggtattcacaaccagcatggcaaccgccaatttcatcgccgaacaaaaacccgatgcttccgtatatgtgatcggcgaagaagggatccgtcaggccattgaggaaaaagggctggcattcggcggggaagacgccgactttgtcgtcgtcggcatcgaccgcggcattacatacgaaaagctagccgtcggttgtcttgccatccgcaacggcgctacattcatctcgactaacggcgatatcgccattcctacagaaagaggactcttgccaggcaatggttctctcacgtcagtattaactgtttctacgcagacagagcctatttttatcggcaagccggagccgatcatcatggagcaggcgatgaaggtgctcggcacagacatcagtgaaacgctgatggtcggtgacaattatgatacggatattatggcgggaatgaattccgggatggacacgcttctcgttcatacgggcgtgaccaaaaaagaacaccttgaagcctatcaggaaaagccgacatatgtcattgattcactgacagaatggct

SEQ ID NO: 742 - DNA, 966 bp, Bacillus licheniformis
atgtcgcttgatgtgatgaccttcggagaatcgatggctatgttttacgcaaatgaagcaggcggactgcatgaggcgtcttcgttttccaaagctcttgccggagcggaaacaaacgttgccgtcggactgtcgcgcctgggttttcgggtcggctggatgagcaaggtcggcgccgattcgcttggaacctttattttaaatgaattgaaaaaagaaggcgtcgacatttctgaagtcaaacgcaccgcagaccggcagacgggcatactgctcaagtcaaaggttgaaagcggagaccctgatgtcacatattatcggagcggatcagccgcaagcacgatgagcattgatgactacccggcagagtatttcaagcaagccaaacatatgcatgtgacgggcatacctcctgcactttcaagggaaatgaggggcttcgcccgccacgccgttcaccagatgaaaaaagacgggaagacgatttcgtttgacccgaatctccgcttccagctttggccggatcagcagacaatggttcatacaattaatgaaatcgccgcgcaggcagactggtttctgccggggatcaatgaaggaaaactcctgacaggctgcaattctcccgaggatatcgctaaacattatgtaatgcagggggtcaaggtgattgtcatcaagcttggaaaagaaggggcttattacaggacatcggaaaaagaaggttatgtgccgggttatcaggtggagaaggttgttgatactgttggcgctggcgacggttttgccgtcggcatgatcagcggccttttagacggacttccgctggaagaagcagttcagagggccaatgcgatcggagcgctggccgtcatggctccgggggatatggacggtctgccgtcaagggatcaattgaaagcttttatggctggagagaaaaacaaccaaaaaataggaggttga

SEQ ID NO: 743 - DNA, 896 bp, Bacillus licheniformis
gtggattgtctcgaaacaatcaactcaggaagagctggccaatgcattcagaaaactgatgaaagcacctgatattttgaaaatacccggtgttcatgacggaatggctgccattaccgcaaaaaacatcggcttcaaagcgctctatctctccggggccgcctacacggcaagccgcgggctccctgacctcggaatgatacactcccaggaaatcgctgaaaaagcaagcgaacttgtgagagccgcaaatcttccgcttttggtcgatatcgacaccggctacggcggtgtcctaaatgcggcacgcacggccgccgaaatggccgagagcagagtcgcagccgtccaaatcgaagatcagcaactgcctaaaaaatgcggacatttaaatggaaaaacgctcgtacccgcagaggacatgatcgcaaaaattagagcgataaaagaaaccgccccttcgctcgttgtcgtggctcggacggatgcaaaagcagcagaagggatggaagccgccgtcaggcgcgccaatttatatgccgacgcgggagccgatgccatctttcctgaagcattaacgagcgcagccgaattccgggaaatggcttcttccattaaagcgccgctcctggccaatatgaccgaattcggaaaaacgccttattatacggctgacgaattccaaatgctcggctgcagcatgattatttaccctgtgacttccctgcgcgccgccgcgaaagcttatgagcgggtcttcgcggagattttcgaaaaaggcacgcaaaagggtgtgctcgatgacatgcagacacgcgaagaattatatgatgcgattcattactacgactatgaaaaactggacgaaaatattgccaaaacggtgcttcccgaaa

SEQ ID NO: 744 - DNA, 837 bp, Bacillus licheniformis
agcttttcaacgaacctgcttgcagcccaatgaagcggtcgcagctctcatcttcggaatgattgagcgggctctgattccgttcggtctgcaccatattttctactcgccgttctggtatgagttcttcagctatacgaaccaggcgggagaaattgtccgcggtgaccaaagaattttcatggcgcaaatcaaagacggcgtcgaattgacagcgggtacatttatgaccggtaagtatccgttcatgatgttcggtcttcctgcggcagcgcttgccatttatcatgaagcaaaaccgcagaacaaaaagcttgttgccggtattatggggtcagcagccttaacatcattcttaacagggatcactgagccgatcgaattctcattcctgttcgtcgcaccgattctgtttgcgattcactgtgtgtttgccggcctgtcattcatgatgatggacatcttgaatgttaagatcgggatgacgttctccggcggtttgatcgactacttcctgttcggaattctgccgaaccgtacagcttggtggcttgtcattcctgtcggtttagtcctggctgtcatctactacttcggattcagatttgccatccgcaagttcaacttgaaaacgcctggacgcgaagatgcagctgcagaacccgctgatgaaggcaaagaagcagcaggagatcttccttatcaaattcttgaagcgatgggtgaccaggaaaatatcaagcaccttgacgcttgtatcacaagacttcgcgtaacagtcaacgatcagaagaaagttgacaaagagcgcttgaaaaaactcggcgcttccggcgt

SEQ ID NO: 745 - DNA, 795 bp, Bacillus licheniformis
atgatgaaacgaatctgtgccatatgctgcggattcctgctgacgctggcgttcagcggcaatgctgaagcgatttccaacaaggcgatccattggggtttttcaaaaagcaaaaaccatcagccggcagatgcgggtcaagagctgaccaaccttttacagcagtacgacgccttttatttgggcaacacaaaggaaaaaacgatctatctgacctttgataacggctatgaaaacggctacacccctcaggtgctcgatgttctgaaaaaacaaaacgtcaaagcggccttttttgtgacgggccattttgtcaaagatcagccggagctgatcaagcgaatggccgaggaggggcatatcatcgggaatcattcatatcaccatccggatctgacgacgaaaacaagccgcgtcattcaagaggaattggaatcggtcgatgaggaggtttacaaaatcacaggcgaaaaaaacaacctctacctgagaccgcctcggggcattttcagcgagcgggtgctcgaagaaacgaaaaagctcggctatcaaacggtattctggtctgttgcttttgtcgattggaaaatcaatgcccaaaaagggtggcgctatgcgtacgacaatatgatgaaacaggctcaccccggcgccatctatctgcttcacaccgtctcgagagacaatgccgaagcgcttgatcaggcgatcaccgacttgaaaaaagaaggttatacatttaaaagcctcgatgacctgatgtttgaaaaatctatgatgcttgagaccctttga

SEQ ID NO: 746 - DNA, 853 bp, Bacillus licheniformis
atgcttgtcaatcaaactgaaaccccgttgtacattaaggtgaacgaaaaagacaatgccgcaatcatcgccaatgccggcggactgccgcaagggacggtgtttccttgcgggcttaagctgcaagagcggattcctcaagggcataaagtggctttaacagacatcacacagggcggtgccgttattcgctacggcgaaattatcggctatgccgtcaaaccgatcgaaaaaggcgggtggatttccgagtcgcatatcatgcttccggaagctccgccgctcgatgaactgcccatcgccaacaaagttccaaaacccgctccccttcttgaggggtatacatttgaaggataccggaatgaagacgggagcgtcggcacgagaaacgtgcttggcattatgacaagcgttcaatgcgtcgcaggcgttctcgattacgcagtgaaacgaattaaagaggaactgctcccaaaatatccgaacgttgacggtgtcgctgcattaaatcatcagtacggctgcggcgtggcgattaatgcgccggaagccaaaatcccgatccgaacgattcaaaatatcgccaggcaccctaatttcggcggtgaagcgatggtgatcggactcggctgcgagaagctccttccgacgaagatagagccggaaggagacgctgaaaacattctttcactgcaggaacggcaagggtttcagcaaatgatacaatcgattatggaaatggccgaagagcgcttaaaaaggctgaatgaacggaagcggatgacatgtcccgcttcagacctggtgatcggcctacagtgcggaggcagcgacgccttttcaggagtgaccc

SEQ ID NO: 747 - DNA, 880 bp, Bacillus licheniformis
atgagtaaaatatgcgtgatcggcagctcttcgatggatttagtcgtgacatcgcccaagcggccggccgccggagaaacggtgcttggcgaatcttttaaaacggttccgggcggaaagggggccaaccaagcggtagccgcggcccggcttggcgccgaggtccatatgatcggctgcgtcggcgatgatcattacgggaaagccatcctcgacaattttcaagccaatggtgtcttgacagactatgtggaaccggttacaggtcaggaaagcggaaccgcacatatcgttctcgcagacggcgacaacagcattatcgtcgtcaaaggggcaaatgaccatgtcacacctgaatacgttcaaaaagcgctgcctgcgattaaacaggcagacatcgttctgattcagcaggagattccggaagaaaccgtcgattatgtcagcggactgtgcagctctctcggcattcctctcctgctgaatccggcaccagcccgtccgctacgcccggaaacggtcgaacacgcggcctacatcacgccaaacgagcatgaagcttcggtactgtttcagggcatgtcccgggaggaagcgttaaagcgctatccggagaagctgttcatcacagaagggaaaaacggcgtccgctatcacaatggtctggaagaacgtgtcgttccttcattccctgtcaatgcgattgatacgacgggcgccggagacaccttcaatgcgggatttgccgtcgcgctttccgaaggacaaagcatcgaatctgccttgcgctttgcgaaccgggcggcttccctgtcggttctgaaattcggcgcacaaggcggcatgccaaaacgggatgaagtggagcgtgaactgtcat

SEQ ID NO: 748 - DNA, 1137 bp, Bacillus licheniformis
aggagcaggtaccatgaaaatcgtaatcgcacctgattcatttaaagaaagcatgacatcgcttgaggcggctagaagcattgaaaaaggctttaaagagattctgcctgacgccgaatacgtcaatattccggttgccgacggaggcgaaggaaccgttcaggctctggttgacgctaccggaggagatattgtatatcaaacggtcactggccctctcgggaagcccgtaaaggcagcttacggcctgcttggtgacggaaaaacggctgtcatcgaaatggctgaagcgtcaggccttcacctcgttccacctgaacagcggaatcccctgttaacgacaacgagaggaaccggagagctgattctggatgctgcggaaaaaggagtgtcccagatcatcatcggactcggcggaagcgcgacaaatgacggcggcgcgggaatggcttcagcacttggcgtgaagtttctaaaccgcgctggagaagagattgaaaatgggggcggtgcactagctgagattgccaaaatcgatgtgagcggccttgatccaaaattaaagcatatccaattcgaagccgcctgtgatgttgataatcctcttacaggtcctcgcggtgcctccgctgtatttgggccgcaaaaaggagcgaacagtgaaatgacggcccacttggatcaaaacttaaaacattatgctgcagctgtcaaagcagagctgggatgcgaaatcgattcactcccgggagccggagcggccggaggattgggagctggcctgtgcgcctttttaaaagcggaattaaaaagcggtgttgacattgttttagatactttgtctttttctgaacgcattaaaggggccgatcttgtaattacaggcgagggaaaaatagacggccaaacggtcagcggaaaaacgccggccggcgtcgcaaaacgcgcctgcagcgaaaatattccggttattgcatttgccggatcgctcggtgaaggctgcgagcttgtttatgatatcggcatttccgctctcttttcgatcgtgcccggcatcagctccttggagaacgctcttgccgatggaagttcaaatcttacgcgctgtgcgcgaaatgtagccgccgtctggtcact

SEQ ID NO: 749 - DNA, 1075 bp, Bacillus licheniformis
atgattgcactgcatttcggtgcggggaacatcggccgcggatttatcggagccttgctctgcaaatcggggtatgatgtcgtgttcgccgatgtaaatgatgccgtgatcaatgaactgaacgataagggccgctataccgtcgaaatggccgatgccggaaggaagcaggaaacgatcggaccggtccgggcgatcaacagtgcgacccagcttgacgaattgtatgatttgatagcgaaagccgaccttgtcaccacagcggtaggcccggcggtgcttaaattgatcgcagagccgattgcagaaggtttgaagcgtcggatgaaaataaacaagcagcctttaaatattatagcttgcgagaatatgatcgggggcagcgctcatcttcgcgaggaaattttcgcccgcttaactgaaacggagcgcgccgcaatcagcgattcagtcggctttccgaactcggcagtcgacagaatcgtgccgatccagcaccatgatgatccgttgaaagtaacggtggagccttttttcgaatgggccgttgatcaaacggaattcgccggaaaagtgccggatattgaaggtgtgacatatgtagcggatcttgcgccattcatcgaaagaaagctgtttacggtcaataccggacacgccatggcggcgtatgccggctataagaaaggtttgaagacgataaaagacgccattcatcatccggaggtccgccaaacggtggcaggcgcgctagaagaaacaggccggtaccttgtccaaacatacgattttacacaggaagagcaccgggcatatatgacaaaaattatcggccgctttgagaatgaatgcctgtcagacgatgtcacccgtgtggccaggtcgccgcttcgcaagcttggcagggatgaccgtcttgtcggcccggcccggaagctttgcgatctcggctttgaacctgtccgccttgcagaaggcattgccctggcgctgcagtttgattgtgccgatgatccggaagccgttcagcttcaaagcatgatcgctgaaaaaggctatgccggcgtgcttcgcg

SEQ ID NO: 750 - DNA, 821 bp, Bacillus licheniformis
ttgccgatatggacgaaagactgcgtgaagggctcattgccgaaaaggggaaatgatagtcataaaggaacttatggaaccggccttttgctcgcgggaagcgatgatatgccgggagcggctctccttgcaggaatcggggcgatgcggagcggtctaggaaagcttgtcatcggaacgtgcgggagtgcgattccgctgatcctccccgttcttcctgaggcgacgtattggcgggacggcgccgaaaaggcggcgtcaggcgagattgccgaaccttaccgggcgattgcgatcgggcctgggctgccgccttcgcaaatgactgagcaagcggttcaaagcgtattagcgaaagactgcccggttgtgcttgatgcgggtgctctttcaaaacgatcgtatcatgaacgggaagcgccggtggtattaacgccgcatccgggcgaattttcgaaaatgacaggcttgtccattcgagaaattgaagcaaaccgggccggttatgctcgagattatgcggaggaacaaggtattacccttgtcttgaaaggcaatgaaacgatcgttgctttccccgacggcgagtgctggaggaatgtaacgggaaatggggcgctggcaaagggaggaacgggggatacgttaacaggtatgcttctcgggatgctgtgctgtcatgagaattcgagagaagcggtgctgaatgctgtccacttgcacggcgcatgtgcggacgcatggacaaagaccagatcggctcatgcgcttcttgcgcatgaactttccgatctgctgccaacggtatggaaagcgtatga

SEQ ID NO: 751 - DNA, 795 bp, Bacillus licheniformis
tccgctcaccagttttcggatcgatcattgtcgttttaaccaatttgccgtttctcaataaaatgatgagcaaatccgcgcttgaaacgttccagtcggctttaagcatagcgccgagcgcaacgatcagcatcatgtccgttttcgtcgtattcgggatcgggtattatttgtccaaaacttatgaagtcgaagcggtttttggaggagtcgtcgctttggcatcgttccttctgctgactccgtttgtattaaacggcgaaggaggggaagtgattccgaacgtcatcccgattgacaggctcggtgcgaaagggatgttcctcggaatgattaccgcctttacatccgctgagattttcagattttttgtccagaaaaactatacgatcaaaatgcctgccggcgttccgcctgctgtagcaaaatcttttgccgcgctgattccggcggtgatgaccttgtccgtctacttggtgatcaatatccttgtaacccaagcgttcaatacgaatatgcacgatttaatttacaacctggtgcaggctccgcttgtcggtcttggaagcggtatcattccgaccttgattgccatatttttcactcagctgctctggtttttcggactccacggacaaattatcatcaactccgttatggatccgatctggaatacgctttcgatcgaaaatttgaatagctataccgcaacaggagaagtgccgcatattatcaataagcagtttatggaagtctacaccgtcggaatgggcggaaccggcatgaccttggcgt

SEQ ID NO: 752 - DNA, 1377 bp, Bacillus licheniformis
aatcatcgcggcaaccggctgtccaacagggattgcccatacatttatggctgaagaggccttaaaacaggctgccgccaaactgggtgtggaaatcaaagtcgaaacacacgggcaaatcggcgttcaaaacgaactatcgccagaggacattaaacaagccgacggggtcattgtcgcggcagacaaagatgtaggcgcagagcgttttgcaggcaaacgtgtccttgacgtcccggttgcgcggggcatccgggatgcggaatctttaattcggacgctgatgaacggcgaagcgccgatttaccgcggacaaactgcggcaaaaacagaggatgaaccaaaaacaggcgaatccgcttccatcggccgtaaaatatataaacatttgatgaacggggtttcccacatgctcccatttgtcgtcggcggaggggttttgattgcactttcctttttattcggcatccattcagcggatcctgaacatccaagctacaacgcttttgccgaattgctgaataaaacgggcgcattcggattccagctgatggttccgattttatccgcctatatcgccgattcaatggcaaaacgccccggcctgattgtcggttttatcggcggcatgatcgccagcacgggcggagcgggttttctgggcggcatcgtatccggttttttggcgggactgatcatttacggcctctcgcatgcacttaaaaaaatgcctcagtcacttgaaggactaaaagcaatttttctttatccggttatcggcatttttctgatcggtgcggtcatgtttttcctcgtcgaaccgatgacggccattaatgaggggatgaagggctttttagccgactttcaaggggcgaacccaatcattctcggcttgatcatcggctgtatgagcgcatttgacatgggcggcccggtcaataaagccgcttatgtcaccggtactgctcttctcgctgaagggaaccaatatttcatggcaggcgtctccgccgcgtgcatcacaccgccgctcgttattgcgtttgccacattgcttttccgcaaatatttcagccagcaggaccgaaatgcaggacttgtcaattttattctcggcgccactcatattactgaaggcgctatcccgttcgccgcaaagaaaccaatccctgtcattccgattttgatgatcggctcttcggtttcggcaatattaacatattcattcgcagttcaagtacctgccccgcacggcggattccttgtacttcccgttgtaacaggagcctttcaatgggtgctgtcgattatcatcggatcgcttatcggtgccttcttatacggcttttaccaaaaacggacatatgaaaaaga

SEQ ID NO: 753 - DNA, 831 bp, Bacillus licheniformis
atgaatcgccaagagaaaaagaaacgggcgctgtggactttgctggctgcatggattaccgtttttcacctgattccgttttatattttgctgacgacggcgctgaaagcaaagggagatttcagttcaaaatggaagttcccggacgaaatcagcctcggtaattttgcagaagcatgggataaagcaggtctggccggctcgtttttcaatactgctgtgatcacttttgcttcggcggctctgctcattgtgatcggctctctggcggcatatccgctcgccaggcgcagaacaaagctcaatcaagccgtttacttcctgtttatcggcattatgatcattccgccgctgacatccatggttcctttatacaaaatggtggtggagcttggcatgctgaatacgcttgaaatcgcgatattgaataatacggcggcttatatgcccttgacgatttttttgtatgccggatttatccggtcgacgattccgaaagagcttgaagaggctgcgagaatcgacggggcgagcacggcggggattttcttcagaatcgtctttcctttattaaagccggtgactgcgacgatttgcattattgcctgcgtattcatctggaacgactatcagttttcgatctttttccttcaagacaaaagtgtgcagactttgactgtagcgattgccggcttctttgggcaaaatgcgaacaacctgcacttggtggccgcggcttcgctgatggcgatgctgccgatgacgattctatttttattcctgcaaaagtactttataaaaggattatcagcaggagcgctaaaaggctag

SEQ ID NO: 754 - DNA, 763 bp, Bacillus licheniformis
ctgtgaaccatttttatgtgtggcatatcaaacggattaagcagctaatcattattatgatagccgcttttgcgacagcaagttttttttatgtgcaaaacctgctccctcttcctgtgttttctacagaaggcggagcaaaagcggtatatagaggagattcagatacaaatgaagtagcccttacatttaatatcagctggggagatcaaaaggcaatgcccattttagacacattaaaagcaaacggtattaaagacgcgaccttttttctatcagcttcatgggcagagcgccacccggatgtcgtagaaagaatccgtaaagatggtcaccagatcgggagtatgggctatgcttataaaaactattcgcaaatgaagaaaagcgagatcaaaaaagacttagcaaaagcacgacactcctttcaaaaactcgggcttgacgaccttacgcttttaagaccgccgaccggccagtttaataaagacgtactcgatgttgctaaacagtacggctacaccgttgttcattatagtattaactcggatgactggacgaacccgggggttcaaaagatcgtccaaaacgtaaatggaacggtaaacgccggtgacatcgtgctctttcacgcttcagattccgccaaacaaacaaaagaagccctgccagagatcgtgcaccatctcagaagcaaggggctcaaaaacgtaacagtcagcgaattaatcgcaaatacggatgcaaaatcttcagaagtaaa

SEQ ID NO: 755 - DNA, 982 bp, Bacillus licheniformis
atgaaaaaaggattgaaaatcgtaacaattggcggaggttcaagttatacgcccgagcttgtcgagggattaatcaaacggcatgacgagcttccggtcagcgagctctggctcgtcgatataccggaaggggaagaaaaacttaatatcgtcggcacgctggcgaagcgaatggtcgaaaaagcaggcgtcccgatcaaagtccatctgacgctagaccgcagggaggctttaaaagacgctgattttgtcacgacgcaattccgcgtcggcttgctcgaagcgagagcaaaagatgaacgaattcctttaaaatacggggtgatcggtcaggaaacaaatggaccgggcggccttttcaaggggcttcgcaccattccggtcatccttgagattgcaaaagacatcgaagaactgtgccccgacgcgtggcttgtcaattttaccaacccggcaggcatggtgactgaagcgctgctccgctattctaatttgaaaaaagtcgtcgggctctgcaatgtgccgatcggcatgaagatgggggttgcaaaggcgctcgatgttgatgaaagccgcatagacattcaatttgcaggattaaatcatatggtgttcggactcgacgttttccttgacggcgtcagcgtcaaagacaaagtgatcgaagcgatggcagatccagaaaatgcgatgacgatgaaaaatatctccggagaatcgtgggaacccgactttatccgcggccttggcctgattccgtgcggctaccaccgctactactataaaacacaggaaatgcttgaacacgaactggaggcttcaaaaacggaaggaacgcgtgcagaggttgttcagcaagttgaaaaggaattgtttgagctgtataaagatccggagctggcgatcaaaccgccccagcttgaaaagcgcggcggcgcatattacagtgatgccgcctgcaacttgatcagctcgatttaca

SEQ ID NO: 756 - DNA, 675 bp, Bacillus licheniformis
tcctgcgggaaatagaaagaaaagagccgggcgtctcgtgtttcatatcacgacggccggtcttgcgatcatccttttgtatcccgttatctggctgatcgcaagctcgtttaaagaaagtgcgagcatattcgccacatcccactcgctcattccggaccccttgatcctgtccaattatacggagggctggaaagggatcgccggacagccgttcatcacattcattaaaaattcgcttatcattgtcggcctttcgacggccggcgcggtcttgtcctcggcgttcatcgcttacggattcgcgcggattccgtttaaagggaaggcgttttggtttagctgcatgatggtgacgatgatgctgccgcacgaggtgctgatgattccgcagtacatcatttttgcaaagctggattggctgaattcattcaagccgatcgttgttccccaatttttcgggcacgcgttttttatctttctgatgattcagttcatcaggacgatcccggtagaactcgatgaagcggcaaagattgacggctgcagccgtctcggcatctttttcagaattattttgccattgatcgcaccggcgctcgcgacgtccgccatcttctcgttttactggaagtgggaggaactgatcaatccgcttctttacttgaacaagcc

SEQ ID NO: 757 - DNA, 1427 bp, Bacillus licheniformis
ttgaaagtcttatttgctgtttctgaatgtgtgccgtttgttaaatcaggcgggctcgccgatgtcgccggggcgctcccgaaagagctcgcccttttaggcatagaaacggtcgtcatgatgccgaaatacagtttgattgcggaagacgtcagaagacggatggttaaaacggctgaatgcgaggttcgcgtcgggtggcgcaggcagttttgcggcattgaacaccttgaacatgacggagtttcctattattttcttgatcatgggtattattttaatcgggattccctttacggccattatgatgatggagagcggtttgcttttttctcgcgggctgttttggaagcactatacgcgctgaattttgaagctgatgtcatccatacccacgattggcacacagggatggtcaattatttattaaaagaagaatatcgaaaaaagccgttctatcagcacatgaaaagcgtatttacaattcataaccttcaatttcagggcattttcccgaaggaagcggttcatgacctgctcggacttgatatttcccatttcacgaccgaaaagctcgagttttatgggaacattaattatatgaaaggcggcattatcgccgctgatcaggtgacaacggtcagtccgacgtaccgcgatgaaatcttgactccatactacggcgagcggcttgaaggggtgctgtcagacaagaaggatgcactgacaggcattttaaacgggattgacgatgtgctgtacgaccctttaaacgatccgcacatcgattatcattacgatgccgtcaaccgggacggaaaacggaaaaataaagccgtgatccagaagacattcggtctgccggtgaatgaagacattccgctcatcagcatggtggcaaggctgacgaagcaaaaaggcttcgatttgatcaagcgggtattgcatgaactgtttgaagaagaagacatgcagctgatcgttttaggaaccggagaagcggaatttgaaaattacttccgctatatggagcatgcttttccggacaggtgcaaggcgtatatcggttttcatgaaccgctcagccgcaagatttatgccgcgagcgatcttttcctgatgccttcaaaattcgagccgtgcggtcttggacagctgattgccctcaggtacggcgcggtgccggttgtcagggaaacaggcgggcttcatgatacggtgaccgcttaccgggaaacaaccggtgaaggcaacggttttacgttcgcccattttaacgcccatgatatgaagcatacgatcaaaagagcactgtcattttatcacaggaaagaagagtggggcaggatcgttcaaaaagcgatgacacatgatgtcagctgggctttgtcagcccgtcagtatcagcggttatacagccgggagat

SEQ ID NO: 758 - DNA, 1419 bp, Bacillus licheniformis
taatcatgaaatataaaacattagctcaatttccgaaagattttttgtggggcgcgtctacttccgcttatcaagtggaaggcgcttgggacgaagatggaaaagggccttctgtcatcgatgcgcgcgaaagctacccggaagggacaaccgattttaaagtcgcaagcgaccattaccagcgctataaagaagatatcgctttatttgcggaaatgggcttcaaagcgtaccgtttttcgattgcctggacgcgcatcattccggacggggacggtgatattaatccgaagggaatcgaattttacagccgtttgatcgatgaacttctaaagtatggaatcgaaccaattgttacgatgtaccactttgatctgccgaatgctttgcagaaaaaaggcggctggtcggacagggccacgattgatgcttttgaaaagtatgcgaaggtcctttttgaaagctacggtgaccgcgtcaaatactggctgaccatcaatgagcaaaatatgatgatcctccacggatctgcactcggtacactcgatccgaacttggaaaatccgaaaaaagagctttatcagcaaaaccatcacatgctcgtcgcacaggcgaaagcgatcaagctttgccatgagatgctgccggaagcaaaaatcggtcctgcgccgaatattgcgctcatctatcccgcttcttcgaaaccggaggacgtgctggcggcttttaactataatgcgatccgaaactggctttacttggatatggccgtattcggacggtacaatacaacagcgtgggcatatatgaaagaaaaaggctgcacaccggtcatcgctgaaggggatatggacattctgcggtcggccaagccggattttatcgcgtttaactactatacatcgcaaacggctgaagcaagcaggggtgatggcagcgacacggctgctcgaggcggagaccagcatttgcagacgggagaagaaggcgtatataggggaagcagcaatccgcacctaaagaaaaacgcatttggctgggagatcgaccctgtcggtttccgttcgacgctgcgcgaaatttacgaccgctaccagctgccgctgatcgtcactgagaacggcctcggcgcgtttgatcagcttgaagacggagatgtcgtaaatgacgattaccgcatcgattatttaaaagagcatatcaagcaaattcagctggcaatcacggatggagtcgatgttttcggctactccccatggtctgccatcgacttaatttcgacccatcaaggctgttcaaaacgctacggatttatttatgtgaaccgcgatgaatttgatttgaaagacttgcgccgcattcgcaaaaaaagcttttactggtataaaaacctgattgctacaaacggcgaaacactcg

SEQ ID NO: 759 - DNA, 549 bp, Bacillus licheniformis
gctatgatatgaggaaattgctgaacggtacggtcgtttccaagcatccgttgaaagcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagat

SEQ ID NO: 760 - DNA, 1340 bp, Bacillus licheniformis
atgaaacatatacttcagctgcttggaaagtctttgctgattccgattaccgttcttccgatcgccgggctgctgctgcggctttctgcggaggatatgctggatataccgctttttcaagcgtcaggcgtgattttgaacaatatggatgtcctgatcgcgatcggcatcgccatgggctttgcccgttcaaaagataaagggattcctgcgctgacaggatatttggcgataaccgtgttaaaagaggggatcggcatcttgaatccggaccttgatatgagcgtcttcggcggggtgctcgccggcctgatggcggctttcatttataatcaatttcaacatgcaagactgccaagcatgttttctttttttggcggagagaagtttccgattacaatgatcgtattggtgacgattccggtggcagggtttttttcggtcgtctggccttacgcagaggcggcgatcgacgcttttagccagtcgcttgttggtcttggcgctttcggtgtttttgtgttcggatttctgaaccggtttttgcttccgttcggacttcaccatgtcatgaatacgtgtatatattttgggcttgggcgctatgagacggcatccggagaagcggtgacaggggaaattacacggtttttgaatggagacccgacagccggctactttctcggcgggttttttatcacgatgatgttcggcattccggcgatcgctttggcaatagcgcatgcagccagaacgagaaaaaaagaaacgaaagcactcatgtcttccggagcagccacatcgctgatcaccgggattacggaaccggttgaattcacgtttttatttacttcgcctttattgtattttcttcactcggtctatacgggacttgccggagcggtgctctgtttgctggggattcgtcacggcttctcatggggagcgggcgccatcgattatttgctgaatcttaatttgtcagacggcggattattgatcataccggtgggcgttgcttttttcgcgctctattatgttacgttttactttgtgattataaagcgaaacgttccggtgatcggaagggagcaggaaacacctgaaggagaccggctgcagcagtctatggcggcaggtattctcaagtatatgggcggccgtgagaatgtcgtcacttgtgaaaactgtattacccgtttgcgactgaaattaaaagacacgtcattggcggatgaagcccaattaaagcgattgggggcgcacggtgtgatcataattgatcggcatcatattcaaattgtgattggaacggatgcggggactgtaaaaaaagactt

SEQ ID NO: 761 - DNA, 815 bp, Bacillus licheniformis
atgaaaaaatgctggctgttgatcactgcaatgcttttctgtctcatcgttaccgcttgttcggggaatcaggcaagcggagggggagacaaaggctacgtcggaatctcaatgccgacaaagtcatcggaacgctgggtgtatgacgggaaatacatggtgaaagagtttgaaaagctcggttataaaacggatctgcagtatgcggaagatgtcgttgaaaaccaagtttcacaaatcgaaaatatgattacaaagggcgtcaatgtgcttgtcattgcttcgattgacggagaagcgctgaccgacgtcctagagaaagcaaacaagcaggatattaaagtcatttcttatgaccggctgctcatgaacagcaaacatgtcgactattatgcgacatttgacaatcataaagtcggggaacttcaagggaaatatattgaagaaaagcttggcttaaaagacaaaaaagggccgttcaacatcgaattgttcgcgggatcgcccgacgacaacaacgcgcatttcttttttgacggcgccatgtctgttttgaagccttatatcgattcgggcaaattaaaggtgttgagcggccagacttcatttgagcaaggggcgacgctcaggtgggacggcgcaaccgcacaatcccggatggacaatttgctgagtgcgcattatacaaaggcgaagcttgatgcggtgctttcaccgtatgacggaatcagcatcggaatcatttcatccttaaaaggtgcgggctacggctcggacaagaagccgctgccggttattacgggacaggatgcaga

SEQ ID NO: 762 - DNA, 1173 bp, Bacillus licheniformis
tagagaggatgtcacagatgaacagaattcagcaggcagaagaagcattaaagaaagccgggaaaaaagtgaatcgccgttaccgaatgggctatcacatgatgccccgggcaaactggataaatgatccaaacggacttattcaatataaaggggagtatcatgtcttttatcaacatcatccgtatgatgagaattgggggccgatgcattggggccatttgaagagcaaggatcttattcactgggagcacttgccggttgctttagcgccgggagacgaatttgatgagagcggctgtttctcaggaagcgcagtcgaatataacggcgacctcgctttaatctatactgggcataatatgatagatgaagagaaagacgatttctaccaaactcagaatatagcagtcagcaaagacggtatcgtctttgaaaaactgaaagaaaaccctgttattgcagagccgccggaagacagcgcacgtcactttcgcgatccaaaagtatggaagcatcgtgagaactggtatatggtggtcggaaactcctcaaaagagaacgtcgggcgggtcatcttataccgctcgcctaactttgtagattgggagtacgtaggcgttctcgcccaaagcgacggaaatctcggctttatgtgggaatgtccggatttctttgaactagacggcaaacacattttgctgatttcccctcagggtatagaggctgatggtgaatcatatcaaaatctgtatcaaacaggctatttgattggagactatgatgaagaaacgaatgagtttgtacatggctcctttaaagagttggatcacggccacgacttttatgccgtgcaaactttattggatgacaaaggccgcagaattgcgattggctggatggatatgtgggagtcagagatgccgacgaaagcagacggatggtgcggggcattaactttgccgcgtgaattgacgttgaaggatggtcacaaaattttaatgaatcccgtcgaggagactaaattacttcgtggatcggaacatcatgagtgtgacaatcaatcgatttccggcagctattttataaagacagccgaaaagcttcttgaagtggtggccgtttttgatttgacaatttgcagtgccgaaacggttggcttaaagatccggg

SEQ ID NO: 763 - DNA, 627 bp, Bacillus licheniformis
atgatggtattgtcacacatcgaagaacaaaaactgattgcgatcatccgcggatacaatccggaggaggcagtgagcattgccggcgccttaaaagcgggcggcatcaggcttgtggagattacgcttaattcccctcaagcgatcaaagcgattgaagcggtttcagagcattttggggacgaaatgcttgtcggagcgggaaccgtacttgatcccgaatctgcgagagcggcgcttttagccggcgcgcggtttatcctgtctccgaccgtcaatgaagagacgatcaagctgacaaaacggtatggagcggtcagcattccaggcgcttttaccccgactgaaatattgacggcgtatgaaagcgggggagacatcatcaaggtatttcccggaacaatggggcctggctatatcaaggatatccacggaccgcttccgcatattccgctgcttccgactggaggagtcggattggaaaaccttcacgagtttctgcaggccggtgcggtcggagcgggaatcggcggttcgcttgttcgggctaataaagatgttaatgacgcgtttttagaagagctgtccaaaaaagcaaagcaatttgttgaagcagcaaaacagtaa

SEQ ID NO: 764 - DNA, 1089 bp, Bacillus licheniformis
tttaaacttaatcggcgaataccggattataatggagggcatgttttccccgcctcgtctctttggcacctattcccttggcgtgaagcgcgatgatcaaatgatccgcttctattcaaagaacttccctgacaaaggaataattgaatgcagcttgagcgatttagcctttgaccagtccgacggctgggccaattatccgaagggaatgttccttttgacgaaagcggcaggccatcaaatcgttcacggcgccgatattttgtattacggaaatattccgcacggagcgggcctctcttcttccgcatcgattgagcttgcgacaggcgttttgttaaaagggctttatgatttgcagacagacacgatctccatggtgaagctcggacaaaaagtcgaaaacgaatacattggcgtggggagcggcattatggatcaattcgcgatcggcatggggaaaaaggatcacgcgattttgctagactgccgtacacttgattacacatacgctcccttcgtgttgaaagaacacgatgtgatcatcatcaatacaaacaaacagcggacgctggccgggtctaaatataatgaaaggcgcacccaatgtgaagaggcgctcggcgatctgcaacaggagttgtcgatcgcaagcctgggcgaattgacgatggaaggatttgaagcccatcagcacctcatcagaaatgaaatcaatcaaaaacgcgccaaacatgctgtctacgaaaatgcccggacgctgaaggcgcttgaaaaacttcgcgaaggcgacctcgccggatttggcaagctgatgaatgaatcccatttgtcattaagggatgattatgaagtgacggggctggagcttgatgccattgtccaggcggcctgggaacaagacggtgtccttggcgcccgcatgaccggcgccgggttcggcggctgtgcgattgcgattgtagaaaaagaccggacagacagctttaaagaacgcgtgaatgccgtctaccgcgaaacggttggctatgatgccgctttttatactgcggcaataggcgacggcgccaaagaaatatagaaagggga

SEQ ID NO: 765 - DNA, 792 bp, Bacillus licheniformis
  misc_feature (1)...(792): n = A,T,C or G
atcaggagcttcgtcaaaaggcaatgaaccgggttgaagaataccgggatattgtaaaccttgatccctatcggctgcattatcatatcatgccttctgtcggactgctgaatgatccgaacgggttcattcagtggaaaggggtgtaccatcttttttatcagtggatgccttttaaaacggggcacggtgcaaagttatggggacactactcctcagcagatctggttaactggcggcatgaagagatcgccctcacgccgagcgactggtttgataaaaacggttgttattcaggaagcgcgatcgctgaaaatgatgtgctgcatctgttttacacggggaatgtcagagacggcgagggaaatagggagacctatcaatgtctcgccgtctcaaaagacggcatctcgtttgaaaagcagggggttgttgcaaggcttccgaaagggtatacggctcatttccgcgacccgaaagtatggaaaaagaacggcagctggtacatggtgctcggcgcccagactgaaaatcttgagggaagggcggtgctgtttcaatcggataatctgaaggactggcagttcctcggncgatatgccacaggttcaaatacagatcagctcggggaattcggctatatgtgggaatgccctgacatgttcgaactggacggcaaagacgtcttaattgtctgtccgcaaggccttgaagcagaaagagatgcctctacccaaaacggtctattcagtaaggcttatttttgtcggtggaattggaacgaggctgaaa

SEQ ID NO: 766 - DNA, 1512 bp, Bacillus licheniformis
acccggtgttgaccggttttcatccggacccttcaattatcagagtcggggaagattattacatggtgaactcaacgttccagtatttcccggcaatcgttatttcccactctaaagatttagtccattggaagatcatcggccacggaatcacggaaaatgaaggattggacctgtcggatatcaatgattcgcacggcatttgggcgcctgatatttcgtatcataacggaaccttctacatcttcgcgacgcacaggctgaacggaccgactgtcatcaacggccgaaagctgatccgcagacagattatgatcaagtccagccgccccgaagggccttattcaaagcccgttttcattgatgaaggcagcggcatcgatccttctcacttcgttgacggcgacgggaaacactatatgctgctcagtcctgcctgcacgctctttcctctaaatgaagaatgcacagacatctccggcgagccggttcagatatgggaagggactgggagaagggcgcctgaagggccgcatttgctgaaaaaagacggttattactacgcgatattggcagaaggaggaaccggatattcccactcgattacgacagcccgctcaacgcatttgtacggtccttatgagccctgcccgtataatccgattttaacgcagacagacccggatgctccgattcaaagagcaggacacggcaagctcgttgaaacccagaatggagaatggtgggcggtgtatctatgcggacggcccaatcaaggtagctatacaacggttgggagggagaccgctttggatcccgtcgaatggacggatgacggctggtttgtcatcaacaacttgaagggcccgagtcttgttcagcgcgctccaaacctcccccaagtcaaatgggatgaaaagaatttcgacgattttgacgaggatacgctcggtcttgactggcagtttgtcaggaatcccgatcattccagctggtctttgatcgagagaccgggatatctcaggctgtggacaggtgattgggatttacatgacatccgtgcaaaaaatacggtcgtcagaagggaaaagcaccacctatacagcgccggcgtgaaactcgacttttcaccttcggcctccggagagcaagcggggatcgtctgctactacagcacgaataattatttgaaatgctgcttgatctatgaagaaggattgaagatcaaggtcgtggaaaatcgctccggttgccaaaaaacgctggggaaaaaacatgccgaggccggcccgctgtttctgaaagctgtcatcaataagcaaaagagggatttttactacagttatgaagggaagcattggcaccacgcgggcggtacagaggacgccagttttttaagcgatgagggttcgcgtgacgcaaagggacatacgggaacgatggtcgggatattcgccaataacggcggaagcggcagaaaggctgccgctgattttgactggttccgctata

SEQ ID NO: 767 - DNA, 1179 bp, Bacillus licheniformis
atctcaacgctatatttttaaacatcttcatatttacagtgaaaatggaatgatagaagacggttttcttctgacgaatggagaaaaaatcgaggcttacggaccaatggctgatattccagcttccgcacaaacggcagaacagctgacatttccggagaacttcaaagtgctgccgggcatgatcgatgtccacattcacggggcaaacggcgcagatgtcatggacggaacagccgaggctttgcaaacaatggctgaagccctgccgaaagaaggaacgacaagcttcctggcgacgacgatgacccaagataaagccacgatcgagcatgcgctggcaaacgttcaccggtataaggaagccggcggacggcccggaacagccgaagtattaggcgttcacttagagggcccttttatttcagaaaagcggtgcggcgcccagccgccggatgacattatagcgccggatctttcgttatttaaagaatggcagcgcatctcagggaataacattaaattagtcacacttgcgccagagctggaagggtctttggaactaatttcctttttgaaggaaacaggggtcatcgcatccgcaggccattccgacgccggactcaaagagatggaagccgggattaaggccggcctctcccatgtcacccatttgttcaacggcatgcgggggctgcaccaccgcgagccggggactgccggtagcgctcttctgcatgatgaactgaaggctgaagtcattgccgacggcatccatgttcaccctgccgtcatcaagctggcatttcagcaaaaacagaaagaaggcatcattttaattacggatgccatgcgcgcaaaatgcttgaaaaatggaacctatacattaggcggacaggaggtgttcgtaaaaggcgataaagccgttttacgggatggtacgcttgccggcagcatcttgaagatgaaccaggctgcactgaacatgatggattttacgggatgttcactcgaagatatcgtctacatgacagcagtcaatcctgccagacagcttcatatttatgaccggaaaggcagcatacggagcgggaaagatgccgatttgatcattttaaatgaaaaaaatgaagttgtgatgacgctttgcaaaggcgtgattgctttcagcaaaaggga

SEQ ID NO: 768 - DNA, 555 bp, Bacillus licheniformis
ttgaccaaattgccgaacgcgtcagaccgggtgccgacggactgctgttccatccatacctcgcaggcgaacgggcgccgctctggaatccggatgtgcgcggttcattcttcggcctcaccatgtcccataaaaaagaacacatgatccgcgcggcattggaaggggttatttacaatctgtacaccgtcttcctggcgttgacagaatgcatggacggtccagttgcccgaattcaggcgaccggaggcttcgcaaggtctgatgtgtggaggcaaatgatggccgatattttcgaatcggaagtcgtcgtgccggaaagctatgaaagctcttgtctcggagcctgcattttgggactgtacgcgacgggaaaaatcgattcgttcgatgtcgtctccgacatggtcggaagcacgcacagacacgcgccgaaagaagaatcggccaaagaatacagaaaattaatgccgatctttatcaacttatctcgagcactggaaaacgagtatacacaaattgcaaattatcaaagaagcttaaccagcaaaaaat

SEQ ID NO: 769 - DNA, 657 bp, Bacillus licheniformis
atggtatatgttgctccttctattctttcagccgattttgcccgtctaggggaggaaattcgagatgttgaacaaggcggcgccgatttcatccacatcgatgtgatggacggccatttcgttcccaacctgaccatcgggccgcttgtagtggaagccgtccgcccgatcactgagcttccgctcgacgttcatttaatgatcgaagcgcctgaccgctatatacctgcttttgcaaaagcgggcgccgatattttgtccgtccatgttgaagcatgcccgcaccttcacaggacgatccagctcatcaaagagcaaggggtcaaagcgggagtcgtcttgaatccgcatacccctgtgcagcagatcgagcatgtgcttgaagaccttgatctcgtattattgatgacggtgaatccgggcttcggcggacagtcgtttatttcctcggtcctgccgaaaatcaggcaggtcaaggagatggctgagcaaaaaggacttgccgatctgctgattgaagtggacggtggcgtcaacaaaaatacggcaagacagtgtattgaagcgggagcgaacctgcttgtcgcaggatctgccgtttataacgaaaaagaccgcaaaaaagccatttccgatataaaaggtgcgcttgggtaa

SEQ ID NO: 770 - DNA, 1439 bp, Bacillus licheniformis
gtgacgattctcgcctttgatcttggtgcgtcgagcggcagagcttatgcaggtcatgtggacggcggtctgatcaaagcggaggaaattcaccgttttccaaatcagcccgttcaggcgggaaaacacctttattgggacattctcaggctttatcatgaaattaaacagggcattttaaaggcgaaaaacggctgtggacgaatcagctgcatcggaatcgattcatgggcggttgacgtcggttttctcgatcggaacggagagctgatggggaacccttatcattaccgcgacccttacacggacggaataatgacggaggtgttgaatgaaatcggaaaagaagagctgttttccagaaccggtattcagcttttgccgttcaacaccatctttcagctccgggcgctgaaaaaagcgaattctccgctgttggattacgcggacacactattaatgattcctgatttgctgcgctattttttaacgggcgagaaaaaaagcgaatttacaaatgcgacgacaacccagctgttcaacccgaaaacgtctgactgggattgggagctcatcagccttctggggatcccggccaagatttttccaaaagatatagcaaagcccggaagcgaagcggggaggctgtcgcaatcagtgtgcggcgaattgtctgtgcccgccgtaccggtgattgccgtcggcgaacatgacacggcttctgcagttgtcggcatccccgctgaaacggatgactttgcatatttgatttgcggcacctggtcgctgatcggaaccgaacttgacgctccgctgatgacaaaacaggcgctcgattggaattttacaaatgagggcggtgccggcggcacattccgttttttaaaaaacattatgggattgtggctgttccagcgctgtcaggcggattgggaaaaagatgggatcagctattcgagcgccgagcttgtcaaacttgccggacagtcagaagcattcaggtcggcggttgacccggatgacccggtgtttctcaatcccgtccatatgcctgaggcgatcagagagtactgccgtgcagcagggcagcacgtgccggaaacgcccggacagatcatccgctgcgtgctggaaagccttgcgtttaaataccggttcaccttcgaacggattgaaaccttgacaggaaaagaatatgacggacttcacatggcgggcggagggattcgaaatgaactgctctgccaatacacggcgaatgtactgtccagaaatgtatgggttggactgtcagaggcaagcgccatcggcaacattgccgtacagtctgtcgcgctggacatgttttgggatattcagagcgcccggaaagcgatcaaggcttcctttcctcaaaaaacgtatgtaccggaagatacagaagcgtgggagcgggcata

SEQ ID NO: 771 - DNA, 813 bp, Bacillus licheniformis
gaaaatgttacttgtgctgtctatgttgatgggggtgctgtacgggtgttccggtcatgaaacaaaaggagaggaaaaaacagaaccaaatacggctcaaaaagcggcaaaacaatcaaaacagcaggcggaacatgatccatcatccaagtgggtcaaagtgaaaagcccggcccgcattccgattctcatgtatcacagcatttcctcaggaaacagcctgcgcgtaccggaaggggaattccgcgggcatatgaagtggctgaaggataacggctattacacgttgacacctgaggaagcctatattgtcttaacgcaagataaaatgccgagtgataaatgcgtgctgattacgtttgatgacggttatacagataactttgaaaaagcgtacccgattttgaaaggctatgggatgaaggcgacaatttttatgatcggcaaatcggttggcgggaagaaccatttgacggagaaacaaatgaatgaaatgaggcgaaacggcatttcgattcaaagccataccattcatcacgttgaattgaacggactggcaccgggacagcagctcgatgaaatgacgcgttccaaagcgctgtttgatcgcatgttcagccaaaatacggtgatgctgagctatccggtcgggcgctacaacgaagatacgctgaaactcgcaaagcaggcaggctatcaaatggccgtcacaacagaaccgggagcggcatctagggatcaggggatgtatgcgctccaccgcgtccgaatctcgccggggatgtcgccggacgcctttgggaaaatggtgga

SEQ ID NO: 772 - DNA, 699 bp, Bacillus licheniformis
tacagccaaaaaaaaaaagaaaaaaatcgttgccggtctgctgattccgatcacgctgacagcggtaattgcggggatcacggagccgattgaatttacgtttttgttcatttcgccgctgctgtttttcgtacacagcctcttggccgcgacgatggcaaccttgatgtatgctgcaggggtggtcggaaatatgggcggcggtttaatcgagattttaacgctcaactggatccctctgtttcatcagcacggcagcacttatgtttttcaaattttgatcggcttgtctttcaccgccatttacttcttcgtattcaggttcttgattttaaaattggatattgccacgccggggcgtgaaaaagaccagcagcaggagacaaaattttattcgaaaaaagattacaaggcgaaaaaagaatccgaaaaagaggtttctgcggcgcaggaaattgctgagaccgatcaggcggttctttgcatcaaagcgctcggcggaaaagaaaacattgcggaggtgacaaactgcgcgacaagactgagagtcagcgtgtatgacgagtcaaaagtggagccggacagtacgtttaagtcctttggcgttcacggtgtcgtcagaaacggaaaagccttgcaaattattatcggtctttcggttccgcaagtccgtgaaagggtcgagaagctgctgaacca

SEQ ID NO: 773 - DNA, 986 bp, Bacillus licheniformis
atgaagaagctgttagttgtttatgccgtgatgctctgtttgttttttctgtatgtctacgactactcccggggcgataaagccggttctgcagaagaaagcaggaggcctgcggccgcaggcagtctgtccgaaaaatacgtgatggtcacgtttcaatcgggaatcgaatattggaagagcggtctgaaaggctttgaggatgccgcgcagcttttcaacgtctctgtcgagtatcggggggcggcccattatgatgtccatgagcaaacgaccgtcctcgagcaggtgattgcaaaaaaaccggcgggaatcgctgtttcggcaataaacccaaaagctttaaaccctgtcatcgacaaggcgcacgagcagggtattccgatcgttttatttgattcagacgccccgctcagcaaagcttctacatatatcggcacaaataatatggaagcgggtgctgtggccgcaaggcgaatggccgaatttttgaatggaaagggagaaaccgcggtcattacccagccgcagcagtacaatcatcaggaaaggacgaagggctttgaacaaacgatcaagcaaaaatacccgaacatgaaggttgccgcggttttggacggaaaaggggatgagctgacgtcgaaaaaagaagcggcgaagattttggaggaaaatccgtccatcaaaggaattttcacgactgaagccaatggagcgagcggcgtggcccgtgctgtgaaggaggcgggacttgaaggggaagtatgtatcatcggctttgataaagacaagaaaacgctggacggcatcaaaaacggatcgatttccgcgacaatgagccaggacacatggcaaatgggctattggtcgctgcacatgctgtttttctcaaatcaccatctgaagcatgaacgcccgcttccggccgcaatcgacacaggcattaccatcataacgaaagaaaatgtggcagcctattatgcgaa

SEQ ID NO: 774 - DNA, 709 bp, Bacillus licheniformis
  misc_feature (1)...(709): n = A,T,C or G
atgaaagtgaaagttgcgataaacggattcggccggatcggcagaatggtgtttagaaaagcgatgcttgatgaacagattgacattgcggcgatcaatgcgagctaccctccggaaacgctcgctcatttaataaagtatgacacaaatcacggccgttatgaacttgatgtaaaggctggagaagactgcctgttcgttaacggtaaaaaggtcatgctgaccaatcagagggaccctaagcttcttccgtgggcacaatacggaatcgacatcgccgtggaagcgacggggaaattcaactcaaaggaaaaagcggaagcacatattgaagccggcgcgaaaaaagttattttgacggcgccgggcaaaaatgaagacatcacaatcgtgatgggcgtcaacgaacgcgattttgatgcggagcgtcatacgattatttcaaacgcttcctgtacgacgaattgtctcgctccagtcgcaaaagtgcttgatgatgcattcggcattgaaaacggcctggtgacaaccgtacacgcttttacaaatgatcaaaaaaatattgataatccgcacaaaaacttgaggaaggcgcgccgcctgccngatcttcgatcattccgacnaacaacagcgccgcgaaaacgctgtcactttgtcatgcccccatttaagggtaaaatgcacngcctggcccctgcccttccct

SEQ ID NO: 775 - DNA, 858 bp, Bacillus licheniformis
ggacagacgatcgaaacgcttgagttcaaagcgggcaatgactgaaaaccggatcatcagaggcatggtcggcagggagctgcaaaaccgctaccctgacagaagcgccgagatcggcgacgtcatctttgaagtgaaggattggacagttcaccatcctcttcaacaggaccgcaaagtggtaaacatggcggcgttttccgtgaaaagaggcgagatcgcaggaattgccggactgatgggctccggaaggacggagctggcgatgagcatttttggaagatcatatgggaaaaacatttccggcacaatcgaaaaagacgggcgggagctttacatcaaccaccctgaagatgccattaaaaacggcatcgtctatgtgacggaggacaggaaaggaaacggtttgattctgaaggacagcattaaagaaaacattacgctgtcgaaactggataaggtgtcgagccgattggtgatggacgagcggcgcgaacaacatgaagcggaggattttcgccggaaattaaacatcaagacgcccgatatcagccagcggaccggaaatttaagcggaggcaaccagcagaaggtcatgctgagcaagtggattttcgcggagcctgacgttttaatcctggatgaaccgacgcgcggcatcgatgtcggcgccaaatacgaaatctacggcgtcatcaatcagcttgccgaagcgggtaaagcggttatcatgatctcttcggagcttcccgagctgctggggatgtgcgacagaatctatacgatgtgtgagggggaaatcaccgccgaattttccaaagaagaagccgatcaggagaagctgatgaaatatatgac

SEQ ID NO: 776 - DNA, 679 bp, Bacillus licheniformis
ctgtgaagccgtttttgaatgacgattttcttttaacgaatgaaacgtcgaaagtgttgtaccatcagtatgcaaaaggaatgccgatcatcgactaccactgccacttgagcccgaaggagatttacgaaaacaaaacgtttaaaaacctgaccgaagtatggctctacggtgatcactacaagtggagagcaatgagggccaatggaatatccgaagagtttattacaggagatgcgtcagacgaggagaaattcagcgcctgggcaagaacggttccgatgacgattggaaacccgctctatcattggacccatttggagctgaggaggtttttcggcatcgatgaccggcttgatgaaaagagcgcgccgcatatttgggagcgggttaacgaacagctggccggaggagggttcggcgccagagacttgattgaaaaatcaaacgttgaaacggttgtcacgacagatgaccccacagacagtcttgaatatcatgtaaagctgaaagatgaagactttaatgtaagcgttttacctggatttaggccagacaaggcgatggaaatcaatcaagagggttttgccgcctgggtgagaaagcttgaaacagctagcggtatgaagatagcgaattatgacgattttttgaaagcgcttaaaaacagaattacttt

SEQ ID NO: 777 - DNA, 1218 bp, Bacillus licheniformis
tcgaatcaaacatcatgccgatcgccggaaggatcggttcccaaaggcacctgattgcaatacgcgacggattcatcgccattatgcctcttatcatcatcggttccctcgccatcctggtcaataattttccaataccggcgtttcaaaactttatgaccggtcttttcggcgagggatggacggctgtcggcggagcgatatggaatggctcttttgctctgttgagccttttagccgttgcggctgtcagcttcaagctggccgagtcatatcacacagatggtctgtctgccgcattaatcggggttggcgcattcgccgtgcttacaccgaccactgaagactttggcttctcaatgacttggctgggagcccaaggtctgttcgtcggcttaatcgtggctttgctgtcgacagaagtcttccggctgttttccaaaaatgagaaattgaaaatcaaaatgcctgaaggagtgcctgacggcgtcacaaaatccttgaatgctctattgccggctgccgtcatcttatccactgccgggctatgtaacgctctgatcgttcacttttcggggcaaagcatccatgagcttgttttcagcacgattcaagagccgcttcaaggcctttccaacacggttgggtcagccttgatttttactttcttgaatcatttgctctggttctttggattgcatggaacaaacatcctcgggccgatcatggaatccgtctacctcccgctcattcaggaaaatcagcacttattctcgcaaggaatgagcgcttttgaagtgccgtatattgtgacaaagcctttcttcgattcttacgtatttatggggggatcgggaacaacattggctctgcttgccgccattttaattgccgtgaaatcgaagcactacaaaacgataggaaaggtgtctctcgcacccggcctttttaacatcaatgaacccgttctgttcggccttcctattgtattaaacccgatcatgttcattccgtttatcttgattccattaattttgacgattacatcatatatcgctttggcttccggtctcgtcccgaaaactgtggcgatccttccgtggacgacgcctccgattgtcagcggatatcttgtcaccggaggatcagtccgaggggtctttttgcaaatcttcaacctggtgctggccaccctgctctacctcccgtttataaaag

SEQ ID NO: 778 - DNA, 735 bp, Bacillus licheniformis
agcagaatgactttttgcataaagcaggcgggcggacatcggatcatgccatcgatcagatgatgcacacggcaacagatcagagctaagtgcgcccgatttttgcaaaggtgatgaacggggaaagcgcctcgcctgaggaagagtgcaaattcaaatccttggccttgcactttttgggaacatgctatgcggagaagggctgggcgatgcagctccacattaacgccctccgcaacaacagcagcaaaatgtaccggaagctcgggcctgatacgggatatgatgcgattaatgatcaggatatcgcaaagcctttgtgcagctttctcgattctcttgatcgaaaagatgcgctgccaaaaacgatcttgtattctttaaacccgcgggacaatgtcgtgatttcaagcctttgcggaagcttccaggacggccggataccggggaaaatccagcacggtaccgcctggtggttcaacgatacgaaagacggcatgctcgaacaaatgaaatcgcttgccaacatcggtctattgagccgttttatcggtatgctgactgattcgcgcagctttctttcctacacaagacacgaatatttcaggcgcctgctctgcgatgttatcggcacatgggttgagaacggcgaagcgccggatgatatcgaactgctgggccggatcgtaaaagggatctgctacgaaaatgcaaaacactatttccagtttgaag

SEQ ID NO: 779 - DNA, 544 bp, Bacillus licheniformis
atgtgcaatacaatcggtgtcataggtttgggggtcatggggagcaatatcgccctgaacatggcaagcaaaggcgaacaagtcgccgtctataactacacaagggatttaaccgatcaactcgtccaaaaaacgggaggccaaacagtcaagccatactatgagcttgaagatttcgtacagtctttagaaaagccgcgaaaaatctttcttatggtcacagcaggcaaaccggtcgattctgtcatcgactcgctcgtccctctgcttgaagaaagggacgtcatcatggacggcggcaactcccactatgaagatacagaacgacgatatgacagtttgaaagtgaaaggaatcggctacttgggaatcggcatttccggcggcgaaatcggcgctttaaaaggcccatccattatgccaggcggagaccgggacgtctacaaaaaagccgctccgattctcacaaaaatcgccgcccaagtggatggaaatccatgctgtgtctaactctgtccgaaaggcgccgggtcattttgtaaat

SEQ ID NO: 780 - DNA, 1998 bp, Bacillus licheniformis
atgaagatgaacggaaagctgtaccatggcgcttgcttttatcccgaattgtgggatgaggatgtgctggatgaagatatcaggatgatggagcgaatcgggatcaatgttgtcagaatcggggagtttgcctggtcaaggatggagcctgaaaaaggaaggatcgatgtcggattttttgcagacgtcatccgaaagctccgcgacaacaaaattgaaacggtcatgtgcacgccgactgcgacgccgccgatctggctgacccacgggcacccggaaagaatgcatgtgaatgaaaaaggggagacgatgggacacggttcgaggcagcatgcctgcacaaaccatccctatttcagagagcgggcccggctgatcatcaaacatatcgccaaagagatcggagaactgccgggattgatcggatggcagcttgacaatgaattcaaatgccatgtcgcagaatgcatatgtgaaacgtgccgcacattatggcacaaatggctggaagaccgctatcagacgattgaccgtctgaatgaggcatggggtacgggcgtatggagcgaaacgtatcagtgcttcgagcaagtcccgcagcccggaccgaccccgtttttgcataattcttctttaaggacaatgtatcagctgttttcgatggacaagatttctgaatttgcgcgtgaacaggctgaggtgatcagagcatactccgatgccccgatcacccataatagcagcgtcatgttcggcgttgatcatgaagaccttttcaagagccttgattttgcctcgtttgatacgtacgccagccaggaaaacagtcaagcctttttgtttaattgtgatttatggagaaacatcaaaaaaggacggccgttttggattatggagacgagcccttcctacagcgcttcgcttgaaagctatgcggcgcctcatcaaaacggctatttgaaagctgaagcggtttcttcttatgctcttggcggagccgcgttctgctattggctgtggcgccagcagagagccgggtctgaacagccgcacggatcagtgctcagcgcatggggggagcctgatgtgggatatgaaaatgtgctcgaagccgagcgggcaagacgagaggttgaacacatcatgctggctacggctcctttgcaggctgaaacagctgtcgtctattcggaccgtgcgaaggtgtttttgaaaacggagcctcatcggggtcttcattacagaacgctgatcaccgagttttatgaccgattattaaagatgggcattcacagggatgtcattcttgaagggagcccgctggacggctacaaactgctgtttacgccgtttattcattatcttccccctgcttttatcaaaaaagccgaagcatttgcacaaagcggcggcatttggattgcgggtccgctgacgggcggaagaacagagcaccatacgattcacactgattgcggattggggcctttagaaaaatgttctggtgttaaaacgctgtttacattcccgatggatgagcggaactcaagcggaacggcgtttggcgtaaaggcgccgctgagcttgtggagcgctgtttttgaagccggcggcaccaaggctgtcgggatgattgagaaaggcccggcgtcaggcaaagcgttcatcacggaacacaaatgcggaaaaggcaaaatcgtcatgctcgggtcgatgccggcaggcgaagcgggggacatcatgatgaaaaagctgatcagccattatgccgaagaagcgggcgttgagcagaaaaccgatgtcactcccggaacagtcgtcgcgccccggaaaggagcagacggtcttgtctgggtcgtgatcaatatggacggcaaaggaggcgcagtgacacttgacggcaacggaaccgatcttttatccggcaggcccgtaaccggacgcgtaacactcggcccgcacgactaccgcgtgattttgttatcagagaataaatga

SEQ ID NO: 781 - DNA, 618 bp, Bacillus licheniformis
gagaaagtgtttcatccaagtccttgcattgcttttcatcattgctgcatgtttcgcgccaaaccaagcctctgcacaaactcaaaaacctgttttttcagaagtgacggtacatgatccatcgattattaaagcgaatggcacgtactatgtcttcggctcccatttagcttcggccaaatcgacggacctgatgaattggacgcaaatttcctcgagtgtccacgacggcaatcctctgattccgaacgtctatgaagaattaaaagaaacctttgaatgggctgaatctgatacgttgtgggcacctgatgtcacccagcttgaggacggcaagttttatatgtattacaacgcctgccgcggggattctccgagatccgccctcgggcttgctgtcgcagacgacattgaaggtccatacaaaaataaaggcatttttctgaagtcgggaatggatgggatcagcaatgacgggacgccttatgacgcgacaaagcacccaaatgtcgtcgatccccacacattctttgatcaaaacggaaagctgtggatggtgtacggctcctattccggcggaatttttattttagaaatggacaagaaaaccggatttcc

SEQ ID NO: 782 - DNA, 626 bp, Bacillus licheniformis
gtggaattacagttagcattagatttagtcaatataccggaagcaatcaaagtggtaaaagaagtagaagaatacattgacattgtagaaatcggtacgccggttgtgataaatgaaggccttcgtgcagtaaaagagatgaaagatgctttcccgaatttgaaagtgctggcagaccttaaaattatggatgcggccgggtatgaagtaatgaaagcctcagaagcaggagccgatatcatcaccattttaggagccgctgaagatatgtctattaaaggcgctgtagaagaggcaaaagctcaaggaaaaaaaatcctggtggatatgattggaattaaggacatcgaatcacgcgctgccgagttggatgtacttggtgtggattatatttgtgtgcatacgggttatgatcttcaagccattggccaaaattcatttgcagacttaatgaccattaagaatgtagtaaaaaacgctaaaacggctattgcaggcggaattaaattggacacattgcccgaagtcgttaaattaaagcccgatttgattattgttgggggcggtattgcaaatcaagatgataaagctgcggcagccgcaaaaatgaagcagatgatccagca

SEQ ID NO: 783 - DNA, 774 bp, Bacillus licheniformis
tggggatcgcgatgtcgttcatttggctgaaaacgatttacgaaccgaaaaaacacccgagaataaacgccgccgaactggcgtacatcgaagaaggcggcgcgcttgtctcgatggatgagggaaagaacgcggaaaaaaaagaaaaggagtcgcaatggccttatattaagcagcttttaagaagccggatgctgctcggggtgtatatcgctcaatactgcatcacaacgctgacctatttctttctgacatggtttccggtctatcttgttcaggcgcgcggcatgtcgatccttgaagcgggttttgtcgcatcgcttcctgcaatctgcggatttttaggaggattgctgggcgggttcgtgtcagacttccttttgaaaaagggctgctccataacggttgccagaaaaacgccgatcatcctcggcatgctgatgtcctgctcaatgatcatatgcaactatgcagattcgtcctggctggtcgtttccatcatgtcgcttgcctttttcggaaaaggattcggcgcgctgggctgggcggttgtgtcagatacctcgccaaaggagtgtgccggcttgagcggcggcatcttcaacacctttggaaacattgcgtccatcacgacgcccatcatcatcggatatatcgtgaatgcgacaggctcatttaacggagcgcttgtgtttgtcggagccaacgcgattgccgcggtattaagctatttgtttctcgtcgggccgatcaagcgcatcgaactgcagaaag

SEQ ID NO: 784 - DNA, 629 bp, Bacillus licheniformis
atgctgttttttattgatactgcaaatttagacgaaattaaagaggcgcacgctctcggcgtgcttgcgggagttacgacaaatcctagtttagtagcaaaagaaaacatttcgtttcatgaccgtctgcgtgaaattaccgaagtggtttctgggtcagtcagcgccgaggttatttctctgaaggctgaagagatgattgaagaaggaaaagagcttgcgaaaatcgcgccgaatattacggtgaaaattccgatgacgcctgacggcctgaaagctgttaaagcattaaccgatctcggaattaaaacgaacgtcacactgatcttcagcgcaaatcaggcgcttcttgccgcaagagcaggagctacgtatgtttccccgttcctgggacgccttgacgatatcggccacaacggcctcgacttgatcagtgaaattaaacaaattttcgatgtgcacggtttggacacgcaaatcatcgccgcgtccatccgccatgcgcagcatgtgactgaggccgcgctcaggggagctcatatcggcacgatgcctctcaaagtcattcaccagcttacaaagcacccgcttactgataaagggatcgaacagtttttggctgactggaa

SEQ ID NO: 785 - DNA, 983 bp, Bacillus licheniformis
atgatgacaaaaacaaaaggatttccaaaagattttttatggggcggtgcgattgccgcaaaccaagcagaaggagcctggaatgttgatggaaaaggaccgtctgttgctgatattgccatgtaccgttcgaatttgagtgttgaagattacgaaggacatcttgctgtttcttctgaaaacattgaacgcgcaatgaaagacccggacgtaaaaaaatatccgaagcgcagagggattgacttttatcatcactataaagaagatgtggctctctttgcagaaatgggttttaaaacattgcgtatatcgattgcatggagccgaattttcccgacaggagaagaagcagagcctagcgagaaaggccttcagttttatgatcgtctgtttcaagaaatgaaaaaacataacattgaaccgatcgtgactctgtcacattatgaaatgccattagcacttagtctgaaatacaacggatgggttgaaagaaaagtgatcgacctctttgtgaaatttgccaatgtgtgttttgaacgctataaagatgtcgtaaaatactggcttacctttaatgaaattgacagtatacatcgccattctttcattacagcgggaatcattcctgatcgctgtcctgaagggaaagtagaagaaacggtttatcaagcattgcaccatcaatttgtggcatccgctcttgtgactgcagattgtcatcgcatcattcccggcagtcaggtgggatgtatgctaacgaaactcacgacatacccgcacacttgccatccgagtgatgttgaacgcgcactgaagcaaaaccttgataactatttctatgcagatgttcaagtgtttggcgaatatccgccattgatcaaacgcatgctggaacgaaaaaatatcaatattaagatggaagcggacgatcttgccattataaaagaacatacggtagacttcgtttcgtttagctactatat

SEQ ID NO: 786 - DNA, 694 bp, Bacillus licheniformis
gtgctggaatctttgaaagaacaagtattaaaagcgaatttgcagcttgaagaataccggcttgtcacctttacatggggaaatgtcagcggtattgaccgggagaataagctggtcgtcatcaagccgagcggtgtcaaatacagcgatttgaaagccgaagatttagtggttctgaatatggacggcgagattgtggaaggggatctgaagccatcttccgatacgccgacacacctctatctttaccggcagtttcaatcgatcggcgggatcgtccatacgcattccccgtgggcgacaagctgggctcagtcagggaaggacattccgtcgctcggaacgactcatgccgactactaccacggcgacattccgtgtacacgggaaatggatcccgatgaaatcaggagtcaatacgagctgaatacaggaaaagtgattgtagagacgttccggcatcttgaccccctggcggtgcccgccgttctcgtgaacaatcacgggccgttttgctggggaaaagacgccttaactgccgtacacaatgccgtcgtcctggaagaagtcgccaagatggcgtaccgctccctgatgctgaatccgtctcttaagcggattaagagcgctttgcaggataagcattattttcgaaagcacggggcagacgcctattacggccaatagaggaggg

SEQ ID NO: 787 - DNA, 842 bp, Bacillus licheniformis
ctgacaaatacgaaaaaaatgctgctggacgcacaggcaaacggctatgcggtgccggcttttaacattcataactttgaacccgtgcaggccgtgacagaagcggctgaagccttaaggtcccccgtgattcttgcggctactccaggaaccttcagctatgcagggcgcgactatattcaagccattgcagaaacggccgcggcgcgctgctcgatcccggtcgccctccatctagatcatcatgaagaaattgatgatattcgcgagtctttatcattggggacgaaatctgtcatgattgatgcttcgcaccatccatttgccgagaataccgcaattacggcgagtgtcgttcaatatgcccggcaaaaagatgccactgtagaagccgagcttggaaggctcggcggacaggaagacgatttgatcgtggatgaagccgacgcttattataccgatccggatgcagcaaaagagttcgtcgagaaaaccggaatcgattcgctggcggtggcaatcggtacagcccacggtctttactcaaaagagcccaatatcgattttgagaggctggccgcgattcaaaaacgggtttcagtcccgctcgtcctgcacggcgcctcaggaatttcagagcaagatgttagaaagtgcatcaagctaggctgtgcaaaagtaaatatcgcgactgaattaaaaattcctttttcagataaactgcgccgatatttgcatgaacacgccgatgcaagcgatccaagaaaatatatggcccccgccaaagaagccatgaaaaaaatcgtccaagaaaagattttgatgtgcatgagcaatgacag

SEQ ID NO: 788 - DNA, 896 bp, Bacillus licheniformis
atgatatacactgtaactctcaacccatcggtcgactatattgttcacgttgaagaattttctgtaggcgggctgaatcgttcagtctatgacacgaaatatcccggaggcaaaggaatcaatgtctcacgcgtactgaacagacaccatgtaccttcaaaagttctcggttttatcggcggttttaccgggggatatatcaaatcatttctcgaagaagagaagcttgaaacggcttttcatgaggtgaatggcgacacgcgcatcaatgtcaaattgaagaccggggatgagacggaaatcaacgggcaggggccggtcatcagcgaagaagatttcgcggcctttttagaccagttttcagcgatgaaagaaggggacattgttgtactggcgggcagcattccttcatcattgccgcaggacacatatgaaaagattgcggaaaaatgcaaagagcaaaatgtccgggttgtcgttgatatttcgggtgaggcccttttaaaagcagcagaaatgaagccgcttttaatgaaaccgaaccatcacgagctcggagaaatgtttggaacaactatcacctcggccgaagaagcggtgccttacggaaagaaactcgttgaacgcggggctgaaaacgcgatcgtttccatggctggagaaggcgcacttttatgtacaaaagacggtgtctaccatgccaacgtacctaaaggaaagctcgtaaactcagtcggtgcgggggattcagtggttgcaggctttctcgcaggcattgaaaaacagcttggcatcaaagaagcttttcgcttaggagtcgcttcaggaagcgcaactgccttttcagaggagctgggaacggaagagctcgttcacaagctgcttccggaagttca

SEQ ID NO: 789 - DNA, 490 bp, Bacillus licheniformis
ttgatcaatgagattatcgcctacttcggcggagaaaagatcaattttttgctgaatgaaagctggttcaggccgatgtacattcttcaggtcatctggagggaagccggctggtcgacgatcatctatttggcggcgattacagctgtcgatccgcagctttacgaagcggcgaaaatggacggggccaatcgcctgaggaggatgtggcatgtcacacttcccgcgatcagaagcgtcatcgtcgttttgctgatcttgaaaatcggcgatacgctcgaactcggctttgagcatgtgtatctgcttttgaatgcaacgaaccgcgaagtggccgaaatctttgatacgtatgtatacacggccgggttaaagcagggacagttcagctacagtacagccgtcggtttatttaaagcagctgtcggtctcattcttgtcgtatttgcaaacaggatggcgaagaaatttggagaagaagggatatatt

SEQ ID NO: 790 - DNA, 1188 bp, Bacillus licheniformis
taaaagagtcattatcataatattagacagcttaggtgtcggttatatggaagatgcaagcgattatcatccttcagatgttggcgccaatactttctatcacatacttgatacggtgccctctttaaacattccgaatctcgaaaaattgggtattaataaaatattgcaccatcctaaattgaaaaaaacagatcatattgccagctatggtgttttaaacctgatgcatcaaggagcggacagttttgaaggacataatgaaatcatgggaacaaagcctaaaaagacatatttagctccttttgcggaacatctcaatcatgttaaactcgctttggaagatcaaggttataaagttaacataccgaattcagatttgccgtatctattggtaaacgatttagtggtcgtggctgataatatcgaaacagattacgggcaaatttataatgtaagcgctccgctggattatattccgtttgatgaagtattgaaaataggaagatgcgtccgtcatcatgttaaagtaaatcgcgtgattgttcttggaggagaaaacgtaacacctgaacacttgcagagatcggttgaaagaagagaagacggattaataggggtgaattcgcctaaatctaacgtatacaagcaaggatatcaagttcgtcacttaggatttggtatctctcccgaaaatcagttgccgacattggcgagaaataggggaatggaagtctctcttatcggaaaaatgcaggacatcatttattgtgaaggtgcaaatagatttccaggtgtagatacagaacaagtcatgaaggatattattcaggagatggaccgcgtcaaaaaaggcttgattgctgccacagtacaagaaaccgatttggccggacatgcacagaatcccgtccgttatgcgaatcggattgaaatggtagatcgatatttgccggaaattctccggaaaatgacagatcaggatctgctgatgattagtgcagatcacgggaatgatcccacgatcggccacaaccaacacacacgggaaaaaacatatttgctggcttatcacaaaaaattatcgcctgttcacatcggggaaagaaaaacgctatccgacattgctgcaacttctgctgattatctagggcttcgcaatactgaaaacggcagttcattccttca

SEQ ID NO: 791 - DNA, 1071 bp, Bacillus licheniformis
aaacgtggaagattcccgacgattttattctcggcgcagcagcgtcggcgtggcagacagaggggtgggacgggaagcggccgacacaggattcctatttggatatgtggtacaaaaatgatcctgatgtatggcatgacggatacggaccggctgtggcaaccgatttttataaccgctacaaagaagatattcaatatatgaaagacatcgggctaacccactaccggacatccattaactggtcgcggtttcttttggattatgaaaccgccgaagttgacgaggtgtatgcaggctacattgatgacgtcatcgatgagctgaagagatgcggagtagaaccgatgctttgtcttgagcactacgaaatcccgactgtcctgctggaacagtatggcggatggggatcaaaacacgtggttggcttatttgcggcttatgcagaaaaagcgtttgaacggtatggggacagggtgaaatactggtttacctttaatgaaccgatcgtgccgcaaacacggatctaccttgacgcacttcgctatccgtacgagcagaacacgaaaaaatggatgcagtggaactaccataaagcactggcgacagcaaaggccgtggcaattttccggaaaaggaagcccagttttagagaaggcgcaaaaatcggcgtcatcttaaatcctgaggtcgcgtatgcgaggtcaagcgcgccccatgatcagaaagcggcccaagtttatgatttgttttttaacagggtttttttagatccgagcataaaaggcgtctatcccgatgaattgatggagctcatggccaaacacgacatcctttttgaccatgatgaagaagagctttccgtcatcaagcggaatacggtcgattttgtcggtgtgaacctgtattatccgaagagagttcaagcgccttcaaggcaatggaatgaatcgacgccttttcatcctgcttattactatgagccctttgagctgccaggcagaaagatgaatccgttcagaggctgggagatctgcccgcgcattgtgtacgatatggctatgagactta

SEQ ID NO: 792 - DNA, 694 bp, Bacillus licheniformis
gtgttagaacaactgaaagaagaagtattacaagcgaatttggacatgcctaaatacggactcgtgaaatacacatggggaaatgcaagtgccattgaccgtgaaacaggtctattcgttatcaaaccgagcggtgttgattatgaaacgatgaaagctagtgatatggtggttgttgatttagatggcaatgttgttgaaggagagctgaggccttcatcagatacagcgactcacgcagtgctttataagcgctaccctgaaattggaggaattgtacacactcattcaacttgggcgacaatctgggctcaagcaggccttgatgttccagcgatggggaccactcatgcagacacattctatggttccgtaccatgtgcccgttacttgacacaagaggagattgatcgcggttacgaagcagaaacaggtcatgtgattatcgaaacatttgaggagcgagggttagatattttagctgttcccggtgtcttacttcacggtcatggtccatttacttggggcaaagatgtaaaatcagccgtattgaatagtgtggtgttggaggaagttgcgaaaatgaatttatttacaagagaattaaatctttttgcagaagaattaccacaacgtattttagataaacattacttacgaaaacacggtaaaaatgcttattatgggcaaaagt

SEQ ID NO: 793 - DNA, 438 bp, Bacillus licheniformis
tcatatttaatcttcccacccgcttcccgggacggggcgaggagcacgaagtccgcgtccaccaattgctgatgaacaaacaaggctggccggttgtcgcccctcaccgctatgccggagagaagcttgaaaaggtgaaaaagtcagatgtgattggcgattacgaattggtgaggcacggcaaagacatctccgcagatattaaagaatcgaaagaaatccgcttgaatcaaaatggcaaaataacaggcgcagtagccggaacgtggaagaacacggggcataacaaaatagaactcaagatcgacggaaaaacctacgatggcgtgtttttgcgtcagtgggatgcggcttctgagcgtaaggtgatgacgtttagtgcgttgtctcgtgagggagatgcggtttgggggagtagtttaaaaagagcggaatttt

SEQ ID NO: 794 - DNA, 1005 bp, Bacillus licheniformis
gtgcatgcacggaaggccgggattttgatgctgaatatgaagcgacaagcgcgaaagaaggcggaagcggcgccgaagtcatcgcagatcgcctggatgtgccttggacgatcgctcatactggcgagaccttttacattacggaaagaaacgggggaattgtgtccattgctgacggcaaaaaggagcgcatgcagcttcagctgaaaaagcccgttcatcaagaaggggagggcgggctgctcggatttgtactccatccggattttagaaacagtcaggaggcgtacgtttatcatacatacaaagacgggagccatctgaaaaaccggatcgtaaaattgacgcttgaccgcctcacttggacagaaacggatgaactgcttgccgatttgcctggaggcgcgattcataacggcggccggatggcgatcgggcccgatcaaaagctgtacatcacgacaggcgatgcaggggaaagggaatgggcccagcagcctgaaaagatggcgggtgtgattctaaggatggagcttgatggtacgataccggctgatcagccctttagctcgtcttatgtatacagtttcgggcaccggaatccgcaaggcctcgcatggatcggccgacagctttacagctccgaacacgggcagtctggacatgatgaagtaaataaaatagaacccggagccaattatggctggccggtgattgaagaaagcgatgagaagcagggaatgaaggcgccgctcatacattcgggagaaaaaacgcgggcgccatccggtttagcacagaaaggggacgtcctctatatggccgggctgcggggagagggtgttttccaggtcgatccggcggaagccaaagtagtcaagtggcttggcggatacggcagaatcagagatgtgaaagtgatcggcgatgatctgtatttcattacgaacaatggcgacggaagaggcgaaaaaaaacagacagacgatcggctcatccgcgtac

SEQ ID NO: 795 - DNA, 572 bp, Bacillus licheniformis
atgtattatgttcctcatatgtatccatatcaatattcttatccttattatgttaatgtgccaatgtacaactgtagaagacagtcagttcaccggactgttcctagtgaagtagagcatgcaaacaaattaagttctgttcgctcatccaaaggtagtaacagcattttgttaaaggattatggaccagaagcgtttgtggttaatatcaatgaagctacgaagcaaaataatacgtaccgtaccgctttatggacaggaactcatttgcaagtcaccttaatgagtctcaatgttggagaagatattggtttggaaatgcaccctaacgttgatcaattcttacgtgttgaacaaggtcagggaatcgttcaaatgggcaagaataaagaccatttaaatttcaaaagaaatgtctatgatgattctgcaatcataatacccgctggaacatggcacaatctaaccaatacaggtagaatcccgctaaaactatactccatatatgctcctcctaaccatccatttggtactgttcatgttactaaaggagatgcattagcttcagaaga

SEQ ID NO: 796 - DNA, 912 bp, Bacillus licheniformis
gcttgaagtcaaagaagggggagtttttctccctccttggtccgagcggctgcggaaagtcaacgctcctgaatattattgccgggttccttgaaccgacgtcaggttttgtatatataggaggacgagatgtaactgatttgccgccatacgaccgacatatcggaatggtttttcaggattatgctttattcccgcatctcagcgtttttgacaatgttgcatacggcttgaaagtccgaaaatggccccgccgcaagattgaagaacgggtgatggaatgcctcgctcttgtcaggcttgaagcgtttgctaatcgcatgccccatcagctgagcgggggtcagcagcagcgggtggcgattgcccgggcattggccgttcagccgtctgtgcttttgctagacgagccgctgagcaacctggatgcgaaacttcgaaaagaaatgcagacggagctgcgcagcatccaaaagcgcgtcggcattacaacgattttagtgacgcacgaccaggaggaggctttaagcttatcggacaggattggaattctcggatgcgggaggcttcagcagctcggcactccgttggacgtgtaccgcacgcctgccaatcaatttgtggccgaatttatcggacaggtcaatttactgaaagcgcgtgcgtcgaagatacagccttcatcgggcggctatggatacgaaacggtcgatttcgaagtgtatgaaggcgttccgctgacatttgaaatcaaccaggaactctcaaaaaaaacttctgtattgttcatggtgcggcctgagaggatctcagtctccttcgagaagcaaaagaacaggctgattgaaatgcctgcaacaattaccgaagtcagttacgccgggcatgatctcaggctgaaagccgctgttt

SEQ ID NO: 797 - DNA, 483 bp, Bacillus licheniformis
cgaaaaagcatcaagtgaaagtgtctttgagcttgactatcgtccatatacgtggacatctgcgaaggaacgggccgtctactatacgcttgttgccgaacaatcagacattgtcatcgggacgcgtgatgagtttgatgtaatggaaaataagagcggcggcagcaatgaagaatctgttcagcatttatttgcacattccgcagatcttgtcgttatcaagcacggtgtcgaaggttcatatgcatacagcaaatccggggacgtcttccgggcgaaagcgtacaaaacgaaggtcttgaaaacgtttggagcgggcgattcatacgcctccgccttcctctacggactcgtttcaggcaaagatattgaaaccgcgctgaaatacggaagcgcttccgcctcgattgttgtttcaaagcacagctcatctgaagcgatgccgacagtcgccgagattgaagagcttattgcggctcagtc

SEQ ID NO: 798 - DNA, 603 bp, Bacillus licheniformis
tcccgctgttgggatatttttgacgggaatcattatgcaatatgttgtcaatacgcctgtcaagtacattatggacggcatgacacattggcttgaaggtcttggaacagaaacccttgtcgtaatgggtattgttttaggcggtatgatggcgattgatatgggcggtccgatcaacaaagcggcctttacattcggtatcgcaatgattgaagctggaaactttgggcctcacgcagccatcatggcaggcggtatggtgcctccgcttggaattgcccttgcaacgactttctttaaaaataaattctcaaaacgggatcgcgaagccggaattaccaactacgtgatgggcttgtcatttattactgaaggtgcgattccttttgcggcagcagatccggcacgcgtcattcctgcttgtatcatcgggtcagcagttgccggcggtctgtctcaatttttccatgtcacactgcaagcgccgcatggcggaatattcgttctcttctttacgacgaatcatgcgctgctgtatctcctcagcatcttgatcggtgcggttgtgacagctttgattctcggcgttttgaaaaagccggt

SEQ ID NO: 799 - DNA, 1353 bp, Bacillus licheniformis
cgcgatcggcgggagagaagaacgttgtatcgctagtccattgcgcgacaaggctccgcttcaaactgaaagaccgttccaaagcagacagagaagcgcttgaaaatacggatggcgtggtaaccgtggtggagagcggcgggcaatttcaagtcgttatcggcaataacgttcctgaagtatataaagaaatcggccggatctctcaactgttggaaagttctgcggccgatcacagtcaaaaagagaaaggaagcctcgccggtagattagtagatgtcgtatccagcattttcactccgctgctcggcgtcatggcgggagcggggattttaaaaggcctgcttttgatttgcacaaacgccggctggctctcgccggaagagacgacatatacgattctatacgcggcagccgacagcctgttttatttcctgcctttgctgctcgccgttacggccgccaaaaaattcggagcgaacccgttcatagcgctgacgattgccggagcgctgatctatccgacgatactcgaactgaaaaacagcggcgcccatacggagtttttcggcattccggtcgtcttgatgaattatacgtcgaccgttatcccgattatccttgcggtatttgtgatgagctatcttgaaagattatgtatgcgctttattcatgaaagcgtgaagaactttatcacccctttattatgcctgacggtgatggtgccgttaactttgatcgtattcggaccgctcggcgtttacacaggaaacgggatcgcggcggcgattctgtccgtttttgatttcagcccgattctggcaggagcgattattgcggccttatggcaaatccttgtcatcttcgggattcactgggggatcgtccctgtcattttgaacaacattgccgtccacggcaaggactacattaagccggcgacggcagccgccgtgtttgcccaaacaggagccgcatttggcgtcatgctgaagacgaaaaacaagaagctgaaagcattggcaggatcagctgccgttaccgggatattcgggattacagagccggccgtctacggggtgacgctcaggctgaaaaagccgtttgtatgcggtgtcatcagcgcggcggcaggcggagccattatcggatactccggcagcgtcgccctcgcttccggcgctccgggcttgttgacgattccgattttttacggaccgggctttctcggcttcatcatcggcatttcagtttcatttgttttatcgattttgctcacttacattgtcggctttgacgaccctgtggaggtgacaaaagaggagcctgttgaaaaaagcgccggtgaaccga

SEQ ID NO: 800 - DNA, 492 bp, Bacillus licheniformis
atgaaaatcgttttgggcagaattgatgaccgctttattcacggccaagtattaacaagatggatcaaaatccacgctgctgatcgcattatcgttgtctccaatgaggtggcacaggacgaaatgagaaaaacgctgatcctttctgttgcaccttcaaatgtaaaagccagcgccgtttcgatttccaaaatggccaaagcgttccacagtccgcggtacgaagatacgacggcaatgctgttattcgaaaatccgggcgacattgtttccttaatcgaagcaggcgttccgatcgaaatagtcaatgtcggcgggatgcgtttcgagaataaccgcaggcaaatcacgaaatcggtaagcgttactgaaaaggacatcaaatcgttcgaacaattgcatgaattgggcgtgaagctggaactgaggcagctgccgtcagattcgagcgaagactttatgcagatgttaagaaacgcaacaaaatcctag

SEQ ID NO: 801 - DNA, 566 bp, Bacillus licheniformis
atgactgcgatttgtttgatccggcacggcgagacggactggaatgctttaggaaaactgcagggaagaacagatatccctttaaatgaaaccggtaaaaaacaagcaaaagaaaccggggcgtttttgaaagggtccgactgggacgtcatcattacaagccctttaagaagagcgaaagaaaccgctgaaatcatcaatcaatacctcggacttgaaatcatcgaaatggaggatttcatcgagaggaattacggagatgcagaaggaatgccattcgaagaaagaatgaggctctatcctgataaagaatatccgaatcaggaatcaaaagaagcgcttgccgaacggctgatggccggcgttcaaaaggtcagtgagcggtatccggacaaaaaagtgctgatcgtcgcacacggagccgcgatacacgcgcttctgtcaaaaatctcaaacggcgacatcaacctggaaaacacgaagctcgtcaatgcctgcctaagcaacatcaaatttcatgaaaataaatggcatgtgaaggattacaacctttcacaccatttgtc

SEQ ID NO: 802 - DNA, 722 bp, Bacillus licheniformis
atgaagatcattgaagctaaagattatcaggacatgagccaatcagccgcccgattcatcatcgagcaagtgaatcgcttatctgcacctgttctcggccttgcaaccggaggaacgcctctcggcacatatcaggttttaagggaagatcatgcgcgtaataaaacgacttacaagcacgtctatactgttaacttagacgagtatgtcggcgtttccccggatcatgaaaacagctatacattctatatgaaaaaacagcttttcgatcacattgacatcccgctcagccacacccatcttccgaacgggatggcttgtgaccaggatgccgaatgcagccgctatgaagcgctgatcgagcggcttggaggcattgatcttcaagtgctcggcctcggcttgaacggccacatcggatttaacgagccgggcaccccattttcatcgaaaacgcatacggttgaactgacacaatcaacgaaagaagccaatgcccgctattttgattcctatgacgccgtcccgtcgcaagcaataacgatgggcatttccacgatcatgaaaagcaagcagatcctgctgctcgtttcaggagagaaaaaagccggcatcttggcgaagctgctcactgaagaaccaaatgaagacacccccgcttccgtcttaaaaacgcaccaagacgtcgtcatcatagcggacagcgatgctttatcaatcgt

SEQ ID NO: 803 - DNA, 763 bp, Bacillus licheniformis
ttgatcagccatgtgtttgacgagctccccttcggcgaatatgaggcccctgctcatggcaaaggagcgtgggcgccgagcattcgataccataacggagaattctgggtgtatttcgcaacgcctgatgaaggaatcttcatgagcaaaacatcagatccgtttaaaggatgggagcctctcatacaggtcaaaaagacaaagggctggattgatccttgtccattttgggatgacgatggaaatgcctatctgatccatgcttacgcaaacagcagaatcgggatcaagagcaagctgaatctttgccgaatgaaaaaagacggaacggctttggaagacgatggagaaatcgtctttgacggcacgctgaaccaccctacgattgaaggaccgaaattgtataaaaaagacggctattattatatctttgctccggcgggaggggtgaagacaggctggcagacggttttgcggagcaagcagatttacggtccctatgaagacaaggttgtccttcaccaaggaaatacggtcattaacggtccgcaccagggaggctgggttgaacttgattccggagagtcatggtttatccactttcaagatcgcggagcattcggcagagttgtgcaacttcaacctgtccgctggttcgacggctggccgctgatgggtgaagacataaacggcgacgggatcggagaaccggttttgcattgggaaaagccgaagacgggcgccaaagaagtgaaactgcctt

SEQ ID NO: 804 - DNA, 1144 bp, Bacillus licheniformis
gtgcaatactttgattttttatccgcctctcaaaaagaagatgtctttttcaaactgccgggtacggttacaaaggactctccgaagcgcattctcgagtatgcgcttggagctgcgctctatgttccggggaaccgaaaagatatagcagatgtcatcatcaataacaagtatccagaactgtgctcggtcgttttttgccttgaagattcgatcggcgattgtgaggttctacaggctgaaaacaatcttgtcagtcaggccgatatgatttatcaggcgcaaaaactgcagaacatcaacagcgatgtgctgccgctgatgtttatccgagtgcgggaacctgagcagatgctcgaattgggcaacaagctcggccgcgcgcttcacttgtttgccggattcgtatttccgaagttttcgatgttgaatgcagagcactaccttgatactttaacgaagctgtcgcaagaatccggcattgtgctatacggaatgccgatctttgagacacctgatctgctggcgatggaaacgagggcaaaggcgctgcaggaattaaaatcaacgcttggcttttatcaggatatcattctgaatatcagaatcggggcgactgatttgtgcggtctctacggcttaagaagaaaaccggaaacgccgatttacgacattttggtcatctctgatttcatcaaagatatcgtcaattatttcggcttgcaattcgtgatttcggggcctgtctgggagtactttggagatgcttcgcgaacggttccgccttttgcgccgaattgggctgaggcgggggaatcttcgcttgtgatcaatcggtatatggacggattgatcaatgaaacgcttcttgacctggccaacggcattcacggaaaaagcgtgattcatccgtcacaaataaaagcggtccaaagcctgcatgttatatcaatggaggattatctggatgccttaagcatcgtcgaaagtgccgacggcacccgcggcgttgtaaaaagttctttctcaaataaaatgatcgaaatcaagccgtaccttagctgggccaaaaaaatattattaaaggctgaaatctacggggtatatcatgaaaaccgcagctatacggatatacttagagcgt

SEQ ID NO: 805 - DNA, 970 bp, Bacillus licheniformis
atgtcttgcactgttcagaaaagccggtttttacatgaggaagcgatacggtttgaaaatgatgatttagaggcagtacttgtgcccgggtggggaagcaatttgatttcattgaggtggaaggcgggcggtttgaatttgttgaaaacgcctgaaacaaaggaagaatatgacgcgaatccgtttttattcggaatccctgttctttttcctcccaaccggatcgatcacgggagatttacatatgcgggaagaacatacgagctgccgatcaatgaaaagccgctcgaaaaccacctgcacggatttctttacgataaaaagtggacggtaaaaaaaatggaggcaacagaagagcggatcatcgtgcagacgatgctggactctgatgatcatccgggcatcaaatcgatcttccctcactctttttccatcaccatcacctacacattagaaggacagcatctgaaaattgatgcgtcggctgtcaaccgcggtcaagatccgatgccgatcggattggggtatcacacatctttccgctatcctttaaacgaatcaggggataaagaaaagtgcctgtttactcttcctgcctcaaagcattggacgctgacagaccgcatgctgccgactggcgagtatcgggtgacagaggagttcaaagcgggaaaaatggcagcgggtgaaaggcttgatgatatattggcggctgagcaagaccaagaaggaaacagcaccgccgtcattgcggacagcctcgccggcattcgcgtacgctatcaatgcgacggccattttaagcactgggttgtgtttaacggtacatctgatcaggatgatctgctttgtattgagccatacacttggatgacgaatgcaccgaacgtgaaccttccgaagagtgtgaccggatttcgggatttggggccgcaggaagagctgacgatgcgaagcaaaattgaggtag

SEQ ID NO: 806 - DNA, 726 bp, Bacillus licheniformis
taccggcagatgctgatgccgcggcggagatcgtgaaaaaggcgcacagcgccggtgtaaaagtgatttcgtatgaccggctgattcgaaacgcggatgttgattattacgtttcatttgataacgaaaaggtcggggaactgcaggcgcaagcgattgtaaaaaaagcgaagaaaggaaacttcgtatatatcggcggatcgtctcttgacaacaatgcggtcttattccggaacggcgccatgaaagtgctcgaaccgttgaagcggcagggtaaagtcaagctcgtgcttgacgaatatacgaaagactggctaccagaagaagcgaaaaagaacatgaaaaaagcattgaacaagacgagagatatcgacgccgtgatcgccgccaatgacggtacggctggcggggtgatcgaggcgcttcaggaggcgggcctggccgggaaaattccggtgtccggacaggacgcggaaattcaaggcgtccgacgaattgtgaacggtacgcagacgatgaccgtttacaaaccgattcccgcgcttgccaaaaaaagcgctgaaatggctgttcaagcggcgaaaggcgaagcgattcaaaccgatacaaccgtcgaaaacggcaaagccaaagtaccggcgattttacttgagccgtatgccgttacgaaaggcaatatcaatgagactgtgatcaaagacggccatctgtccaaaaaagatatta

SEQ ID NO: 807 - DNA, 1302 bp, Bacillus licheniformis
gaacgtggagcggtttttggttcccgttgctgcaaaattgaattcacagcgccatatatgtgcgatcagagatgcttttattctatcatttccgattattatggcaggatcgattatcattttattgaattttgccattttatctccggacgggtttatcgccaaaattttatttcttgaaaagatatttccgaacttggctgattaccagtcggtctttacgcccgtactgcgggggtcgctcgatattatgtccatatttgtcgtgtttctcgtcgcccgcaatttagccatctcaatgaaagcggatgaactgcttgccggattaacggctgtatcctgttattttatcatttattcaccgtaccgcctgatcgaaaacgagagctttttaacgacgaaatggctcggcgcccaaggactgttcgtcgccttaatcatcggaatcatcgtcggtgaagtgttcagcaggctatcaaatgccaagcgactgcaaattcatatgcctccgcaggtgccgcctgcggtcgcccggacatttaaagtgctgtttccgatcatcttcattacgattggttttgcgatattaagctttgcgctgatgtccctgtcgaaaaacggtctgcatgaattggtgtatactgtgctgcaggcgccgttgagagagatgggaacgaatattttcaccgttgtttttcttggaatcgtcgccaactttttatggctgttcggcattcacggtccgaatacgattgcggcgatcagagaaacgatttttgcagaagcaaaccttgaaaacctcggttttgccgctaaaacaggctctgcatggaacgctccgtttcctgaaacatgggcgctgaatgacgcctttgcgaactacgggggatcaggcatgacgctggggcttttgatcgcgatattcatcgcttcaaagcggcgggattataaagatatcggcaagctttcgatcgggccgggaatatttaatatcaatgaacctgtcattttcggacttccggtcgtgctcaatccaatcttcatgattccctttattatcgttccggcagtcaatactgtcatcggctatttgttcatcaagtttcagctgattccgccgatcgcatacgctgttccgtggacaacgccagggccgttgattccgtttctcgggaccggaggaaactggcttgcgctcggcgtcggctttctctgcctcgccatttcaacgatgatttatctgccgtttgtgatggctgccaacaagactgtgaatacggacagggagcattccgcggaaaa

SEQ ID NO: 808 - DNA, 1332 bp, Bacillus licheniformis
atgaaccgggtagaagaagtgacagattgggctttggaaagagagttttacgtcgtgttaaatattcaccacgattcttggctatggatcagccggatgggaaacagccagcaggagacattagataagctggggaaagtctggaagcagattgccgagcgcttcaaaaacaaaagtgaacgcctcctgtttgaaattgtcaatgagccgaccggaatgagcgcatatcaaatgaatctgcttaaccgagagatgctgaacatcatccgttcgaccggcggcaaaaacggccagcggctcgtaatcgtcggggggcttgaagataacaaagatgaattgcttcattcatttgaaccgcctgatgatgaccggattgtcctcacatatcactactattctccttgggattacgtatcaaactggtggggccggacgacttggggatcggcagccgaaatctccgagatggaggaggatatcaaaccggtttatgaaaaatttgtaagggaaggatacccggttatcatcggtgaatacggtaccctcggcgccaatgaaaagcattcaaaatggctctatcatgatacgtttgtccgccttgcccacaaatatcaaatggtcccgatgtggtgggacaacgggaatgaccagtttgaccgggctgagagacagtggcgtgatcctgttgttaaagagattgtcattcaggcgggacgcggcgttcccaatgcgatcatcaaaccggcagatctttttatcaaaaaaggtcaaagcatcagcgatcagacggtggacattcagctgaacggcaatgtgctgactggcatttatcagaaatctgaaccattaaaggaaggcagtgattatacagttgacaatgccggaaaaacggtctctattaaggcatcctgcttggcaaagctgctgaacggggcggggcagcctggggtaaaagcgcagctcacttttacgtttcataaaggagccagccaggttatggatatcattctttatgatgacccgaagcttgaaaaaagcgaattcaccatcagtcaatcggcaatcagcggtgatctcaaaatcccggcgtcactgaacggaacgaagctggccacggttaaaggagtcgtcgattctacaggaaggccggttcttgaagaagtatggtcatggacgccctacttgaactatgacgaagatttttacgaaaaagacggggatttgtatttgaaagagcgggttttaaagtatttgaaaagcgattccacctttacatttgaactgtggccgaaaggcgtggaggcggtcgtgaaggtgaaaatcacgccttga

SEQ ID NO: 809 - DNA, 510 bp, Bacillus licheniformis
gcggtgattgggacaacctgttaaggcggatcaaaatcaaaccgggcgatttttattatgtgccaagcggcacgattcacgctctttgcgaggggacggtcgttttggagacacagcagagctccgatacgacgtacagggtatatgattatgaccggaccgatcaaaacggagaaaagcgcgaacttcacctgacacaggcgatcaatgtcacaacagtaccgcatgtagacagctatgttgacgaatcgacagaaactcaaaaaggcattaccattaagacatttgttgaagccgaatatttctccgtatataaatgggagatcgacggtgccgctgagctgacccaggatgcccctttcctcctgtgcagcgtgattgaaggagaaggaaagctcactcagggcggcgaattatttccgatcagcaaagggacaaattttatcctgccggcggaaaccaatgactttacaatagaaggaacatgtgaactaatcgtgtcacacatat

SEQ ID NO: 810 - DNA, 450 bp, Bacillus licheniformis
atgaaagtaatcattgcatcagatcacggcggaatcaatatcagaaaagaaattatggcattgatggacgaattgaacatcgaatacgaagattacggctgcgaatgcggttcaggatctgtggactacccggattatgcgtttccggtcgcgcaaaaagtggcgaacggggaagccgacagaggcattttaatatgcggaacaggaatcggcatgagcatttccgccaataaagtaaaaggcatccgctgcgcccttgtccacgacgttttcagcgccaaaatgacaagagagcacaatgacacgaatgttcttgcgatgggtgaacgggtcatcggccctggtttagcgagagagattgcaaaggtttggcttacgactgagttttcagccgggcggcacgccgtccgcatcggaaaaatcgccgattatgaagacaagcatgaataa

SEQ ID NO: 811 - DNA, 729 bp, Bacillus licheniformis
ggaaaaaggaaaatcgaccgctttcttgcaaaaatggacggattttttacatgtcatacgggtttaatggcgggatacggcgtatatgtattcggagctgaccggcacggattccggagacatcggtctgaacaacaagggagccgtagaggcggtggaatacgccgaaaaatggtttagtgaatattggccgaaaggcatgcaggacaatacgagcgcagacgattttatccagcagacctttatggacggaaaagcagcggctgttatcggaggtccttggtcggcttccaattataaagaagccggtttgaactacggcgcagcgaaaatcccgacattgccgaacggaaaagagtatgccccgtttgcaggcggaaaaggctgggtcgcctcaaaatatacgaaagagccggagcttgctgagaaatggcttcaatatgccgcaaatgacgaaaacgcttaccgcttttatgaagatacgaacgaagttccggccaacctcgctgctcgaaagaaagcaggggagcaaaaaagcgagctgacgtcggcggtcatcacacaatacgaaacggcgactccaactccgaatattccggaaatggccgaagtgtggacaggtgcagaaagcttgatatttgacgcggcagcagggaaaaaatcggctcagcaatcagcggatgatgccgtgcgcgtgatcaaagaaaacattaaagaaaagtatgtgaa

SEQ ID NO: 812 - DNA, 1284 bp, Bacillus licheniformis
atgagaaagccgcttatcatttgcgattttgacggaacgatcacaacaaacgacaacatcatcagcattatgaaacaatttgctccagaagaatggaccgctctaaaagacggggttctgtccaaggacatatcgattcgggacggagtcggcagaatgtttaatttgcttccggccagcctgaaagaagacattacggcatatgtactgaaacaagccgagacccgccccggatttaaagaatttgtttctttcctggatgagaagggtcttccgttttacgttgtgagcggagggatggattttttcgtctatcctctgcttgaaggaattgtcggaaaggaccgcatttattgcaacgaggccgctttcaccagccgcaatatcgagatccgctggccgtatccgtgtgacggcggctgcggaaatgactgcggctgctgcaagccttccatcatccgccggctgaaaggccgggacgatttcgttgtcatgatcggggactctgttacagatgttgaagctgccaaatgttccgatttatgcatcgcgcgcgactatttgctgcgggaatgtgaagagctcggcttgaagcatgcggcattcggcgatttccgcgatgtaaggcgaatactcgaagagaccgcggaggtgaaagaatggatgtctgagcaaaaacggcaggaactagccgaggtaaaaaaagagcttgcggaaagggattggttcccggcgacaagcggtaatctgtcaatcaaagtatcagaagacccgctgcggtttctcatcacagcaagcggaaaagataaaagaaaagagaccgaggaggattttctcctggcggacgaagaggggaggccggcggagaccggacacgcgctgaagccgtcggcggagacgctgctgcacacctatgtctatcaacacacaaacgccggctgctgtcttcacgtccacacggttgacaacaatgtcatctcagagctttatgcaaaagaaaagcaagtgacattcaggggccaggaaatcataaaggcgctcggactttgggaggagcacgcggaggtcacggtcccgattatcgaaaacagcgctcatattcctgatttggcggcggattttgccgggcacctttcaggcgattcaggcgcagtgctgattcgcagccacggcattactgtctggggaaaaacggcatttgaggcaaagcggatgcttgaagcatatgaattcttgttcagctggcatttaaagctgaaagctttgcaggcttatcacgtttaa

SEQ ID NO: 813 - DNA, 503 bp, Bacillus licheniformis
ttgctgaaaaaattattcggtattggtcaaaaacaagatgaagtgaaagaagaaaccgttttttcaccggttgacggacaagttttggaactttcaaaagttcctgaccccgttttctctcaaaagatgatgggtgacggaatggctgtcgagccttccgcgggcgagatcgtatcgcctgtcgacggggaagtgatccagctgttccacacaaaacacgccataggcattcgttcattgtccggcgtggagctcttgattcacatcggtctggaaaccgtagcaatggaaggcgaaggtttcacagcccatgtcaaagaaggagacaaagtaaaagtcggcgatcctttaataacatgcgatttggaactgatcaaggaaaaagcgagcagcacaattacgccgatcgtcattatgaacggcgatgtgttggaacgcgtcacaaaacatgaagaggcagcagcgaaaaaaagcgagacaaagctcatggagcttaaagtaaa

SEQ ID NO: 814 - DNA, 722 bp, Bacillus licheniformis
gtgaaaattattcatgtatcaggttatgaagaaatgagtggaaaatcggctgatctaatggctgagctcattcaaaattcaaataatcctgttatcggctttgcaacaggttcgacaccgattggtttatataaatgcctgataaaaaagtatcggcaaaaggaaatttcatttaggaatgttactgcttttaatttagacgagtacgttggattggctaaagaaaataaaaacagctaccattattatatgaatgaaaaattattcaaacatctggatattagtcgaaggaatatcaatatccccaatgggatggcggaagatttggaacaagaatgcctcagctacgacagacttgtttctgaaaaagcaattgacatacaaatattaggaatgggattgaatggtcatatcggttttaatgaaccggggacaagctttaaaagcagaacccatatcgttgatttggatcaatcaacccggcaggcaaattcccggttctttcgttccttggacgaagtaccgacaaaggcattaacaatgggcattgaaacaataatggaaagtaagcggatccttctgctcgtgtctggaaatgaaaaatctgaagccttggcacggctgctgaacagcacccgtgtctcccaagagttccctgcttcaattttaaggaaacataaagatgtgacggtgatggcagatgacgcagccttaaataaaat

SEQ ID NO: 815 - DNA, 1290 bp, Bacillus licheniformis
aggtgactgagatgtttgagcgggtcgcttttaaaattacaagtttcaaatatatcatggtcattaagtcggcgtttgtcacactgatgccggtcatcattgccggggcgtttgcggttttgatgcagaatatggtgatgagccccgagacgggacttgcggttttcaggccttttcggttcttgtctgcgcttgagccgattatggcgtcaatcaattatgcgacgctgaactttattacgatcggcgcggtgtttttgatcgggattgagctcgggaagctgaatgggcatgaatcgttttttcccggcttgatggcgctcatgtcctatatctctgtcattccatcggcggtgctgttggaagtgaacggttcgatgcaggaagtggttaacgtgctggccaaggaatttacggatccgaagtcgctgtttttggggatgtttatttcgattgtgtctgttgaaatcttcagcaagctgtcaagcatggaccggctcaagattaaaatgccggacagcgtgccggcaaatgtctctgtatcattcggcactttatttccttcgattattaccgtcacgatcatcgccagcttcggatttgcgtttcatcggctgacgggggtatatcttcatgaagccgtgtacaatgtcgtgcaaaagccgcttgagggcgcgattcaaggtcttcccggcattctcttgctggtgtttgtcgcacagtttttctgggtgatcggcatacatggaaaccagatggtgaagccgatcagggagcctttgctgctcgcttcgattaccgtcaatatgaatgcatacgcagccggcgaatcgattccgaatatcattacgatgccgttttgggatgtgtacatgagcatcggcggatccggcgtcacaatcggtctgttgatcgcgatgtttatcgcggggaaacgggaggatttgcgcagcattacaaagatttcgtttggtcccggcatcttcaatatcaatgaaccggtcatctttggggttcccgtcatgctgaatccgttaatggcgattccatttattgtgacgccgcttgtgacgggtgcgatcggttacatcgcgacagcggcgggctttgccggaaaagccgttgtcatggtgccgtggacgacaccgccgattatcaatgcctggctgtcaacaggaggaagcctcggtgccgtcgtcacacaaatcgtatgcatcatcgtctccgtccttatttatcttccgtttgttattttattgaatcggacctttacgattagttctgaaaaaa

SEQ ID NO: 816 - DNA, 570 bp, Bacillus licheniformis
agtgcaagagcagctgggcgaggccgggctgatcgcagtcgtccgcgcagacggtaaggaggctgctgaggagaccattcacagactgatcgacaaagggattactgcgattgaaatcacatatacgacgccgggagcgtctgagctgattgaaaaatttgcgggaaaagacggtcttcttgtcggagcgggaacggtggttgaaagcgaacaggcgagggaagccgcggcagcggggtcaaaatttatcgtcagcccgggtttttcggaatcactggctgaggaggccgcatcattgcatacattttttattcccggcgtattaacgccaagcgaaattatggaagcggtctcaaagggttttcgggttcttaagctgtttccagggggaacatccgggattccttacatgaagaacctcgccggtccttttccgaaggttcggttcataccaaccggaggaatccatcccggcgatgtggagaagtggcttgatgccggagcattggcagtaggtgtgggaagccagctgaacaaagtgtcagaagcggatctccagcgcatctttca

SEQ ID NO: 817 - DNA, 435 bp, Bacillus licheniformis
  misc_feature (1)...(435): n = A,T,C or G
atgattacagtcattatcagcggccacggaaactttcccatagcattaaaagaatcttcagggatgatattcggagaagaggagagcctgatcgcggtgccgtttctgaaaggggaaggcattcagacactgcaagaaaaatatcatcagacgctgaaggatgttccggaggaacacgaggtgctttttttagtggatattttcggcgggacgccatataacgcagcgaccccttacatcgcgaaagagcggagattcgatatggcagccggagtgaacctgccgattttgttagaggcattgagcttgagggagcatatgccgctcaaacaactgctgaaccagttgaaaaagatgagccgggaatgcttncaaatatgcagcgagcaattggaaaaattcagtcagtccaatcagggaagagaggatgaattg

SEQ ID NO: 818 - DNA, 825 bp, Bacillus licheniformis
gggacaatgtgctggcctatacatttttaggtccggccttgctgattttgtcagtgtttctcgtgattccttcgattatggcggtttactacgcatttacagattattatttgttaacacctgacctgcgcaagtttgtcggttttgacaactttatcaaattgttcaaagaccctattttcttgaaaagtttgagcaacacattgaaatttgttgtccttgtgattccattacagatcggggccgctctcgggctggcccttctgttgaataaaaagcgcaaggccaatacgtttttcaaagtcgcatactttagccccgtcgtcatgtcgcttgttgtcatctccgttttgtggctgtacttgctgaatccgaatgaaggaatgataaataacgtactgacgcatgtcggtttgccgccacagccgtttttgacaagtcctaatcaggcgatctttacaattgttttcgtttcagtctggcagggagccggatttcagatgctgatttttttagcgggcctgcaaaacattcccggagatgtctacgaggcggcgcaattggatggtatgaataaatggcagcggtttatttatattacattgcctttgttgaaaccgacgtcggtttttatctttattacgacgctgatcagtgcgtttaagctcctcgtgcagccaatggtcatgacccaggggggaccggtcaattcaacgatgacagttgtctattatatttatcaaacgggatttaccgatcggatggtcggctatgcaagttcaattgcgctcttgtttggcacgataattggattggtgacgcttg

SEQ ID NO: 819 - DNA, 696 bp, Bacillus licheniformis
ttcacataaaagaaatcgatgaacaaataaaagattatgtgaatcaagaattggccggttttaaagaggataacgcaaaggcccaggctcaggatgaagacgggccttttgaactgaacattaaatataaggttgtctattatacaaaggatacggccagtgttgtgctgaatcaatacatagaggccggcggcgtatcgggtacaacatctgtcaagacgtttaacgctgatttaaagcagaaaaagctgctgtcccttcaagatctgtttgaagagaattcagattttctgaacaggatttcaagcattgcctatcaggaattgaaaaatcggaatccgtctgctgacatggctttattaaaagaagggacgagccctcaggaagaacatttcagccgcttcgcgcttcttgaaaacgaggtggaattttattttgagaaaaaacaaaccggtcttgaacagtctgtaaaaataaaaaaagaatgggtaaaagatattttaaaagaccgatatcaggatatgaaaaagaatcgtcttcaggccaaacctgatcaggagcctgttccgcttccgaagcaagcgaaaattaatcccgatgaaaaagtgattgccctcacatttgatgacggtccgaatcccgctacaacgaataaaatattaaacgctttacagaagcatgaagggcatgcgactc

SEQ ID NO: 820 - DNA, 1098 bp, Bacillus licheniformis
atgtcagccggcatttcggaaacaccatcgcattggaagacgtacagcttgaagtcaaagaagggggagtttttctccctccttggtccgagcggctgcggaaagtcaacgctcctgaatattattgccgggttccttgaaccgacgtcaggttttgtatatataggaggacgagatgtaactgatttgccgccatacgaccgacatatcggaatggtttttcaggattatgctttattcccgcatctcagcgtttttgacaatgttgcatacggcttgaaagtccgaaaatggccccgccgcaagattgaagaacgggtgatggaatgcctcgctcttgtcaggcttgaagcgtttgctaatcgcatgccccatcagctgagcgggggtcagcagcagcgggtggcgattgcccgggcattggccgttcagccgtctgtgcttttgctagacgagccgctgagcaacctggatgcgaaacttcgaaaagaaatgcagacggagctgcgcagcatccaaaagcgcgtcggcattacaacgattttagtgacgcacgaccaggaggaggctttaagcttatcggacaggattggaattctcggatgcgggaggcttcagcagctcggcactccgttggacgtgtaccgcacgcctgccaatcaatttgtggccgaatttatcggacaggtcaatttactgaaagcgcgtgcgtcgaagatacagccttcatcgggcggctatggatacgaaacggtcgatttcgaagtgtatgaaggcgttccgctgacatttgaaatcaaccaggaactctcaaaaaaaacttctgtattgttcatggtgcggcctgagaggatctcagtctccttcgagaagcaaaagaacaggctgattgaaatgcctgcaacaattaccgaagtcagttacgccgggcatgatctcaggctgaaagccgctgttttcaaaggagaatggatcattcaggcgcccgatcctcaattccctagattgccgaaggcgggagatcaagtgtatctttctttggagccgggcgattttgttccgctggatgttaaggaggatgcagatgagggctgttga

SEQ ID NO: 821 - DNA, 691 bp, Bacillus licheniformis
atggatgttattagcataggagagacaatggcgctgttcactccgaatgaagacggccctctcagatacgcaagaaactatcaggtgagaatagcgggcgcagaaaccaacacgctgatcgggctttcgaagctcgggaaaaaagccggctggattacacggcttggaaaagacgagttcggggcgatgattctttcttctgtcagaggagaaggagtcgatgtgagccaggtgaagctcgatgacgcggcgccgaccggtttgttttttaaagaaaggaaaagcgcggccaaagtcaatgtcttctattacaggacgctttcagcggcgagttttttaaagaaatgcgatattgatgagcaatacattgagaaagcggggcttttatacattacgggaattaccccggctttaagtgaaagcgcttcagatgcggtgttttatgcagtggagctcgccaaaaagcacaataaatgcgttgtatttgatccgaactttcgaaaaaagctctgggacggagagcgggcgcggcagaccatgtttgaacttatcaaacggtctgatatcgtgcttccggggttgagcgaagggcgttttttgttcggcaccgctgatgagaaaaaaattgcggaagccatccgcgggctgggggctgaaactgcgatcatcaagcttggttcaaaaggcgcct

SEQ ID NO: 822 - DNA, 1014 bp, Bacillus licheniformis
aggcttcacagcactcatccttgctatgtttgataaagtaggctggattgcagttgcgatccttgcagcggttcttccatttatggttgcatcagggatgcacaaagcgatggtgccgtacgctgtaacaacaatgggcaatctcggaaaagaagcactttacttgcctgcatcacttgcacacaatatcgccgaaagcggagcgtgtttcgcaattgcccttcgtacaaaagataaagtgcttcgttcaactgccatttctgcaggaatttccgcattctttggcattaccgaacctgcattatacggggtgacactgcaaaataaacgtgtgctcagcagtgtcatgatcggttctttcatcggcggcatcttcattggacttgtcggacttcaagcgtttgttcttgttggacctggtcttgcaagtatgtcgatgtttatatctgacgagcttccacgcaacttcatgttcgcagtgattggttttgccatctcatttgctgttgcgtttgctgctgcctttattttaggaaaggatcgaaagacagaagaaacggaaaaagaagcagagccaggtgctttcgctgaaaaacttggcgcagatgagacgttcaaaagtccagtcatcggtcaaatgatttcactatctgatgtagaagatgacatattttcttcaaaggtaatgggagaaggaattgccattattccttcaaagggtgagctatatgcaccggtagacggcgagatttcccttctctttgaaacaaaccatgcgctcggcatgaaaacagcaaacggagttgaggttcttttccatattgggatcgacaccgttcagctagagggcaagttctttaaacctttggttcaagcaggagacaaagtcaaagcaggtgatctgctcattcaatttgacctggaaaaaattaaggaagcaggttatgatccagttacactagcagttattacgaatacggatcaatatgatataaaagtcacgcaattaaaaga

SEQ ID NO: 823 - DNA, 642 bp, Bacillus licheniformis
gacaccggaaaaaagcggcgcttcagcacggtattgccggttcacccggattcttgcagccggcacagtcaatcaattatgtggaatgccatgacaatcatacattttgggataaaatggccttatgttttgaagaagatgcggacactaaacggcttaggcaaaggctcgcggtgtcgatcgtcctgctttcgcaaggcgttccatttcttcacgccgggcaggaattttgccgaacaaagaatggggacagcaacagctacaggtccggagatgacatcaataagcttgattgggaaaagcgtgcggagctttgcgaggatgtcgaatatgtgcgccagctgatccggctgcgaagaagccatcccgcttttcgtctgcaaaaagaggaagaagtcaaggagcatctttcttttatggacggtacaggagaggtaacggcctacaagctgaagaacattgcagcaattgatccctggaacgaaatcatagtggtgcattgtccgtttgcaaaaaaggagacgcttaagctgcccgatcagaaacagtacttgctgcactgcgatccttttacgttcttcaatgggaaggttcaagcggaaaaaaagcttcggctgaacggcatcgggacctatgttttat

SEQ ID NO: 824 - DNA, 477 bp, Bacillus licheniformis
gtttggcatggagcctgttgaaaccgatacactctatccgggcgataaaaatgcggtccgttatcaaaaccggtcgtatgagctgaaagattacgcgaccgtgctgaagctcagtacggcagatcccgagggattctatgaggacgacttttatgcggacacgacggctgtgacgagccatccatacaaacaggggaaaacgtattatatcggtgcgcgtttaagcagccaatttcatcgggatttttatggaacattgattaaagagctagcgattcaaccggctcttgacgtgaaacatcagcctggcgtctccgttcaagtcagacaggatgaggaaaatgactatattttcatcatgaatttcacggaaaaacgtcagcccgtcgtgttggcgtcggcagttaaagatatgctgaccggagaaacgctggccggcgaagtcacattggaaaaatatgaggccagaatagcggt

SEQ ID NO: 825 - DNA, 709 bp, Bacillus licheniformis
atgaaaaaaatatttctattcggctgttcgttttattttctagtaggggttatccatattctgctggggagcctgtcaccgtacatcattcaagaatatcaacgggatcttcatgatctatccttcctgatctttttccaattcaccggttttctaaacggcgtcctgcttgcgccgatgtttgtcagacgcacctctcatacggctgtattgacgtttggccttcttcttattctcgttacgcttttaggtgttttcctttttgatatgttcatcttttttgtcatcatgggatttttgctcggctttggcgcgggtactttagaaacgacgatgggggcgtatgtgattgcgcaagataaaaatgcgaaagggatgaatattttagaggtttttttcggattaggcgcgctgctgtttccttttcttatttatatccttacggaacgatatgcctggcatttccccttgtatgctttatttatcttcgtttttgtgctcgcgtgtatgtgggtggatcatttgcgcaaaaaaacccccggcactgcttccggtcagatggattatcatgaaaaaccgactgtgtcacccatatttgaaaccggcaggaaagaaaaaaacattttcctctttctcatattcgctattgagactgcgggtgtcgagaccaattccgcaaactttttgcccgcgctgatgctggaaaaaa

SEQ ID NO: 826 - DNA, 780 bp, Bacillus licheniformis
gccttgttttgctggcggctctgtttatatttccgctgatttggatggtcgcttcatcgatgaaaccggaagccgatatttacaacaatatcagcagcattaaagcgtttcttccgtcttttcatccgtcggaatggtttcaatcctacagggaagtgctgtcacggtttgatttactaatgtatattggtaacagtctgttttacggtttgtgtgtggcagcgggagcggtcattatcaacggaatggcgggctttgcattcgccaagctgcaattcacaggtaaaaaagtgctgtttaccatattgctggcgcttttaatcgtgccgatggaaacgattttaatctcgcagtttacaattgttcataagctcggacttgttgatacgcgccttgccgtgattttgccggcgcttgcgggggctttcaatatttatttgttccgaaactttttcatggcgatcccgggggagatgattgagtcggccaagctggacggagcaaatacatggcagattttctggcgggtgatgctgccgatgtccaaaccggctgtcgctacggtggggacattggcttttatcggcagctggaatgactatatttggccgctgatggttttgacggataagtcgaaatttccgatccaggtggcgattacagccatcaacagcaccgagccggtttatacgaaccaggtgatggctgtcttgtcgatttccacgattccgatgaatctgatttacattgtagcccaacgatacattttagatggcttgg

SEQ ID NO: 827 - DNA, 711 bp, Bacillus licheniformis
cgcaaggcgaacttctcgatcacttgagcacaaaacagcagatcgaaaagcgcaagcaggaaaaagagaagcaaaaagctgctgcggaaaaaaagaaagaaaaatcgaaggaaaaaacggtttatttgacgtttgacgatgggccttcagccgtaagccaaaggctgctgcaaattttatccgaacatgatgctaaagcgacattcttcatgctcgaaccgaacatgaagcttcacaaagaagccgttctcaatatgaagcagcagggccatgcacttggacttcacggggtgacccatgaccaaaagcaattttataaaggcgccaattctcctaatctggaaatgaagcaggctcaaaaaacgctgaagtctatcaccggggttgaaacccatttgatcagaacgccgtacggaagcaaaccgtcgctgaccgaagcgcagaaaaaagtgctgaaaaagaacggatttatttattgggactggaatattgacagcctggactggaaatacagaagccaaaaattcgttccggaagtcatgaaacagctgaatatcctggaaaaagcggcagacaaaacaaccgatcgtgatcctgatgcaccatattccttcaacggttcaatcattggccgttattgcttgacaatttaaaaaacattggggtattcatttgcaccacttggattgattccttgaacacccgttccat

SEQ ID NO: 828 - DNA, 993 bp, Bacillus licheniformis
atggcgttgacggcaagtatggataggcgcaagttaatgatgtatgctctcggtttgtttgtgataggaaatattttggcttttaccctgcctggttatggttggtttgttgcagcgcgtgtcgttatggctttgggggcaggcatggttgtggtcacggccttaacgattgccgccaagatcgcaccggcgggtaagcagggcagtgcaattgctacagtcgtcatggggtttaccgcttctttgattataggtgttccactcggaagaatgacggcagaagcattagggtggaagtctgtatttgggggaattgctttattgggattcatcgcaatgattgttctattcttaacattgccgcatactgaaggcgataagcccgtccctttgcttcagcagctttcccttttaaagaaacggaaagtagcgatggggttatcggtcacttttttctggctcggaggatattccgttgcatatacttatctgtctccttaccttctgaccgtttcagggatcagcggcaatttgctcagcggcgttttgcttatatttggaatcgccagcttggttggatcgaagtttggcggatatagcactgataaatggggagttccttttacgctcgttggcgggatggcgctgcatatcatcgcactgattttgctgtcgcttgtcacccattcctatgtcggagtactgttgattctcatattatggtcgttcgccgcatggtctaccggcccgacgcagcaatatcacttagcgacgcttgaacccgaattgtcaggtgtattgctcggcatcaatcaatcgatgatgcaattcgccatggccgcaggtgcaggaatcggagggatttttgtagaaaaagtgtcgctggcttctattacgtggtttggggcattgggggttatgattgcgattgttgttgttttgacgaccttcagttcacggaaagcagcacatgtaagagaaatcagttcataa

SEQ ID NO: 829 - DNA, 975 bp, Bacillus licheniformis
atgaagtctatccgcaatgggcggattctcgctaatatgattaacttgatcgcggggactgctttcgcatttctccctgcgctaatcggctggtcggccgtcaagcggtttggcggaaatccgctgctcggcatcgtgctcggcgtcatgcttgtgcaccctgatttgttaaacgcctggggatacggggctgcggagcaaagcggagagattcctgtctggaatttattcggtttggaagtgcagaaggtcggctaccaggggcaggtgcttcccattttgctcgcttcttatttgctggcaaaaattgagcgctttttgacaaagcggacgcctgagagcattcagctccttgttgtggcaccgattacgctgcttgtcacaggttttgcttcatttattgtccttggaccgattacatttgccatcggaaatgttttaacatcaggccttattgctgtctttgaacaattcgccgtactgggcggactgttatacggagggctttacgccgctctcgtcattaccggaatgcatcatacattccttgccgttgaccttcagctgatcggctcaaagctcggcggaacatttttatggccgatgctcgcgctgtccaatattgcacaaggttcagccgcgcttgcgatgatgtttattgtcaaagatgagaagcagaaaggcctgtccctgacatccggaatttcagcttatctcggaattaccgaaccggcattgttcggagtgaatctcagatacagatttccgttcgtgatcgcgatgatcagttcggggattgccggtatgttcatttcctcgcaaggggttttggcaagctctgtcggcgtcggcggcgtacctggaattttctctattatgagccaatactggggagcgtttgcgatcggaatggcgatcgtgttgatcgcgccgtttgccggaacatatctctacgcaaaattaaaaatgaaataa

SEQ ID NO: 830 - DNA, 798 bp, Bacillus licheniformis
ggctctttaacattattggcgtcctcgttacagccggctttttattccccgtttactggatgattgctacggctttcaaaagcgatgccgaattgtttaaaacaccgcctttattgtggcccgagacattccgcacggccggctttgaagctgtgttcacttctggcgtcgccggatactttttgaacagcctcctgatttccggggcggctgccgtcatcgttctcatattggccgttccttccgcctacggcttggcgcgctttcggatcaagggcaaaaaaatgttcattttactgtttctcatcacgcaaatgctgcctgccaccgttgttttgactccgctgtttatcgcctttaatcaactgaacatattaaatacgtatatcggaccgattttgacgggggcaacgctcggcgttcctttttctgttttaatgctcagaaccttttttcttgggattcccaaggaccttgaggatgcggccaaaatcgacggctgcagccgttttaccgcgttcatccgcatcattttgcctatcagcgtacccgggattgccgtcagcggagcggtttctttctttttcacatggggagatttgatttacagcatgacattcaaccgaaatcaggagctgtggccgctgacggccggcatttacaatgtgatcagccaatacggaatccagtggaatgatctgatggcatttgccgttttatcggttctgcctgtcatcatcatttttatgctgcttcaaaagcagcttgttaaaggacttatcaatggatctatcaagt

SEQ ID NO: 831 - DNA, 829 bp, Bacillus licheniformis
atgtcagtaagggaaatcgatatggagcgttttcgtgatcaaatcaggctgctgacattgaaacagcttcatcacctcggctttggacattatggtggcagcttgtcaatcgccgatgtgttggccgttttgtatggaaaggtgatgaaaatagatcctgccaatccgtcgtgggaagatcgggacttctttatcctttcaaaagggcacggcggccccgccttatatgcagcgcttcatctttccggctattttgaagaagatgtgctctatacgctaaaccaaaacggcacagctcttccgtcgcaccctgaccgaaatttaacaccgggagtcgatatgacgaccgggtcgctgggccaggggatctcggctgcagcaggagtcgcgctgtcgcacaagctttcaggacgcgctaaccgcacctttgtcattgtcggcgacggggagctgaacgaaggccaatgctgggaagcgatccaatttgcggcgcaccataagctccgcaatctttatgtgtttgtggatgataataaacaacagctggacggcccgacgaaagagattatcgatccgctggattttgtcagcaaatttagagccttcgggttttattccgaaagggtaaacggacacgaaccggaagcgatttatcgtgcggtcaaaagaggcgaagcccagcgggaaaggccggttgccgtcatccttgatacggtgaagggaaagggcatcccttattttgaaaaaatggagaacagccaccacattagagcaaatgaagagcaaaaccgcatgatcgaaaggatcattttgacgcttgaagaaaagg

SEQ ID NO: 832 - DNA, 864 bp, Bacillus licheniformis
gggaagggtacttttatttgtttccggcagttctttttatgcttgctcttatcggttatcctctcatctacaacatgattctcagctttcaaaacgtatcgcttgcaaatatagcctcacacgatatcagctttatcggaatcgaaaattatcagcggcttgcccaggataaaatattttgggcatctttaaaaaacacgctgctttacacggccggaagcgttgtatttcagtttgcaatcggctttttgctcgctttgtttttcagcatgaagttcaggcttgccccgtttctcaggggattgatgatggtgagctggctcatcccgctgacggttacggcgcttttattcaagtttatgatggcttcaaacgaaggagtgttcaatcagctgctcctatcatggggaatgatcgacaccccgatcccctggctgtcagacccgaatatggccatctggtccgttatcatcgccaacatctgggtcggcattccttttaatatgctgctcatatccgctggactcagctcccttccggaagacgtctatgaaagcgcaagccttgacggcgccaatgcttttcagaaattcatccatctgacactgcctttattgcggccggtgatcactgtcgtcatgatgctcggcttcatttatacgttcaaagtgttcgatcttgtgtttgtgatgactggaggcggtcccgtggacgcaactgaagtcctgtcaaccgtcagctaccgctactcctttgacgaatttcaattcagcatgggcgcggcaagcgccaatgtcctgtttcttattcttcttttggtcagtctcgtctatttgcggctgatcaaaaaagatgaggtgatgt

SEQ ID NO: 833 - DNA, 960 bp, Bacillus licheniformis
atgcctgacgccgtattccttgacaatgtcgacaatgcttcattcgccgctatgggcgtgctcgaagatttgacggagaaaatcgaacaatgggggcaggctgaccagttttatgaggggcctctatcatcagccggatatgaagagaagtactacggcatccctttcgcaagcaatgcgcttgccttgttttacaacaaagacctcttgaagaatgcagggatctccaaaccgcctgaaacgtggagcgatctgaaaaaagcggcggaaaaaacgagcaaaggccaaacgaaaagatttgccctgtcagccgtaaaatcagaggaaagcgcttttcaattttatccgtttcttttgtcttccggagcagatctaaaacagctgaattcaaaagaagcagcctcttctcttcagtttttaacagatctgatcaagaaaggcgcaatgagcaaggaagtgttaaacgccacccatgatgatctggccagacagtttgcagcaggtcagctcgccatgatgatcaacggctcctggaatattgaacggctggaagaagccgaagacttaaattacgggattacctatatcccgaaagatcaaacattcgcttctgccctcggcggcgaaaatattgccgtcgttaaaggaaaaaacaccgccggcgcctgggattttatcagttggctgatcgatccggagcggctcgaaacgctgacagcagaaacaggcgtgtttccgccgcgcaaagatttgctcgaatcatcgagccattggaaaacagatgataatttaaaagccttcattccaatcatagagatcgcatcagcccgcggcccttcgaaagactggccgaagatttcggaagctttgcagactgccctgcaggaagcattgagcgaaagcaaaacgccgaaagaagcgctggatgaggccgcgcaaaaaatcagcgccttaaactag

SEQ ID NO: 834 - DNA, 699 bp, Bacillus licheniformis
agcaggaaccgataaaagaaaattccgcggcttcagcatcggtgccgggaggcaaacataaagcagagaaaaaagaaagtaagcaaacagcgccggaaatcggaaaggtcgtctatttgtcatttgatgacggtccgaatcctgcggcttcagataaaatcttaagtttgctcgataagtatcatgcgaaagctacatttttcatgttaaaaccgaatattgaacaaaatcccgatattgtgaagaaaatggttgaaaacggccattctgtcggctctcacggagtgacgcatcaagtatcgaaaatctataaatctcctgaaagcttcgcggcagaaatgaatgatacgcttaaagccatcaaagaaacgaccaacgttgacacacatttgatcagatcgccttacggatcaaagccctatatcaccggtccatttcaagaagtaattaagcgcgaccattttaacctttgggactggactgttgattcagaggactggaaatctgcaaatacaaacggtcaattcgtgaataatgtgattcagcaagtcaataacctttccggtgttgagccgctagttgtattgatgcatgaaaaaccgacaactgcggcccatttagagaaactattgaaatacttccaagaaaacggatatgaaatgaagcccattcatgattcgataaaaccggttcatttca

SEQ ID NO: 835 - DNA, 957 bp, Bacillus licheniformis
atgcttgtcaatcaaactgaaaccccgttgtacattaaggtgaacgaaaaagacaatgccgcaatcatcgccaatgccggcggactgccgcaagggacggtgtttccttgcgggcttaagctgcaagagcggattcctcaagggcataaagtggctttaacagacatcacacagggcggtgccgttattcgctacggcgaaattatcggctatgccgtcaaaccgatcgaaaaaggcgggtggatttccgagtcgcatatcatgcttccggaagctccgccgctcgatgaactgcccatcgccaacaaagttccaaaacccgctccccttcttgaggggtatacatttgaaggataccggaatgaagacgggagcgtcggcacgagaaacgtgcttggcattatgacaagcgttcaatgcgtcgcaggcgttctcgattacgcagtgaaacgaattaaagaggaactgctcccaaaatatccgaacgttgacggtgtcgctgcattaaatcatcagtacggctgcggcgtggcgattaatgcgccggaagccaaaatcccgatccgaacgattcaaaatatcgccaggcaccctaatttcggcggtgaagcgatggtgatcggactcggctgcgagaagctccttccgacgaagatagagccggaaggagacgctgaaaacattctttcactgcaggaacggcaagggtttcagcaaatgatacaatcgattatggaaatggccgaagagcgcttaaaaaggctgaatgaacggaagcggatgacatgtcccgcttcagacctggtgatcggcctacagtgcggaggcagcgacgccttttcaggagtgacccgcaaaaccctgcgtccggatatgcggccgacttactgtccggggcaggggccacggtttattttcggaagtcaccggaagtccgcgatgccgttcatctcctaa

SEQ ID NO: 836 - DNA, 936 bp, Bacillus licheniformis
  misc_feature (1)...(936): n = A,T,C or G
atgcgttttgggacggggaggacacaaggaaggaggcgccagaaggaggcgggagggggggggaggagggggagagggcgagagagacgagcaggacgggcgaaggagagcaagggagacggcggggagcaagggcgagggaagggggggcgggagaagaagggacgagagggagacgcgagcggccgacgggcaaggaggaggcgcgaaccaacccacgcgcagagcgcggagggggggggaagagggggcgggcgggagggggagggaaaggagagcggcgagagcgaagccgcgggggaggggggggggcggagagagggaggaggaagagagaaaggcggggggagggggcgggagggggagggggagaaggggaggggggcgagcgggggcgggggcgggaggcagggagaggcacgaggggagggaaggggggaaggggcgggagagaggaggggggggggggaggggggcgacgcggggagaggggggggagcggaggggcccgcgccgggacggcggggggggcaaggggggggggaggaggacgaggagagcaggggaagaaagcggagggcgacgaggggggcgccaccgcgcgccgcaccgggcgccggcacccccagagcaacacagccagccagggcccggcggccaggcccgaccaagcacgacgcagccagcgccaacaaggagccgcaagggcacggccgcagccacgccgggccaggcgggcgcagcggcgcctccaacaatgaaaagggtccggcnaacacaccggaacctcaaatctattcctatgcttctacagatctaaaaaactgcggaagatgctctttatgcgcttcaagcatttcgtccagtatttgtttcgcaattttgtcggacggaacgagcgggttgatcgtcatggccacaagtgcagtgttgtaa

SEQ ID NO: 837 - DNA, 1050 bp, Bacillus licheniformis
atgatgacaaaaacaaaaggatttccaaaagattttttatggggcggtgcgattgccgcaaaccaagcagaaggagcctggaatgttgatggaaaaggaccgtctgttgctgatattgccatgtaccgttcgaatttgagtgttgaagattacgaaggacatcttgctgtttcttctgaaaacattgaacgcgcaatgaaagacccggacgtaaaaaaatatccgaagcgcagagggattgacttttatcatcactataaagaagatgtggctctctttgcagaaatgggttttaaaacattgcgtatatcgattgcatggagccgaattttcccgacaggagaagaagcagagcctagcgagaaaggccttcagttttatgatcgtctgtttcaagaaatgaaaaaacataacattgaaccgatcgtgactctgtcacattatgaaatgccattagcacttagtctgaaatacaacggatgggttgaaagaaaagtgatcgacctctttgtgaaatttgccaatgtgtgttttgaacgctataaagatgtcgtaaaatactggcttacctttaatgaaattgacagtatacatcgccattctttcattacagcgggaatcattcctgatcgctgtcctgaagggaaagtagaagaaacggtttatcaagcattgcaccatcaatttgtggcatccgctcttgtgactgcagattgtcatcgcatcattcccggcagtcaggtgggatgtatgctaacgaaactcacgacatacccgcacacttgccatccgagtgatgttgaacgcgcactgaagcaaaaccttgataactatttctatgcagatgttcaagtgtttggcgaatatccgccattgatcaaacgcatgctggaacgaaaaaatatcaatattaagatggaagcggacgatcttgccattataaaagaacatacggtagacttcgtttcgtttagctactatatgatccctgacagaatctgcacaggaggggtctggaaaaaacagatggcaatacgattcgcggtgtga

SEQ ID NO: 838 - DNA, 774 bp, Bacillus licheniformis
attacatacaaacagcaagagacgtattgcagcatgtcggcggtaaagagaatattgcccacttggagcattgttcgacacgactccgttttacattgattgatcaaaacaaggcggatgtaccggcgcttgagaaaacaccaggtgtcatcgctgtccgtatgtcgggccaatgccaggtcgtgattggaaacgatgtcatcgaagtctatgaggaattgaccggccttctcggcggagcactttctggacaaaatgggtcttcccatcagccgaaggaaaagcgaaaagtggggactgtactattagacttcattgtcggtgtttttcaaccgcttgttccagccattgcgggtggagggattttaaaatcgtttctcctcctcttctcgttattcggattcattgatgccaaagggcaaacgtatcagattttaaatatggttggcgatgcgccgctttacttcctgccattgctagtcgccgtgacgacagccaataaactaaaagtgaatccgcttgttgcattatcggcagtcggcgctcttattctgccaaacatgacggcgatgctgacagaaggcgctcaattattttcattcgatgtgaaaaatattgcgtatgcctatcaggtgtttccggtgatattatctgtcctgttgtatgcacagatggaaaaatggtttactcgtatttcgccaaaacccattcgtatcttcttcgtaccgatgatgtctttggttattacagttccgatcactctcctgctgttgg

SEQ ID NO: 839 - DNA, 888 bp, Bacillus licheniformis
atgacaatgagtaaaatatgcgtgatcggcagctcttcgatggatttagtcgtgacatcgcccaagcggccggccgccggagaaacggtgcttggcgaatcttttaaaacggttccgggcggaaagggggccaaccaagcggtagccgcggcccggcttggcgccgaggtccatatgatcggctgcgtcggcgatgatcattacgggaaagccatcctcgacaattttcaagccaatggtgtcttgacagactatgtggaaccggttacaggtcaggaaagcggaaccgcacatatcgttctcgcagacggcgacaacagcattatcgtcgtcaaaggggcaaatgaccatgtcacacctgaatacgttcaaaaagcgctgcctgcgattaaacaggcagacatcgttctgattcagcaggagattccggaagaaaccgtcgattatgtcagcggactgtgcagctctctcggcattcctctcctgctgaatccggcaccagcccgtccgctacgcccggaaacggtcgaacacgcggcctacatcacgccaaacgagcatgaagcttcggtactgtttcagggcatgtcccgggaggaagcgttaaagcgctatccggagaagctgttcatcacagaagggaaaaacggcgtccgctatcacaatggtctggaagaacgtgtcgttccttcattccctgtcaatgcgattgatacgacgggcgccggagacaccttcaatgcgggatttgccgtcgcgctttccgaaggacaaagcatcgaatctgccttgcgctttgcgaaccgggcggcttccctgtcggttctgaaattcggcgcacaaggcggcatgccaaaacgggatgaagtggagcgtgaactgtcatga

SEQ ID NO: 840 - DNA, 401 bp, Bacillus licheniformis
ttaggcaaatgccgctgttgtttgcggtcggaattccgatcgcactggcaaaaaaagcgcaagcgcgggcatgtttggaagcgcttactacttatttgaccttcaattattttgtcagcgctattttgactgtatggggcgactttttcggagttgatatgactcaggaagcaggaggaacaagcgggcttgcagaaattgccggcatcaaaacccttgatacgaacattatcggggcgattctgatttcatcgattgtcgtttatatccacaaccgctattttgataagaagctgcccgattttttagggatttttcaaggctcttgattcgtcgtcattatttcatttgcgattatgcttccggtagcactggcaaccgcgtggatttggccgatggtg

SEQ ID NO: 841 - DNA, 381 bp, Bacillus licheniformis
acaatgaagaaatcggttatggcggcaactccaacatcccgcctgaaacggtggaatatttggctgttgatatgggagcgatcggcgatggacagtcaacagatgaatatacggtatccatttgtgtaaaggatgccagcggcccatatcactacgggcttcgaaagcgcctgacagccctttgtgaagcacatggaatcgattataagcttgatatttacccatactacggttcagatgcttcagcggccgtcaaagcgggccatgatatcgtccacgggctgatcggcccgggaattgacgcatcccatgcgtttgaaaggacgcatcaatcgtccttggagcagacggcaaagctgctgtatcactatgttcagtctg

SEQ ID NO: 842 - DNA, 375 bp, Bacillus licheniformis
tgcggttatatatgaggttcacatccgcgatttctcgattcatgaagacagcggtatgcgccataaaggcaaatatgttgcttttactgaggacggaactgaaacatccggcggcttctcaacgggaatagaaaaaatgaaagagctcggaataacacacatcgaggttgtgccctttcacgattttgccggagtggatgagctgtctcctgatcaatcttataattggggatataaccccctccattttaatgccccggaaggaagttattcgctcgatccgcagaaccccaaatgcagaatcaccgagctgaaaacgatgattcagtcgctgcacaaacagggcttctccgtgattatggatgccgtatataa

SEQ ID NO: 843 - DNA, 843 bp, Bacillus licheniformis
atgaaatcatttgcaaagtatcaaacatttctggatctccatcatcagtcagacccattcgttctgccaaatgcatgggatgcagccagcgccaaagcatttcaaaactgcggttttaaagcagtcgggacaaccagcgccggaatcgctatgtccctcggctatcccgacggcgaacatctcccctttgaaacattgctttccgtactgaaaaccatcacggatgccgtcgatattcccgtcagtgcagatcttgaagcgggttacggccaaacaccggaaacagtcgctgaaaacgcaaaaaaagccgcagctgccggggttgtcggtatgaatattgaagacggaacgaaagacccctgccggccgctttctgatgcaacattaatggaagaaaaaataacggctgttaaaaaactgaaccttcctgttttaatcaatgcccgtacggatgtgtactggctcaatgctgacgcccccggctcccgtcttcaagcagcagtccggcgggcaaatcggtacagtcaagcaggcgcggactgcatttttatccccggagccgatgatgcaggcaccattgccgggctgagaaaaggtatatccgggccgatcaacgtgctggccggctcacacaccccctctttacagattctttccgaactggggattgaaaggatcagctgcggatccgcccctttcagagctgcactgtcactggtgaaaaagatcggtgaagacatcatccgccgcggcgccttcaatcgtatgacggacggcgtgctttcatacggagaagcggctgattggatcagccttcatcgtgacccaaaacaaaatcgttga

SEQ ID NO: 844 - DNA, 753 bp, Bacillus licheniformis
ggcaggcatacagctcagccgtttatgaactggctcaagaaaacacggacatcgtggccttggaagcggatttgatgagctcgatctccatggacaaagtcaaacggcgcattcccgagcaagtgatcaattgcggtgtcatggaagccaatatgatagggattgcggccgggctttcgttaaccggaagaatcccgtttgttcacacgttcgctcagtttgcgacaagacgctgttttgaccagctgtttgtttcaggtgcatatgccaaaacaaacattaagattctcggatcagattcgggaattacggctgaacataacggcggaacccatatggcctttgaagatttgggactcgcccggctgatcccaaacgcctttgtttatgaagcaagcgatgcggcaatgctcaaatttttgatcaaaaaggctgcggcagagtacggcattcactatatcaggacgatcagaaaaaaggctgtcaggctttatgatgaacacgaaacattcgcagacggaaaagcaaaagttctcaaagatggcagcgatgcggcgctgtttgccagcggcatcatggtcgacgaagctttgcaggcggctgaactgctaaaagaaaaaggaatcgatgcagcagtgatcgatatgtattgcattaagccgattgatcaagaaacgggggtttcgttttgccaaaaaaccaatgctattggtaccgcgtggaaaacctaattgtaattaggcggtattggtg

SEQ ID NO: 845 - DNA, 498 bp, Bacillus licheniformis
ggattggaaaactgcagccctcgaccgcttgcccaaagtgttgacccgtaaccaatccactggttttatgggagattccccctttgaattggctgccggtcaagaatcaattcttcaatcgcatatgcttgaagttgacccatctttagcaagcaataaaccaaaaattatcgtctctccattaggtattggtgatcgtgaagacccggcacgcctagtgttcgacggaaaagcaggagatggcgtggttgtttcaatggcagactttggtacgcactacaaattgttgattaacgaagtttctgcatttgaaccaactgttccagcaccaaaccttccagttgcacgggtgctttgggaagtgaagcctaacttccaagatggagtgaaagcatggcttgagaatggcggcggccaccatacagttgtttcattgtttttaacaacagaccaaatgatcacttatgcaaagctcgttgacttggaatatgtagtgat

SEQ ID NO: 846 - DNA, 822 bp, Bacillus licheniformis
atgctgaaggacgccggcgttgacttgaaaacgctgccaacggttgagaatccatggacgtgggacgaattccttgagctttgcaaaaagctgaaaaataaatatgacaaaccggccatcgatatgcagttgcagtcaaaagacgaaatgctgacctatgcgcttttgccatttgtttggtcggctggcggcgatgttctttcaaaagatggcaagaaagcggagggtgtttttaacgacaaactgaccgttgaagcgatgacatttattcaaacaatgctgaaagagggttacacgacccggactccggttaagcaggcgtttgaaacggaaaaatatccgatgaaaatgagcggtgtctggacggtaaccgacatggaaacaaattttcctaatgtcgattatggtgtgatgccgtatcctgtgtcgccaaaaacaaaaaagcttgtgtccccttcaggaagctggcagtttgccatgacacagacgtctgaaaacaaggaatgggcggcaaaattggtcgattggatgacaaacaaggaatccaacttggaattgagccgttcgatcgccgcgctgcctgtgcgctattcatcagagaaagtgctggcaaaagaattctcagatgaaatgaatgtcttcttgcagcagctgaaagaaacggggcatgcacgaccggtgacaccggcatatccacaggtgacgcgcgcatttcagcaagcgatcgatgacatcagcttctttgatcagcatcaggatattcaatcggttctggatacgcgtgcaaaagaaatgcaatcagccatcgataaggcaaactag

SEQ ID NO: 847 - DNA, 1231 bp, Bacillus licheniformis
atgacatattgtttgacaacgacggccgcggcaatgccgatgccggctccaataagaaagtggcgcagtttcatcctttcagcacctccaaagcttgtttttttcattatacagaacatgtccgtccgtgttaaggatgggctctcttctggaaacacatcgcacacttatgtaaaatgtagagagatacataagaaaagagggaaacagatgaatcaggaaacgagaacgctttttcaaacgcttacggagctccccggcgccccgggaaacgaacatcttgtccgtcgcttcatgaaaaaagagcttgaaaaatatgctgatgagatcatccaggacagacttggaagcgtgttcggcgttaaacatggacctgaaggcagtccaaaaattatggtggccggccatatggatgaagtggggtttatggtcacatcaattacagataacggcctgcttcggtttcaaacgctgggcggctggtggagtcaggttttattggcccagcgggtggaaatccacacggacaacggaccgatccccggcgtcatcgcgagcacgcctcctcatcttttgacagatgagcagaggagacgtccgatggatatcaaaaacatgatgattgatatcggggcggatgacagggaagatgccgaacgcatcggtgtcaaaccaggccagcaaatcgtaccgatctgtccgtttaccccgatggcaaatgaaaagaagatccttgcgaaagcatgggataaccgctacggctgcggactcagcattgaattgctgaaagaactgcaaggaacagaacttccgaacaatctttactcaggtgcgaccgtccaggaagagctcggaacaagaggcgcgcaaactgcggccaatatgatacagcctgacttgtttttcgcgcttgatgcaagtccggcaaacgattcgagcggcgacaaaaatcaatttggccagcttggcaaaggagtgctgttgaggattttcgaccggaccatggtgatggacagcgaaatgagaaattttgtgctggatacggcagagacaaatgacatcccgtatcaatattttgtttctccgggaggaaccgacgccggccgtgttcacatctcaaatgaaggcgttccttcggccgtgattggcatttgttcaagatacatccatacatctgcttccattatccacgttgagatctaccttgctgcaaaagaattgctgcaccaag

SEQ ID NO: 848 - DNA, 816 bp, Bacillus licheniformis
atgcatttatgctggcttttccgctcaccagttttcggatcgatcattgtcgttttaaccaatttgccgtttctcaataaaatgatgagcaaatccgcgcttgaaacgttccagtcggctttaagcatagcgccgagcgcaacgatcagcatcatgtccgttttcgtcgtattcgggatcgggtattatttgtccaaaacttatgaagtcgaagcggtttttggaggagtcgtcgctttggcatcgttccttctgctgactccgtttgtattaaacggcgaaggaggggaagtgattccgaacgtcatcccgattgacaggctcggtgcgaaagggatgttcctcggaatgattaccgcctttacatccgctgagattttcagattttttgtccagaaaaactatacgatcaaaatgcctgccggcgttccgcctgctgtagcaaaatcttttgccgcgctgattccggcggtgatgaccttgtccgtctacttggtgatcaatatccttgtaacccaagcgttcaatacgaatatgcacgatttaatttacaacctggtgcaggctccgcttgtcggtcttggaagcggtatcattccgaccttgattgccatatttttcactcagctgctctggtttttcggactccacggacaaattatcatcaactccgttatggatccgatctggaatacgctttcgatcgaaaatttgaatagctataccgcaacaggagaagtgccgcatattatcaataagcagtttatggaagtctacaccgtcggaatgggcggaaccggcatgaccttggcgtga

SEQ ID NO: 849 - DNA, 612 bp, Bacillus licheniformis
  misc_feature (1)...(612): n = A,T,C or G
gcgaaactagccaggtccacaccattttatccgccatcggcgacggagcattttacttcctgccgattttgctggcggtcagtgccgcgagaaaattcggcagtaatccttatgttgcggcggcgatcggagcggcgattctgcatcccgatctgacagcgcttctcggttcagggaaaagcatttcctttgtcggattgcctgtaaccgctgccacttattcgtcgaccgtcattccgatcctgctcgcgatttggattgcatcttacgttgagaaatggattgacaaagtcaccccgacttcgttgaagatgatttttgtaccgacgctgacgctgctggttgtcgtgcctgtcacattaattacggtcggtccgctcggtgcgattgcagggaactatctgtcaatcggtgtgaacggtttatttgaaaatgccggtttaatcacgatgatccttttagcaggaacgttctcgctgatcgtcatgacaggaatgcactatgctttcattccggttatgttcaacaacattacgcanaacggctacgattacttgatacctgcgatgttcttggcgaatatggggcaggctggcgcgtcatttgccgtct

SEQ ID NO: 850 - DNA, 321 bp, Bacillus licheniformis
ccggtgttatcacttggatgcatactttctcgcctgcgaaaatgtggattcgcggaacaaaattattgcaaaaaccattacttcatttagcgacacaatttaatgaaagtattccatggccaacgattgacatggactttatgaacctcaaccaatctgctcatggcgaccgtgaatacggttttatcaatgcccgtttgaaaaaacaaaataaagttgtcgtaggttattgggagcgacctgaagtgcaacagcaaattgcagaatggatggacgtagcggttgcttataacgaaagcttcaacatcaaggtcgctcggt

SEQ ID NO: 851 - DNA, 653 bp, Bacillus licheniformis
atgaacatgctgattgattcagcgcatataccggagattgaaagattgcttgattcatttcccgctggcggcgtcacgacaaacccggcactgatcgcaagggagaacaagccttttaaacagcagattcaagatattcggcggcttcttcccgagcatctgcctctccatgcccaagtgatcgccgaccattggcgggatatggtcgatcaggcgaaggcactctataactggctagatggaaacgtgtctgtgaaaattccggtgacgactcaagggctttacgcgatcagaaagcttgcggctgaaaatatccagaccaccgggacaacggtttataccgctgcacaggctgtactggcggcaaaagccggcgcctcctatgtcgcgccgtatgtcaatcgcattgatcaagagtatggtaatggcgctggcgttgtcaaaacgattgtcggcttattcaacacaaactgtttaaattgcaaagtgcttgcggcaagctttaaacataaccgtcaaattcttgccgtcatggaagcggggagccatgaggcgacaatcagccctgagcttataagccgtttggctgatcatccggctgtagatcgtgatatccatgcgtttcgtgagatttggcactctcaatatggaac

SEQ ID NO: 852 - DNA, 594 bp, Bacillus licheniformis
cattttagagatgagaggcatcacgaaggagtttcccggcgtcaaagcgctcgacaatgtccaccttcgcgttaaagcgggcgaaatccatgccctctgcggggaaaacggggcgggcaagtcgactttgatgaaggtgctgagcggcgtctatccgtacggtgcgtatacgggcgacattttatataaaggggaagtatgccaattcaaaaatattaagcaaagcgaggaagcggggatcgtcatcatccaccaggagctggcgctcgtcccccagctttccattgcggaaaatctttttttgggcaatgaacaggccagccgcggcgtcatcaattggcgaaagacaaagctggaaacgctcgaattaatgaaaaaagtcgggcttcaagaatctccggatacgcttgtttcccaaatcggcgtcggaaagcagcagcttgttgaaatcgccaaagctttggcaaaaaaagtgcagctcttgattttggatgaaccgacggcggctttaaatgaagctgacagcgagaatctgctgcagctcttgctcgaactgaaaaaacagggaatctcttcgattatgatttcccataa

SEQ ID NO: 853 - DNA, 329 bp, Bacillus licheniformis
atgtccgaggaattggaacaaacgatatttcaaattatccttcacggaggaaacggcaggagcttttgcatggaagcgatagccgaagccaaaaagggagatttcgcagctgcaaaagaaaagatccgggcggctgacgaagaactgatcagggcgcatcactttcagacagctttgattcaaaatgaagcgaagggtgcgaaaaccgaaccttcactgctcatgattcatgcccaggatcatttaatgaatgcgatgaccatgaaagatttggccgcggagattgtcgagctctatgaaaaaatgaatatccacggaggtgtcaattg

SEQ ID NO: 854 - DNA, 332 bp, Bacillus licheniformis
atgatgaatatgaaaaaatatgttggaatcagcagtgtcattgctctcagtttgtctttaactgcagacgggcataaagagagcagcaatggagcatcagactcgaagcaaaaggaactcgtggtctgggaagataaagagaaaagcgaaggcattaaagatgccgtcgcccaatttgaaaaagagcacggcgtatctgtcaaagtcgttgaaaagccttacgcaaagcagatcgaagacttgcggatggatggaccggcgggaacgggtccggatgtgttaacgatgcccggagaccaattcgggacagcggtaacggaaggtttgttcaa

SEQ ID NO: 855 - DNA, 1239 bp, Bacillus licheniformis
atgcatattaaaatgaaggacatttttaaagcctttggccaaaaccaggtgctgtccggcgtttccttcgagcttcaagaaggtgaagtccacgctttaatgggagaaaacggcgccggaaagtcgacactcatgaatctgttgactggacttcacaagctggacagcggaacgatcgagatcgacggaaaagaaacgtatttttcagatccaaaggaagccgaacagaacggaatcgcctttatccatcaggagctgaacatttggcctgaaatgaccgttttggaaaatctgtttatcggcagagagctttcttccaaacttggatttttaaacaacaagaaaatgaaagcgctagcaaaagagcagcttgaaaggctcggtgtctcaatttctcttgaaaaagaagccggagactgttccgtcggccagcagcaaatgatcgaaatcgcaaaagcccttatgacagacgcgaaagtgatcatcatggatgaaccgacggcagcgttgacagaaagagaaattgaaaaactgttcggcgtcattagagcattaaagaaaaacggcgtctccatcgtctatatatcccaccgcatggaagaaatcttcacgatttgcgacaggatcacggtgatgcgcgatggaaaaacggtggacacgaaacggattcccgacaccgactttcatgaagtggtgaaaaagatggtcggacgggagctgaccgaacgctatcctgaaagacagccaaatccgggacgcgtcgtcctcgaagtcaagcaggcatccaaaaaaggagtcttccaaaatatcagcttttccgtccgctccggcgaaatcgtcgggatttcaggactgatgggtgccgggcgcaccgagctgatgagagcggttttcgggctcgatccgcttgactcgggagacattttcatcgaaggcaaaaaagcggcgctcaaaaaaccgagcgatgccgttcaaaagggaatcggctttattaccgagaaccgcaaggatgaaggacttgtgctcgacacgtccatcagagaaaatatcgcccttccgaatctcgccagcttttcgccgaaaggatggattgacaaaaaaagcgagcaggaatttgtcgatcttctgatcaagcggctgacgatcaaaacggaatcgccggaaacccacgcgcgaaacctttccaggaggaaaccagcaaaaagtggtcattgccaaatggatcggcatcggccctaa

SEQ ID NO: 856 - DNA, 266 bp, Bacillus licheniformis
atggcacaaaaaacgtttaaagtaactgcagattctggaatccacgctcgtccagcgactgttcttgtacaaacagcaagcaaatatgatgcagatattaatttggaatataacggaaaaacagtaaaccttaaatctattatgggcgttatgtcactaggtattgccaaaggtgctgaaatcacgatttctgcttccggcgctgatgaaaatgatgctctttccgcacttgaagaaacaatgaaaagcgaaggtttaagcgaata

SEQ ID NO: 857 - DNA, 489 bp, Bacillus licheniformis
aagccgctgaacaaggagccgctccatctgaagcgggcgcgggagagatcattcaaagcccgctgaaaggcgaagtcaaagcattgagtgaagtggatgatgcgacattttctggagaagtcatgggaaaaggcgtcgccattgagcctgaagaaggcaaagtggtgtcgccggtatcaggcacgatcacaaccgtttttcaaacgaagcacgccctcggcattacaagcgacaatggggcggaaattattatccatatcggaatcgacacggtgaaattgaacggcgagcactttaccgtgcatgtcaataaaggcgacgctgtaaaaccgggagacgagcttgtctcatttgatatggatgcgattaaggatgcaggctatcagttgatcacgccggttatcatcacaaatacggaccggtaccagtcgatcaaacctttgaaatcagatgaaagcgttgacattgaggaagcgctgatcgcgctgg

SEQ ID NO: 858 - DNA, 705 bp, Bacillus licheniformis
atgggtccaacgggagccaccggcccgacgggaacaacaggagcgatgggtccaacgggagccaccggcccgacaggagcgacgggtccaacaggagtaacaggttcaacgggagccaccggagcaacgggagccactggcccgacgggagcaacaggagcgatgggtccaacgggagccaccggcccaacgggagcgacgggtccaacaggagtaacaggagcgacgggtccgacaggagtgacgggtccaacgggagccaccggagccacaggtccgacaggagcgacaggtgcaaccggagcgaccggcccgacgggtccgacaggagtgactggagccgccggagcgacaggtccgacaggagtgacgggagcaacaggagtaacaggttcaacgggagccaccggagcaacgggagccaccggagcgacgggtccgacaggagttacgggagcagcaggagcgacgggtccgaccggagccgccggagcgacaggtccagctagtccacaaactgctatattctttaacaatctatttgggtctacttcagtttacaatccaccgactattcctttaaataccgaggtaactgttgtaaacgtccctaatgtgccggtcactagcggtcagaatattaaggtggattatgcgttggcagtagaagcggtgaatactgctaacagtaatgggatcctatag

SEQ ID NO: 859 - DNA, 255 bp, Bacillus licheniformis
atgcctgcatttgattataaccgcgtatttttaatagtaatggattccgttggaatcggcgaggcgcctgatgccgaaaaatttaatgacaaaggcgcagatacattgggccacattgccgaacacatgggaggcatcagcctgccgaacatggcaaagctcgggctcagcaacatccgtgaaatcaaaagcgtcgaaaaagcggaaaagccgcttgcctattacggcaaaatgaaagaagcctcaaacggaaaa

SEQ ID NO: 860 - DNA, 687 bp, Bacillus licheniformis
atgaaacgtatcggagtattgacaagcggcggagattccccgggaatgaacgcggcggtccgcgcggttgtcaggaaagcgatctaccatgacgtagaagtatacggaatttacaacgggtattcaggtttaatcagcggaaaaatagaaaagcttgaaatcggttctgtcggagatatcattcaccgcggaggaacgaagctatatacagcaaggtgtcctgagtttaaaacggtagaaggacgggaaaaaggaatagcgaatttaaaaaaatatggtatagaaggattagtcgtcattggcggcgacggttcttatatgggagccaaaaagctcacagaacacggttttccttgtgtgggagtgccgggaacgatcgacaatgacatcccaggcactgatctgacgatcggattcgatacggcgctaaataccgttattgacgccatcgataaaatcagggatacagctacatcccatgaacgtacatacgtgattgaagtaatgggccgccatgccggggacattgctttatggtcaggtttggccggaggcgcggaatccattttgcttcctgaagcagactacgatgtggaacgaattattgcccggctgcaaagagggcatgagcgcggctcgaaacacagtcttatcattgtggccgttgcgcgtctcccgcggttttga

SEQ ID NO: 861 - DNA, 460 bp, Bacillus licheniformis
atgatctatacatgcacgatgaacaccgcagtcgacttattcgttgaaaccgacgagctgcttcccgatgttgtcaaccgtactaaagatgaagattatcagccaaacggaaaaggcgtcaatatttcatttatgctcaagcgccttggtcttgacaataccgcgcttggctttacaggcggattcaccgggcgttttattgaaaatgaactgctgaatgaaaaaatcgtcacagactttgtcgaagtggaaggcatctcacggatcaatatttttatcaattcaacccgggaattcaagattgtaaacaaaggaccgctcatatctgaagcccgaaaacaggagctgatcaacaaaatccgtcaaatcccgccgggccgcttcttatttatttcaggcagtcttccgagaggagtccctgatgacatgtacctttcgctttccgagattgccgccgaaa

SEQ ID NO: 862 - DNA, 288 bp, Bacillus licheniformis
atggcatcattgatcgcgatcggattcctcatttacggtcccgtcatgctgatcggccttcaagcgcttgactttgttcctaaaaaagcggccggcacggctgcaggattgaccggtctgttcggttacctgggcggaaccttgacggcgaatgcgctgatgggtgttatcgtcgatgcatccggctggaatgcgggctttacgcttttaaccgcttcatgtgcaatcgcagcactcatatttgcgatgacttggaatgtgcggggacaggaagttgtgaagcattaa

SEQ ID NO: 863 - DNA, 237 bp, Bacillus licheniformis
acggccaatttcaagtggtgatcggccaaggaacgggcaacaatgtgtacgcggagctggtgaaggcaacaggaatcggcgaatgggcaaaggatgatgttaacaaagcctgagataaaaatatgaatcctttacagcgggccgtgaaaacgcttgcagatatatttattgcaatattgccggggattgtgactgccgggctgctgatggggatcaacaatatcctgacgggtgaag

SEQ ID NO: 864 - DNA, 254 bp, Bacillus licheniformis
atggttcaacaaaaagtggaagttcttttaaaaacagggcttcaagcgcgcccagcggcattgtttgttcaagaagccaaccgttttcaatcagatatttttctggaaaagggagataaaaaagtgaatgccaaaagcatcatggggctgatgagccttgctgtcagctccggatcggaagtcacgctgatcgctgacggatccgatgaacaagatgcccttgatgcactgactgcatatgttcaagagaaaga

SEQ ID NO: 865 - DNA, 576 bp, Bacillus licheniformis
atgcaaggctgggaagactccaatttaacggctttgggactggcaaacgcaaatgccctcggcgaacggctgaaagatgttcaattccaagccgcatattccagtccaagcggccgggccgttgattctgcgcgggctatgctgcagaaccgcagcattccctttataacagacgacagattaaaagaaatctcgatcggccgctgggaagggaaaacgtatgatgagatcaaacaaagtgatcctgacttgctggaagcgtattttaatacgcctgaaacatatatgcccgatgaaagcgagagcttttacgattttgaaaggcgggtcagtcaggcgtatcaattcattctccgccgccatcgggaaggcaatgtcctcattgtcagccattccgtgtttatattgatgctcttgaatcttataaaaaagaggccggtcggtgaactatggaactcaagctatgttcatgacacagctcttgcggttgtaacggtttccgaggatggaagcgccgcgattgaaagagaaggagacggtgaacatagagtagaagcaaagaatgccacctggtag

SEQ ID NO: 866 - DNA, 237 bp, Bacillus licheniformis
cacttcgatgaccggaagctggctcgccatcgtgcaaggatttgccggcatgcgcactcaggatgagaagctgtcttttgctccgtttctgccgaaggaatgggacggttattcgttcaacatcaattatcgagaccggctaatcaatgtgcaggtagaggaaaacagcgtcgttttcagtcttttaaaaggagaaccgctttctatgacagtttatggagaacagatcgcactgaa

SEQ ID NO: 867 - DNA, 429 bp, Bacillus licheniformis
ttttcagcaagtcggcgctgtccgttattatttgccaaaaggcacgtggacacaccttttgacgggaaaagagacggaaggcggagaatggaaagaagaacggtacggctatatgaggcttcccctgttcgtcagggaaaacacactgctgccgctggggcaggaatccgggcgacctgattatgattatctcgacgatgtgacgttctgcctctatcatttaaaagacggctgtacagccgaacagacgatttacaatgaaaagggcgaagcaatgacactcagagcttcacggcatcaaaatacgattgccgtgaaaacaacgggcgtccaaaagaactggaagctgctcctccgcggtctttctgtcacctctgttattaacggagctgcggaagcgcttcaggagggaacagcggttcagccaaa

SEQ ID NO: 868 - DNA, 254 bp, Bacillus licheniformis
atggcgaaatacagaggttatatcggaacatatacaaaagcagacagcgtagggatttatacatttgagcttgatacggaaaaaaaggcgttaagcacgccgaagccggcagcaaagctgggcagtccgacatatttgaatatcgccaaagacaatgacatgctttatgcagtggtcaaagacggcgataagggcggggttgccgcatatcgtattgacggttccacaggagagctgactatcgtcaaccagca

SEQ ID NO: 869 - DNA, 309 bp, Bacillus licheniformis
taacaagcagcaatcacggggaggtggcaaaagaatattcatactcagaacatgcaatcgttccggatattttgatcatgaatttggacaaaaaggatcaattaagcgaagaacagcagaatgcggtgatcgaagcggcgaaagagtctactgagtatcacaaaatcgtttgggctgaagaaactgaaaatgcggttgagaaagcaaaggaaatgggagtgaagttccacaagccagacaagactccattccgggatgcggtaagcccgcttcatgatgagtttgccaaaaaagaattgatcggaaaat

SEQ ID NO: 870 - DNA, 309 bp, Bacillus licheniformis
aattggaacaggtctcatttgaaatcatccttcacgccggaaatgcgcgttcttctgcaatggaagcgttgcagcttgtgaaacatcacgaatgcgaaaccggttatcaaaagatacaagaagcagaatcggagctgaaccaagcgcatcaggcacaaacccgcctcctgcaaaaagaagcacagggcgcaggcctttcacccaatctattattaatccatgctcaggaccatttaatgacagccataactgtaaaagatttggcgaaagaaatgattgatttatatcaagagcttgggaaaggaagag

SEQ ID NO: 871 - DNA, 195 bp, Bacillus licheniformis
atgacatcgattttgtgatttttctgagagacccgctgacggcccagccgcacgaacctgacgtgtcagcgcttatccgcttgtctgacgtttatgccattccgctcgccaccaacatgggaactgcggaaatcttgatccgttctgtcgaggaaggcgcgtttgagttcagaaacattgtccacggcagggatc

SEQ ID NO: 872 - DNA, 282 bp, Bacillus licheniformis
atgaagatattggcagtttgcggatcaggactcggaagcagttttatgctggaaatgaatattaaggatattttgcaggaaatggggttaatggagatcgaggtggatcattcggatttgagttcagcgtctcctgatcaagcggatttgtttatcgttgccaaagatatcgcagaaggagcggcccacctgcgcgatatcgtcgtgcttgaaagcattatagacatggatgaactgaaaacaaaactggttaaaacattgcaggaaaaaggagtgctttaa

SEQ ID NO: 873 - DNA, 516 bp, Bacillus licheniformis
atggatcagtctatcaaaacggtcatctcagtctgcgactatatgaaagcgaaaaagaacagcaagaaaacgattcacatttcatatgatgagtggaatgtctggtatcactggaatgaaaaagacaaagaagctgaacgctgggtgatagcgccgcacgttcttgaagacatatacaactttgagtatgcgcttctcgtcggctgtatgctgattacgatgctcaagcacgccggccgcgtgataatcgccagtgtggctcagcttgtcaatgtcatcgcgccgattatcacagacaaagggggagaagcatggcgtcagaccattttctatccgtttaagcacgcttccgtatacggcagaggaacggtactgcagacggcggtatcgtctccaaagtatgatgcgaaagactttacggatgtcccgtacttggagtccgtgtctgtcttcaatgaagaagccgaggaattaaccgtttttgccgtcatccgcgcacacagacgccggccttga

SEQ ID NO: 874 - DNA, 237 bp, Bacillus licheniformis
agtaagtgcaagcgctttagaaagtttttcagaggtctactccatcttcagcttgccttatttatttgacagcaaacatcatttctatgaagccatggacagtgatattgcaaaagaaatgtatgatacaacgaaaaacatagggtttattggattaacctactatgatgcgggattacggaacttttacacaaagaacaaaccgattatgcacccaaatgaccttaaaggtataaa

SEQ ID NO: 875 - DNA, 420 bp, Bacillus licheniformis
ggtcgaggagcttagaacgctccgccaaaacgaaaaaaacgcggcaatatcgcttaatcaaggcaccgaaaaattggacattgttcaaccggacaaagctgagcttttcatcagtccgaaagttattgaagagggttttgagatttccttcaggggtgcagcccgactcatatacaataaagcagaaggcatcataaccttggagagaaacagttatgttgatgaaaaaacggaagccagacagtgccgtttgcaggagcttcgcaatttaaacatctttttagacgcctcttctattgaaatcttcgtcaatgagggagaggaagtctttacggcaagatattttccttacccgggaaataatgatgtttggatcagtgccagaaaagaaatcataatgaatgtgacatcctggacaat

SEQ ID NO: 876 - DNA, 295 bp, Bacillus licheniformis
atgaagatcgcacttgtatgttcagccggaatgtctacgagtatattggtaaaaaaaatgcgggaagaagcggaaaaccgttcattgaaggcggaaattaatgcgtatgctgaggcagatttgccaagcgatctggatgaaattgatgtgatactgattggtccgcaggtccggtatttaaaagggcaaatgacagagcgtgccaagccgtatcatacacccgtggccgtcattgaccaaatggcttatggaatgatggacggggcaaaagtgcttaatcaagcaatcagccttg

SEQ ID NO: 877 - DNA, 444 bp, Bacillus licheniformis
tttacagccctttgcaaggagaagtcctgccgttaacagaagtatcagataaagtgttcgcatcgggggcgcttggagagggaatcgcggtggttccgtcaaaaggcgttgtcaccgcccctgcggacggcatcgtgacaacggcatttccgacgggtcacgcatacggcataacgaccgaaagcggagccgagattttgattcatattggaatggacacagtcaggctcgaaggaaagcacttcaatcctaaagccgtgcaggggcaaaatgtgaaacggggtgatatactcgcagaattcgatctggacgctttgaaagaagaagggtttgacgtgaaaacgccgatcatcgttacaaattccggtcaatacacggatgtcattccaacggatcaaaaaaaggtgaaaactgaagaacggatcatcactttaatttcatcac

SEQ ID NO: 878 - DNA, 294 bp, Bacillus licheniformis
tcttattagcttgcgccgcaggaatgtcaacgagtctgcttgtgacgaaaatggaaaaaagtgcagaggaacaaggaaaagactataaaatctgggccgtttccggaggagaggttcagaatcatatcgataaagccgacgtattgcttcttggcccgcaagtccgttacatgctcccgcaattaaagaaattaggagaatcgaaaggtgtatccgtcgatgtcatcaatacggtccattacggaacttgtaatggagctgaagtgttaaaatccgccgaacagcttgccggct

SEQ ID NO: 879 - DNA, 282 bp, Bacillus licheniformis
  misc_feature (1)...(282): n = A,T,C or G
taatgaagaaaattttattggtttgtgcggccggcatgtcaacgagcctgcttgtcagcagaatgaaaaagcatgcagaggcgctgaacgaagaggtcgacatcattgctctgcctgtatccgaagcggggactgccgcgtcaagcgcggacgtcgtattgttggggccgcaagtcaggtaccaaaagtcacangttgaggcgagcgcaggagacacgccggtccaggtgatcgacatgcgagactacggcaccatgaacggcgaagctgtgctgcaaaaac

SEQ ID NO: 880 - DNA, 297 bp, Bacillus licheniformis
  misc_feature (1)...(297): n = A,T,C or G
tgttgttggaaaaaaacgaaagacgcgtttttgggaaaagcttctccagcaaaaatatttatatttgatgattttgccgggactgatttattttttgctttttaagtatgtgccgatgtggggggattgtcatagcgtttcaggattaccagccgtttctcggcataacggggagcgaatgggtgggctntaagcattttgaaaagctgtttaccgaaccgacgttttttatgctgttgaagaatacattgaattttgtttttctcaactttggtggattcttttcgataccgatta

SEQ ID NO: 881 - DNA, 180 bp, Bacillus licheniformis
agatgatcggcgcatttttaggagcggtgctcgtttttcttcactacttgccgcactggaaagaatccttttatcaaggcgcgaagcttggagtattttcgacaggtccggcgataccaaatacatttgcaaacctgttcagtgaaacattggggactttaattcttgttctcggacttt

SEQ ID NO: 882 - DNA, 2513 bp, Bacillus licheniformis; identical to SEQ ID NO: 724

SEQ ID NO: 883 - DNA, 429 bp, Bacillus licheniformis
atggattgcggacgtttattgacaagtatttttggcggacgcataacttccgttgcctttctgatcttcagcgccggagccttgactgtttcgcttttgattctcgcgtggtttccggttcatcaaacacagctgctcctcgtatttttcatcgggctgtcggcagccggcatttttccgtgcgccgtcactcttgcctcgttggctggaaagccttttacagaggaaatcacgagtctcttcatttcgtccgcaagtctgggaggagcgcttctttcattcttgatcggctgggcgattgatgcaagcgcagccgctgtcttcccgtttttgctgttcggcggattggggggcttgctgctggcgatcagcgcggtgatttttttatccggcctgcaaaaaaacaagcagagtcatttggatatgtag

SEQ ID NO: 884 - DNA, 402 bp, Bacillus licheniformis
atgaggagcaagcagatgaagcaggtcgcaaaactcggagcagccccgggaattttcaacgtaaatgaaccgatcattttcggtctgccgatcgtcatgaacccgctcatttttattccgtgggtcatctcgccgatgatcgtcactttgattacgtatttcgcgatggcgtccgggcttgtaccgccgccgaccggggtcacgattccttggactgtgccgatctttatcagcggaatgatggcgaccaattcgcttgccggcggcattcttcagattgtgaatttagccgttgtctttatgatctggttcccatttttgaaattcatcgaccggatgaatatgaaaaaagagcaggagatcaatgaagcggaacaagaaaagacaacactaggactttaa

SEQ ID NO: 885 - DNA, 465 bp, Bacillus licheniformis
ggctgaaaagagggcatgagcgcggcaagaaacacagcatcatcattgtggcggaaggcgtcggcagcggcgttgaattcggaaaaagaattgaagaagccacaaatctcgaaactagagtatcggtgcttggacatatccagcgcggcggttccccgactgcagcagaccgcgtattggcaagccgtctaggggcatttgcggttgaactgcttcttgaaggaaaaggcggacgttgtgtaggaattcaaaataaccagcttgtgcatcatgatatcattgaaatactcgagcaaaaacatacaattgatcaaagcatgtaccgcttgtctcaagaactgtcaatctagtgtaaaacccgaggaggaagcaatatgagaaagactaaaatagtttgtacaattggaccggccagcgaaagtgttgaaaagctcacccagctgatggaagccggaatgaacgtgg

SEQ ID NO: 886 - DNA, 351 bp, Bacillus licheniformis
atgcaacatttaaaaaaaggaattttagtgctgctggcgtcagttctgctgttcggtcttgccgcctgttcaagttcaaaggaaacgggaggcagcggcgggaaaaaagtgctgaccgtgtctgtagaagaggtctataaaccttacgtcgaaagcataaaggaaggttttgaaaaagagaatgatgtgacagtcaaaatcgttgaaaagccgatgttcgaccagcttgaagcgcttccgcttgacggtccggcaggcaatgcacccgatgtcatgcttgcggcatacgaccgtatcggcggcttaggacagcaaggtcatttgctgggagtcaaaccgtctgacacataa

SEQ ID NO: 887 - DNA, 270 bp, Bacillus licheniformis
aagagaaagaatttgacattgtagcgatcggccgcgcatgcatcgatttaaacgcagtcgaatacaacaggccgatggagcagacgatgacattttcaaaatatgtcggcggctccccggctaatattgcaatcggcagttccaaattaggcttgaagaccggatttatcgggaagattcgggatgaccagcacggcagattcatcgaaacctatatgagaaatacagggtgtcgatacgtcacaaatgggcgggtgataaagacggaca

SEQ ID NO: 888 - DNA, 234 bp, Bacillus licheniformis
aagaggaggtactcatatggattataataaagtatcgaaggacattttacaactcgtgggcggtgaagagaacgtacagagcgtgattcactgcatgacaagactgcgtttcaatctttatgacaatgcgaaggcagaccgcgcgaaactggaaagtcttccggctgtaatgggcaccaacatcagcggccagcagtttcaaatcatcatggaaatgatgtccaataaggtgta

SEQ ID NO: 889 - DNA, 321 bp, Bacillus licheniformis
atgcagcttagaaaagaatttcgtagccttaatcgaaaaagaagcaaggagagagttatggtgttagtaacaaaatcaacagttcggctcccccgggggcttcaggccaggcatacgaccctatttgtccgcaaagcgatttcattcaaaagtgaaatcgtactcgctaaaaacgggcagacagcaaacgggaaagatctgatggaaatcgttcaattaggagtgcaagaaggggatgagatcacgttaatggtctatggtacggatgagcaagccgcaaaggagactttggaaaaatttcttttgaatgtagtgccataa

SEQ ID NO: 890 - DNA, 315 bp, Bacillus licheniformis
atgaatacaattttactgcgcatgcatcttctgacaatgttctacacagtctcctggcttaccaatatgcaggaatacgctcattcaatctgtgacaaggcaaaaatttgggcggacggacacgaccatgccaaaaaccagatggcatatgccaacctcgctctcatcggcccacacatgaacttcttaatatgcgatctgcacaacgaagctgaacagtacggtcttaacgctgatgtcattcatatgctggcttacggaatggctgatggaaaaacagcttatgaacacgcgctcagcctgatcggggattga

SEQ ID NO: 891 - DNA, 303 bp, Bacillus licheniformis
atgggtgcgaaagatgttgtcgaaagcgatggatcgatccatgatgactatcgtattagctatttcagagagcatttccgtcagatgaaagaagccattgaagaaggtgttgatctctttggatataccagctggggacccattgacattattagtgcgggaacatctcaaatgtccaaacgatatggatttatccatgttgatcaagatgacgatggcaacgggacattgaagcgctcacgtaaagattcattctactggtataagaaagtgattgagacaaacggagaagtattagactaa

SEQ ID NO: 892 - DNA, 561 bp, Bacillus licheniformis
ttgtatctccggatcttttggccgataccaatctactttcccactagcacggatcaagtcacaggcgctgggttgaataaacacaagtcattggagagtccccaatgttccgcccatgttttccttccgcttgcgacgtcaagtatcgtccggaagatttcccagccgacttcctctattgaagcttcgcctgtagcgatccttccggcattgacgtcgatcaagtcgtgccaatcttctgataatgactgccgggtcgccactttcaaaaccggagccatttcaaggccgtacggcgttccccttccggttgtaaatacctgcaaatgcatgccagaagccaattgcagggtgccgcatacaaaatcgcttgcaggtgtcgccgcaaaaatgagtcctttctgtacagccctttcaccgggcgcaagtacggcactgatcgggctgcttcccgacttcgcgatcgacccgagcgatttctcgaccacgtttgccagtccgccttttttgtttcccggcgacggattggcgcttcggtctgattcgcctctttccagatag

SEQ ID NO: 893 - DNA, 1368 bp, Bacillus licheniformis
atgagcgatgagaaaaaatatgccgggctggcaagactgattttacaacacatcggcggcccgtctaacgtcgcagatcatacccactgtatgacgcgcctgcgcatcacgcctgtcaacagtcaaaaaaccgacatcgactcgatcaaagcgcttgaaggcgtgatcggcgtagttgaggaggaaacgcttcagattatcctcggcacaggcgttgtacagcacgtatcagacgagttcgggaagctgcttaaatccgcagaacacgttgacttaaaagaatccgcagccaaacataaagcggagatttccaagaaaaacgcgacgcctttcaagctgtttctccggcgaatcgcaagcatttttataccgctgatccccgctttggtcgcctcaggcttgattaccggaatcaccaaagccgttatccaggctggctggctcgcggaaacctcacaaaccgcgattattttaacggtaataggctcaggtctatttacgtatttgggtatcctggtggggatcaatacggcgaaagaattcggcggctcccccgcactcggcggattagccggtattttaatcattaaccccgccgttggtgaaatttcacttttcggtgaagcgcttttgccgggacgcggcggtttaatcggcattttattcgcagctgcatttatcgcttttctcgaaaaacgggtcaggcgccttgtacctcactcactcgacatcatcatcacacctacagtctcccttcttatcacaggaatcgtcacctacgttgtcttcatgcctgtcggcggcttgatttccgacgccattacgtcaggtcttctcgccatcttagatcttgggggcattatcgccggctttgtactgggcgccaccttccttccgctcgtcgtaaccggacttcatcaaggactgacacccgttcatatggaattaatcaattcaatcggcgatgacccgctgctgccgattttggccatggggggcgcaggacaagtaggcgccgcttttgcgatctatttcaaaacgaaaaaagcaaagctaaaaagagccattgccggcggactgccgtcaggcctgctcggcatcggcgaaccgctcatattcggtgtaacccttccgctcggacgtccgtttttaaccgcgtgcctcggggccggagtaggcggagcatttcaagcgtatttcaaaattgcgaccgtatcgataggcgtatcagggctccctttgtcgtttttggttcatacccaccaagttcttttgtatattctcggtttgtttatttcctatgctgccggctttgtcttaacatactcctttggtttcaaggacgatatggcagttgaatttgattaa

SEQ ID NO: 894 - DNA, 264 bp, Bacillus licheniformis
atgtttcgttctgttcgaattctccctcgcgaatcgcaacgttcacgcgcgtcagactttggtaaacgatccggcctgcgccgatattcagatggccgacttccgagttgcccatctggccgtctggaagacctaccgcttctcctgaagctgtcagcgtctggtgcggatacttgttccaatagcggtcaaagttcggttttttcgcttgggctacggcgtttccgacggtttcgtcccttagtccaaacccatctaaaatga

SEQ ID NO: 895 - DNA, 192 bp, Bacillus licheniformis
aacgaacagcaccgttcagcttgttgcgaaagtgatggaaagttcaggtgacgttgtgttcaccaacttggcgctccttttcgctgtcggggttgccatcggtttggctaacggcgacggcgttgccggaatcgctgctattatcggatatcttgttatgaatgtcacgatgagtgcagtgctccttcaaaa

SEQ ID NO: 896 - DNA, 853 bp, Bacillus licheniformis; identical to SEQ ID NO: 746

SEQ ID NO: 897 - DNA, 1138 bp, Bacillus licheniformis
atgtcaatcctacattagggatcaccaaagcatttgctgacagaggcgacaatgtgcactatctttcaacagaaaagtataaagacaggctggagggcgtcggagctaccgttcatttatacaaagatctggtgagaaacgcgcatattgatccgaattcaccgtccggccttcttgaatttttaaaaattcatctcaaaacctcgctgtatattctagacattgtaaaagagctgtccaaaagcatttcgttcgatgtcgtgtattatgacacattcggtgcgggtgaattggtcagggattatttgaacattccgggaatcgcttcgtcggcttcatttctcttcggacaagaacataagaagattctgccgttgcatccggattcaggcgcggagctgcacttggacaaagaatgtgaggacctgcttgcggaactgaaagaaaagtacggcgtctcgcctaggcatacaggacagtttatgagcaatcaggcggagctgaccgttgtgtatacaagccggtattttcagcctgacagcggccgttttggggatgatgtgctgtttatcggcccgcgttttccaaagcgcctggacaagaccgattttccggtagaatcgttgaagaatgagaaagtcatttatatttcaatgggaaccgtacttggcaaaactgcggattttttcaatatgtgcattgatgcttttcgtgatttcgacggcaaggttgtcatcgccgctggcgaaaaatcggactacgcggaaattaaagaagtgccggagcattttatcatcgccccgtatgtgccgcaattagaggtgcttaaagaggccgatgtgttcatcacgcacggcggcatgaacagcgtcaatgaaggcatccattaccgtgtcccgatggttgtgcttccgcatgataaagatcagccgatgatcgcccagcgcttgaaagagctgaatgcgggatatcctctgtttgcagaagaagtgaatgctgaaagattgagagatgcagcagaacaagtgctcactgacggaaaatatcaggaaggtattcaaaaaattgatgaaagcttcagcaactgcatggacattaaagatgcattggcgcgtattgatgaatatacggcgcggaa

SEQ ID NO: 898 - DNA, 636 bp, Bacillus licheniformis
attgcctaacgcttttcaaacttacagcgaaacatttgatagaccggttgttttttgttggcactcttatcttggcaaactcaaggctgaggataaagatactccgattattaccgacagccggcgtcctgtcatgctgatatctttagggacggcgttcaatgcctggccggaattttatcatatgtgcatagaagcattcagggacacgaagtggcaggttatcatggctgttggcacgacaatcgatcctgaaagctttgatgacatacctgagaacttttcgattcatcagcgcgttcctcagctggagatcctgaagaaagcggagctgttcatcacccatgggggtatgaacagtacgatggaagggttgaatgccggtgtaccgctcgttgccgttccgcaaatgcctgaacaggaaatcactgcccgccgcgtcgaagagcttgggcttggcaagcatttgcagccggaagacacaacagcagcttcactgcgggaagccgtctctcagacggatggtgacccgcatgtcctgaaacggatacaggacatgcaaaagcacattaaacaagccggaggggccgagaaagccgcagatgaaattgaggcatttttagcacccgcaggagt

SEQ ID NO: 899 - DNA, 1140 bp, Bacillus licheniformis
  misc_feature (1)...(1140): n = A,T,C or G
catcaatccttctatcggcgtcacaaaggagctgcaaaggcgaggggaaagcatcgtatattatgcagttgaggaatacgctgaaaaaattaaaaaaacaggcgcagaagtccgtttatacccggatttcagagaggttctatcacccgggaagaaaaaagaaaagatggactttgccgaagtggtttacaatatgtcaagtaaagtcaatgagatcgttcagttcatctaccgggaagtcaagagtgaatcttatgattatgtgatatatgaccatcacttcttagcggggaaaattattgctgaaatgcttgagctgccgagcgtttcgttatgcacgacatttgcaatggacgagcagtttgcaaaaacgtttaccccgcaaggcgaccttgaaagctcgccttattttgaaaaattgaaaggatccctcggcgaattaagtgagcggtatcctgtcagtctcgacaagccgtttgacgtattctcctgtccgggggatatcacgattgtctttacttccagagcgtttcagcctcatgccgaacgatttggaagtgactatttgtttgtagggccgtcgattgcgagcaggcaggatccgggaagcttcccgttcgccgagctggagggggaaaccgctantttgatctcgatgggcacgatctttaatcagcaaaaagagctgtatcatatgtgtatcgaagcgctgaaagactttgacggcaaggtggtcatgtctgtcgggaaatcaacggatcctagggatctcggcagcataccggatcattttatcgtgaggccgtatatcccgcaattggaggttttgaaacaagctgatgtatttgtcacacacggcggtatgaacagtacaaatgaaggcctttactttgatacaccgctcatcgtcatcccgatgggggcagaccagtttttcgtcgctgatcaggtggaacgtacaggcgccgggatcaagctggacaaaaatgaactttccccggctgttttacaaaaaacgattaaagatatgcttgaaaaccgctcctataaagacgacgccgccaaaatcggccgctcgctccgcaatgccggcggctatcaaaaagcagcggatgccgtattggagttggcggggagaaa

SEQ ID NO: 900 - DNA, 555 bp, Bacillus licheniformis
atatcgcgatttttaatattccggctcacggccatattaatccaacgctagctttaacggcaagccttgtcaaacgcggttatcgggtaacatatccggtgacggatgagtttgtgaaggctgttgaggaaactggggcagaaccgctcaactaccgatcaactttaaatatcgatccgcagcaaattcgggagctgatgaaaaataaaaaatatatgtcgcaggctccggtgatgcttatgcaagaactggacgaggttcttcctcagctagaagcgctctatgacaatgacaagccaaaccttgtgctttatgactttatggccatggcgggaaaactgctggctgacaagtttggaatataggcggtgcgtcttttttctacatgtgcgcagaacgaacattttacatttaaatccatttgtgaatagggtaagatccacctgccgtctgtccaagacgatgcttgtaacaatgcggctgttccggggttgaactgggaggatgtggtgcggccttctggattgaacatggactttatcccctgttgctttt

SEQ ID NO: 901 - DNA, 1347 bp, Bacillus licheniformis
atgccattattaatcgtagcaatcgggattgtcgcattattgcttttgattatggggttaaaactgaatacgtttgtttccttgattatcgtatcgttcggtgttgcattggcacttggaatgccgtttgacgacatcgtcaaaacgattgaacaaggccttggcggaacgctcggccatatcgcattgatcttcgggctcggcgccatgctgggcaagctgatcgcggattcagggggcgctcagcgcattgcgatgaccctcgtcaacaaattcggggagaaaaacatccaatgggcggtcgtcatcgcctcctttatcatcggggttgctttattcttcgaagtcggattggttttattgattccaattgtattcgcaatttcaagagaattgaagatttctattttatacctcggaattccgatgacggcggccttatccgtcacacacggcttcctgcctccgcatccgggaccgacggctatcgcgggagaactcggcgccaatatcggggaagtgctgctctacggtatcattgttgcaattccaaccgttcttttggccggacctttatttacgaaactggcgaaaaaaatcgtaccgcaatcatttgagaaaatgggcagcatcgcttcactcggtgaacagaaaacgttcaagcttgaagagacgccagcctttggcatcagcgtcttcacagctatgcttccagtcattatcatgtcgatttcgactattattactctcattcaagaaacaatgggacttgcagacaacagcttcctggcagcgattcgtttaatcgggaatgcctcgacttcgatggtcatctccctgttgttcgcgatttatacgatgggtatcgccagaaagatcccgatcaaacaagtgatggattcctgttcaaccgccattactcaaatcggaatgatgctcttgatcatcgggggcggcggcgcattcaaacaagtcttgatcaacggcggagtaggcgactatgtagctgaattattcaaaggaacggccatgtcgccgatcttgctcgcctgggtcattgccgcgattctgcgaatctctttaggttccgcgacagttgctgcattaagcacgaccggactcgttcttccgatgctcggacaaagcgatgtcaatcttgcactggttgtgcttgcaacaggggcaggaagtgtaatcgcttcccatgtcaacgacgcgggcttctggatgttcaaagagtatttcggcctgagcatgaaagaaacattcgccacctggacactgcttgaaacaattatcgcggtggccggattaggatttactttattgttaagtctatttgtataa

SEQ ID NO: 902 - DNA, 1248 bp, Bacillus licheniformis
aatcaatgcaataggcgccttatgcgcattagtcatatcaatctttctcattctgaaaaaagtcccgccggcttacggcatgatgatcggcgcattggccggaggcttaatcggcggcgcagatttaatagagacgacggatctcatgatagcaggtgctaaaaacatgattcccgcggtgctccgcatcttggcggcaggcgtgctcgccggcgttctgattcaatccggctccgcagcggtgattgcggaaaccattgtcaatcagatcggagaaaaaagggcgcttcttgccttaacattggcaacagccatcttaacaacggtcggcgtattcgttgatgtcgccgtcatcacagtcgctccgatcgctctggcgatcgcgaggcggacctttatcagcaaagcggccattctgttggcgatgatcggcgggggaaaagcgggcaatatcatgtcgccaaaccctaatgccattgccgcttcagatgcctttcacgtccctttgacatccgtgatggccgccgggatcatccccgctattttcggattgggcgccacttacttgctggcaaaacgcctttcaaataaaggaacaaaagtagctgcaaatgagattgagacccaaacggcacaacaactgccggcattttgggcggcggtcagcggccctgtggtctctatcctgttgctcgccttaaggcctgcggcaggaattacgattgatccgattatcgctctgccggctggaggcctcgtcactgcgatcgcatcggggcaagcaggcaaactgagggattttgccgcttcaggactgtcaaagatgtcaggcgttgccgtgatgctgctcggaactggaacccttgcaggcatcatcgccaactccaaactcaattctttaatcaccgacacccttgtcggcttgggtctgccgtcgtttctcttagctccaatctcgggcatgctgatgtcaatggcaaccgcctcgacaaccgccggcaccgctgtcgccagcagtgtattcggcccgacattgcttgatcttggcgtcgccggcctcgcaggtgcggcgatgattcacgccggagcaacggtgctcgaccatctgcctcacggaagcttttttcatacgacgggaggcagcgtattcatggccatgaaagaacgattaaagctgattccatatgagtcggtcatcggcttaatcctaacgattatctcgactttgatttttggaatttttcaatt

SEQ ID NO: 903 - DNA, 1572 bp, Bacillus licheniformis
aaggaaatatgtcactgcttatcatattaatggccggcttgtttctggccattttaaaccaaacgctgctgaatgtggcgatgcctcatctcatgacagagttcaatgtgagcgccacaacgattcaatggctgacaaccggatatatgcttgtcaacggcgttttgattcctttatcagcctttctgattatgcggttcggcggacggagcctgtttttaacggccatgctgctgtttacggccggaacgctgatatgcggaatttcgcctaatttctcgacgatgttaaccggacgcctcattcaggcagtcggcggaggcatacttcagcctttggtcatgacgacgattctctttatctttcctccggaaagccgcgggaaaggaatggggatctttggccttgcgatgatgtttgctcctgctgtcggtccgactctatccggctgggtcattgaaaactacagctggcggatcatgttttacagccttgtgccggttggtgtcatcgtcatcattttcggttttttcctatttaaaaatatgacggaacctaaaaaaatcaaattggatacagcaggcgcgattctttcagtcgtcggatttgcggcgttgctgtatggcgtgagcgaagccggctcagacggctgggatgatccgatcgtactttctacagttgtgatcggtgtaatcggcattgccgcttttatcatccagcagttgaaatcgaaagaaccgatgcttgacttcagagtgttcaaatacgatatgttttcactgtcaagcgtgatcaacgccatcattacggttgctttgtatgccggaatgttcctgattccgatttatttgcaaaacctggtcggttttacagcgcttcagtcggggcttcttatgctgccgggcgcactcgtcatgcttgtgatgtcgccgatctcaggaattttatttgataaagtcggcccaaggccgctggcgattgtcggtttattgatcaccgttgtgacgacctacgaatttacgacgcttacgatcgatacgccgtatatgtacatcgtgctgatctatgcgattcgggcgtttgggatgtctatgctgatgatgccgattatgactgccggcatgaaccagcttccgcagcatctaaacagccacggaacggcgatgtcgaatacgcttcgccaaatcagcggttcgatcggaacgagcttgatcacgacgatttatacgaatcgtacgacattccactatgcatcaatggccgatcagacaaatacggctgatccgtcatttatgagcacattgcagtcaacgattcagtcaaccgcgcaatcgatgcatatatctctcgaacaagcacaacaatatgtcgtgaaatatttgaccggacaggcgcagctcaactcgaacgtcatgggtattaatgacgcgtttatgtgggcggccgggttctgtgtcatcggtctcgttctcagcctgtttttgagggatgtcagaaaagacaagctgcgcaggaagaacaaagcgcaggagctgacattgcttccggctcctaaagaagcgaaagaatctt

SEQ ID NO: 904 - DNA, 1299 bp, Bacillus licheniformis
gagcaatggaagtgcagcagtctcaccattcaataaacgaaccgtcgcagcagctttggcaaattacattgatgcaggctccattgtcgcaggatcggcaggattatctttatgggtcagttacctgaagctttctgatacacagatcggactgctcggcgcatttagcgccaacgccatttcggcagcaatcggagcgctgctcggaggctttttggccgacaaaattggccgaaaggctgtctatacgaacagtatgctggtttatgcactgggcatttgtttagttttattcggcaccagcttcccctttttgttaagcggttacattattatcggtttatcggtaggagctgatattacggcttcctggacgatcatcgcagagaacgcacctaagaaaaacagggcgcgtcattgcggggttgcacaggtcgcatgggctgcgggagcggttgtggttctgctgctgtcggtcctgctcggtgatttaggcttattgggcaataaaatcgtgtttgggcatttgctcgttatcgcactgattacttatgttctgcggaaaaggctgccggaatccgatgcctggcaggatcaatccgaaatggctcaagccgtcaggaagccgaagacgccttatctcgatttgcttcagcctaagtatttgaaaagcattttattcttaatgggcgtgtacttggtttggaatctggctgcaggtgtcatggggttttttatgccttacatttatcagcaggtcggcgatgtatcagcgaccatggcaaatattttgcagatggggctgtttattttcaccgggcttggcgtcgcttttatcttcatgccgtttgcagacaaatacaggaagacagtgtttgggatctccgcatttgcggcggtgatcggctggtcattgtttctgcttccggcagagggcatgccgattctcatcctctttatcgtgatgatcggcataaacaacggggcggggcaacaggccaactatcaattatgggcgagtgaaattttcccgacggaatatcgcgcatctgcacaaggattgatgttcttccttgttcgtatctcaatcggggcttggagccttttcgttccaatgatcatctcgaattttggaattgcatttatggcggccattctccttggatgtgtaacggccagcatgctcatcgggctcttttttgcaccgaatacatccggtaagtcgcttgaacaaattcaggaagagctgtatgggactcctccggctcaagctgggcaagtgcaaacaagaaaaattat

SEQ ID NO: 905 - DNA, 1206 bp, Bacillus licheniformis
atgcttcataatccagttggaaaagagaggttggcattggcttttctgctcggaatgcttgccatacttggacctcttaatatcgatatgtatttgccgagcttccctgaaatagcggatgacctgggagccggtgcgtcgcttgtgcagctcagcttaacggcttgcttgatcggccttaccatcggccagctcgtgattgggcctgtgagcgatgcgaagggaaggcgaaaacctttattaatttcgatttcgctgtttgcgctgtcttcactgttttgcgcgctgtcgcctaatatcgcgacattagtgcttgcccgttttttacagggatttaccgcttcggctggaattgtgctgtcgcgcgccattgtacgggacgtgtttacagggagagagctttctaaatttttctcgcttctaatggttatcaccgcggttgcgccgatggtcgcgccgatgacggggggagccatcctgcttttgccgttcgctacttggcatacgattttttatacgctggcattgatcggattgttactagtactcgttatctcgatgaaattgactgaaacattgccgcccgaaaaacggattccaagctcaatcggttcgtctctcaaaacgatggggagcttgttgaaggatcggtcttttatcggctatgcgctgactgtcggtttcattcacggaggcagctttgcctacgtatccggaacgccttttgtatatcaggatatctatggggtttctcctcaggtgttcagcgtgctgttcggcattaacggcctcgccattatttcgggaagctttatcatcgggcgattcgggggaatcattcatgagaggaagctcttgcggatcgcggtcattaccgctgtcatcgcgacatccgttctcctgacgatgacgattttgaaaggaccgcttgcagcgattgtcatttcaatctttatctacatgataaccatcggaatgacgttgacaagcacatttacgctggcgatggaaaaccaggggcaccgtgcgggcagtgcaagcgcaatgctgggcatgcttccgctgctgctcggttcgatcgtttcgcctctcgttggaatgaatgaaacaacggccgttccaatgggtgcgatcatgttcatcactgctgtgatcggctctttcgctttttttgctttaacgcgggaaaaccagggggagcggtaa

SEQ ID NO: 906 - DNA, 1344 bp, Bacillus licheniformis
aaaagaaacgggccctgtttttaacagccgttgcatcagggacgatgctgaatccgctcaactcttcaatgatttctttggcgctgcacagcatccagcatgagtttcacctttcatttgcaaccgtatcgtggctgatttcatctttttatctagccagtgcggtcgcacagcgtgtcacaggaaaaattggcgatttaatcggccggaaaaagatgtttttgtcagggcttgttctcgttgccgtatcggcaatcggcgctcctctcgcaccggctttttccgtcttgttgatcatgcgtttgtttcaatcgattgggagcggcgccatttacccttcgggagtgggcctgatcagaagccacattcatgagaagcaggcgtctgcactcagtgtgctgtccattttttcttcggcaatgaccgcctttggaccgaccgtggggggatttttaatcgtactcgggggatggcccgccatcttcctcgtgaactttccatttattttgttcagctttttgctggggatgtacatgttcccgaaagatgagaaaaaagccggcttaaatgtccgcgccgtgatcaagcggcttgatctcaccggaattcttctgtttgcgggcggaatcgttctcctgctggcatttctgctctcattgagcacgggcgagccccgttttgccgaggggatgttcggactcgtcttgcttttgatgtttgtttggtgggagctgagagtgaacagtccgtttattgatatcaggctgttgatcgcacgcaggacgttaacttcggtctatgctcaatttattatgctgaacatctttaactactgtttgttttttggacttccgagttattttcaggatgaaatgcacctttccgttcaaacgagcggtcttttgatgctgttcatgtccgggacgagcgtattgatctcgcctttcgtcgggaaatggattgaccgttcaggagaaacgcagcccgtgttaattggttcttgcttaatggcagcgggcgctatcctgctcacattgttttttgtcgatgcaccgatgttgtggaaaggcatcatcctctctttgctcggggtcagctacggcctcggcaatgtcgccctgcaggctgccatgtttacggcaagtccgccggacatcgtcgggacgacttcggggctttttcaaacatgccgctatcttggctcgatcttttcgtccgtcattctgggtctgttgtttggagaagaaataaccgcggggcattttcaggatctggggatggtcatgattgcggttgccatcggcagcattttgatgagcttcagatttatcaagctgatgaagg

SEQ ID NO: 907 - DNA, 1395 bp, Bacillus licheniformis
caaaggcgggggaaatcaatatgaatgaacagggaaatcagaaatcatttttgcgtactattattttagtctcgacgttcggcgggcttctattcgggtatgataccggagtaatcaacggagccttgccttatatgtctgaaggagatcagctgaacctgacagcatttacagaaggattggtcgcgagttcgcttctcctgggagccgcattgggagcggtgttcggcggaaggctatccgattatatcggacgccgcaagaacatcatttttctagctgtacttttctttttctcgacgcttggatgtacgcttgcgcctgatgtgacggttatggttatctcacggttcctgctcggagttgccgtaggaggagcatctgttacagtcccgacttacttggctgaaatgtctccttcagaaaaaaggggacgaatggttacccaaaatgaattaatgattgtctccggacagcttttggcatttaccttcaatgccatcctcggaaccacaatgggcgattcctcacatgtttggcgttacatgctggccattgccgcagtcccggctgtattcttgttctttggtatgctgagaatgcccgaaagtccgcgatggcttgtctctaaagggaaaaatgaagcggcgctgggtgttctgaaaagaatccgcaaggaaaaaagggcgcattcggaagttgctgaaatcgaagctgcagtcatgaaagaatcggaaatgaaaaaagcgaattataaggacctggctgttccttgggtgcgccgaatcgtatttcttggaatcggtatcgctgtcgttcagcagattaccggtgtaaactctattatgtattacggaacagaaattcttaaaaatgccgggtttgaaactaaagctgcactcatcggcaatattgcaaacggtgtcatttcagtattggcgacgttcgtggggatttggcttttaggaaaagtgggacgcagaccgatgctgttgaccggtttaataggaacgacatcagctttgctgcttatcggcatcttctcaaacgtccttcaaggttcagctgctcttccttatgtcgtacttacgctgactgtaaccttccttgcattccaacaaggcgccatttctcctgtaacatggctcatgctttctgaaatattcccgcttcgcgtacgcggcctcgggatgggcgtcaccgtgttttgtttgtggatcgccaatttctttgtcggattctcgtttccgatactgcttgaatcgattgggctgtcctcgacattctacatttttgtcggacttggacttctttccattgcattcgtgaaaaaattccttcctgaaacaaaaggcctcacgcttgaacagcttgagcataatttccgcaactata

SEQ ID NO: 908 - DNA, 1228 bp, Bacillus licheniformis
atgaaacggaaaatacactacgcctggattatcgtttttgtgacgtttttgacgcttttggccgttcaaggagtgcgcctttctttcggagcctttattcagccttgggaagaggaattttcaatggacaggggcacgatttcgcttatttccatgctgagcttcattgtatatggcgtgtcccagccggtgatcggcaggcttgtcgaccgcttcggaccgcggatcattttatccctcagcacgcttctggtcggcttgagcatcttttttacatatctcgtgacttctccgtggcagctgtttattttgtatggcatcatcgtttctctcggcgtcggcggtgcgtcgaatgtcgcgtcgaccgtgatcgtgaccaattggttcaatgagaagcgcgggcttgcattcggcatcatggaagcgggattcggtgcgggacagatgctgcttgtccctggatcgctcatgatgatccactggtttaactggaaagtgaccgtcattgttctgggattgtttttagccgttattgtatttccgatcgtcatcttgttattgcggaaccatccttcggaaaagaatgtacagccgatcggcggcgctcagggcggcgagataaaagaagagccggacgcccagccgaaaaagattccatacaaagccgtttttctcaaaagaacgttttggttcctcgtcttgccgtttttcatttgcggatttacaacaacggggttaatggatacccatcttatccctttttcgcatgaccacgggttttcgaccgaagtaacaagcgccgctgtcagcctgctggccgggtttaacatcatcggcattttgatttccggcgtcgtcgctgaccgctggagcagccggaaaattttgtgctttttatatgccgtaagggcgctgtcgcttgtcattctgttgtcgagccacaactcgatgctcctgctttgcttcgcggttttgttcggtttggtcgactttgcgaccgtcgccccgacgcaaatgctggcaacccagtatttcaggcagtattccgtcgggttcattctcggctggctattcctcagccaccagatcggttcggcgctcggggcttatttgccgggcgtctggtacagccaaacaggcaactataacctgtctttctacctttcaatcgttattttggcggtagcaagcattttgaacatcctgctgccggaacctaaaaaaataa

SEQ ID NO: 909 - DNA, 1231 bp, Bacillus licheniformis
atgaaaaaagcgaaaaacaggtggctcattgctttatgtgctgtaggcattcatttgtcaatcgggtcggtatacgcatggagcgtctttacaaacccgctcgctgaaaccttcggctggagcctcagccagatcagtctgacgttcagcatcgctattttatttctcgggctttcagccgcatttttgggacacttcgtcgaaaaacacggccccaaaaaagcaggcatgctcgccgcacttttcttcggagctggcgtgacgttttccggcttcgccgttcagatcggctcccttcccctgctttatttgttttatggagtcttcggagggatcggactcggcgtcggctatattacacccgtatcttcgcttgttaaatggtttcctgaccgccgcggcttggccacagggcttgccattatgggcttcggatttgcggctttgatcagcagcccgatcatgcaaaagctgatctcagcggtcggtatagccaacaccttttttattctcggcatctgctactttcttgtgatgatgctctcttcgctttacctcgccccgcctgaagaaggctggcagcctgaaggattttcaaccggaaaaagcggaagagcacaaagcgctgatatttcccagctgacggcaaatgaagcgattaaaacgaaacgcttttattatttatggctgatgctttttattaatgttacgtgcggaatcgccatcatatcaatcgcttcaccgctggcgcaggaaagtgcgggcatgtccgccgccgcggccgccgcgctcgtcggcgttttgggcgcatttaacggtttagggcgcatcggctgggcctctgtatctgattacatcggacggccgaatacgtataccgtctttttcgccatacagctgatcgccttcccgcttttgccgttcatttccgacaaggccgccttctctgttttgatggcattgatctatacgtgctatggcggagggtttgccgcaattccggcttatatcggggatttgttcggaacaaagcagctcggtgcgatccacggatacattttaacggcttgggcggcggcagggcttgcaggcccgatgttctcttcttgggtacgcgatgcaacagggagctacagccaaagcctgacggtgtttgcggcactgttcgccatcgccctgttcatttcgatattcattagaacggacattaaacagttgcggaaaaaagcgg

SEQ ID NO: 910 - DNA, 1173 bp, Bacillus licheniformis
aaccacctgagaactccagtatgtttaaacagccaaaagcggtctgggcggtagcctttgcctgcgtgatctcgtttatggggatcgggctcgtcgatccgattctgccggcgatcgcgcagcagctgcatgcttcccccagccaggtttcgcttttatttacaagctatctgttagtcacaggttttgccatgcttttatcaggcgctgtctcgagccggattggagcaaagctgacgttaatcagcggtttgatcctgatcatcgtctttgcgggcctgggcgggctctcgcattccatctctcagcttgtcggcttccgcggcggctggggactcggaaacgccatgtttatctccactgcgcttgccgtcattgtcagcgtggcttctggcggaagcgcaaaagccattattttgtatgaggctgctttgggattgggcatttcggttggaccgcttgccggcggagagcttggcacgatatcgtggagagcgccgtttttcggtgtatcggttttaatggccgctgctcttttggccatcttttttcttttgccgcctgtccaaaagccgcagaagaaaatttccgtcagtgcgccgatcaaagcgcttcgttataaagggctgttgacgctgtcaggagccgcattcttatataatttcggtttcttcaccctgcttgcatattcgccgtttgttcttgacttaaatgaacggggcctcggctatgtctttttcggctgggggctgtttcttgcgatcacttccgtttttatcgctccggccgtacagcggatcttcggaaccgtccgatctctgatccttctgtttatgctgtttgcagctgatttgctcgcgatcgggatttggacggagcacatggcgctcgtcatcggggcgatcatcatagccggaggtattcttggcatgatcaatacgattttgacaaccgcggtgatggaagccgcgcctgtcgaacggtctgttgcttcatctgcctacagctccatccggttcatcggcggggccattgcgccttggatcgccggtgtgttagccgatcattttactgcgcatactccatattttgcaggatgcatcgccgtgcttgccggcatcgccgtcttggctggaggccgccgttatttggcgggcatcaaagccggtcatt

SEQ ID NO: 911 - DNA, 1185 bp, Bacillus licheniformis
taatatgagtgaaacacagcacaagacaaatcaattgccgattgttgccgtcttgattatggggacatttatcgccattttgaatcagacgcttttgacgacggctctgcctccgattatgagggacttaaacattacgccggggcttgcccaatggctgacgaccgtttttatgctcgtgaatgggatcatgattccagttacggcttttttaattgaaaaattcacaacgagaaagctgttcatggcggcaatgtctttatttacggccggcacgctgatctgcgccttgtcattcagctttccggcgctgattgcggggcgcgtcgtgcaggcggctggcgccggcattatgatgccattgatgcagacggtgcttttattgattttcccaaaggaaaaacgcggatcagcaatgggaatggtcgggcttgtgattgcctttgctcccgctgtcggaccgaccctgtcaggctggatcgtcgatcgctatccttgggaagtattgttttacctgctgcttccgttcgccgtgatcgacatgattgccgcgcactttattttaaaaaatgtcaccgaacagacatcgcctaagatggatgttacttcaatcatactgtcttcgcttggcttcggcggcattttgtacggcttcagcagcgccggtgttgccggctggacgggtgcggacgtgctggccggcttcgcggtcggcagcgttgcgctgttttggttcatttggaggcagctccatttggaagagccgattttggagttcagggtatttaaatatccgatgtttaccttggcgacgattatcgggatggttgtctttatgtcgatgatcggagctgcgacgatcgtgccgatgtatatgcaggatatgcgccatttcacggcgatggagtcgggaatgatgctgtttccgggagctgttgtgatggggctgatgtctccgattaccggaagaatttttgacaaaatcggcgcgcggattttgagcatcaccggtttgacggcgatcttcgtgaccacattgctcttgacccatctgacaaagacgacgccttttgcatatttgtctatcgtctatgcgattcggatggtcggcatggggatggtgctcatgcctgttacgacagccggcttgaaccagctcccgcgccatttgattcctcacggaac

SEQ ID NO: 912 - DNA, 1281 bp, Bacillus licheniformis
tttttctttttggcagcatcgttttcatggcgggatcagcattgtgcggaacggctacaaccattgagcagctcagcatataccgcgcgatccagggaattggcggaggcgcgctcattccgattgcttttacgattatctttgacatttttccgctggaaaagcgcggtaagatcactggacttttcggtgctgtttttggcctttcaagcattttcggaccgctcatcggcgcctatgtcactgactacatcagctggcactggattttttatatgaatctgccgctcggtatggtttcttttattttcattcttctattttacaaagagacgaaacagcatgaaaagcatcgtattgattggctcggagcgattacgctcgtaggggcggtcgtatgcctcatgtttgcgttggagctcggcggcgggaaatacgcctgggattcgaatgtcatccttacccttttcggaagtgcagccgtcttgttggtttgcttcctcatgatcgagcgcaaagccagtgaaccgatcatttcgtttcatatgtttaaaaaccggctgtttgccggcagtacgcttgtcgccttattttatggagggacatttatttcagcgaccatccagattccaatctttgttcagggtgtttacggagattcggcgacaaactcgggacttgtgcttttgccgatgatgctcggctctgtcgtatcagcacagcttggcggattcttaacaacaaaaatgagctatcggaacattatgctcatctctggattggttctcgtcagcggattttctttattaagcacgcttaacattgacactccgcgtttattattaaccatgtatatgatcgtcgtcggcttgggagtcggtttttctttctctgtattaagcatggcagcgatccatcatttcggcccggagcagcgcggctcagcgacatctacgagcaactttatgcgctctctcggcatgacgatcggcgccagtatgttcgggatgattcaaaaaaaccaattttcagaacagctggaagatatgtttaaaagcagcggcgcttcaaatttcgcctcaacgaatgacgccgaccagattttatcaagtgcacgggcatcactgccgccggatgttttacataacatcaccgaagcgctatcaaattcgattgttcacacgttcatttgggcgatttccccagcagcggccgcctttttactggtgttcttcatgccgaatgacagggtgaaagtgaacgcaaaaaaggaagtgaaca

SEQ ID NO: 913 - DNA, 867 bp, Bacillus licheniformis
tacttttaaattactttgaccgtgttgccatttcagtcgcagctcctgcgatacaggattcctttcaattgacggcaacccaattaggcatcgtcttttccatctatacctactcatacacgctgatgcagattccggtggggagtctcttggataagtacggcgttgcctgggtgacaagggtcggaatgaccttgtggagttttctaaccattatattggcttttttacagggaaaactgcttctttatattgtcagatttttaatcgggctgacgagtgcttcagcttttcctgccgcatccaaagcaacggccttatggtttccgcctaatgagcgcggccttgccaattccttgtttgactcggcagccaagttcgcgaatgtcatcggcgcgcctctcgtagcctttttagttacgacattcgactggcgagccgcttttttaacgatcggaatcattaatgtactgttcaccgtatttttctggttgtattatgaacagcccgatcggcacaaacgaatctcaaaggaagagctccattatattcaaaagcataatgccgtatcagaggaagatatctcggaacggacgcttattgctttaaaagcgatgctgacaaaccgtaaagtatgggggctgatgatcggatttacgggttacggctatacattcaacctgctcttaacctggctgccgaccttctttaagaaacatacggaatggacattatgtcctcagggctgtttacagcggttccctggctgatatcgacggttttcggaatcgttgttggccgatggctcgtcgatttttttattccaaaaggcatttccaatacaaaagtattcccaaaccattattg

SEQ ID NO: 914 - DNA, 1178 bp, Bacillus licheniformis
atggagcggcaaaaacaaatcgtctatgaagaaaaacaaattttaaggaaagatcatatgatcttttggggtgccgtcttttgtttctggtttgctacatacatctatgtccctgttttcggattatatttagacaacatcggattttcatattcagcgataggaatcgtacttggaagctacggcgtcactcagatattactgcgttttccgttcggcatcctgtctgatgttctttcgccgcttagaaaacagctgttgatcagcggctttgcaatgtctctgttgagctgctgcatatttctgttgtccgattcgttcatcatggtgatcacagccaggctgctcgccggtatgaccgcggcgatgtgggtgatggcaaccgttttatactcgcagtattttacaaaagatcaatcatcaaaagcgatgggcatcctgcagtttttaacggtccttccccaattcatcagcatggcagtcagcggctacctcgtccatttgttcggctggatgtttccgttttggatcggtgttgccgtatcatgcatcggactgattctgtcattttacattaaagataacgggccccgccatacggccaaggggatggctttgtcagactatgttaaacagacgttgcgtcttcctgatttaaaagcgattacaacattatcgtttttagcccacgctgtactatttatgaccgtgttcggatttacgccgatttacgcggaatcggtcggaatcgatgagaaacagctgatttgggttatgttcgccttttttgttccgcaaacgctggcttccgtgtggtgtatcttttacaaagtaaaggccgccgatgcactgatatggatatcttatgtgataacggctgttttcttttgcttgctgccgtttgccgaaacccttttcgcggtatgtatcgtccacgccgtgacaggactgacattgggatttatttttccgcttttggtcagcaaagtcgttcagcttggtacgcctcagctcaaaatgtctgtgatgggtttctatcaatctttttatgcgctcggtttttttctcggaccggttgtggcgggaaaagtggctgaactgttcgggctgccgaaggtgttttggtttgccggcgcattgtcactggccgctgcatgtatcatgcttttttccaaaca

SEQ ID NO: 915 - DNA, 1368 bp, Bacillus licheniformis
catgattatcgcaatcttaatcgtcggaaattttctcgctctgattaatgagacggtcatgaatgtggctttgccgaaaatcatcgacgattttggcatttcagcgaacacagcccagtggctgtcaaccggatatatgctcatgatcggcatcgccgtgccgattaccgcgtttttaatgcagcgctttacgacaaggcagctgtttctgtctgcgatgacgctttttacagcgggaaccttgctggccggaattgctccggtcttcccgctcgttctcgccggacggatcatccagggttcaggtacaggcctgatattgccgcttgtgatgaatgtgatactgactttgattccgccgcaaaaacgcggaacgatgaccgggatccttacgctcgttatcttatttgccccggcgatcggtccggtcatctcaggctatattgtcgaacattattcatggcgcgttgttttcttcatgatgctgccagtatcggtcttcatgattttttatgcggcgttccgcttgaaaaatgtaaccgaactgacgtatccgaaaattgacatattatcaattcttttatcgaccgtcggatttggcgggatcgttttcggcttcagcaacgccggggaagcagcgggctggagcagtccgaaagtcatcatcggactggcggccggtgtcatcggattaatattgttcgtcatgcgccagctcagattggaagtgccgatgcttgatatgaggccgtttcgttcaaagatattttcaatctcggttatcctgatgtggatcgtgatgatgctgcagttttcgatgatgctgattttgccgctttacttccaaatggcgcttgagctgtcaccgctttatacaggcattctcatgctgccgggcggcctcgtcctcgcgatgacatcccttgttgcagggcgcctgtttgataagcttggctttaaaccgctgttgatcaccggattgatcattgtgattgccgtcctttcgctgtttacgaatatttcaagcgatacgccgatggcggtcggaatgatgctctacgccggctttacactcggcgtcgggttgacaatggctccgattatgacgctcggtttgaatcaggtgcccaaaccgctttacccgcatggttcggcgataatgaatacagttaatcaagtttcaggggcaatcggtccggcattgtatacgacgatcctgacaaccgtttcgaatcgctttatcgcgcactcttccggaggcagccgtcaggagctgcacatgcaaggcatgacagaaggcgttcatatggtttatttcgtagccatcgcctttgcagccgccgctcttgcgatttcggtttttgtaaa

SEQ ID NO: 916 - DNA, 1383 bp, Bacillus licheniformis
aacaacagacatacaacagaaatatcatcgtaggtttgcttattgccggggcgtttatcgcgatcttgaaccaaacgctcctggttaccgcactgccgcatattatggcagacttgaacatagacgctacaaaagctcaatggctgacaacggcgttcatgctgacaaacgggattctcattccgattaccgcctttttgatcgaaaaattctcgagccgcgcgctcgtcatcgcggcgatgagcatctttgcggcgggaacagtcgtcggtgcggtggcgcctaactttccggttcttctggcggcgcggatcattcaggccgcaggcgccggaattatgatgccgctcatgcagacgatctttttaacgattttcccggttgaaaaacgcggggctgcaatgggcatggtcggcttggtgatcgcatttgcaccggccatcggaccgacattgtcaggctggatcgtcgacagctttacatggagatacttattttatattattctgccaattgcactgattgatcttgtgcttgtcatcttgctgatgaaaaacgtcacgaaattgagagaaacatcagtggacatcatatctattatcctgtccagcctgggtttcggcggtttattgtacggcttcagcaacgccggatcagaaggctgggggagcaatactgttttaatttcctttgcagtcggtgcggtcgccctgttcttctttatctctagacaattgaaaatcaaaaggccgatactcgagtttcgcgttttccaatcgtggacttttacgataacaacgctacttggtatgatcgtttttgcattaatgatcggtactgagaccattttgccgctgtacacgcaaaacgtcagagacgtgacagctttcgattcgggtttgatgcttctgccgggcgcgatagcaatgggcatcatgtcgccgatcatcggccggatttttgacaagatcggcggaaaaggccttgcgattatcgggtttgccgtcttgctgctgacgtccatcccgtttgcggacctgcaaatggatacttcgctgacatttattatcgtcatttatacgctgcggatgatgggaacttccatgattatgatgcctctcacaacggcgggcatcaatgcccttccggcgcacctcattccgcacggaacagcgatgaacaatacgatgcgccagatcggcggttcgatcggcacggctgttctgatttccgtcatgagtaattcagccaaaaacgccgcgacatctcatccgttaaatgcgctcattcacggcatgaattccgcctttatcgtggccgctgtcttggcgctgatcggatttatcctttcgtttacattgaaaaagaagccgcaggccgaca

SEQ ID NO: 917 - DNA, 1275 bp, Bacillus licheniformis
aagagaagccgacaaaggttagagtgcgggtactgctgtttatttttgtatgtgtcgtgatcaattatatggatcgaagcaatatctctgttgcagcttctgcaatcggggacgatttaaacttgtctgccgttcaattgggcttgattttttcagctttcggctgggcttactgcgcactgcaaataccgggcggcgggcttgtcgaccggtttggcccgaggcttgtctacggctttaccttggttacatggtcgctcgcaacattgcttcaggggtttgtccgcggcttcggttcgctattcggcttgcgtcttgcgaccggagcgtttgaagcgccggcttttccgaccaataaccgggtggtgacttcatggttccctgaacaggaaagagcttcagccattgcattttatacgtcggggcaatttgccggccttgcatttttgacgccggcgctcagcgccatccagcatgtcgtcggctggcgcggcctttttattgtaacaggggtgatcggcatcatctggggcctgatctggtatatcttttatcgtgatcctgatcgtcatccaaaggtaaacaaggctgaacttgaccatattgaaaaaggcgggggtatcgtccgccgcggccggacttccgagaaagagaaattggcatttacttggaagcattttaaacaagtgaccgctcatcgcaagctgtggggcatatatatcggacagttcgccgttaattcgactttatggttttttctgacgtggtttccgacataccttgtaaaatatagaggccttgattttctccaatccggttttctcgcctcgcttccatttcttgcggcatttaccggtgttctgttgtccggcttcctgtccgactttttgatcaaaagaggcgtatcggccggggttgcccgcaaaacaccgattattaccggattgttcctgtctatttcaattatcggtgccaattatgtcgatcagacatctctgatcattttgtttatgacgctcgccttttttggaaacggtttggcctccattacatgggtgcttgtatcgtctttagcgcctaagcatttgatcgggctgaccggcggagtatttaattttgtcggcagcctcgcctccgttatcgttccgattgtcatcggctttctcgccaacggcggaagctttgcgcccgccctcgtctttatcggagccctcgcccttgcgggagcgctttcctacatctttcttgtcggaaaggttgaacggattcaggtca

SEQ ID NO: 918 - DNA, 1236 bp, Bacillus licheniformis
agtcgacgattacggtcgccatgtccaactatttggaggcgggatccatcgtcgcgggggccggcgggctttcgttatgggttgaatatttaggattggacgacgcccgggtcggacttctcggcgccttaagcgcaaatggtttcggcgcggcgatcggcgcttttctcggcggttttttagtcgaccgttacgggagaaaattcatatataaatacgatctattagtctatatgcttggcgttttactgatcgccgcgtcgtttaattttcccatgcttttaaccggatacatcgtgacgggaattgcggtgggcgcagcaattccggctgcttggacttacattgccgaggaggcccctgaccatgaacgggccggacgcgtcggctgggggcagctggcatggtcggtcggaccggcgcttacgctgctgttatcagttgccttggcgccgctcggtttaatgggaagccggttgatttttgcccaattattcgtcgtcgcagtcatcacctggattttgcagcagcagattcacgaatcgtccatctgggaggagcaaaagcgaaaagaagccgaagacaaagcaaaaggagttgaagaaaaggcgtcgatcaaagagctgttgaccaacaaagcgaaccttcgcgcgatgattctcctcatcggaatttatgcgttttggaaccttgttgccgggacgatgggatatttcatgccgtatatctatgagacggtcggcggcctaacagcggcacaagccaacctgctgcaggcatttttatggattttgactgtggcgtccacatacttcgtctttatccgtctcggcgataaagtcaatcggaagttgctttttggcataggagcagctatggcaaccgccgcatgggtcatcctcaccttcggcacgatgaacatcacggagcttttattattcgtatgcctgtggggcatttctgcgggttttggagcgcaggcgttttacggactgtgggcggcagagctgtttcatacgaaatacagggcgctcgctcaaggcttcatgttcttcatcgtccgcatcggcgtcggactcatctcattggtcgttccggcgatgattacgggcttgggcttcaaaacagccggcgccgtcatgattgcatttctcgtcattcatatgatcatcgggctccgtatggcgccggaaacgcgcggcaaatcgcttgaagccattcaaagcgaacgctatc

SEQ ID NO: 919 - DNA, 1197 bp, Bacillus licheniformis
acagtctgtattggaaactaagcgcctattttttctttttcttttttacttggtcttccagctattctttatttgcgatttggttagggcaagaaatcaatttgaacgggtccgcgacgggcattatcttttctgtaaacgctatctttactttgtgcatgcagcctttgtacggttttatctccgataagctcgggctgaagaaaaacatattatttatgatcagtttgctgctcgtatttacgggtcccttttatattttcgtctacggaccgcttttgcaatacaacgtctttcttggggctatcgtcgggggaatttatttgggaactgcttttctcgccggaatcggtgcgattgaaacctttattgaaaaggtcagccgcaaatatcaatttgaatatggaagaacaaggatgtgggggtccctcggctgggctgcggcgacattttttgcaggtcagctgttcaatatcgatccgaatatcaacttctgggttgcgtccgcctcagcaatcatattggtggccattattgtttccgtaaaaattgagatgacagatgatgaaaaggaaagagcagactcggtcggattaaaagacgtaggagggctttttctcttaaaagatttctggtttttgatgctgtacgtgatcggcgtaacatgcgtgtacggcgtctatgaccagcagttcccgctttactacgcttccttatttccgactgcggccttggggaaccaaatatttggataccttaattcattccaagtatttattgaagcgggcatgatgtttcttgcgcctttcatcgtcaataagctcggtcctaaaaaaagcttgattttagcggggctgttaatggctttccggattatcggttccggacttgtcagcggaccggtcggaatttcatcgatgaaactcattcatgctttagaattgccgattatgctgattgcgatgtttaaatatttggcgactaattttgataatcgtctttcatccgtactttatcttgtcggctttcaattcgcatcccaggtaggcacgtcgattttttcgccgcttgcgggaggtttatacgacagcatcggatttcgccacacttatctcatcatgggagcaatggtcctttgttttaccattatttcgatttttaccttgctagactcaaagaaagatgttgaatttgctc

SEQ ID NO: 920 - DNA, 1296 bp, Bacillus licheniformis
atcgttcagttcatccagcggaagtcatggcggccagcaaatttaacaaagtgcacctgactgttttcctgtggtgttttttcgccattgcctttgacggttatgatattgcaatgtacggcgtcagcctgccatggctgatggaggaatggagcctgaccgccatccaagccggagcgatcgggagctatacattgatcggcatgatgctcggcgcgcttattttttcgccgatcgcagatcaatacggccgcaaaaaggtgttgggcttctgtatctttctgttcagcctgtttactgcagcagccggtctgatcgattctccgcttttgtttacgatcatgcggtttctcgctgcgcttggaatgggcgggttgatgccgaatgccatttcgctgatgacagagtattcgccgaaaaaaaacagagcggtgattgtagccgctatgtattgcggctattctgcaggcggtgtgctggcttccctcgtcggcatgttcgccgtgcccgtgacaagctggagagtgctctatctgatcggagccgtgccgctcttcgtgctcccgttctttttcagcaggtttcccgaatctctgtcattttacgttttgaagaaaaagacgaaagcgctggctgagattttcaatcaggtgcatccggcgggacgctacagggaagacgacaattatcaaatctcggtgattgcgaaagaaaagaaaggctttccggtaaaaaaactgtttggacaaaaacgtgcagccagcacattcgcattctggctttccgttttcagctgccttctcatggtttacggcttaaatacatggcttccgaaaatgatgcaggcgtcaggctacgggctgtcgtcaagcttgtcattcaacttggcgctttgctgcggacaagccgcaggagcggtattcggcggatatttggcagataaagccggccataaaaatgtgcttgcggctatgtatgtcatcggagccttttgttttgcagcatttggaatgacgatgaaccccgttcttctgtacttgctgattgccttaggcggggcatgcaccgtcggagcgcaaaatatcgccaatccttatatttctgagtattatccgaaagaaatcagagcgaccggcatcggctgggcgctcggggtcggcagactcggagcgatcattgcgccttcgctgtttgcattgatccttgcttccggcatggagccgaagcaggctttcatggtgttcgcgatcccgagtgtttttgctgcactcggcatcatgctcgtccaagagaaac

SEQ ID NO: 921 - DNA, 858 bp, Bacillus licheniformis
ttttagggtgctgcaggctttggggactgctgcgcttccattaattgcggcaaccacaatcggatctctgtttaagggaacgaagcggggcagtgcgatgggaacttatcaaatgctgctttcccttgcaccggcagcggcgcctattctcggcggttttatcggggagcgctataattatccgggtattttttggtttttgacagtattgtctgttcttttgcttttcggcaatttgttttgctttccgcgcagccattcggagaaaaagaccaatctcagcgcgggcagcctgctgtcgcattataaggacatattcaaaaacagggcgggcaatgccgttttaatattaagctaccttattttctttatttatttttcaatgatcgtgtatttgccgattttgctgaccgatcactatcaccttgatctgcagatcgtcggcttgctgtatttgccgatagcggtcagcacgattgccggcagcgtgctgtttaagtggatacaaaagagattatcgctcagacgcctgtttttgatcggcaatctgaccgccgcagggagcgtcgtctgttttgccttttcccatttgttttcgcttttcgccatgtcggcggctctggttcttttcggcgttacgatggggctgattccgccgctcttctctacgatgatggcgaatgaatttgaggagaaccgcggcagtgcgatgggcatgtttaattttatcaggtatacgggaatggcctgcggtcctgttatatcaggcatgttattggggatgtcatcttctgttttcgttttcggctgtttcggtatcgtttatgccgcagccgcccttttgatgaccgcggtcat

SEQ ID NO: 922 - DNA, 741 bp, Bacillus licheniformis
gggggtggaaggcttcctttgtgttgatcatgatcatcgggcttgtttggacttgcttctggatgaaattcatgaaagataagccggctgattccggcagtttgtctcctgaaaaggaagcgcgtccgaaaaaggataccggcatcccgctgtctttttatttgaagcagccgaccgtgctgtttacggcgttcgcgttcttttcctacaactatattttgttctttttcttaacatggtttccgagctatttaacgacagcccgggggctgagcattcacgatatgagcgttgcaacgattataccgtgggttgtcggatttctcggtcttgcgcttgggggatttatttcagattatctgttcaagctgacgggcaaacagatgttttccagaaaagccgtgcttgtgtgctgccttttggctgcagcggtatgcattggatttgccgggcttgtcactaccgcgtttggagctgttgcacttgtcgcattatcggttttctttttgtatttgaccggcatcacatactgggcgattatacaggatatcgttcatccggacagggtcgggggcgtgagcggattcatgcattttcttgccaatacatccggcattatcggtccgacggttacagggtacatcgtcgagtacaccggagctttcacaagcgcctttttgcttgcgggagggctggcggtggcaggttctatttgcgtcgctttgtttgtgaaaccgatac

SEQ ID NO: 923 - DNA, 681 bp, Bacillus licheniformis
tttgatggcctttttagtttctcctttttggggaaggttcggcgataaacacggctataaaaaaatcctcttgatctttggtaccggaatcggcacttccattcttctcatgtcccttgtctcgtccgtctacgagctgttttttttgagaatggcgatggggctcgtcaccgggttcattcccacttcccttgccatgatttcggctcagacgccgaaaaaaacggctggcaaagtgctcggcacgctgcagatgggcacggtctcgggaggattattcggccccttgctcggcggtctgctcgccgatcgcgtcggttttacatatacgtttttcattacgtcatttgcgatttacagcgcggttttcctcgtgtttgccggagtgcgcgaacggcccctgaagcagaagcgcgatgcttccgccgggtacacgagaaagcaggttctgcagacgattctgcatcagcgtccgctgatcacggcgatgatcctcaccgctgtgattcaagtgggaaacttcagtgttcacccgctgctcgctttatacgtcagcgaactgcacggaactcataatctcgcatttttttcaggggttggcttttttggcacccggctttggaagcctgctcgctgccgagaaaatggggcgcttttgggcgaccgggttcgggcccggaa

SEQ ID NO: 924 - DNA, 1452 bp, Bacillus licheniformis
atgcggattccgtccattttgacaaatcttgcttttgctctcggtgttccgcttggacgtatattttcaaggaggttcggcattcggaacagctacctgacactcatcaccttatttttatgcggctcgctgatcgacgcattttcagcaggcttgttttcgcttcttatcggaagggtgatacaaggattatgctccggaatgttatttttgacgattcttcctgtcaaattgatttcgtttccgaacaaggtccgcaatttgtttttgtttttcgtcattagcggattgttcggcgcttctgccatcggagcggtttttggttccctgtcactcagcgcggatgcatggcgctgggtgtttatattaaatatttgttcgcctgtcctttgccttgtgatcggcttcttttctttgccgaaacaagcagcggatgagcgggagcatcattcgattgataagacgggcgtttttatgctctcattgctcatggttgttttgacggtgccgcttatcaatttgcagaagacgggtgttcattctttttatgtgtggccgttctttttggccggattcatcattttggcgttgtttgtcattacagacttgcgcgcccgggaacctcttgtgccgtttcgttcactgtggtccgcaaaagctgtttccgggacagtcatggccgttgcttcacacattgcaatcattgtttcccttgccgggataaacggatttttggaaaacattgcagaggcttcttttgaaagcatgacacgcttttatttgtgttttttcgcagggattttagctactgccgtgctcagcacgcttttgtatgatcattttggcgccggattgctcggctgtatcggcgctttggaaatgatcatcgtcggtatggaatggagatcggttcaacccggtgtttcgatggagtcgttatatcttcatgctgttttgctgggcagcggcgtcagcatggtattggtatcgggagcgctgggcacggcgcttgccggagatattcaccaagcttcaaaacgctcggtttcgcttcactttatccgcaatttcgccggtgcctgggctgcaccggtgatcggctggtttgcttcaatgaagaatgcggtgcactacgagatgataagaggacatatcagtgaagctgatcctgaaattcagctggaattgtcaaaaatgattcgtgattttgtcagcagcgggctttctgttggtgatgcgaagaacatggcggcctatacgattgttgcaaatgccagaaaagcttcagcccttggcgcatatcacgatttgtttacgatactgctctggctaagcatcatcatgcttgcggcttcaattggaaaggcagcgaccggaaaaggaagatcgctcgttcagaagcgccttcgcctgccagacccttcagcaagtcaacaaaaggagataggataa

SEQ ID NO: 925 - DNA, 852 bp, Bacillus licheniformis
gcagaaaaaaagacatgaaaagcatttttgcgctgtcttcggtcccgctcgtgatgacgctcggcaattcgatgctgattccggttttgccggtgatcgaaaaaaaattaaacatttcttcgtttcaggtgtcgttgatcatcacggtttattcaattgtggcgattgtatgcatcccgattaccggctatatgtcggaccggttcggaagaaaaaagatcatgctcccatgccttctgattgcgggagctggaggagcgttagcaggtttggcttcaacttttttcaatgatccgtttgcgatgattttagcaggtcgcgtccttcaaggaatcggctcagccggcgcagcgccgatcgtcatgccgtttatcggcgacttgttccaaaatgatgaagaaatcagcgcgggactcggagatatagagacggcaaatactgccggcaaagtattaagcccgatattaggggcttttttagcatcttgggtttggtacatgccgttttggtttatcccggtcgtgtctcttgccagcttttttctcgtcttgttttttgttcccaaaccgaaggacaaagatgatgaaaagcaaacgttaaaaaactttgcaaaaagcgtacaggaaattttcaaacgggaaggtcggtggcttgtttccacttttgtcatcggcggaattattatgtttcttttattcggagtgctcttctacctgtcggatactttggagaagaagcatcaaattgacgggattgcgaaaggagcgcttctcagcattccgctgctttttctttccgtcagttcctaccttgccggaaagctgatcggagaagataagatcagaatgagga

SEQ ID NO: 926 - DNA, 1434 bp, Bacillus licheniformis
atgaatagaaggccgttcaatcaaaggacggttgtcagcattgtatatgtaacagccatgtttatggctgcgatggatgcgagtgtcatcaacatggcattgcctgccatcatgaccgaatttcaaacattgccgtctgctgcaggcacagttaacatcggatacttagtcagcttggcggtctgtcttcccgcagccggctggcttggggaccgctttgggacaaagcgtgttttcctagccgcgctttcgatatttacagctgcatccgccttatgcggaatcgctgacaatctggcggcgttaaacgcatttcgcgtgatccagggggccggcggcgggttgattacgccggtgggaatggcgatcttgttcaggacgtttcctccgcatgaacgggccaaaatttcgagagtcctcgttcttccaattgccgtcgcgcctgcggttgggccgatcatcagcgggtttctgacagatcagctgtcatggcgctggattttttacattaatattccgatcggaatgatcattctgctgtttggcctgttgtatcttcatgaacatttggagccggaagcgggcagatttgattggcttggattccttttggcggcgccgggaatggcgttggcggtttttgcactcagccaggggcctgcgcgtggattcggctctccggatgtgcttgcagcaggggccgggggaatgatgctcctcgcaatcctcgtttttgtcgaactgaaggctgagcatccgttgattgaacttcgcttattgaaggaccgggtttttggaatgatgagcgtcatttcgcttctgacagcaggcggactgcttggcatgctctatatatttccgctgttgtgtcaggaagcactcggctactctgcgacagatactgcgctgattacgtttcccgaagcattaggcttgatgctggcgtcccagctgatgccgaggtcgttggcaaagcttggcccgaggcgggtcatttccgttgcgctgttaggcgctgctgtgctgtttgggctgctgagcctgaccggatatgggtcaaatctttggcttctcaggctgctgctgtttttagcgggctttttcttggggcacgcggttggtgcggcgcaggttgtttgttttgccaacatttcatcatcctcaatgggccgggcaacaacgctgtttaatgtgcaaaaccggctcggatctgcctttggagttgctgtcatgtcgtgcgtccttgctgtgctcagccagcccagcgcaggcatagagcctgatttatcagcttaccggacagctttgctctgtgcagccggtttcctcatggctgcgcttttcatcgcactcaagctcaaggacgctgacacaggccgtcaaatggacaagcatgcttcagcacccaaaggtgcggcagcttctggtgagtaa

SEQ ID NO: 927 - DNA, 684 bp, Bacillus licheniformis
tgcaggagctcggcggctccgagtcagagggcggccttttgatcagcggcttcatgctgtccgcgatttttgcaaggccgttttcgggagctgttattgagcgttttggcaaaaagagaatggcactcatcagcgtcgtgctgtttactttggcatcatttctttatatcttcattcacgatatctacctgctgcttggcattcgctttttccaaggcatttggttcagcatcatcaccacggtgacgagtgcaattgcagccgatttaattccgccggcccgccgcggggaagggctgggctattttgctatgtcgatgaatttggcggttgtcatcggcccgtttatcgccttgaacctgctggataaaatgagtttttccgatctgtttattttattttcaggaatcgtcactgtagccatcctctgtacggcactggtgcggattcctaaaggaaacgacatccgttcagctgtgttcaggctgtcattttccaacatgtttgaaaagggcgcgattcggattgcaacggtcggcttgttcgagtcgttttgttattcaagcgtgatttccttcatctctgtttatgccaaatccctcggccttattgaagcaagcaactattactttatggtgttcgcggagtacatgatcaacaccccgacgaagacggagaaactga

SEQ ID NO: 928 - DNA, 699 bp, Bacillus licheniformis
ttgcggctttcatttattttatttatgcggcggtgctggtcattcaatttaaacaccacaccgtaccggcagctgagcgtaataagcgtataaaagtgcgggacgcgctggaggtgacaaaaacagaccgggtatttacgattacgctaatcggttcgattctttgtttgttcggatattcccacttcacatcgacgcttgcacaatacatggcggccagcccgttcattgaagacgggacgaaagtgttcggcatgatgctgacgctgaatgccttggccgttcttgccgtacagtacccgatcgtacatatcgccaaacggttttcaccgattttatcgctgattgcaggaaatgtgctgattagtggaagcctgttcagcctctcttttttccatgatctatggtccattgtcttgatcattatcgtgtttacgatcggggaggtgcttctcttttcgatgatggatttactggtcgaccggattgcccggcctgagctgaaaggcacttactttggggctatgggcttcacccagcttggaagcgtggtcggcccttgggcggggggaatgctgctggacacctttggagcggaaaaaccgtttttcacttttgcaatcctgtctgctgccaccatttgcggcgttcctttcctggtagcagcctaccggaaactcaaaatggatgaagcaaaag

SEQ ID NO: 929 - DNA, 1368 bp, Bacillus licheniformis
atggctgctttagacaacggcatcatttcagcggcactgacgacaatcaatgattcttttcaagtatccccctcatggggagcatggggcatcacgctttatacgctcggtttggcagtcagcgttccgatcgtcggaaagctgtctgaccggtatggacgcaaaaagctgtttatcatcgaagtcttgctgtttggcgccggttcgctgctcgttgcattgagccaaaacttcccgatgttcttgttggcgaggctgattcaatcgcttggcggaggcggaatctttattatcgggagctcgcatattctcactgcgctgcctaaagaaaaacagggaaccgccttggggcttttaggtgcgatgaacggaatcgcggcagtgctcggtccgaatatcggcagctttattttggatatgaccggaagctggcactggctgtttttgatcaaccttccgattgccgcagcactgatcatcctcagcgttccattgatgaaggagacaaaaggcggaacacgaaaacccctagatctggccggaactgtgatattgtctcttgcgattttagctgtgatgtacggaataacgaatataaacggacagcgcctgtctgccgtcttgtccgatccaaaggtttacttttttctcctgatcggctgcgcgctgtttgcgggactcattttttacgaaaagcgcgtagagctgaagggaggcgacccgatccttgcctacagtttattaaaaaacaaggtgtttcaatggacgctttttatcggatttttatccggcggactcttggcagccgttatttttattcctgcatatgcggaacaatatttgcacgtcgctcctgaaaaagcggggtattggatgacgcctcttgcgctggcttcagggataggagccgggctcggcggaatgctcgccgatcgaaaaggaccggtaaaggcggcccggctctctggcgtcatttcgttcgccgggtttttgctcttgtcctcctgggtgacagagaagtgggaatttgttttggcaagcatcatcgcaggggtcggttttggctttctgttaggcgcgccgttaaatatgcttgtatccgaggcggcaaaacaggattacgggacagcgctcggtacattatcgctcgtcaggcagatggggatgaccttggcgcccgcgctgtatgcaggatatataacggccggctacgaaaatatcggcacacatatcaaacataagctgaatgatgcagggatcactctgaagggtttgcaggcggtgagacggacgtataaggctgagcgaatccctcagccaaatttccgacccaaaagtaaaagacatcataagcgaagcgatccatga

SEQ ID NO: 930 - DNA, 918 bp, Bacillus licheniformis
agctgcttttcgccttggcgagccagatgtggctgctgtttgtttcccgccttctcggcggagcgggagctgcgtttttggtgccggccatgtttgcctacatcgctgacatcacatcggaaaaggatcgaagcaaagggatggggctgatcagcgccgcgatgtctctcggctttgtcatcggtccgggagcaggcggatatttggcggcgttcgggctcaccttcccgttttacgtgtcagccggattagccggcttggcgacggttttatcgcttcttgtcctcccggaaacgctcagtcaagaaaagatgcttgaaaagcgccgctccgttcaaaagcgcgaaccgctcgctaagcaaatggcgcgcgcgctgcggtcgccgtatgcatttctgtttatcctcgtgttcatcttgaacttcgggatcatgaatttcgaggcggtattcagcctttatgtcgatcataagcacggctttacaccgggagacattgcctttgtcataacagcggcaagtctgatcggcgtgttcgtccaggcggtggctctcgggatgctgacgaaccgcttcggcgaaaaaaagctgatgaacatgacgctgatcggttctgccggagcgcttgccgtctgctcgattgccggttcgtactggctggttttcggggcaacaattgttttcttcatgctgacgtccattcttcgaccggcgattaatacgctgatttcaaaaatggccggagatgaacagggatttgccgcaggcatgaacaatgcgtttatgagccttgccaacattgtcggaccgacagtggccggtctgttattcgatgtgaacgtagaaattccatatatttttggtgtggtcgttctcgtgctcagctttttggcggcagtcagctgggggcggaagcagc

SEQ ID NO: 931 - DNA, 1143 bp, Bacillus licheniformis
aagcattcagccgccttcatccgttgatccgatttttgctgataggcacgcttgtcacgaaggcggctaagtcgatgacaaccccgtttttggcgctctatctccatatgaaaacgggagccgattttggaaccatcgggcttgtcatcggtttaggctatttttcaagcactgtaggaggggtagtcggaggagcgctttcagataaaatcggcagaaaaaaagtgatgctttcatccattttcatctggagctttgtattcattctttttggacttgttcatgatttcatgtggtttttattgctgaatattttaagctggctttgccattcgtgttttgaacctgtgtcaaaggctttgatggctgagttatcagaacgggagatgagattccgcattttctctttgcggtatttggccatcaatgttggagctgctgtcggccctttactgggcgcttattttggtcttgccaaaaccggaacgccgtttatcatcacagggctggtctattttggctatgccatacttttgagcttgatgatgattcggctgaccacggtgaaagagacaaaaatcgctcctgaaaaagtccaggcaggttcagttttgaagacgttaaagcaagacaaggctcttcgattatacatagccggcggcatcctttttttgttcagctattcgcaaatggaaagcactttgctgcagtatttaaataacgactttgcaaacggagttaaaatattttcgactttaatcacgttaaacgcggtgacggtcatccttttacaagtgccgctcacccgtttatttgagaggtataaatccttaacaacaatatcaattggaaccgttttttgcattttggggaatatcggtttttctatcgcaaatggctggattgtttttatgctttcgatgtttgttctgacaatcggcgaaattttatgttttccttcaatgaatgtccttttggacgagctggctccggatcatatgaagggcgcgtattacggcatgcaaaacttatacaacatcggtgagtttttagggccttggctggggggaatgatgcttgccttgtacgggggaaaagccgtctttcttattgctgcgtgttcagtctttttggctttaggcg

SEQ ID NO: 932 - DNA, 1266 bp, Bacillus licheniformis
atgttaagcgtattgaaaaataaaaactttttatttttgatattagggcgtttggtaaccaatattggggacagtatgtatacagttgcggcaatgtggcttgtgtttgatttatcaaaaagtacattttattccggattagctggttttttgacgatgttcccaactgttttgcaatttttaacaggtccgattgttgataaagtcagattaaataaagttttggtttggagtcaactcatccaagctattttggtgttgattattccgcttttttatttcattggatatttgaacatttggatcatcatgatgattatgcctcttatcgtattcattgagcaatttacttatcctgcgcaatctgccgcactgcctaaaataatcaaaagtcaagatctagttaaagcaaactcacttatgtcattttcatatcaaggtacagatattatatttactggtattgcaggtattgtgattgcttcggcaggagctataagcatatacttagttgactctttcacttttttgttagcggcgctgttttttaagtgcgtaaaattagaacaaaaaaatgagatagaacataagccccgattccacttcaaaaaagtcatacacaattatacaacggatataaaagagggatttacactcattcgtcattccctcattccaaaaatcctcttgggctcgatgatttctaacttcatgcttagtgcgacgattgtgattttgccaagcttctcttcgattagaggaggagaagaatactatggatattatttggcttccatgtcatgcggtttactgttaggttcaatattcgcaacagtgtttggccgattcgcgataggatcacttacgatatacggatttttcatttcaggggttttatggagtatttcggcgatcgccacctcttcatacatatcgattattttatttggtttgtctcaaatatccatcggcgtgacaaacgtcattttcatgtccattttgcaaagcatactgccggaagagtttatagggagagttttttcttttatcgcaagtttgacaagcatagcagctccttttggatctttgctgggagggtttaccgcgtcattgatcggcagcgataaggttttctttataggaggaattgccatgctgtttgtatctgtttattgggtgtttcagtcttctttaagatcaattccttcatcagaaaaaataaacgctaaagaatacagcttttttacaaacgtgttgaataaataa

SEQ ID NO: 933 - DNA, 1257 bp, Bacillus licheniformis
atgtacaaacttatggcagaaaaacaaaactctggcatgacggttgttgctatcgggtcgatcccgttgattatgacgttgggaaattcgatgctgattccgattttgccgaaaatgaaatccgaactcaatttatcgcaatttcaagtcagccttgtcattacagtgttttcgatcactgcagcgctctttattccgctgctcggttatttggccgaccgcttctcacggaaagtggtgattattccgtgcctgttcctttatggggcaggggggattcttgcagggtttgcatcgacgacctttgcgaatgccttcccatgggtgctgttcgggagaggactgcaagggctcggggcagccggtacagcgccgatcgcaatggcgctgacaggagacctttttaaaggggccgacgaaagccgggtgctcggtcttgttgaagcctcgaacggcttcggaaaagtgctgtctcctattttaggatcattgattgcattaatcgcttggttttgggtgttctttgcatttccggctttttgtattgcgccgatcattttgacttggatttttattaaagaaaaagacaagaaaaaagatccgccgcctcttggaaaatatgtaaaagggctgacaagcgtttttaaacatgagggcagatggcttttcaccgcatatctcgcaggagccgtctgtttgtttactctgtttggcatcctcttttacttatccgatgttttggaaaaagaatatcatacagacggcgtaaaaaaagggctgattttggcgatccctctgcttgtgatgtgtacaacatcatatattacgggcagcaaaatcggacaaaatcagcggctgatgaaaaagatgatggtcatcggactcgctctgattacggtttcctacggcacactgtcttttttctccgcgctcattccttttatttcgatccttgtcatcagcagcatcggcacaggctttgttctgccatgtgtcaacagcttcataaccggggctgtcggaaaagagaggcgcggctttgtgacatctctgtacggttcggtcagatttttaggagtcgccatcggaccgccgattttcgggagactgatggaatggtcgaaactcggcatgtttatgtccatagcgggcctgacgttgattgtcggtgtacttgtgctgaccatgattcacgtcaaaaaggaagacacgacaaaaaaaggggacaaggggctgcagccggctgacgcaagatag

SEQ ID NO: 934 - DNA, 774 bp, Bacillus licheniformis
gcggaatcgtatacggtattagcagtgccggagaggctcaggaagggtttcagtcccctctgatcatcggtgtgatcatcatcagcctgatcagcatcgtgttgttcgtgcttcggcagttgaaacttgaacaaccgttgcttgatgtgcgtgtgttcgcctataaaaattacacgcgcggggtctgcctttttgtgattgtcattatggcgatgttcgcttccgaaattgtgatgccgatgtatttgcaagggccgctcggtttttcagcaaaagcagcaggtcttttgcttttgcccggagccttgctaaacggtctcatgtcgccggctatgggcgctttgttcgataagttcggcccgagaaaactcatcattccaggtacgatcgttctcgtcggcgtgatgtttttcttcagcaggatcaatccttcggtgccgatttgggcgttcattattgtatacatcatcttgatgctgtccatctcggccatcatgatgcccgcacagacgaatgcattaaacgaattgccgaagcatttatatcctcatggaacggcaatttccaatactcttcagcctgttgcaggcgcactcggtgtttcggtgttcgtcagcatcatgagccagggacagaaaagctatcttgccggccaagaagcagccagcaaacaaatcgtgcatgaagcgatgactcatggtgttcaccatgcctactggtttgcgctcgctttaagctgtatcgctttctttaccgctttatttattaaaaaag

SEQ ID NO: 935 - DNA, 470 bp, Bacillus licheniformis
atgttttcaaacggccgcgggtttgtcatcgtgatgctttttttggcgggagtgattaattatttggatcgttcggcattgtctgtcgccgctccttttattcaggaagatttgaacatacgtccggcgcagatgggcatgctgttcagcagttttttcatcggatatgccgtctttaattttatcggcggctgggcatcagacaaatacggagcgaaacatacgctgtcggctgcaatggtcgtatggtcggttttcagcggcgctattgcactgacatataatttcgtttcactgtttatcatccgcgtcattttcggcatgggggaaggtccgctgtcagcggcaacgagcaagtcggtcaacaattggtttccgcaaaaagaaagggcaagagcgctcggcatgacaatgtgcggaacgccgctcggcggagccgtttcaggtccgatcgtcggattgatcgcgat

SEQ ID NO: 936 - DNA, 1098 bp, Bacillus licheniformis
atggcaacgatgattttagtgttttttgcctcaccctatttagggagtttggtggatcgatattctcgaaaagcgatattcctctatatggaaattacaggaatagtggtcttgggcgttttttctgttctatgcaatgtttccgccgtgttggacatcacccttgttgtgatgctgattttttatcatacagcttacgattcgataaagtatcctgctttagccgctttaacacaggaaatgttcaaaaaagaggactatagtaaagtgaacagcagtcttgaagttcaggggcaggcggcgctgatgattagttcggggctggctgccatgatgatcggcaagatggatgcggcagttattttggttatgaacatctctacatttatagcagcttccatcctcatctaccaacttccttatcaaagaaatgctgaagcggaagagcattccaatacaatgaaaaatgaatcttactggaaaaacttcagatcctcactccaatatttatgttatcgaaaagttttgtttgttcttttattgacttcttttataccaagcatcgtgattattgtcgcaaactacttggatccggttttcatttacgactatttaaacgaaggtccgtcagttatcggcattgccaatattgtttacgccattggagctatgggtgcgggctttgtcgcatatcaaatatcaaagaaatggtctgatatgcaaggtgttatattgtttatggcagtatttgctctagcaacaattgcgatcttcctcgttccgaatgccgtgacatttatagtggcaagcctcttttgggggcattcaaatgctgcgatcagagtatttagaaaaagctatatgttccatcatgtcgataatgcatatatgggacgtgtcaattcgttgtttaatgcggtaaagctgttgggacaagttgctttaataggcatcttgacgattacagtagtgccggcgggtcaaactgtttacggatacttcgttttattcatcattgtaattgctgctcttttaacaacaacttatttatttaacagaacttataacaaagataaagaaaagcgggtatctttatag

SEQ ID NO: 937 - DNA, 1047 bp, Bacillus licheniformis
atgcaaattccatcaggagcacttgtcgataaatttggacaaaaaaaggtgttaattcctgcatttatcgtttttgcgctggctacatttgtgattggcacaagttcaactatcatgcaagtatacattggttcgttattggctggtatttcgactggttcatattacggtgcagccttttccttatcagctaaacatacgccaaaagataaaaaaagcttttccaatgcgattataaatagcggttcagcattagggatggtaattggactaatcggatcatcggttttagtaggcggttttgaaattcaatggaattatatgctttttataacagctatcgttatcgtagctgtaacatttgtgtttgtgctgtttattaaacaagataaaacatcagataaggaagtggctgaagagaagaaagacactgtacaaagcacagatattcaaaatgaaagcttattttctccaagacaattagttgtatattttgtatattttgcaacatgctatggctattatatgattgtaacttggttgccgtcctttcttgtagcagaaaaaggatttgctcaaggttcagtaggatatgtagctgcactagttgcggtcactgcagtgcctggtgctttgatatttactaaatatatagacaaaaatgcacatttgcgtctgcgtttaattttatttttattaattgcagcagcagtaacaattagtttgacagtgtttgcaccaaatcctgcagtactgtatattgcgttaattttatatggcttattaggtaaacttgcgattgatccagttttaataacctatgtatctgattccgtatcaggagacagagttgccagagcattaactctctttaacttctttggaatgagttcatctgttattgcaccaacacttactggttatattggtgatgtaaccggctcgcgagtattagcattctatattgcaaccattcttcttgcagcagcagcgttgctatttttccttgtggttatgttaagacagaataaaacagcagctaactaa

SEQ ID NO: 938 - DNA, 993 bp, Bacillus licheniformis
atgatcatttcagctgtatttttaatgatcggatttttggcgctgtcaggcatgaattcggtttttttgctggccgcttcaagggtgatcgtatcggcatgtttgaccgcaatcgaacccgctgcaagatcgctcttgccagatacattgagaaaagaacaaattgaaaaaggaatcgcatttcaagaagtgctcacacagctcatccaagtgattgttccgcttgtcacaggggttctgttttcctttttgcattttggctggttatgggtgctgtgcggaagcctttccttcttgtcgatctttttggagtggagaatcaaagatgaaaggggcagccaaaagcgtattccttttaccaataaacaattgttcagcggttttacaagcttgtatcaaaataagccgctcaagtatttgttgtatgggacgagcatacagcagcttgtattcagcggttttccgatatatatcgtcatttggacttcgctgcttttaaaagatcaggcctggctgggcggcgctttccaatcattttgggcgtgcgggacgctgtgtgcggcgcttttcttgtcctttatcgcaaaaccggagcacgcaaaagcagctgtgcctgctttaatgctgattttcggcctgcttttgtctcctctcggctggattgatcatgtcgtgctgggcgctgtgaatttgatcgtcatcggaatgatcagcggcgtcgtcaacatctatattgaaggttacttgcaaagggtaacggaaggtgaaaatagaggcagatcgctgggcgctttctttgcggtcaacagctcttttatgccgctcggctatgctgccgcagggatgttgtcggaggccgtcagtccggaatatttattcctcatcgtcgcactgcccgcgccgttcgctgcgttttcaatgatgagatcattttatttatgggaaaaacagacgaaggaaacggtcgctttgcaggatgaaacgtcaatataa

SEQ ID NO: 939 - DNA, 918 bp, Bacillus licheniformis
  misc_feature (1)...(918): n = A,T,C or G
atgctgggattggcccttattccgtcaatcggccttttaatcggtatctttttcatgccggaaagcccgcgctggctcttaacaaaaggaaaagaagagaaagcaaggcgggttttgtcaaagatgagaggaggagagcgggtcgatcaggaagtcaaagaaattattgttgcggaaaagcaggaccaggggggcttgaaagagctgctggaaccgtgggtgcgcccggcgttaatcgcaggggtcggactggcatttctgcagcaatttattggaaccaacacgattatttactatgccccaaaaacgtttacgaatgtcggatttgaagattcggcggccattttagggacagtcggctttttaacggtcaatgtcctgatgacgcttgtggcgatccgcttcattgacaggattggccggaagccgcttttattatttggaaatgccggaatggtcatcagtttgatcgtgctttctttttctaatctctttttcggcaatacctctggtgcggcatggacgactgtcatctgcttaggtgtgttcatcgtcgtatttgccgtcagctgggggccgatcgtctgggtgatgctgcctgagctgttcccccttcatgtcagagggataggaaccggagtatcgactttaatgctccatgcagggaacttaattgtgactntgagttttcccgtcctcatggaagcgatgggcatcagttacctgtttctgtgctatgcggncatgggaatcgcggnctttctggntcgtctctttaaggtacagaaacaaaaggaaagtctgggagagatcgagcaggatttgcgggacaagcaccgcggaattacgggaactgacacaatcccggtgaacgataggcaaaaggatgggcaggccccatcctttttgggtgantag

SEQ ID NO: 940 - DNA, 585 bp, Bacillus licheniformis
aggcgtgcccgcgatcgccatggcttatgtcggagaggaatttgatccgcgagggctcggcaaaatgatggggctatacattagcggcacaagcctcggaggaatgagcggaaggcttttgaccggccttttgacagacttgttcagctggcgcgcggcgctaggaatcatcggggcattatcagtactattaagctatttgttttggattttgctgccccggccgcagcactccgctaagcgaaaaacaagtgtgaaaaaagcgagcttggcctacggcgccgtcttgatgaacaaacggctgctgtcaatcatttcacttggatttctattaatgggaagctttgttacgctgttcaattatatcgggtttcagttgatgggacctccgtacagactctctcaaactgtcatcgggttcatctttatcgtttatttggcggggacgctcagttctgtctatatggggaagaaagccgatcgttttggcagcccgttgatgctgaaaatcgggattgccattatcgcaggaggcgcattgcttacgcttctgcctcagcttcctcttaaaattgccggaatcgc

SEQ ID NO: 941 - DNA, 843 bp, Bacillus licheniformis
atgacaaaagaggcgggatcagttgaaggtaaaggaaaacaaccactggttccctattgggtaaaagttgttatcgtatttttcttcggttgggtggctctttatgcaacgcgaacaatattaaaccccattatgggggatattgaatcagcgttttcattaagcaaggcacaacttggcttaattatgagtatatttttcatcggttatgctggtatgaatgttcctgcaggaatattaggagataaaattgggaaaaaacgagtgttggttccaggtgttattctatttggctcgcttgcagcagttacagggatgatgcccacattctttctgtttatctctgcatggcttatggttggtatggctcagggggtatattatgggccgcaatatggaatatcatccgaaattatcccgaagaaccgtctaacattaggcagtgctgtgattaatgcagggatggcttttggtacttcaattggctattatatctccagttatgttgttggagaatggggattcggatggggaaccccattttttgccatcgcagtgccggttgtacttatcggcatcgcaatggcaattgtaattaaagacaaaccaaaaactgataaagaggttaaaaggagcgctgaaccgtttaagttttcatctttatttaatagaaacttaattttggcatatattattattttctgctctatttacggattctttatgattattacttggttgccatactatttagaaacagcacgcggtttaaaccggaggaaatattgcctttgttgcatcacttgttccatgggcagcaattccaggttcattattttttag

SEQ ID NO: 942 - DNA, 324 bp, Bacillus licheniformis
ttggttctttttgcggctcttgatcggaatcggggatcatatgatgcacttttcaacgcaaacttgggtgaccacattatcgtgtgaaaaaaaacgcggcggcaatatctctttgtacggcctttcgtttggtttgggatttgcagccgggccttttttaacgccgcttgtcaacatcgccccatcattgccgtttatcgtatcaggtgcgttcagcctgctggcatggctgtttattttttgcctgcaaaacgatttccctgagaaaagcggctctgaaagccgcagcgataacagcttgaagcgtttcgctcaagccttcct

SEQ ID NO: 943 - DNA, 747 bp, Bacillus licheniformis
atgattttctttaaggagaatcccgcagatcataagcgcgtcaatgaggcggaactggcccatattcgggaagggcaggctcacatggaagaaacgggcggcggccagccgctgaagtggtatcagctattcaaatatcgcaacatatgggcgatgtgcattggatttttcatgatcaattataattcttacttctttatcacatggctgccgacataccttgttaaagaaaggggcatggatttaatcgagatggggattatggcgtctctcccgcttttgactgcaatggtcgtcgaagtcggagccggatggatgtccgaccggatatatgcaaagggaaaactgtcgctgacagccgtccggaaactgtttttaattatcgggcttgtcatggcttcgtgcatcggttttgccgcttttgcagattccgctatcctggctgtcatccttctttgtgtagcgaaatcgggaacgactgtcgccgcgtcccaagtctgggcgcttccgggggatgtggctccgaaaaatatgacgtcgatggttgccggtattcaaaatacagtctctaatatgggccggagtggtcggacccatcattaccggcttcatcgttggcgcaacgggttctttcgtgccggcgctccttttttcggctgctttgatcatcattgccattttaaattatctattcctattgggaaaagtgaaacagattcaagtataagtatcaagcccggctcataa

SEQ ID NO: 944 - DNA, 351 bp, Bacillus licheniformis
caaagccgaacagggtatggatcgctgtcatattgggtattttatcgggaatcggtccggttgtgatcgatttatatttgcccggccttccacagatggcaactgatttacatacgaatgcttccgtcgttcagctcagtttaacatcgtgtttactggggctggcaatcggccaaattgtcatcggccctttcagcgatgtccttggaagaaggcttccgctgatcgtgtcgctgtccgtttttgccgcggcctcttttttatgtgctatgacatcttctgtatgggttttgatcgcgatgcgctttattcaaggagcggcgggggcaggcggcatcgtcatatcacgac

SEQ ID NO: 945 - DNA, 810 bp, Bacillus licheniformis
  misc_feature (1)...(810): n = A,T,C or G
tttacttatatgttggaatgctaaaattanncccgaatcaccacgttttttaataaagaacaataaacttgatgaagctcgcaaggtgttgagctatattcgctctaacaaaggagagattgattctgaaataacgcaaattcaagaaactgccagagaagaagcgaaggcaaatcaaaatgcatcatgggctaccctcttaagcaataaatatcgttttttattaattgccggtgtgggtgttgctgcttttcaacaattccagggtgcaaacgcaattttttattacattcctttaattgtagaaaaagcaacaggaaatgcagcaagttcagctttgatgtggccgattattcaaggagttattctcgtgctaggttcattaatattcttagtgattgctgataaatttaatcgccgtactttattaacagtaggcggaacaataatggggctgtcctttattttgccggcaatattgaatatattaattcctaatgcgaatccgatgatgatggttgtctttttgagtatctatgtagcactttattcattcacatgggctcctttaacttgggtcatagttggagaaattttcccgctggtaattcgcgggcgtgcgtctggtttagcttcatcatttaactggattggttctttcttggttggattgctatttcctgttatgaccgcttcgatgtctcaagaagctgtgtttgcaatcttcggtgtgatttgtttgcttggagttgtatttatccggacacgcgtccctgaaactcgaggtcgcagtttagaggaaatcgaaaa

SEQ ID NO: 946 - DNA, 515 bp, Bacillus licheniformis
aaaaaaagtcaaatgtacgctgggttgtcgcgtttatgatgtgggctgcgattgccatcaattatattgaccggacagttctttcggctgccgctccctatattaccgaggagttcaacttgacacccggccaaatgggaatcatcatgtccggtttcttctggtcgtacgctttgctgcagctgccttcaggctgggcggccgacaagtacggtcagaaaaaaacgctcggttttgcggttgtttggtggtctgttgctacggcgctgacgggtcttgcgacaggcttcaaatccctgctcgggctgcgggtcgcactgggagtcggagaggctgctgcatatccgagcaatgcggggattgccgccaaatggtttccgaaaaaagaaagggcgacagtagccggaatttttgacagcgggtcaaagtttggcggagactgttgcaatgcctttgatcgcctggatgatagcggtcttgactggcaaactgacgtttattttggcacccaagga

SEQ ID NO: 947 - DNA, 456 bp, Bacillus licheniformis
atgaagggaaaaagatcgaatgcctggctttatttttttggagccttgggcggtgtgctctacggttatgatacaggcgtcatttccggggcgattttgtttatgaaagatgaacttgggctcaatgcctttacagaagggctggttgtcagcgcaatattaatcggggcgattttcggatcgggtttgtcaggcaggctgacagaccgcttcggccgaagaagggcgattatgtcagcggctgtgctgtattgcatcggggggctcggaacggccctggcgccaagcacggaatatatggtggctttcaggatcgtgctcggccttgcagtcggctgttcaacgaccatcgttcctttgtacctttcaaagcttgctccgaaggaaatcccgggcgcgccttcttcattaaatcagctgatgattacgaatcgggattctgctctcttattttga

SEQ ID NO: 948 - DNA, 267 bp, Bacillus licheniformis
aaagaaaatctcaagtggcttcatttacttttttggggcttttgcgggcattcttttcggttatgatatcggcgttatgacgggtgctttgccttttctgcaaaatgattggaaccttcaagacaacgccggggttattggatggattacctcttcggtaatgttaggcgctatttttggaggcgcccttgccggacaactttctgatcgtttgggacggcgcaaaatattttaatttccgctatcattttgttgtggataccgagg

SEQ ID NO: 949 - DNA, 261 bp, Bacillus licheniformis
tgtgggatcaactctttcactccgcatcagttttatggccgacctgcttccaaaacgccttctcccggccgggaacttgatgtgcggaattacattcaacttccgaagcattttcggtccggttgcaggcgggtggtatatgcagatattccataacagcaacctgttttattagattacatgcgtgatggtgttgatctggatcggggtgctctttggcaaaacgaagaaaaacggcgctctccaacaatctgaggcggc

SEQ ID NO: 950 - DNA, 954 bp, Bacillus licheniformis
attttcctttttctttgtcaaattggctctcactgcagcgagtccggtcgacattctggcccatcgctttacggtcgcttttttggctgcgcttattccccttctgctcggatgggtgaagatcgccatcagcataaaagacgcactgaaagtgctgcctttagcattattttaccctgtcatgttttttgcttttcaagttttcgggctcgtctacacgtcttcgtctgaagccggaatcattcaagcggcgatcccgattttcaccatgatattcgccgcttattttttaaatgagcggtttacgaaacggcaattcttttttaccgtcttgtcagcggcgggggtggcctgcatctttatgatgaaaagtgcaggcaccggaagttccgatttaagaggggcggcgctgattttgctttcggcgctttcatcggcgggctacagcgtgctcgccagaaagatgacgcgaaccttcagctcgcttgaattaacatatgtcacaacgggagcgggatttctttttttcaacggcatcgccggaatcagccatatgtcagacggcacgctgagcggattttttgcccccttcactgatccggtgtttgttctttcggtattgtatttaggcgtgttgtcatcgtttgcgacatcatttttatcaaattatgcactgtcaaaaatagaagctgcgaaaatcagcatgtttaatcacttggcgacactggtgacgattttggcggggattatatggctgggagaatcactcgaatggtttcacttcgccggaacggggatgatcattgccggaattattggggcgacgatggttcggcgggaaaatcggctgaaaaaaagctgaaaaaacggaaaatcggcagctgcagcacaccgattttccgctttctttacattgtcggaacagccgtactgcggctggccgcggcaatcgtt

SEQ ID NO: 951 - DNA, 896 bp, Bacillus licheniformis
atgaagacaagacgcgaaaccgccggacacctcgcagctgtgatcacgatcatcatctggggtactacttttgtctcaacaaaggtgctgctcgaggatttcccgcccgtagatatattgttttaccgttttctcatcgggttgattgtgctgatcatggtgcatccgcatgtgctgactttccggagctggaggcaagaagcgctgtttgcgggagcaggtttatgcggagtgacgctttactttctgttggaaaacatcgcgcttactcttacctacgcctcaaacgccggcatgatcgtcgcggttattccgatgatcaccgcggtattggcgcattttctcctttcgggcgaaaagctggagccccgctttttcattgggttcgccgccgctttcactggacttgcgctcattttctttaatggacaaatgatgcttaaattgaatccgctcggcgacattctcgctgctgcctccgcattcgtctgggcggcatatgcgattttgatgaaaaaaatcagcacattcggttaccatacaatccaatgcacacagcggatctttctgtacggtttgctattcatggttcccgctctgttcctgtttgatttccgcttcgacgcaagccctttttcctcccccgtcaattggttgaacatcctattcttaggcgcgggcgcatctgcgctttgctttgtgacatggaactggtcggtcggtgtgcttggagcggtaaaaacgagcgcttatatctatatggtgcccgtcatcactattgcggcatccgttatcattctgcaagaaaaactgacatgggttgctttttgcggaggagcgctcacattggccggcctttatatttctgaaacaaaaccaaaaccgcagctgaagga

SEQ ID NO: 952 - DNA, 909 bp, Bacillus licheniformis
tcaacacggtgttcgaaaagcggccggggtcgtttttatggtctttgggacgatgtgttttgcttcaaaatccatttttgtcaaatgggcttatgaacaaggtgcacagccggaagcggtgctgttgtaccggcaattatttgcggcgccgctgttttggctgatttttattgtgtatcgctcaaagcttccggctaagcctgaaaaagcggagatttttaaagcttgtgcggccggattgctttgtttttttctatcgccattgcttgattttatcggccttcacggtgtttctgcaaccgttgaacggatgattgtgatgagctaccccatgttcgtattgatcataaccgcctttgtaaataaaaaaatggtctcgggtaaaacgtttgctgccatcttgcttgtgaatgccgggctgtttttggctgtcggcggatgggatgtgcaagcattggaagcgaacctgtcaggggcttttttgatcctattgtccgctgtcgcttatgcggcctatcttgttgtggcgggaggacttgtccgtcaaatcggagggattcgaatgaatgcctatggaatgtcggcagcaagtcttgcgatggccggttatgcgctgcttcgctcgctgagagaacaaccgggaatcgtgctttcttatcctcccgcaatgtatggtttttttatgatcattgcggcggtgacgacggtcattccttttttattcatgctggaaggcatgaagcggataggagcggaacgaggggccgtcatttccatgatcggccccgtcctcaccatcttcggaggtgttttgtttttaaacgaacgtttaactcccgttcagtggctggggtgcttgctagtgcacctgacggttagtctgctggaataccggaaatagagaaaggg

SEQ ID NO: 953 - DNA, 819 bp, Bacillus licheniformis
agtatcggttctgtttgtcttgcttgcggcaattttatggggaacgacgggaacaacccaggcatttgcgccgaaagaggcggcacctcttgtgttcggcgctgtcagaatggctgtcggcggcatcaccctgctcttgttcgcggctttccgcggtcaattgaaacgaagcggctggcccgttaaaacgctgatcatcgcagcattgagcatggcattttaccagcctttctttttttcagccgtcagcctgtcaggaatcgccgtcggaacggtcgtcgccatcggcagcgctccgattattgccggctgcctcgaatggctggtgttcaaaaaggttccgcagacgaaatggtggatcgcaactgctgcagcgatagcaggcgtagccttattattcattccctccgcctcatcgggggggagctttctcggcatactgctcgcacttggcgccggtctttcctttgccgtctacacgctgacaagcaagaaactcctgcaaaagcaaaagccggaggctgtcacaggcaccgtattctttttaagcgctgtattgcttgccccgttgttgtttctgtacgatctcggctggatctcatcggttcagggaatggctgtcagcctctatatcggggtcattgcaaccggagccgcgtacctgttatttacgacaggattggcaaaagtgcccgcctcaacggcggtgacgctgtcgcttgctgaaccgcttacagcgtcgctgttgggaaccgtgcttgtcagggaatcgctgcctcttgtttcctgggccgggatcgccctgcttcttttaggcat

SEQ ID NO: 954 - DNA, 555 bp, Bacillus licheniformis
ctctgtttggggtgcttgttttcctgagtgggcgacgacaatctcgatcgttctcggcgttctggcgctgatttttatcatcgtgggaatcgtgctgacatcgctggaagaccgcagccaaaaaacagaggaaaaaaccggcgacatgaaaaaaggaatcgtgattttgctgatttcaacattcggctatctcgtgtatgtcgtcgtcgtccggctttttgatgtcagcggctgggcggctctttttcctcaggctgtcggcatggttgccggcggtttgatcttgacattcaggcataagccgtttaatttttacgtcatcaaaaatatcattcctggtttaatctgggcagcgggaaacatgtttttattcatctcccagccgcgggtcggcgtagcgaccagtttttcgctatcacagatggggatcgtcatctcaacgctcggcggcattattctgctcggcgaaaagaaaacaaagcggcagctgatcggtatcgccatcggcatcatactgatcgtcgcagccggcgttttgctgggcatcgcaaaagc

SEQ ID NO: 955 - DNA, 536 bp, Bacillus licheniformis
atgtttaaagtacttttggggatcatctctgtaacgctgatttgggggtatacctgggtgacgatgaaaatcgcaatcactgacattccccctgttttattttcggccctgcggctgttcattggagctgttcctttgtttgtgattctcttgatcaaaggaaggaaacgttcaataggaaaggagaatatcaagcattatctggtgatgagtttattgatgggtttaggttatatgggggtgttaacttacggcatgcagtttgtcgattcgggaaaaacgtctgttttggtgtacaccatgcctatttttgttactgtcatcagtcattttaaattaaacgagaaaatcaatgtgtataaaatgctcggtttattttctggtctgatcggtcttttgtttatattagggggcgggattctgcatgttgatcaaaacgtcatatttggagagctttgcgttttaatcgcagcgctcagctggggcgtcgccaatgtttacagcaaactccggcggaatgagggaaatgcagtgca

SEQ ID NO: 956 - DNA, 843 bp, Bacillus licheniformis
tagcattagtggtcggggtgttggctgtgtcttcctccgccatcttcgtcaggctgtcaacagctgatgctggaatcatcgctttttatcgtctctttttttccgctttgctgatctttccttttttctggggaaaaagaaaagaagtcttgggtttttcgaaaaaagactggctgttttccgcggcagcgggattctttttagcatttcattttattttatggtttcgctcgcttgaatacacgtctgtggcgagctcggttgttcttgttacgctgcagccgatcttttcctttatcggtacatattttttatttaaagaaagagtctcgttcgctgggatcatcagtgcgcttctcgcgatcggcggaagcgtgtacatcagctggggggatttcaaagtaagcggccaggcgctctacggcgatatcctggcgcttttggcatgtgcgcttgtgacggcatatctgctgtttggccagcatgtcagaaaacgccacagcttgaccgtttacacttttattgtatatggaatcagcgccctcactttatgtctatactgcctgttttcgggcgccgcctttttttcttatcctgcgtcagattggggttacttctttctgcttgccgtcattccgactttgctcggccactcgctctttaactgggtgctgaaatggctgagcacaaatatgatttctgtggcgattttatttgaacccgtcggagcggttgcgctggcgtattggattttagacgaatccgtcatgatgacgcaggtgatcggcggagcggtcattttttcaggcatcatcctgttcatggcctcgcaaagcatacgga

SEQ ID NO: 957 - DNA, 939 bp, Bacillus licheniformis
atgctgacaaacgttttaaagtatcgggttcatattttatttatcgtgttatgtttgatcggcgggacgacatgggcttttcaaaaagccgggctgagtgacagccttccattttggtccgccggcatgcggttcatgatcgcaagcattttgatcgcggcgtttctgttggcacggaggcagtttgttctgtcaaaggaactgctagtgctgtcgtttttgaacggcatcatgtatttttccgttccattcggatctgtttattgggcctctctttatttgccgagcgggttggtgtctatattagcggcaagcatttcagtctttgccctgatgatcaaccgcctcgtcaaagggacaccggcgacgaaactgcagaaatgggggatatgcctggctttgctcggcattacaatcgtgtttggcaaccaactgctgatcaaagtcgatgttattgaaattgtcgcaatgattgtgattttgtgtgcgatgtttggctcggcttttattcaaatcaaagtacagcagagaattcgttcgcttccgatcttaagctttaactccctttcaatgctgagcggcggagcggtattgctcatcagcagcctcatctttgaaagcgggacaagaacgttttccggtgtgagtctttatgcgctgctttatttagcggttgtcggctcgattttgggtttttggatcaacatttatctgcttaaaaaatggcacatctcaaaagcgacttcccacttgttcatctcccctgtcattgcgctctatatcggatttctgtttctggatgaaaaactgaatgcgaatatttatttaggaacgctgtttgtcatattcggtgtgatgttcatcaacttaaaaaaagaagagaggatcgcgaaaattgacgaaacgaaacaaaaacttggccatcatttgtcaaaataa

SEQ ID NO: 958 - DNA, 912 bp, Bacillus licheniformis
atgactgtcgtgggtttttgcgtattattatgttctgcatttatccatgcatcgtggaactatctttctaaaaaagccgatggaggcgttacgattatctggctgttcacagcgattgcagccgtcatctacacgccgttggccataggtgtcgtcatatatgaaaagcctgagatcggcatctggcagcttgtcatcatcatggcgagcatccttgctcacttgggcttttttcttgttcttcaaaaaggatacaaaaagggcgatctctcccttgtctatccgatcgcgagggggacaggcccgctgctcacctgcatgctggcggtcgccttttttggcgagacgttgacgctgcccgctattatagggattctattgattgtgatcagcattcttttttttacagggggagtgaagcggttaaaagaatcaggctcgttcacaccggttctttacgggctggcggtcggcggcattattgccgcatatactctccttgataaagcagcggtcagccggtttctcattccgccattgctgctggattattgcaatacgctcggccgcctggtcatattgactccttatgccgcgaaaagctggagtgaagtccggtttgagtggaagcatcaccggatggaagctgtcggggtcggggtttttaattctttggcttatattttggcgctgagtgtcatggtatttgccccggtcagctatgtggcgcctgttcgggaaatcagcattttaatcggaaccgtgatgggggcggttttttgtcccgaaggtttcggtcgattttggatcatttcggctgtcttaatgttgcttgtcttgatatcggtaaccgcttgttatgttgtgttccatctgtgtgatccgttaaatttgtattttaaattgaaatga

SEQ ID NO: 959 - DNA, 369 bp, Bacillus licheniformis
atgaaatcagctcatgtgaaaggcgtattgatggtgctggcaggggcttcgttgtggggattatcggggagcgctgcacagtttgtatttgaaaggggagcggctgatgccggctcgcttgtcttcgtcaggcttttggcgtcgggcgtcattctcttgctatatgtttcaatgaaaaacggatttcaacatgtgtgtcagatatggaagaaaaaaacagatatttgttcgattttggtattttccatttttggaatgctgggccgtccaatatacattttttggcttaatcgaaaaaggaaatgccgctgctggtggaattttttaatatttggcggcctttttcgaattggtttaactatatggtaa

SEQ ID NO: 960 - DNA, 345 bp, Bacillus licheniformis
atgattcatatgaatgcatggcagcttctcacaggagcggtgatgttattgattttctcttttatactggaaccgtcccggccgattcactggtcaaatgaagcaatcttgtctctattgtttaacggtttattctctacggctttgacgttcgtcatttggttttggatactgaatcaaatcgaagcgtcgaaagcatcgatggctttaatgtttgttcccgtattaggccttttgttcggctggctgcagctgcatgaaccggtcacattcagcatcctgatcggcgcattcatgatctgcatcggcatttttatgaatacttatcaatttaaaaaagtgtaa

SEQ ID NO: 961 - DNA, 1141 bp, Bacillus licheniformis
atggaaaaaaacaaacaaattccacagccgatcagaggagaaaaaggagcggaaacgaaaattccgcacaacgttgagcgcgaccgccaaaacccggacatgctcgtaccgcctgaaaccgaccacggaacggtgccaaacatgaaattttcattttccgatgtccataaccgtcttgaaaaaggcggatatgcacgggaagtcacagttcgcgagctgccgatttcagacaagcttgcttctgtcaacatgaggctgaaacctggggccatcagggagctgcactggcataaggaagccgaatgggcgtatatgctgtacggaaaagcacggattacgtctgttgaccaagacggcagaaactttattgaagatgtgaaagaaggagatctctggtacttcccgtcaggtctgccgcattcaattcaagcacttgaagacggatgcgaattcctgcttgtcttcgatgacggctccttctctgaaaacagcaccttccaggtgacagattggctggcccatacgcctgatgaggtgattgccgcaaacttcggcatttcaaaagacgtcgtcgcctctcttccagttgaagaaaagtatattttccaagaagcgatccctggctgtcttgagaaagacaaagttgaaagcccgaacggaacggtacctctatctttcagctacaatttgcttgaacaggaaccgattatatccatcggaggaaaagtatggattgccgattccacgaacttcaaagcatcgaaaacgatcgcttctgcgttagtggaagtcgaacctggaggcatccgggagctgcactggcatccgaatacagacgaatggcagtattacatttccggacaagcgaaaatgacggttttcgctgccgacgggcatgccagaacatttaattaccaggccggagatgtcggctatgtgccgttcgcaatgggacactacgtccaaaatacaggagatgagccgcttcggttcctcgaaattttcaaagacgaccactatgctgacgtttcgttaaaccaatggctcgcgcttgttccggaagagcttgtccgccagcaccttgacgtcggcagcgaatttacaaaaatgctctctaaagaaaagcatccggtcgtcaaat

SEQ ID NO: 962 - DNA, 1038 bp, Bacillus licheniformis
tcacgtgccgcatccaataagaaacgatggtgcgggcgcgaccgattttggcccccgcgacgtgatgcgggatttagagaatcccgacatgttcgttcctccaaaaacagatgccggagcaatccctaatttaaagttttctttttcagacacacatatgcagttaaatcatggcggctggtcccgtgaaataacagcccgggaactgccggtatcaacgacgattgccggcgtcaatatgcggctgacgccaggcggggttcgcgagttgcattggcataagcaatcggaatgggcttacatgattttgggccatgcgcgcattaccgccgtcgatcaggaaggccgaaactttatcgccgatgtcggccccggagatttgtggttctttcccgccggaataccgcactcgattcaagggcttgaggatggctgcgaatttctcctcgtttttgatgacgggaacttctctgagttcgataccatcacgattaccgattggttcgcacacacaccgaaagatgttctggccgcgaatttcggtgtacacgaaagcgccttcgcccgcatccctgacaaacagcggtacatcttccaagcaaaagtgccgggaccgcttgaaaaccaaaaagtgccggacccgtatggaaccgtcccaaaaagcttcgcatacaggctgtttgcacaaaagcctatcgtaacgccgggcggaacggtacgaattgttgattcttcaaactttccaatttcgacagcgatcgccgccgcactcgtcgaagtcaagcccggcggaatgagggaaatgcattggcacccgaacaacgatgaatggcagtactatatctcagggaccgggcgaatgacagtattcgccgcaaacgagactgcccggacctttaattaccgggcgggggatgtcggatatgtcccgtttgccatggggcattacattcaaaatacaggcagcgaaagcctgtggtttttagaaatattcaaaagcagccgctttgcagacatttcattaaatcagtggatggc

SEQ ID NO: 963 - DNA, 1941 bp, Bacillus licheniformis
tgaatacgaggcaaaaagacattctgaatctgttgttatctgaacctgatgactatttagtcgtacaagatttcgcagacagggtaaagtgttctgaaaaaacgatcagaaatgatctgaaaacgattgaagactatctcaatcagcattctgatgctcaattaattcgcaaaccgggattgggcgtttatttgaatattgaagatcaagaaagagtccgtttaagccggcaattatataccgaacatcacgccgcacagcagctacccgatgaagaaagaatgctgcaaatcgcttatcagctattaatgaatccaaagccggtttctgcaaaagaaatggctgccgagcatttcttgaataagtcttccatcaaaagggatttgaataaaattgacgtttggctgaagcggtttggcctcacactggtatccaagcagcgcctcggtttaaagatcgaaggaagtgaaaaaaataagagaaaagcgctggcgcgcatctcggagttgattgacaacccggagtttacaagccgatttattaaaagtaaatttttaagccatgaagtggaatttgttaaaagtgagatcagatcattgcaaaggcggcattctttatatttcactgatgaaacgttcgaaaatttactgttgcatacattgctgatgatccgccgcatcaaaatgaaacagccgatcaccatttcgccgggggaaatcgatgcagtcaaaaagaaaaaagaatttcagtggacgtttgcctgtttaaaacggctggaagctgtttttgcgatccgctttcctgaagaagaggccgtctatttaacattgcatatattaggcggaaaagttcgctacccatttggaaaagaaggggacagcggactggaaaaccctttgcttccaaaggttgtcgaatatttaatcaatcgcgtatcagagttgaaaatgatggatttccgcgaggaccgggttttgatcaatggattgaaagttcaccttaataccgttttaaaccggctgagctatgacctttccgtatcaaatccgatgctcaatgatatcaaaaaaatgtacccttatctgtttcatattgtcattgatgctcttgaagacatcaaccaaacgttttcactttcgattcccgaggaagaagccgcctatctgacattgcatttccaagcggcgatcgagcgcttcagctatggaaaagacaagcataaaaaagcgatcatcgtttgtcatatgggcatcggaatgtcacagctgctgcggacaaaaatcgaacggaaattccaccaaattgccgtgatggactgcatcgcgaaagcagatttggcggactatactgcaagatataaagatatcgagcttgtcatatcaacggtcagcctggaggatttatcaattcctcatattgttgtatcaccgctgctcgagtcggctgatgagaaaaagctcagcgactttatggatcagctcggtgaatcgacccgccaaaaacaaaaaacgtttaaagtgctgaacgacacgactccttttctcgttttcttgcagcaagagtcagaacaccgctacaagctgattgaacagctggcaatcgctttatacgagaaaggctatgtggaaaaagaatatgccgtacacgccgtcttgagagagaaaatgtcggcgacaaacatcggagcgggcatcgcgattccccacgcgaacgccaaattgattaaacaatcagccattgcgatcgccacattaaaggagccgcttgactggggctctgaaaaagtatcgctcgtctttatgctggctgtcaaacatgaggatcaaaacatgacaaaacaattgttccaagagctgtccagcttaagcgagcagccggccttcatccaaaagctgacgaaagaaacaaatgtgatgaagttcttatcttatttggattatt

SEQ ID NO: 964 - DNA, 1452 bp, Bacillus licheniformis
gatgagatgaagctgcgatcgtgcatcgcagagcacctttttccaagcgggaaacggatattgatattatgaacacccggatatccattctcccaaaagaagagcttgctatgatccgtcaaacgattttagaaaaaataagcgaagatcaaatttctctttcagatatcggactaaacaatcttctcatccacgtcgccattgcatgcaaacgcatccgaagcggcaaacatgtttctctttattccaaagatgtaaaggagattatgaatcataaagaatatgaagtggcgagggcgattgtccgcactcttgaacaaaagctgcacgtggcgtttccagaaaaagaaacggcctacatcgccatccatttgcttggcgcgaaaaggacggttatggccgccattcgcagcggtgcaatcgaaagcatgatggatgaagaagagacagaccggctgacgcaattgatcatgaaaaccatcgatcaaaaattcaccctcggcattggggatgacaaagaattaaaaatcggtctcggccttcacctaaaaccggctttgaatcgctgcagatacggcatgaatatcagaaatccaatgctggatgcaattaaggccaattatccgctcgcatttgaagcgggtattcaagccggtgaagtcatcaaaagagagacgggatttgacattcaggaaagcgaggtcggctacctcgcgttgcatataggcgcagccatggaaagaagaaacatgaacaggccctcaaaacgctgtatgattgtctgtgcttcaggggccggaagcgccatgctgcttcaggacagactgcgggcaacattcggttcaaagcttgagatccttggaacggttgattactacaagctgaatcaaatgtcgctccatgcactcgactttgttatcagcacaataccgctgtccgatgatcttcccattccggtgattcaagtaaacacaatactgggagggggagatttaacgaaaatagaacaagtgcttgccgaagatgacggaatcgcttcgacttatacgagaaaagagcttgtctttttgcgggaaagtctgtcttcaagagaggatgtccttcgctttctgtgcggaaaagtgacgcaatcagggcttgcagacgcggggcttgaagcctcggtctttgaacgggaggccgttgcgcccacttgcttcggcaatctggttgcgattccgcatccgatgacaccaaaaaccgcttcaactttttgggcggtttgcacgctgcaaaaaccgatagtctgggagaataagagggttcaattcgtctgccttctttgtgtagaaaaggacaatacagcaaatttgcaggagatgtacaaatttttgggccgtgttttagatgacagggcgattgtccgggaactcctgaaatgcaaaacgtacggggagtttatgtccgtcttta

SEQ ID NO: 965 - DNA, 1124 bp, Bacillus licheniformis
atgaaaataactgagctactaacaaagcatacgatcaagttaaaccttgagagcagccagaaagaaaacgttatcgaagaactcgtcagcgttttggatcaggctggcaagttgaatgataaagaaggctacaaagaagctgtgatcaaccgcgagaaacaaagctctaccggtatcggcgaaggcatcgccatcccgcatgcgaaaacggcaagcgtcaaagagcctgcgatcgcgttcggccgttcaaaaggcggcgtcgattatgaatcccttgacggccagccaagccatctcgttttcatgatcgccgctacagacggtgcaaataacactcacctcgaagcattgtcaagactgtcgactttgcttatgagggaggagattcgcaaacagctgcttgaagcttcatctgaagacgaaatcatcgacatcatcaatcagcatgataaagatgatgatgaagaagaagagcaggccgaagaggctcctgcaccatcagcaaaaggaaaaatccttgcggttacagcatgcccgacagggatcgcccacacgttcatggctgcggatgctttgaaagaaaaagcgaaagagcttggggttgatatcaaagttgaaacgaacggttcaagcggtattaaaaatggtctgacggcccaggaaatcgaagatgccgttgcgatcattgtcgccgccgacaagcaggttgaaatggaacgctttcaaggcaagcatgtcattgaagtacctgtaacagcaggtatcagacgtccgcaagagctgattgagcaggcgctgaaacaagacgcgcctatctatcagggtaaaggcggcggtgcaaccgcttctgaagacggagctgccaaaggaaaaggcggcggtttctacaaacacttgatgagcggtgtcagcaacatgctgccgttcgtcgtcgggggcgggatcttagttgcgatttcgttcttctggggaattaacgcgaccaagccgggagatccgacttataatgagttcgctgctgtattaaataatattggcggaacgaatgcacttggattaattgtcgctgtattggccggatttatcgcgatgagcattgcagatcgtccgggatttgcgcctgg

SEQ ID NO: 966 - DNA, 1164 bp, Bacillus licheniformis
tttatcagctgtgtgaaaaacttgtatttgaatttgaatcaagagcatgcatcacatttcccaggaggcgcgaggtggcggaatctctttaccggcacttgaagccggcatatttcagaatgaaataccgcattccgattcacaatcccttgctcagcaaaattaagaaagagcataaagaactgtttaccatcgttcaaaagctgatgcggcaccttgaagcgctgttgaacaaaccggttccagaggaagaaatcggctttatcacaattcattttggtgcattgcttgagcagccggtgcagtccgggtcatccaaaaagacggcagtcgtcgtctgtccgagcggtgtcagctcatccttaatggtcaggcgccagcttgaatcgttattttcagagattgtcgttgagaaagcgatgtctttgcaggaattcacacctgacgtctttgatcattatgatgccgtgttttccaccgttgagctgaaaaccaaaaagcgatactacatggtcaggccgctgatgacgcccgctgaaaaaagcaggcttgtcaatgaagtgtatcaggaaatgttcggtgtgaagcaaagggagcttttgacagacgaatttcttcacatcctcaagaagcatgccagtatcatagacgaaaaaggactaagagaatcattgaaaaatattgcatttgttcaaaaagtgacggaaacaagggggaaacgaccagtgctgaaagatcttctgacagatgaaaccattcaaatggccgaccaaatcaaaggctgggaagaagcgattcaaacagcggcaaagcctttgcttgataaggaggtgatcttgaaggaatacacggatgccatgatcgacaatgtcaaaacgatgggaccttatatgattatcggccccgagattgccatccctcatgcaagacctgaaaagggcgtccaaaaggtgggaatgagtctcctgaaactgaaggagccggtctattttttggatgatgagcagtatccggtaaggcttttgttttgcattgcggcggttgaccatacgacacatctgaaagcactttcccaactgacccggcttctcagcaataaagaaaatcaggattccttaaaggaaaccgagtcgttggagcatatcaaacgtttaatcgaagcct

SEQ ID NO: 967 - DNA, 459 bp, Bacillus licheniformis
atgaaaacagcagctttaatcaaaaaagagcacatctatctacaagaaacgctatcttcccaagcggaagcttttgaccggctggctcagatcgcatatgaatcaggagcagccaaaacaaaacaagcggtcattgacggattggcgcaaagagaggctgaaagcacgaccggctttatcgacggcttcgccattccccatgcaaaactgaaggacatcacagaagcaactgtcatcatcattcaaaacaaggcaggaatcgaatggaacgcgcttgatcagacgcctgtcacgttcatcattgcattattgatacccgatgccgaggcaggcagcacacatctcaatctattatcatcggtgtctcgcatgcttgttcacgaagatgcgaggcagcagctgcttgaagcctcgagtcctgacgacattctgagcaccttctcaagctatttatcttaa

SEQ ID NO: 968 - DNA, 1422 bp, Bacillus licheniformis
atggcttatcaagattttagagattttttaaatacgctgaaaaaagaaggacagcttcttgaagtccaggaagaggtgaagccggaacccgatttgggagcagctgcacgcgccgccaacaacctcggagacaaatcacccgctcttttattcaacaacatttacggctataacaatgcccaaatcgcgctgaatgtaatcggctcctggccgaaccacgcattaatgctcggccttccaaaagacacgccggttaaagaacaattctttgagttcgcgcgccgttataatcagtttccagtaaaagtgcaaagagaggagacagcgccgtttcacgaaaacgaaatcacagaagacatcaacctgtttgacattctgccgctcttccgcatcaatcagggcgacggcggcttttatttagacaaggcatgcgtcatttcgagagatgtcgaggatccggaccacttcggcaagcaaaacgtcggcatgtacagattgcaggtaaaaggcaaagaccgcctcggcattcagcccgtcccgcagcatgacattgcgatccacctgcgtcaggctgaagagcgcggcgaaaacctgcctgtcacgattgcgctcggctgcgaaccggttattgcaacggcggcatccacaccgctcttatacgatcaatcagaatacgagatggcaggggccctgcaaggcgaaccatataaaatcgtcaaatcaaaactgtctaacttagatatcccatggggcgcagaagtggttctcgaaggtgagatccttgcgggcgaacgcgagtatgaaggtccgttcggcgagtttaccggccactattcaggcggacgaagcatgccgatcatcaaaatcaagcgcgtctgccaccgcaacaatccgatttttgaacacctgtatttaggcatgccttggactgaggttgactatatggtcggcattaatacatgtgtgccgctttaccagcagcttaaagaggcgtatccgaatgaaattgtcgcggtaaacgcgatgtatacgcacggcttgatcgccattgtatcaacgaaaagccgctacggcggattcgccaaagccgtcggcatgcgcgcgctgacaactccgcacggcctcggctactgcaaaatggtgatcctcgttgacgaagacgtcgatccgtttaacctcccgcaagtgatgtgggcaatctcaacgaaaatgcatccgaaacacgatgcagtcatcatcccggatttatccgttttggcgctagatccaggttctgaaccggcgggaatcacccacaaaatgatattggacgcgacaacgccggctgcaccggaaacaaggggacactattcacagccgctcgattcccctataggaacgaaagagtgggaagcaaaattaatgaatctgctaaatcaataa

SEQ ID NO: 969 - DNA, 1465 bp, Bacillus licheniformis
ttggaacaccgttttacagacgacagtctagcactacacacagacctatatcaaattaatatggcggaaacgtattggcgcgacggcattgatcaaaagaaagccgtatttgaactgtttttcagaaagctcccttttgacagcggttttgccgtttttgccggtcttgaaaaagcgattgaatttttgcgggatttcagatttactgaaagcgatttagtttatttaaaagaagagctgggctttaaagatgactttctcggctttttaaaagatatgagattcaccggttcgctttattctatgcaggaaggcgaaatcgtgtttggcaacgaaccgatcatgaggatcgaagcgcctttggctgaagcgcagctgattgagacggctctgctcaacattgtgaattaccaaacattgattgccacaaaagcggcgagaatcaaaagtgtgatcggagaagagacggcgcttgaatttggaacaaggcgcgcgcatgaaatggacgcggcgatgtggggagcaagagccgcgattatcggcggattcgacgcgacaagcaatgtccgcgccggcaagcggtttgacattccggtatcaggcacgcacgcccatgcgcttgtacaggcctatcgcgatgagtacacggcatttaaaaaatatgcggaaacccataaaaaatgtgtctttttggtcgatacatatgatacggtgcgttccggcattccaaatgcgatcaaagtagcaaaggaattcggcgatcaaattgaattttcgggaatccgcctggacagcggagacctcgcctatttgtcgaagaaagcgagagccatgctggatgaagccggatttacagatacaaaagttgttgcatcaagcgatcttgatgagtacacgattatgaaccttaaagcccagggtgcaaaaatcgacgtctggggcgtgggcacaaagctgattaccgcttacgaccagccggctctcggcgcggtttacaaacttgtttcgatcgaagaagacggaaagatggcagacacgattaaaatttcttcgaatccggaaaaagtgacgactccaggcttgaaaaaggtgtacagaatcatcaatcagctgaaccatcattcagaaggcgattatatcgctttggactatgaaaaggtcaatgaacaggagcggctgaagatgtttcaccccgttcatacgtttatcagcaagtttgtgacgaattttgatgcgaaagatcttcaccagccgatctttgaaaaaggcgagcttgtctatgagaatccgagcattcaggatattaagcggtatgttcaagaaaatctcagtttgctttgggaagagtataagcggatcagcaagcccgaagaatatcctgtcgatttaagcgaagcttgctggaacaacaagatgcagcaaattcacgaagcgaaaatcaaggcgaaaaaaggtctggatcaag

SEQ ID NO: 970 - DNA, 1735 bp, Bacillus licheniformis
ttgactgaaaatccgattacaaaatatatagggaattttattgatgagctttcccttgcaggcgtgacagaagcggtcatctgcccgggatcaagatcgacgccccttgcgattttggccgcgagtcatccggacatcaatgttcatatccatgtggatgaaagatccgctgctttttttgcaatgggcatggcaaaggcaatgcggaagccagtcgcattgatctgtacatccgggacggctgcagcgaatttctacccggctgtgatcgaggctcattattctagaataccgcttatgatcttaacggctgatcggccgcatgaactgagagaagtaggagcacctcaggcgattgatcagcaattcttattcggaaactttgttaagtttttcacagactcggctttgcctgacagtcatcctgacatgctggcgtacatccggtctttggcagcacgtgcagccggagaagccaaaaaagcgccgcgcgggcccgtgcatatcaactttccgctgagagagccgctcatgccgaaccttgaggatgaaccttttcaaaggctgagaagcggcagtcatgtgacggttgaaagcggccgcttccgtgctgatcggcatgagcttgtagcgctgagtgctctgattaaagagaccgaaaaaggcgtaatcgtctgcggagagctgcaagatgatgatgcaaaagaacatattgtagctctttcacaggcagcagaatacccaattttggctgacccgctctcaaacttgagaaacggcacccattcaaaagaaaccattatcgatgcatacgactcattattgaaagaagaacagctgaaacgcgagctcatgcctgagcttgtcatccgcttcggtgcgatgccggtttccaagccgctttttcagctgctgaagcaaaatccgagcattaggcaaatcgtcgttgatccagatggaggatggcgcgatccgactcagctcagcgcacatatgctgcattgcacggaagaggagattgctgttcttgcggattccgctgtcaattcagaaaataggacaggcaactggcttgagaagtggcggtttgccaacagccgcttccgcgctcttttaagaaatcttgaagctgaggatcttacctttgaaggaaatatctaccggaaccttcagcatttgattccggacaacagctccgtgtttgtcggaaacagcatgccgatccgcgatgcggacacattttttgaaaatcaggaacggaccttccggatttttgccaatagaggggcgaacgggatagacggtgttgtctcaacggcgctgggcatatatgccgcaacgaaagaaccggtaacccttgtcatcggcgatctgtcattttatcacgacttaaacggcctcctcgtcagcaaaacgctcgatattccgctgactgtcgttctcgtcaacaatgatggcggcggcattttctcatttcttccccaatctgctgaagaaaggtacttcgagctcttgttcggaacgccgacgggtctcgaattcgagcatgctgccaagctgtatgggggacgctatatatgccctgaatcatccgcacattttgccgatgcgtatttatcctccgtcaaccgccgcggcttggatatcattgaggtgaaaacgaagcgcgatgatcgtgtggagcagcatcgccggatgcttgattccgcgctgcatgaaataagaaaagagtggc

SEQ ID NO: 971 - DNA, 1275 bp, Bacillus licheniformis
gtccgaccgagggttggtttgggacacgaaacaaaccagcttggtccgagataccgacgcgagcgggcccctatacggacgccaatgcggacgttgatattcttaaggggctgaaacctttgcgggcgacctggatcagggagcgcggcgataccgaagaatatgaaggcagagaaataagaccggaggataacggctataaaggcaaagagaaagcgagccacagctatacagggttgaaacgaaaaccgctgcgcgcgaaaaaaggacaaaatgtcactcagctgcattacgcaagaaaggggatcattacgcccgagatggaatttattgcgatcagagagcacgtatctcccgaatttgttcgtgatgaagtggcaagcggacgggcgattattccgtcaaacatcaaccatccggaaagcgaaccgatgattatcggccgcaacttccacgtcaaaatcaatgccaacatcggcaattccgctgtcacctcttcgattgaagaagaagtggaaaaaatgacatgggccatccgctggggcgctgatacgatgatggacttgtccacaggtaaagatattcatacaacgagagaatggatcatccgcaactgtccggtgcctgtgggaacagtcccgatttatcaggcgcttgaaaaagtaaacggcgtcgcggaagatcttacttgggacatttaccgcgatacattgatcgaacaggctgagcaaggcgttgattatttcacgattcacgccggcgtccttctccggtatgtgccgttaacagcaaagcgcgtcaccggaatcgtatcccgcggcggggcgatcatggcgcaatggtgtttggctcatcatgaggaaagctttctgtacacccattttgaagagatatgcgagattatgaaaacatacgatatcgcattttcgctcggagacggtcttcgtcccggctcgattgccgatgcgaatgatgaggcccaatttgccgaattggagacgctcgtcgagctgacggaaatcgcctggaagcatgatgttcaagtaatgatcgaaggcccgggacacgtgccgatgcataagatcaaagagaatgtcgacaagcagatggatatttgcatagaggcaccgttttacacgctcggtccgctgacgaccgatattgcaccgggctacgaccatattacatcggcgatcgcagcggcgatgattcggtggtacggaccggtcatggcttgctatgtgactccgacggagcacttgcgcctgccgcact

SEQ ID NO: 972 - DNA, 1203 bp, Bacillus licheniformis
atgagcaaaaaccgtcggttatttacatcagagtcagttacggagggacatccggacaaaatttgcgaccagatttcggatagtatattagacgaaattttaaagaaagatccgaatgcccgcgttgcctgtaaaacatctgtgacaaccggattggtgctggtaagcggtgaaatcacgacgtccacatacgtcgatattccgaaaacagtccgcgaaacgattaaagaaattggctacacacgtgcaaaatacggttttgatgcggaaacttgcgcggtcttaacgtctatagatgaacagtctccagacattgcaatgggagtcgaccaggcgcttgaagcgcgtgaaggagcaatgagcgacgctgaaattgaagcgatcggagccggagaccaaggtttaatgttcggttttgcctgcaacgaaacaaaggaacttatgccgctgccgatttcgcttgcccataaattgtctcgccgtttgacagaagtccgcaaagaggaaattctgccgtatctgcgtccggacggaaagacacaggtaaccgttgagtatgatgagaacaacaagccgattcgcatcgatacaatcgtcatttcgactcagcatcatcctgagatttcgcttgaacaaatccagcgcaatctgaaagagcacgtcatcaatccggtagttccaaaagagctgatcgatgaaaacacgaaatacttcattaatcctacgggccgttttgttatcggcggaccgcagggggatgccggtttaacagggcgcaaaatcatcgttgacacctatggcggctatgcccgtcacggaggcggagcgttttccggcaaggatgcgacaaaggttgacagatctgcagcttatgcagcgagatatgtagcgaaaaatatcgtcgccgcaggccttgctgattcctgtgaagtacagcttgcctacgcgatcggtgtcgctcagccggtgtccatttcaatcgatacattcggtacaggcaaagcgagtgaagaaacattgatcgaagtggttcgcaaaaactttgatctaagacctgccggcattattaaaatgctcgatcttcgccgtccgatttacaaacaaacggcagcttacggacatttcggccgcctcgatctcgatctgccttgggagcgcacagacaaagcagatcagctgaagaaagatgcattaggagaataa

SEQ ID NO: 973 - DNA, 1368 bp, Bacillus licheniformis
atgaatacaaacatccatcagcatgtaaaagaggagaaagcatcgcaaacaccgtctattgccgacatgcgggttatacccgtggcagggcgggacagcatgcttttgaatttgagcggagctcacggcccctttttcacacggaatatcgtgattttaaaggattcatcaggcgctctcggcgtcggcgaagtgccgggcggcgagcggatccgccagacgctggagcaggcgaagccgctcgtcatcgatcagccgctcggcgctgttcaatcgattttgcagtccgtcaggcgccggtttaaagacagggatgccggaggacgcggggtgcagacctttgaccagcggacgacgatacacgctgtgaccgcattggaagcagctttgctcgatttgctcggaaaatttctcggcgtccctgtggcggcgctcttgggggaaggccagcagcgggataaagtgaagatgctcggctatttgttttacatcggggaccgaaagcgcacgacgcttccctatatcagtgaacaagaggcaaatgacgactggttccatctccgccgtgaagaagcgttgactcccgaggcgatcgtccgtcttgcggaggcagcccgagaacgatacggatttcacgattttaaattaaaaggcggcgtcctttccggagaagaagaaatcgaggcggcatccgctttagcgaagcggtttcctaaggcgagaatcacccttgacccgaatggggcgtggtcattggaggaagcgattgcgctttgtaagggaaagcgggatgtacttgcctacgcggaagacccttgcggagcggaagccggatactcaggccgggaaatcatggccgaattccgccgtgcgacaggcattccgacagcgacgaatatgattgcgacagactggcggcaaatggggcatgcgatacagctgcacgccgttgatataccgctggcagatccgcatttttggacgatgcagggatccgtccgcgttgctcaaatgtgccatgaatgggggctgatatggggctctcactccaataaccattttgacgtctcactggccatgttcacccacgttgccgcagcagctccgggcgatatcacggcgattgatacgcattggatatggcaggatggacagcgtctcacaaaacagcctttttcaattgctgacggatatgtccaagttcctgatcagcctgggctcggcattgaaatcgacatggaacgggtggaaaaagcaaatgaactatatgagaaaatgacagcaggcgagcgcaatgatgccgctgccatgcagtttttgattgaaaattggcgtttcgaccctaaacgtccttgtcttgttcgataa

SEQ ID NO: 974 - DNA, 1360 bp, Bacillus licheniformis
atgcatatacttgtcgtgggattggattacaaatcagcccctgttgatatacgtgaaaagttaacctttcagccggatgagctggggcaggcgatggcgcaattgaaagaagaaaaaagcatacttgagaacatcatcgtgtcgacatgcaaccggacagagctgtatgcagtcgttgatcagctgcacaccggacgttattatatgaaaatgtttttggcgaactggttcggattaagcaaagaggacatttcgccttacttgaagttttatgaaaacgacggggccgttgaacacctgttccgcgtatcgtgcggattggattcgatggttattggagaaacgcagattttgggccaagtgcgtacaagttttaagctggctcaggaagagaagacaattggtaccgttttcaactatttgtttaagcaggcggtcacggtcgcaaagcgctgccatgccgaaacggacattgcttcaaatgctgtatccgtcagctatgccgccgtcgagcttgccaggaaaatcttcggcgacctttccgataaacacgtgctgattctcggggcgggcaaaatgggtgagcttgcggttcaaaacctgcacggccacggaatcggacaggttacggtgatcaacagaacattttcaaaagcgaaggagcttgccggccgtttttcaggcgcggcgaaaagcttgaatgagctgcaatgcgctttgatggaagccgatattctcatcagttcgaccggcgccagcggctatgtcgtcacaaaagagatgatcgaacatgtcaataagcttcgcaaaggctgtccgctttttatggtggacattgccgtgccgcgggatcttgacccggctctcagcgaagtggaaggcgtcttcctgtacgatattgacgatcttgaagggatcgtcgaagaaaatttgaaggaacgccaggccgttgccgaagaggtggagctgattattgaagctgagatcgtttcttttaaacaatggctgaatacgctcggcgtcgtgccggtcatctcggctctcagggaaaaagccttgacgatccaggcggaaacgatgcagagcatcgaacggaagctccctcatttgagcacaagggagaaaaaacttttaaacaagcatacgaaaagcattatcaaccagcttttgcgcgacccgattttaaaagtgaaggagtttgcgtcagaagctgatgccgaagaaaagcttgcactgttcacgcagatttttgatattgaagaagcggcttttcctgacggtgagagacaagacgaacgtcagccggttcatgcgtttaagcggcaaaatccgcagggtttgacttctatcgcgagcgagt

SEQ ID NO: 975 - DNA, 1140 bp, Bacillus licheniformis
tgttgacggaaacgaatacatcgattatgtcctgtcatggggaccgcttattttgggccacagcaatgaaaaagtggtgaaagagattcaaaaggcggcagaacacgggacaagcttcggtgcgccgacagaactggaaaccgagcttgccgagcttgtcatcgaccgcgttccttccatagaaatcgtccggatggtgagctccggtacggaggcgacgatgagcgccttgcggctggcgcgcggatacacaggccgtaacaaaatcgtaaaatttgaaggctgctaccatggacacggtgattccctgctgattaaagcgggctcgggagtagcgacactcggcctccctgacagccccggagttccggaaagcattgcaaaaaacacgattaccgttccttacaatgatctggaaagcatgaaacttgtctttcaagaattcggagatgacattgcaggcgtcatcgttgaacctgtcgctggcaatatgggcgtcgtaccgccggttaaagggttcctcgaagggcttcgcgagctgactgagacgcatggcgccctgctgatatttgatgaagtgatgacaggattcagggtggattacaactgtgcccaaggctatttcggggtgacgcctgatttgacatgcctcggaaaagtgatcggcggcggtcttcctgtcggcgcttatggaggaaaggcggaaatcatggagaagatcgcgccgagcggtccgatctatcaggccgggacgctgtccggcaacccgcttgccatgacagccggacttgaaacgttgaaacagctgacccctgaatcctaccgggaattctcccgcaaagctgaccgcttggaaaaaggaatttctgaagctgcagagaaaaatggcattccgtgtacattcaacagggcggggtctatgatcggctttttcttcacaaatggaccggtcatcaattatgatacagcgaaacagtctgacctcggactgtttgccgaatattataaaggaatggccgatgaaggcgtgtttctgccgccttcacagtttgaagggctgttcttgtcaaccgctcatacggatgacgacattgagcatacgattaaagctgctgaacgcgtattcgaaagaatcagccg

SEQ ID NO: 976 - DNA, 1218 bp, Bacillus licheniformis
tgtttcacacaattgaagaagcgattcgcgatttgaagcagggaaaagtcatcatcgtagtcgatgacgagaacagggaaaacgaaggcgatttcgttgcgctggcggaatacgcaacacccgatgtaatcaactttatggcttcgcacggaagggggttgatctgcgcgccgctcaatgaagagatcgcttcccggcttgagctccaaccgatggtggacgaaaataccgattctcaccacacagcatttacggtcagtgtcgatcaccgcgatacaaagacggggattagcgctcaggagcggtcgctgaccgtcatgtcgctgatcgctgatcacgcgcatccgggtgattttaaaaggccggggcacattttccccctgatcgcgaaaaaaggcggcgttttaaaaagagccggacatacggaggcggccgttgaccttgcagaagcgtgcgggtccgcgccggccggcgtcatctgcgaaatcatgaatgaagacggcacgatggcaagggtgcctgaactcaaaaaaatagccgatcagcacggcttgaaaatgatcacgattaaagatttgatcgaataccgctacagcaagggaacgctgatcaaccgggaagtgaaaattacgctgccttccgaattcggtaccttcaaggtttacggctatacaaacgaaatcgatgacaaagaacatatagcactcgtcaaaggcgacatacctttcggtgacgagcctgtgcttgtccgggtacactcagaatgcctgacgggcgatgttttcggctcttaccgctgcgactgcggcccgcagcttgccgctgcgctcgcgcaaatcgaacaagcgggccggggcgtactcctgtatttgagacaggaaggaaggggaatcggcttaatcaataaactgaaagcttataagctgcaggaagaaggatacgacaccgtacaggctaacgaaaagctcggttttcttccagaccttcgcaactacgggatcggcgcccaaatcttaagggacctcggcgtgaagcaaatgaagctgttaacgaacaacccgcgaaaaattgcaggtctcgaaggttacggcctgacgatcgcagacagggtgccgctgcagatggagacaaaaaaagataatgaaaagtatctaaaaacgaaaaaatcaaaattggggcatatgcttcatttttaaactaaaatcaatcacaaaaaag

SEQ ID NO: 977 - DNA, 1293 bp, Bacillus licheniformis
atgattgaaaaaagaacgcccattccagtttttgaagccgctgcgcgtgtctctcagcaccagaagctgggagatgcagagtggattcaccctgaggagagtctccatagatttttagccgaagatgtcaaggctgatcacgatgtacccgcttttgaccgttcgccatacgacggctttgctgtccgagcatgcgatacagccggtgcttcgggggaaaatccgctgcaattcgaggtggttgatcacattggagccggggccgtatcggataaaaagctgggttcttttcaagccgtcagaattatgacgggagcgcagattccggagggcgctgatgcggtagtcatgcttgagctgacaaaaaccttctcggaagacggcaaaaactatatggtgttgaagcgctcactacagccgggagaaaatatatcaaaaaccggagaagatgcgagaaaaggatcagttcttgtgaaaaaaggaacccggataacgccgggtgttgtcgctttgcttgcaacattcggatatgcagcggttcctgcagtcaaaaagcctgtggtaggcatcattgccaccgggacggagcttctgaatgtcagcgatcctcttgttcccggaaaaatccgcaacagcaatgcaggcatggcggccgctcaggttgaagaatcaggcggaaaacccctttatttaggaaagatttctgatcaatttgacgaaagctttgcagcggtggaaaaagctttggacaaggtggattttctgattacgaccggaggggtatccgtaggggactttgattttctgccggcaatttacgaaaagctcggtgccgaggtcctgtttaataaagtggcgatgcgtcccggaagtgtaacgacggtcgctcaattaaacggcaaattgctgtttgggctgtccgggaacccgtcagcctgcttcgttggatttgagcttttcgtcaagccgtccctgcgcacctggctgcatcatccgaagccgtattctttatgtgcagaagcggttttagccaaggattttccaaaacctaacccgtttacgaggtttgtccgctcgtttgtatccattcaagacggcgcgcttcaggcggagcctgtcggtctggataaatcgagcgccgtaacgtctcttgcagatgccaatgcgctgatggttttgccgggcggaacgagaggctttgaagccggggcaagagtgcatgttcttttataccgggatgagaacggaagtgaacagctgtggccgcacattttccaatcctccagatcgtag

SEQ ID NO: 978 - DNA, 1378 bp, Bacillus licheniformis
atgagtggagaacgcaggcagattgtcatcatcggcggcggtattaccgggttggccgccgccttctacttggagaaggaaatcaaaaagaatgatctcccggccgaagtcacgcttgttgaagcaagcccgagactgggcggaaagatgcagacggtacacaaagacggctatgtgattgaacggggtccggattcatttttggaacggaaacaaagcgcacctcagctcgtgaaggatctcggactggagcatttgcttgtgaacaatgcgactggccagtcttatgtgcttgtcagcgaaacgctctatccgattccggaaggagccgtgatgggggtgccgacaaaaatcggtccttttctgacaaccggcttgttttccttgccggggaagttgagagccggaatggatttggtgcttccagcaagcaagccgcaggaagaccaatcgctcggagaatttttcagaaggcgcgtcggcggtgaagtggtggagaacctgatcgaaccgcttttgtcaggcatttatgccggggacatcgaccgtctcagtctgatgtcgactttcccgcagttctatcagacagagcagaagtacagaagcttgatcatcgggatgaaaaaatcgcgcggcgcccagagcgtcggaaagcctgcaaacaaaaagaaaggccagttccagacggtgaaaaccggcctgcagacgatagttgaagaattggaaaagcagctcggcatcacaaaggtttataaaggcacaaaggtcgtcagcattgagcgtgcgggctcggcttacagcatgaagcttgacaacggcaaggtgcttcacgccgattcggccgtggtcaccgctcctcataaagcagctgccgcgatgtttcaaaaagaggattggctgaagggtttagaggatatggtgtcaacatctgtcgccaatgtggcgctcggatttccggaagaagccgtccaaatggagcatcaaggcacgggctttgtcatttcaagaaacagcgatttttccattacggcgtgtacctggacaaacaaaaaatggccgagcacaacgcctgaaggaaaagtcctgctaagggcttatgtagggaaagccggcgatgagtacgttgtcaaacagtctgataacgaaatggtgaaaatcgttctcgacgatttaaaacggattatgaagatcgacggcgaaccggtaatgacctgcattaccagatggcatgaagcgatgccgtaataccatgtgtggtctaagaaaagatttaaagaaatccgggcaaggcttgggtagcgtactatactgggtgatttgattaccggggcactcatttagagggggaaacgatcacctgattgactcacaccagggt

SEQ ID NO: 979 - DNA, 1322 bp, Bacillus licheniformis
atgtcgtttttgattaagccggatctgcacgcaagctatccggtcgttcagtatgcaaaaggaagctggattgtcgaccattccggaaagcgttaccttgacggttgttcgggggctgttacctgcaatctcgggcacggtgtccaagaagtgattgagcctctcaaagagcagcttgatgctgtttcattcgtctaccgttcgcagtttacaagtgagccggccgaacagcttgccgaactcctggctgaatggctgccgggtgatctgaattggtctttctttgtcaacagcggatcggaagcagttgaaaccgccatgaaaatcgccgttcaatactggcaggaaaaaggacaaaacgacaaaacgattttcctttcaagatggaacagctatcacggaattacaaatggagccctgtcgctgtcgggattttatgagcgccgctacaggtttacgcacatgctgcacaagtatcccgccgcttcagcgccaaactgctacagatgccggctttctcatcctgaatgccaggaagcgtgcgtgaaagaaatcgagctcgccgttaaaaggatcggaaagcaattcatcgcgggcttcgttgccgaacccgttattggggctgctggagcagctattacggcacctgctggctattataaaaaagtaaaagaaatatgcgaagataatgaaattctctttatcgcggatgaagtcatgagcgggatcggccgaaccggccggatgctggcgattgaacattggggtgtgactccggatattgccgtactcggcaaggggctgagcgcaggctattcaccgattgccgcagcggtcatgtccgacggcatgatggaaacggtcaaaaacggctcaggggccatcatgagcgggcatacgtacagcgcaaaccccttttcagcccgtgctgcgctcgccgttctccgctacatcctgaagcacgatcttgtcaaacaagccgagataaaaggggaaaagctgaaaagaatgctgaaagaagttatgaaacagtcgagcattattggcgacgttaggggcaagggacttcttctcgggattgaatttgtcgccgatcaaaaaagcaaaaagacatttccttcttcaatgccggtgtcggctctcgtcatttccgaagcgaaaaaaagaggactgcttctttatccgtcccaggcgggtattgacggcggcgggggagatgcggtcatcattgcgccgcctcttacgatatcggacaaagaaatggaagagctcattgaaatatttaaacatgccgtatatgagattgaaaaacaagcggaaaa

SEQ ID NO: 980 - DNA, 992 bp, Bacillus licheniformis
atgaatcagtggatggaacttgcagaacgtgtgctggatggcggggaagtaactgaaaaagaggcgctttccatcttggaatgcccggatgacgacgttcttctgcttatgcatgccgcttttcaaatcagaaaacgctactacggaaaaaaagtaaagctcaatatgattatgaatgcaaaatccggcctttgtccggaaaactgcggctactgctcgcagtcttcgatatcaaaagcgccgatcgacagctaccggatggtcgacaaaacgaccttgcttgaaggcgcaaagcgtgcgcacgatttaaatatcggaacatactgcatcgtggcgagcggcagaggaccgtccaacagagaagtcgatcaagtggtcgacgccgttaaagaaatcaaagaaacgtacggtttaaaaatctgcgcatgcctcggactgctaaagcccgggcaagccgagcggctgaaggaagccggagtagaccggtacaatcacaacatcaatacatcaaaaaccaaccattcaaatattacaacgtcccacacgtatgatgacagggtgaacactgtggaaacagccaaaaaatccgggatgtccccatgttcgggcgtcatcgtcgggatgaaagagacgaagcaggatgtcgttgatatggcgaaaagcttaaaggcgctggatgccgactcgattccagttaattttttgcatgcgatcgacgggactccgctggaaggggtcaatgaattgaatccgctttattgtttaaaggttttagctttgttccgctttatcaacccgacaaaggaaatccgcatttcaggggggcgcgaagtcaacctccgctccttgcagccgttggggctgtatgccgccaattcaatcttcgtcggagactatttaacgacggcaggacagaatgaaacagaggaccataagatgcttcatgatttagggttcgaagtcgaatcggtcgaagaaatgaaagccagttt

SEQ ID NO: 981 - DNA, 1170 bp, Bacillus licheniformis
aagaattcaattttttagcttccgagcttaatacaatgaaagaaaacggaacttttcaagagctgccgatcatcgaatcaatgcaaggatcaaccgtcaaaatgaaaggaaaagacattatacagctttcatccaataactatctcgggctgacgtctcatccgcgcctccaaaaagcggccgaagaggcggtcaaacggtacggagctggaaccggatcggtccgtacaatagccggaacattcaccatgcatgatgagctcgaaaagaagcttgcttcatttaaaaacactgaagcggcactcgtattccagtccggatttaccgcaaatcaaggcattctttcaagcattctcaccaaagatgatcttgttatctcagacgaattaaaccatgcttccatcattgacggcatcagactcaccaaagcgggcaaaaaagtatatcagcatgcggacatggaagatttagaaaagattttgaaaaagtcgatgaactacagaatgcgccttatcgttacagacggcgtgttttcgatggacggagacatcgcgccgctgcccgaaatcgtccggctcgctgaacagtatgacgcatttgtcatggtcgacgacgcgcacgcgtccggcgttctcggcgaaaacgggcgcggaacggttcaccatttcgggctggacgggaaggttcacattcaagtcggcacactcagcaaggcgatcggcgtattaggaggctatgcggccggatccaaggtgctgatcgactacttaaagcataaaggaagaccgtttctcttcagtacttcccatccgccggccgtcactgcggcatgcattgaagcggtcaatgtgctgatggaggaaccttcattgattaaaaagctttgggacaataccgcgtacttcaaaaaagagcttgaaaaaatcggccttccgctgattaagagcgaaacgccgattacgccgattttgatcggtgatgaagctgaggcatgccgcttctcaaacacgctttttgagctcggtttatttgcccaggccattgtatttccgaccgtcccgaaaggcaaagcgcggatcagaacgatcatgaccgcccagcattcgaaagaagagctcgataaagcgcttgaaatcattcaaaccggcgctaaaaaagcgggtctgcttt

SEQ ID NO: 982 - DNA, 1484 bp, Bacillus licheniformis
ttgcgcatttatatagaagggctccaagacgaaaggttccagagaccgcttgagcatatagcgaacttattctttgaggaaagcgaagtcgctcttggcgaagaagcgccggcagaccttgcgatcgttctcggctatgaacgggaagaaaacggcgtcaaggcttccggtgcgataaaggatacggacattacagcagaatatgcgaaaaacattgaccccaagctgacggaaaaggaagcgtttaagcaggtgaagaataccgtttcctacgtttttttgagcatgcttcaggagcataccgggatcattcagaaatgggggattctcaccggtgtccgtccgacaaagctgcttcacaaaaagctggagagcggcatgccaaaggaagaggcccatgccgagctgaagcgggattatttaattcacgacgaaaagatcgaactgatgcaaaacattattgaccgtcagctgaaagctgtacctgatttgtatgagctgggccaagaggtcagcatttacatcggcatcccgttctgccccacgaagtgcgcctactgcacgttcccggcgtatgcgatcagaggacaagccggacgagtcggctcatttttgtgggggcttcactatgaaatgcaaaaaatcggtgaatggctcaaggagaacgatgtcagcatcacgaccgtgtatttcggcggcggaacgccgacaagcattaccgccgaagaaatggatttattgtatgaagaaatgcaccgttcatttcccgatgtgaaaaacatccgcgaggttacggttgaggccgggcggcccgatacgattacagaagaaaagctcgcggtcttaaaaaaatggaacatcgaccgcatcagcattaacccgcagtcttacgaaaatgaaacgctgaaagcgatcggacgccaccataccgtggaagaaacgatcgaaaagtaccatctgtcgcgaaatgccggtatgtcgaacatcaatatggatttgatcatcggccttccgggcgaaggagtaaaagaattcagacactctctttccgaaaccgaaaaattaatgcctgaatcattgaccgttcatacgctgtcatttaagcgcgcgtctgaaatgacgaagaacaggcataagtataaggtggctgaccgcgaggaaattgtcgcgatgatggatgacgctgtctcgtggacgaaacagcacggttaccatccctactatttgtacaggcagaaaaacattctcggcaacctggagaatataggctattcccttcccggccaggagagcatctataacattatgatcatggaggaaaaacagacgattatcgggatcggctgcggagctgcgagcaaatttgtcgatccgagatcgggaaaaatcacgcacttttccaatccgaaagacccgaaaacttacaatgacagatttgaacattatacaaacgaaaaaatccgctacttgtctgagctttttca

SEQ ID NO: 983 - DNA, 957 bp, Bacillus licheniformis
gcatactcaatctgaaaagcttcatgaagaagctcttcaacatatagtcggaggcgtcaacagcccctcaaggtcttacaaagcggtcggcggaggttctcccgtcgcgatggaaaggggaagcggcgcttatttttgggatgtggacggcaacaaatacatagactaccttgccgcgtacggaccgattattacgggccacgcccacccgcatatcacgaaagcgattcaaacagctgctgagaacggggtgctttacggtacgccgacaaagcatgaagtgacatttgccaagatgcttaaggaagcgattcctgccttggataaagtgagattcgtcaattcgggaacggaagctgtgatgacgacgattcgcgtcgcccgggcctatacaggcagaacgaaaatcatcaagttcgccggctgctaccacggccattccgatcttgtgctggtggcggccggttcaggaccgtcaacgctcggcacgcctgattccgccggggttccaaaaagcatcgccaacgaggtgattaccgttcctttcaatgatatcgacagctataaagaagcgctcgataaatgggggaacgatattgcggcagtcctcgttgaaccgattgtcggaaacttcgggatcgtcgaaccgaagagcggattcctcgagcaggtcaatgaacttacgcataacgcgggagccctggtcatctacgatgaagtcattaccgctttccgctttatgtacggcggcgcccaggatcttcttggcgtcaaacctgatttgacggcgctcggcaaaatcatcggcggcggcctgccgatcggcgcctacggaggcagaaaagagattatggaacaagtcgcaccgctcggacctgcttatcaagcgggcacgatggcggggaatccggcttccatcctctctggcatcgctgcctggaagtgctgaaagaagaa

SEQ ID NO: 984 - DNA, 1218 bp, Bacillus licheniformis
atgctgaaaaatcgcaacatcctgctgggagtaagcggaggaatcgcggtatacaaagcggccgccttaacgagcaagctcgtgcaggcaggagccaatgtgaaagtcatcatgacaaaatccgcctgtgaatttgtgtctccgctcacctttcaggcgctttcgcgcaatgaagtatataccaatacgttcgaagaaccgaatccccgtgtcatcgcccatatcgatgccgcagattgggcggatctcgtgatcgttgctccggctacggccaatgtgatcggaaaactcgcctcaggcatcgctgacgacatgctgacgacgacgcttttggcgacgacagcgccggtgtggatcgctccggcgatgaacgttcatatgtacgaccacccggccgttcagcggaacatcagcgttctttacaaagacggctaccggtttatcgaaccgagtgaaggctaccttgcgtgcggctatatcggcaaaggcagactggaagagcctgagcggatcgtccagttggcagagtcgtatttttcaagcgaaaaaagcggtttgcttgaaggaaagcgcgtcgtaattacagcggggccgacaagagaacaagtcgatcccgtccgctttttctccaaccgttcgacagggaaaatgggctatgctttcgctgaggaagcggcacgaatgggagcgcacgtgacgctgattgcaggcccgacatcgcttgatgatcccgcaggggtcgacgtgattcatgttcagtccgcagaagatatgtatcaagcggctctgtctgttttcgatgagagcgacatcgtcattaaaacagcagctgtcgctgattacaggccaaaacatgtccacgatcaaaaaatgaagaaaaaggacggcggcctcgtcattgagcttgaacggacgaaggatattttaaaagcgctgggagagcggaaaacaaagcaaatcttggtcggctttgcagccgaaacgcagcacgtcgaagactatgccaaacaaaagctggagacgaaaaatctcgatatgattgtcgctaacaatatcacggctgaaggcgccggttttggaacggaaaccaacatcgtgacggtgtttcatcgagactgcaaaaagacggcgcatcctctaatgtcaaagcgggaggttgccgccgcagtcttgaaggaagccgctgagcttgccggacggagcgggacgtcttcataa

SEQ ID NO: 985 - DNA, 1043 bp, Bacillus licheniformis
atgaaaaacgacaaggcttttaatgacacattcttaaaagcatgccgaggagaaaaggccgcccatgtaccggtatggtacatgaggcaggccggaagatcacagcctgagtacagagcgctcaaggaaaagtacggtctgtttgaaattacgcatcagcccgaattgtgcgcttatgtgacaaggctgcccgtcgaacagtacgatgtcgatgcggcgatactttataaagacataatgacaccgcttccaggtattggcgttgacgtcgaaattaaaaacgggatcggccctgtcatcgatcagccgattacatctctcgcagatgttgaaaaactcggcgaactcgatccgcaagagcatattccatatgtgctggagacgatcaggctgttgacggaagaacagctgaacgttccgctgatcggttttacaggggcgccctttacattggccagctatatgatcgaaggcggcccgtccaaaaactacaataaaacaaaagcgtttatgtacagccagcctgctgcatgggatcttttgatgaaaaagctcgggaagatggcggctgtatacgtcaaagctcaaatccgcgccggcgccaaagccatccaggtgttcgattcctgggtcggcgcgctgaacgccggtgattactgccgctacatcaaaccgacgatggacgttcttttcaaagagttgaaaaaagaagacgtgccgctgattatgttcggggtcggcgcaagccacctcgcgactgaatggcacgatcttgacctcgacgtcgtcgggctggattggcggatgagcgtacaggaagccagggataaagggctgacaaaaacgctccagggaaatttggatccttcgatcctgcttgccccgtgggaagtcatcgaagaaaggacgaaagccattctcgatcagggcatgcagacggaccggtttattttcaacctcggacacgggatctttccagaagtgagtcccgacacactgaaaaaattgacggcatttgttcatgagtattccgcctcaaaaaa

SEQ ID NO: 986 - DNA, 1110 bp, Bacillus licheniformis
atgattcaaatcaaacagctgacattgtaccatctcagcatgcggctgaaaaagccttttaaatcaagcttggaaacctttcaggatcgcaagtttatcatcgttgaagctgctgatcaagaaggtgtgacaggctggggggaagtatccgctttttcatctccgtggtacaccgaagaaacaacggagacatgctaccacatgctcaaagattttttgattccggctgtgctgcgcgaatcattcacacacccttccgaagtgcccgaggcgcttcgcggattcaaaggcaaccgaatggcaaaggccggccttgaagccgccttttgggacatttacgccaggaaaaaagggatctctttaagagaggcgctgggcggagtaaaaacagaagttcctgccggagtcgtcgtcggtcttgccccattggatgatatgcttcaggaaattgaacaatatgtaaaagaaggatatcaaagaataaaaatcaaaattcagcccgggcaggatatagagcttttaaaagaaatacgccggcattttccgaaggtgccgctgatggcagatgccaactcttcttatgaattaaaagacatcagccggattaaagagcttgacgcatttaaattaatgatgatcgaacagccgctggctgatgatgatatcgttgaccaccgccatctgcaaaaacatatcaaaacatcaatttgtcttgacgaaagcatccgttcggctgctgatgcgcgaaaggcaattgagctcggcagctgcaaaattatcaatataaagccgtcccgagtcggcggtttgacagaagctctgaaaatccacgacatctgcaaagaacatcaaatgcctgtctggtgcggcggcatgtttgaaaccggcatttcaagagcccataatcttgcactgagttctcttccgcagtttttgattcccggggatctttcttcatcctcaaggtattgggaagaggatatcgtaaaaccggaaatccggatcgagggcggctatattcaggttccaaccttaccgggaatgggatttgaagtcgatactcatattttaagaaagaattcatctaaaatagacgtttttaagcagtaa

SEQ ID NO: 987 - DNA, 1093 bp, Bacillus licheniformis
atgaaagcagcatatatacatattccgttttgcgagcacatttgccattattgcgacttcaacaagttttttattcaatctcagcccgttgatgaatatttgcgttccttagagaaggaaatggccaattcaatggaggcaaccggacatccggagctgaaaacgatctttatcgggggaggaacgccgacatcgctgtcggcagctcagctcgaacggctcctcgattccattcatcgcgttttgaaaccgtccgaaagccttgctgaatttgcagtggaagccaatcccgacgatttatcagctgaaaagctggatgttttaaaagctgccggtgtagacaggctgagctttggcgtgcagacgtttgaagacgagctgctgaaaaaaatcggcagggttcacgagcaaaaagacgtactcgtttcgtttgaaagagcgagaaaggcggggtttgataatatcagccttgatctgatgttcggtctgcccggacaaaccatcggccacctcgcttcatcgctcgatacggcgcttgccctcggtgctgaacactattcggtttattcgctgatcgtcgaaccgaaaaccgttttctacaacttgatgaaaaaaggccggcttcacctgccgccgcaggatcaggaagctgaaatgtacgaactcgttatgcggaaaatggaagaagcgggcatcggccaatacgaaatcagcaactacgccaaaaaaggatatgagagcaaacataacctcacatattggaacaatgaggattatttcggttttggcgcgggcgcacacggttatatcaatggtgaaagaacggtaaatgcgggccctgtcaaacattatatcgacctgattgaacaatccggctttccttataaggaaaagcacatggtcacaaaaaatgaacagattgaagaagaaatgtttctcggtcttcgaaaaactgagggagtaaacaaagagcgctttttcgaaacatatggaagatctgttgacgatctctttccgaaggtgctccattcgctggaagaaacagggttgattgtgaacacgaacaaaaacgtgtttctaacacataatggaa

SEQ ID NO: 988 - DNA, 990 bp, Bacillus licheniformis
atgctgtttatcgataatcaaaatattacagatccgaggatcaacttggcgattgaggagtactgcttaaagcatctcgatcctgaagagacgtatctgctgttttatatcaaccagccgtcgatcatcatcggcaaaaatcaaaatacgatcgaggaaatcaacacaaaatatgtagatgaaaacgggatcattgtcgtccgcaggctgtcaggcggcggagctgtctaccatgatctcgggaacttgaacttcagttttattacgaaggacgacggcaacagcttccacaacttcaagaagtttactgagcccgttgtggccgctttaaaacggcttggcgtcgatgcggagctgagcggccgaaacgatttgatggcaaacggccggaaaatctcgggaaacgcccagttttcaacgaaaggaagaatgttcagccacggcacgctgttgttcgattctgagattgaacatgtcgtatcggctttaaaagtgaaaaaagataaaatcgaatcaaaaggcattaaatcgatcaggagccgtgtggccaatattagcgagtttctcgatcagaagatgacgacagtggaattccgaagcatgcttctccgctatatttttgataccgaaggggaaataccggagtataagctgactgaaaaagactggaaaatcattaatcaaatttcaaaggaacgctatcaaaactgggattggaactatgggaagtctccgaaattcaatctgcagcattctaaacgatttcaagctggatcggtcgacatccgcctcgaagtgcaaaaaggcgtgatccgcgagtgcaaaatattcggtgactttttcggagtcggagatgtcagcgacatcgaagagaagctgacaggcgtgcagtatgaaagaaaagcgattgaagaagctcttcaaggcgtggacattaagcattacttcggcaatattcaaaaagaagaatttttggatcttgtctactaa

SEQ ID NO: 989 - DNA, 1067 bp, Bacillus licheniformis
  misc_feature (1)...(1067): n = A,T,C or G
atgtctattttaanagtgattcatgacaggaacgccggcatgatgccggaggtgtataaagaattgactgaggaagaaatggccggaaggattttgaaaatcaaaaagaaattcggagcaaggctgtttatcccggggcatcactaccaaaaagacgaagtgattcaatttgcggacgcgacgggcgattcgctccagctggcacaggtcgcccaaaaaaataaaaaagcggaatatatcgtgttctgcggcgtacattttatggcggaaacagccgatatgctcacttcggacgaacagattgtcgttttgccggacatgcgcgcaggctgttcgatggccgatatggccaatatgcggcagacaaatcgcgcctgggaagagctgacgaagctgtttggcgatacggtcattccgctcacatatgtcaattcgacagctgaaattaaggcttttgtgggaagaaacggaggagcgtccgtgacatcctcaaatgcggcgcgcatgttgacatgggcgctatcgcaaaaggagaggattttatttcttccggatcagcacttgggacgcaacacggcatttgacctcggcattcctctaagcaggatggcggtatgggatccaattgcagaaaaacttgagtataacggcgatatgaaagacataataatcattttgtggaaggggcattgttcagttcacgaaaaatttaccgtggcgaatatcaaaagtgttaaagagcgggatccggacatcaatgttatcgttcatccggaatgcacccacgaagtcgttgcgctcagcgatttcagcggatctacaaaaaaaatcatcgactccattaatgaagcaaaaccggggagcaaatgggcgattggaacagagatgaaccttgtttcacgcatcattcaagaacatcctgataaacaaatcgaatcccttaaccctgatatgtgtccttgtttgacaatgaacagaatcgacatgccgcatttgctgtggtcgctggagcagatcgacaaaggtgaaccgacaggcgtgatcaaagtggatcaagatatgcaaaa

SEQ ID NO: 990 - DNA, 1305 bp, Bacillus licheniformis
atgcgcttgttcaaaacgtttgatgaagcactcagctggattaacggaaggcttaaattcggcgtgaagccgggtttggaacgaatggaatggctgctgagaaagctcgggcaccccgagaaaaagctcaatgcggttcatgtcgccggaacaaacggaaaaggttcaacgatcgcttttctccgttcggtattaaatgaagccggttatacagcaggcaccttcacatcaccgtatatcatcacctttaacgaacggatcagcgttgacggcgccccgatctcagatgaagaatggacggcgctctttaatgaggtcgggcctcttgtccttgagcttgaaaaaaccgaattcggagccgccacagaatttgaaattattacggcatgcgcatttttatattttgctaaatacaggcggacagattttgttatttttgaaacgggcttaggcggccgtttggattcgacaaacgtcgtgaagccgatgttaacggtcatcacttcgatcggccatgaccatacggcgatattaggcggtacattgaaagagattgccgcggaaaaggcagggatcatcaaacgcggcgttcctgttatcacagccgttcatcagcatgaagcggctgaggtgataaagcgaaaggcgatggagacagaatctgcttttatatcccttcacgaggattgccagctgtacggggagctttcattgcctgagggagagcagttttcgttgaaaacaccgttacatcattatgaaggaattgaaacaagcctgatcggcacccatcagcggcaaaacgcgtctttggccatacttgcggccgaatggctgacagccgaaaaacatgcggcgatcggcgaaaaagagctgaaacgcggcattcgtaacgcgggatggcccggccggtttgagaaggtattgaacaagcctcttgtttatatcgacggcgctcataacaaagaagggatggagcggctggccgagacgatctcctcccacttcgccgggcggaatattcacgtatgcttcagcgctcttaaagataagccgtacagagacatgatccgcaaaatcgagtcgtttgcgtcatcgattcacttcacatcctttgatttcccgagggcggaatccgctcaaaagctgtttgagcaaagtaccgctgattataaaacatttgatgaagacatcgcctctgttttccggtatatcgaagaaaaagctgaagaggaaaaagcggtggtcgttatcaccgggtcgctttattttatttccgccgtcagggcagctttaactgaataa

SEQ ID NO: 991 - DNA, 1017 bp, Bacillus licheniformis
  misc_feature (1)...(1017): n = A,T,C or G
caccaacagtgaacaagttttggatcagaaaagccggccgcttcgggatttaagaatttctgtcaccgaccgctgcaacttaagatgtacgtattgcatgcctgcagaaatctttgggcaggattatccgtttttgccaaaaggcgaactgttgtcctttgaagagcttgaacgattggccaagctgtttgttcatcagttcggggtagaaaaaatccgtctcaccggcggagagccgctgatgagaaaagatatgccggaattagtcgggaagcttgcagggatcaaagggattcgcgatattgcgatgacaacgaacggcgttttgctgccggtttacgctgacaagctgaaaaaagcggggctgaaacgtgtaacggtcagcctggattccctggatgatgagcgtttcaaatcgatcaacggaagaggcgtttccgtcagcaaggtgctggccggaattgaagcggcgaaaaaggccggactcggcgtcaagatcaacatggtcgtccagaaaggggtcaatgagaaggatattttgccgatggcccgctatttcaaagaaaaaggccatattttgcggtttattgagtttatggatgtcgggaacacaaatgaatggaaccgtcagtcagtggtggccaaagcggatatcatccggatcatcaatgaagatatgccgattgaaccgatcgacccgaactacgaaggagaagtcgcaaaacgatacctatacctggacggctcaggagaaatcggttntatctcttctgtatccgatgctttttgcaccacatgcaacagagcaagactatcggcgaaaggcgagcttttcacatgtcttttcgcatcaagggggtttgatttaagaacttgatcaagaagcgggcagaccgatcaggagctggcggaggcgatcggcacggtcggccggaatcgcgatgaccaatattctctcgaccgcgctcttgcaaaagcggttccggggaaaaaggttgaaatgtcctatattggagg

SEQ ID NO: 992 - DNA, 806 bp, Bacillus licheniformis
atggaaaagcgaacgtcaatacgaagatgtattatatgaaacatataacggcatcgccaaaatcacgatcaatcgccctgaggtacataacgcatttcgtccaaaaacggtttcagaactgatcgatgcgtttgcatatgcgcgggatgatgccaatatcggtgtcattatccttgcaggtgccggggataaagcgttctgttcaggaggagaccagaaagtaaggggacacggaggctatgtcggtgaagacgagattccgcgtttgaatgtgcttgatcttcagcggctgatccgcgtcattccgaagcctgttgtagcgatggtgtcaggctatgcgatcggcggcggccatgtgctccacgtcgtatgcgatttgacgattgctgcggacaacgcgattttcggacaaacagggccgaaagtcggcagctttgatgcgggctacggatcaggctatctggcgcgtatcgtcggacataaaaaagcgcgcgaaatctggtatctgtgccgtcagtacaacgctcaggaagcaaaagaaatgggccttgtcaatacggttgtaccgcttgaaaagcttgaagaagaaacgattaaatggtgtgaagaaatgcttgagaaaagcccgacagcactcagattccttaaagcggcctttaacgccgatacggacgggcttgccggcatccagcagtttgccggagatgcgacactgctttattacacaacagatgaagcgaaagaaggccgcgatgcgtttaaagaaaaacgccgtccagacttcggacagttcccgcgttttcctt

SEQ ID NO: 993 - DNA, 1133 bp, Bacillus licheniformis
gtgcgtattgacgaatggctcagcagccggctcgcaaagacgaaagcagccgggctttaccgctcgcttaaactgcctcaagctgaacgtacgaattgggcgtcaaacgattatttgggcctggcgaacgacaaacggctgattcatgccgcagaaacagcgctccgccgctttggagccggaagcacaggatcaaggctgacgtcaggcaataccgcatggcatgaaaaacttgagcggaaaatcgccggttttaagcagacggaagcggctctcttgttttcaagcggatatttggccaatgtcggcgtgctttcgtctttgcctgaaaaaggagacgtcatattaagcgatcaattgaaccacgccagcatcatcgacggctgccgcctttcaaaagctgatacggttgtttaccgccacaaggatatgaatgatcttgaagaaaagctccgcgccgcacagagccgtgcacgccgctttattgtgacagacggcgtgttcagcatggacggcacgattgcgccgcttgacgaaatcatgctgctcgccaagcagtaccgggcctttgttatcgtagatgatgcccatgcaacaggggttttgggagaagccggcaggggaacgagcgagtatttcggcgtctctcccgatgttgtgatcggtacgttaagtaaagctgtaggcgcagaaggcggcttcgtcgcaggttctaaaacattgatcgattttttgctgaatcatgcgagaacgtttatctttcaaacagctgtcccgcccgcaagctgtgcggcggcatgcaaagctttagatatcatcgaagacagccgggctaaacgccggcttttgcaatcatcggtgaacacgatcaaacggagtctcgtggatatcgggtttacggtcaacggagaagatacgccgatcatacccgttatgatcggagatccccaaaaagctgttcaatttgccaaacggcctgaaggagaaggggatgaagccccggccatccgaccgccgactgttgcagaaggagagagccggatcaggctgaccgtcaccgcagaacgcaggttgaaagatattgaagatctattagaggggtttaaattaatgggaagagagttgaacttggt

SEQ ID NO: 994 - DNA, 1014 bp, Bacillus licheniformis
atgcatgaacggtattcaagacaaatcagatatcaaaacatcggacaggcgggtcaggacagaatcaggcagagccatgttttgatcgtcggggccggggcgcttggcacgtcagccgctgaagggcttgtgcgcgcaggcatcggcgcactgtctattatagaccgcgattatgtggaatggagcaacttgcaaaggcagcagctctacacagagaaagacgcggaggaaaggcttccgaaagcggcggctgcaaaagaacgtctttccgagatcaacagcggtgttgagcttcgtacatatgttgcagacggcacagttgaaacactcagaccgctgatcgaagaggcggatgccgtcattgatgcaacggataactttgagacccgcatgatcatcaatgaccttgcgcaggagacgggtactccgtgggtttacggcgcttgtgtcagcagtcagggcatgtatatgacgattattccccaaaaaacgccatgccttgcctgcctgtttgaagatgttccgattggcggggctacatgcgatacgtcggggattatttcgccggccgttcaaatggtgtcggcttatcagcaagctgaaattttaaaaatcttaactggacagcaagaagcgcttcaaactgcttttgtcacgtttgatttatgggcgaacacccattatcgcatgcagatcggccgcaatgagaaatgtccttcgtgcggagaaacgccggtttatcctttcctcagcaacatgagccaaaagaaagccgacgtgctgtgcggaagagagaccgtccaaattcgcagcgaaatgttaaaacggctgcctaaagaggagctcatgaaaaagctttcggtcatcggaaaagtggatgcgaatgattatttgctgcatgtacaatatgaggcgttcagaatcgttattttcaacgatggaagagcccttgttcacggcacaaatgatataaaagaagccaactccatattggcgagagtcatcggaatgtaa

SEQ ID NO: 995 - DNA, 1063 bp, Bacillus licheniformis
atgaagattgccgagattacgacaaaccgcatcgccgttccgctgaaaaaaccttttaaaacagcgcttcgaaccgtccgcaccgcagaagccgtcattgtcaaagtaacggctgaaaacgggatgacaggctggggagaagcgcctccgactgctgttattaccggtgagacgcttgacagtattgagggggcagtcaacacgattctcgcacccgccctcaccgggtgcaacttgcgaatggctgaggcgatatttcatgatatcgacaagctgattgttggaaatacaagcgcaaaggccgctgtagaaacagccgtctacgattgcttggcgcagctttgcggtcttcccctgtatcaattgctgggcggatacagacgggagatcgagacggattttaccgtcagcgtcaatgacccggaagaaatggggaaagacgcggcccgctatgtacaggaagggtttcgcacgctcaaaattaaggttggaaaaaacgacatggcaacagacctcgaacggatcagggaaatccgcaaacaagcgggtcccgctgtccgaatccgcgtggacgccaatcaaggctggacggcgaaacaggcggtcaaagccattcggaaaatggaggatgaggggctttcgatcgagcttgtcgaacagccggtccaccggctcgatctcgaaggcttgaaacaggtgacagatgccgtcgatacgccgattatggcggacgaaagcgtgtttaccccaagggatgcttttcacgtgctgaaaacgagaagcgccgatctcatcaatattaaactgatgaaggcaggcggcatccgccaggcgctgaaaatcaacgccatggcagaagcgtgcggagtggaatgcatggccggaagcatgatcgagacaaggctcggcatcacagcggccgtccacttcgcagcaagccagaaaaatgtgacaaaattcgattttgatgcgccgctcatgctgaaggaggatatcgttgaaggcggcatccgctatcatgcaggaacgatcacgataccggatgctcccggactcggaatca

SEQ ID NO: 996 - DNA, 1203 bp, Bacillus licheniformis
cgacgggagggtgtactacgacggattttcttcagtatggctcaatgtccatggccatcgcaagaaggaactggatgaggccatcaaaaaacagctcggcaaaatcgctcattcgacattgctgggaatgacaaatgttccggcgacagaacttgccgaggtgttaatcaagatcacgccggaaaatctgacgcgtgttttttattcggacagcggcgccacagcaatggaaatcgcgctgaagatggcctttcaatattggaaaaacatcggcaagccggagaaacaaaaattcatttcgatgaaaaacggctatcacggcgatacgatcggcgctgtcagcgtcggtgcaatcgagctcttccaccatgtatacgggccgcttatgtttgaaagctttaaggtgaacgttccatacgtataccgctcgaaaagcggcaacccggacgagtgccgcgatgaatgtctcgcagaactcgaacggctcctgagcgagcggcacgatgagatcgccgcgctgtcggtcgaatcgatggttcaaggggcatcagggatgatcgtgatgcctgaaggatatttggcaggcgtccgggagctctgcacgaaatatgacgttttaatgattgtcgatgaagtggcgacagggttcggccgaaccgggaaaatgtttgcctgtgagcatgaacgtgttcaacctgacttgatggcggctggaaaggccattaccggaggctatttgccgatcgccgtaacgtttgcgacagaggaaatttatgaggcgttctatgatgactacaacaaactcaaaacgtttttccacggccactcatacacggggaaccagcttggttgtgccgttgcgctggaaaatttgcgcctgttcgaatcggaaaaaatcgtcgctcaagttgcggaaaagtcgaaaatactggaatcgctctttcatgatctggcagcgctccctcatgtcggcgacatccgccagctcggttttatgagcgggatcgagctcgttcagtcgaaggaaacgaggcagccttatccgcccgaagagcgaatcggataccgggtgtctttgaaaatgagagagcttggcatgctgacgaggccgctcggggatgttgtcgcatttcttcctccgctcgccagcaccgccgatgacctgcgcgccatggtgtcgattatgaaagaagcgattcaaga

SEQ ID NO: 997 - DNA, 1007 bp, Bacillus licheniformis
ttgaccggcaggtattcaagacaggagctctttcacccgatcggaccggacggccaggaaaaattaagccgcgcccgcgtcctcgtgatcggtgctggggctttgggcgcggccagcgcagaaatgctggtgagggccggggtcggttcgctgacgatagccgacagagattatgtggaatggagcaatctccagcgccagcagctctatacggaacaggatgtgattgatcatatgccaaaggccgccgccgctgaaaaaaggctgcgcctgatcaacagctctgttcaagtaaccggaatcgtagcggatgttactgcggaaaaagcgctcgagcttgcggaggaagcgtccctgatcgtcgatgcgacggataattttgaaacacggctgatcatgaacgacgcggcggtcaaattaggcatccctttcctgtacggcgcgtgtgtcgcaagctatggcatcacatatagcgtaattccgggaaaaacgccgtgtcttcattgtcttttggggcatttgcctgcgaataccatgacgtgcgacacagcaggggtgatcggtccggtcgtccagcaggttgccgcataccaggtaacagatgccctgaagctgctgaccgggcatgaaccgtcagggatgctccgctcatttgatatttggacaaatgagcggtctgaagtccgggctgacacgcttaaacatgagacatgtccgacgtgcggaaaaggcgagtttccgtttctttcagctgaaaacgaaacaaaagcagccgttctttgcggcagacaaacggttcagatcaggccggccgcggaacagccgctggaactggaatcgcttgctgccaaattaaaaaaagccggtttaaatgtgacgggaaatccttatttagtttcctgccgtgcggaggattttaagttcgtgatttttcgggatggacgtgctttaattcacggaacgaatgacatcaatcgcgcgaaaacgatatatcacaggtggattgg

SEQ ID NO: 998 - DNA, 855 bp, Bacillus licheniformis
atgacagcaaccatcatcgacgggaaagaaacagcaaaggaaaagcgcgggcagctggccaaggaagttgaagagctgaaaaaacaaggagttaccccgggactggccgttattttaattggtgatgatccggcgtctctttcatatgtacggggaaagaaaaaagcagctgaagcaatggggattcgttttcagctggatcatttcgatgcaagcttcactgaacaggagcttcttgaagtgattgaccagtacaatcaaaatgacgactttcacggaattcttgtccagctgcctcttccggatcatatttccgaacaagcggtgatcgagagaatatcccctgagaaagatgttgacggttttcatccattaaacgtagggaagatgctgcttggcgaagatacgtttctgccttgcacgcctgcggggatcgtggagcttttaaagaaaaccgagattgacctgtcgggaaaagaggttgttgtcgtcggacgaagcaatatcgtcggaaagccggtagggcagctgctcttgaacgaaaacgcaaccgttacgtactgccattcaagaacggccgacattacggctcatacaaaaaaagccgacattctgattgtcgctgtcggaaaggcgaatttcatcaaagcggatcaaattaaagagggagccgtcgtcatcgatgtcggcgtcaaccgccttgacaacggaaagctcgccggtgatgtcgattttgaagaagcgaaggaaaaggcttcctatattacacctgtaccgggcggtgtcggtccgatgacgattacaatgctggcccacaacacggttaaatcagcgaagcgtacaattcaactttaa

SEQ ID NO: 999 - DNA, 927 bp, Bacillus licheniformis
atatgaaattgacaacgttttattcttttttgaatgacgatattgaattaatagaaaaagagcttgaaaagaccgtgcactccgactatccattgctcagtgaagcgagcctgcatttgctgcaggccggaggcaagaggattcgtcccgtgtttgtcctgctttccggcatgttcggcgaatacgacatcagcaaaattaaaaatgttgccgtttcgttggaattgatacatatggcttcgctcgtacacgacgatgtcatcgatgatgcggagctgagaagaggacagccgacaatcaaagcgaagtgggataaccggattgcaatgtatacaggtgattatttgttcgctcgctcacttgaagcgatgacaaaaataaacgaaccgaaagcccatgaaatcttgtccaaggcgattgtcgaagtctgtcttggagaaattgaacaaattaaagataaatataatatggagcaaaatctcagaacctatttgagaagaatcaggcgcaagacagcacttctaatcgcgtcgagctgccagcttggagccattgctgctggtgcgggtgaaaacattcataaaacgttgtactggtttgggtattatgtcggcatgtcctatcaaattattgatgacatcctcgatttcacatcaagcgaaaaagagcttggcaagcatgtgggcagcgatctgcttcaggggaatgtcacgcttcccgtattatatgcacggaaatcgcctgagttaaaagcgcgcctgatgttggtcaacagtgaaaccactccagaacagatcaagccagtgatcgaagagctgaagaaaaaggatgccattgaacaatcgttcagggtcagtgaaatgtatttaaacaaggctttcgaattgggtgaaacgaacccgataaaccgggcgcccaccgcagtgg

SEQ ID NO: 1000 - DNA, 931 bp, Bacillus licheniformis
atgagaaacatcattgtaggctcaagaagaagcaaattggcgatgacccagacaaaatgggtgatcaaaaagctggaggaattaaatccggatttcacgtttgaaataaaggaaatcgttacaaaaggcgaccggatattggatgttacgctgtcaaaggtcggcggaaaaggtctgttcgtcaaagaaatcgaacaggcgatgctctccggggaaattgatatggccgttcacagcatgaaggacatgccgtcggtgcttcccgaagggctgatggtcggctgcattccaaaacgggaagacgccagggatgttctcatttcaaaaggccgtcaaaagctggctgacttgaaacaaggcgcagttgtcggaacgagcagcctcagaagaagcgcacagcttttgcaaatgcgccccgaccttgagatcaagtggatcaggggaaatatcgatacaaggctgaaaaaacttgaaaccgaagattacgacgcgattattttagctgcggccggcctgtcaagaatggggtggaaggacgatgtcgtcactgaatttcttgatccggaaagctgccttcccgccgttgggcaaggcgctttggcgatcgagtgcagaggctctgatgaggagctgctgtctctcttttcgcgcctgaacgaccgctacacacagctgaccgtcacggctgagcgcgcttttcttcatgcgatggaaggcggctgccaagtgccgatcgcaggatttgcaaagatggacgaagacggcgtcatcgaactgaccggtcttgtggcatcgcctgacggaaaaaccgtatacagagaaacagtaaaaggaaaagatccggaggctgtcggcagagaatgcgccgcagtcatgtcggaaaaaggagcaaaggcactgattgaccgggtgaaacaggagctggaagacc

SEQ ID NO: 1001 - DNA, 942 bp, Bacillus licheniformis
atcaggatttgaatttgcacacgttatatacgagtcatacccgtgatgcctgggcaaatctcggcgggcatatgtcggtaaagatgaccgaagaggaagtaaagaagcttgaaggtttaaatgactatctgtctttggaagaagtcgaaaccgtttatgttccgctggcgaggctgctttatttacaccgggcaactcaatatgaacggaacacccgggtaaacggttttttgaatcatcctcacgcggccaagattccgtttatcatcgggattgccggaagcgtcgcggttggaaaaagcacgacggcccgcatcattcagactgtgctctcccgtttgcaggaacggctgaaagtcagtctgatcacaaccgacggttttctttatcctaatgcggttctgacagaaaagcagatgatgtcgaggaaagggtttcccgaaagctatgatgtcaaagcgctgcttgagtttttgaacgatttaaaatcaggaaaggaaattgtccacgcacccgtttattcccatctaacgtatgacagattggaaggggtttatgaaacggtagaacaagcggatatcgtgatcatcgaaggcgttaatgtgctgcagacaccgacgatcgaagacgaccgtacaaaaccgcgggttttcgtttccgatttttttgacttctcgatttatgtggatgccgaagaagacctcattatcaaatggtatcttgaacgctttcgcatgctcagggagacggcttttcaagatccgagttcttatttgcataaattgaaagacctcgcggacgaagaagcggaccatatggcaaagttaatatgggagaccgtcaaccgtccgaatttgcatgagaacattctgtctacaaaattgcggtctgatttaattttgagaaaaggccaaggccacaaggtggaacacatcccggtca

SEQ ID NO: 1002 - DNA, 1146 bp, Bacillus licheniformis
tgaaaataacaggattcgagtgtttcctaattccgccgcgctggcttttcttaaaaatcgaaacggatgaaggcattacaggatggggagagccggtaatcgagggaaaggccgcgacagttaaggcggctgtgggcgagttaatggaatatttgatcggcaaagacccgatgaacatcgaagaccattggaatgtcatgtacagaggcgggttttatcggggcgggcccattctgatgagcgcgattgcaggcatcgatcaagcgctttgggacattaagggcaagttttacaacgctcccgtgcatcagctgctcggagggaagaacagggaatcgatcaaggtctattcatggattggcggagacaggcctcaagacgtcggcctcgctgccaaacaggtggttgataaaggctttacagccgtcaaaatgaacggcacggaagagctgcaatacatcgattcacatgaaaaaatcgatcaggtgattgaaagaatatcagcagtcagagaagcggtcggcccgtacatcggaatcggcattgactttcacggcagggtgcacaagccgatggcgaagatcttggcaaaggagcttgaaccgtttcggccgatgtttatagaagagcctgttctgccggaaaacaacgaggcgctccgcgatatcgccagcctcgtctcaattccgattgcgactggagaacggatgttttcaaagtggcagtttaaaaacctgctgactgacggctatgtcgatatcattcagcctgacttgtcacacgccggcggaattaccgaatgcaaaaagatcctgtcgatggcggaagcatttgatgtcgccgccgcccctcattgtccgctgggcccgatcgctctggcggcatgccttcaggttgatgcaacgtgccacaatgcatttatacaggaacaaagcttagggatccattacaacaaagggacggatttgcttgattatatagtagatcaaaaggtgtttttctatgaggacggctatgtccggattccggatggacctggccttggggtggacatcaatgaagatcacgtccgtaaaatggctgatatcgggcacaactggcgcaatccggtatggcggcacaaggacggaagcatagctgaatggt

SEQ ID NO: 1003 - DNA, 1107 bp, Bacillus licheniformis
atgcgcatagaaaaggttgacacatttccgctgttccacaagctttcctccccttacggcgatgcgaacggattgaaaagctacagaacaagctatctgattcggattacgacagcttcaggtctgacaggatggggagaatgcgcggattggctgcctgctttggatgcaggctttaaaaaacggatcattccttatttaattggaaaagaagcgagcaatcgaacggagctgatcactgtcatcaaaaaatggcatcagcgggccgcctctgctgtaagcatggctttaacggacatcacggcgaaaaaagcaggcctttcggtatgcgaattatggggaggaaaactgcgggagcagatcccggtatatgcgtcattccaatcgtattcagacaggccggattggagccgccattccctccggcttatcgaaaaggcagttcgggccggatttaaggcagtcaagctgaaagcgggaggcaagatgttttcagaagacttggcacatattcaggccttccaggagatgacagggcaaagcaccggactgatcctcgatgcaaaccagagttatgatcaggccgccgcgcgcaagtgggaaacgtggttttccggctggcaaaacgtgctttggtttgaagagcccatgccgtttgacgacctagctgaataccggatgctgcgctcagcgctttctgttccggttgccggaggagaaaacgtaaaaggcgcaaagccgtttttgccgatttttctggagaacgcagtcgatattgcccagcccgatgttatgcactgtgagggcacggacgaatttcaaaccgttctgaagctcgccaggcatttcggaaaaagggtctctccccacagctatgacggcggactttcaagaatatacgccgctttcggacaagcctgtttaccgcattggaccaaaatggacggagaagatatcgaaccgcttgaatgggatgcgatggagaatccgttcgcacaaatcgtgcccgtcagcataaaagacggctgcattcaagtccccgacaaaatcgaaattgatacagagctcgtagaagcgtatgtgtgggatggctcgtcttacatctga

SEQ ID NO: 1004 - DNA, 928 bp, Bacillus licheniformis
atggaagcatcatttcaaagacaccgccgcctgcggacgacagcaggtatgcggaaattggtaagggaaaccgagttaagagcatctgatttcatttatccgatatttgttaccgaggaagagaacgtcaaaagcgaagttccttctatgccgggcgtgtaccagctgtctttggaccgtttgaaagaggagatggaggaagtcgcaagcctcggcattcaatctgtgatcgtcttcggcgtgcctgagcacaaagatgatgtgggaagcggagcctatcacgatcacggcatcgtccaaaaagcgattgcacaaattaaacaggactttcctgaacttgtcgttatcgccgatacgtgcctatgcgagtacacggaccacggtcactgcggcctggtggaaaacggtgaaattttaaatgacgaatcgcttgttcttttggcaaaaaccgctgtcagccaagcccgtgcaggtgctgacattattgcgccgtcaaacatgatggacggtttcgttgccgctatcagggaagcgcttgatcaggaaggatttacaaatgtgccgatcatgtcgtacgctgtaaaatatgcgagcgctttttacggaccgttccgcgatgctgcgggaagcagtccgcagtttggcgaccgcaagacgtaccaaatggattatgccaaccgcagggaagctctccgggaggcaaaatccgatgtggaagaaggcgccgatgttctgatcgtcaagccgacgctttcatatcttgatatcgtcagagaagtgaagaacgaatttaacctgcctgttgtcggatacaatgtgagcggggagtatgctatggtcaaagccgccgcccaaaacggatggattgaagaaaaagctctgttctcgaaatgctgacaagcatgaagcgggctgggcgccgatttgc

SEQ ID NO: 1005 - DNA, 819 bp, Bacillus licheniformis
atgactttacaagaaaaaatcatgcaggaactgaatgtaaagccttctatcgaaccgaaacaggaaattgaaaaaagggtcggttttttaaaaagctatttgaaaaaaacgggtgccaaaggctttgttttaggcatcagcggaggacaggactccacattggcgggcaggctggcccagctggctgttgaagaattgagggaagaaggcattcaggcggaatttattgcggtccgcttgccttacggtgttcagcaggatgaagatgacgcccagctggcgctgaaatttatccagccggacaagtcttttgcttttgacattgcttcaactgtaggttcatttgctgctcaatatcagtcagtcacgggagaggcgcttgccgattttcacaaaggcaatgtaaaagcgagagtccggatgatcacccaatatgcgatcggaggtcaaaatcagctgctggtaattgggacagatcatgctgcagaagctgttaccggattttttacgaaatacggagacgggggcgcagaccttttgccgcttacaggactgacaaagcgccagggcagaagcctgctggaagagctgggagcgccggagcggctttatacgaagtccccgaccgccgatttgcttgatgaaaaacctcagcaatccgatgaaacagagctcggcctgacatatgataacatcgacgactaccttgaaggaaaagccgtctccagcgaggtggcagaggccatcgaaaaacgctacaaggcatccgagcacaaacgccaagtccctgcttcaatgtttgacgactggtggaaataa

SEQ ID NO: 1006 - DNA, 834 bp, Bacillus licheniformis
atgaagacaaaaactgactttctaaaaatgaaacaagagggagagccgatcgtcatgctgactgcctacgattatccggcggcaaagcttgccgaacaggccggcgtcgatatgatccttgtcggcgattcactcggcatggttgtactcggccttgactcgaccgtatctgttacggttgctgatatgatccaccatacaaaagctgtcaaacgcggggcaaaagatacgtttgttgtgacggatatgccttttatgtcatatcactgctctttggaaagcgctctgaaaaatgccgcggcgatcgttcaagaaagcggggcagatgctttgaagcttgaaggcggcgacggtgtgtttgagacgatcacggctttaacacgcggcggaatacctgttgtcagccatttaggcttgactcctcaatccgtcggtgttttgggaggctataaagttcaagggaaagatgaagaaagcgccggcaagctgattgaagacagcaggcgctgtgaagaagcaggcgcgatggcgctcgttctggaatgcgtcccggcagcgctcgctgaacggatttcaaaggagctcacaattcctgtcatcggcattggagcaggtgctggcacggacggacaggttctcgtttaccacgatgttgtcggacacggagtaagccggacgcctaaatttgtcaagcagtatgcacaaatcgaccagccgcttgaacaagcgcttcggggatatgttgaggatgtcagaagccgcgtgtttcctgaagatgctcattcgttccgtatagatcagcaagttcttgaaggattatacggagggaaatag

SEQ ID NO: 1007 - DNA, 858 bp, Bacillus licheniformis
atggcgcttcaaacagcggtgcgttcaaagcaactgatcgcaaagcaatacacgttgtcttatgaagataaaacattgatcatgggaattttaaatgtgacgcccgattctttttcagacggcggaaaatataacagcatcgatcgcgccgtcattcatgcaaaacaaatgatcgaagacggcgcccatatccttgatatcggaggagaatcgacgaggccgggggcggaaaaggtttctcttgatgaagagctgtcaagagtcatacctgtaattgaaaaacttgttcaggaaatcgacgtcccgatttccgttgacacttataaagcgcaagtggcagatgaagccattaaggccggtgcagccatcatcaatgatgtctggggagcaaaagcagatcctgacatggcccgagttgcggccgctcataatgtgccgattatcttgatgcataaccgcgaggaacggaattataaggatttgatcccggacatgctgtctgatttgatggaatgtgtgagcattgcaaaatcagcaggcgttcaggatcatcacatcgtacttgatcccggcatcggctttgccaaaacgtatcatgacaatttggcggtcatgaatcagctcgagaagttcagcgaaccgggatacccggttttattggggacgtcacgaaaaaaatttatcggccgagtcctggatctgccgcctgaagaaagagcggaaggcacgggggcgacagtatgcctcggtattcaaaaggggtgcgatatcgtcagggtgcatgacgtcaagcaaatctccaggatggcaaaaatgatggatgccatgattgataaaggaggcgtttatcatcgataa

SEQ ID NO: 1008 - DNA, 846 bp, Bacillus licheniformis
ttttgtccatcgcctgaaaataaatatcaaaatggtcttgcgcgatttccgcaacgtccgttatgaatcaacacgcgacagaatgactctcgtattaaacggagaagacgctgaagctgtaatggctcgtctgaaacacgttttcggcatccaatcgttcagtcttgccgtgaagtgccggacagatctggaaagcattaaagagacggcgctcgcttctgttcaagaacaatacaagcccggggatacctttaaagtatcgacgaaaagggcttataagcagtttgaattaaatacaaatgagatgaatgccgagatcggaggacacattttgcgcaacaccgacgatcttaccgttgacgtccactccccggacatccatttgcgtatcgaaattcgggaagatgccacgtatttgacattccgggatgaaaaaggtgcgggcggactgccggtcggaagcggaggaaaagcgatgcttatgatatccggcggaatcgacagccctgttgccgggttctatgccatgaagcgcggacttgagatcgaagccgttcactttttcagcccgccatatacaagcgagcgggccaagcaaaaagtgatcgatcttactaagcggcttacggcttttggcggagacatcaagcttcatatcgttccgtttacaaaaactcaagagctcattcaaaagcagattcccgagaactattccatgacggcgaccagaaggctgatgctccagatcgccgacaaactgcgcgaacgccataacgcgcttgcgatctttacaggggaaagcctcggccaggtggcaagccagacgcttgaaagcatgtatgccat

SEQ ID NO: 1009 - DNA, 751 bp, Bacillus licheniformis
atggctcaaacaggtactgatcgcgtaaaacgcggtatggcagaaatgcagaagggcggcgtcattatggacgttgtcaatgctgaacaagcaaaaatcgcagaagaagcaggagccgtcgcagtcatggcgctggagcgcgttccggctgatatccgtgcggcaggcggagttgcccgcatggcagatccgactattgtcgaagaagtgatgaacgctgtttcaatcccggttatggcaaaagcacgcatcgggcatatcgttgaagcgcgtgttcttgaagcgcttggcgttgactatattgatgaaagtgaagttttgactcctgcagatgaagaatttcatttaaataaaaacgaatttaccgttccatttgtatgcggatgccgcgacctaggagaagcgacgcgccggatcgctgaaggagcttcaatgcttcgtacaaaaggcgaacctggtacgggcaatattgtggaagctgtccgccatatgagaaaggtgaatgctcaagtgcgcaaagtagtcggcatgagcgatgacgaactgatgacagaagcgaaaaacctcggcgctccttatgagctgctgaaggaaattaaagccgaaggacgccttccggttgtcaactttgctgccggcggtgtagcaacacctgctgatgctgctctaatgatgcagcttggcgctgacggcgtattcgtagggtccggtattttcaaatccgacaaccctgcaaaattcgcgaaagcaa

SEQ ID NO: 1010 - DNA, 741 bp, Bacillus licheniformis
agcagacgaagcagctggaaaaacgcttaaacgagcttcaggatgatgtggtgttcaaggcatatatcggtctcaaacatatcgaacctttcattgaggatgccgttcgggagatgcataaagacgggattacagaagccgtcagcatcgtgctcgcgccccatttctccacctttagcgtacagtcgtacaacaagcgggcgaaagacgaggctgaaaagctcggcgaattgtcgatcacatcgatcaacagctggtatgatgagccgaaatttatcgcttattgggcggatcaggtgagaaaaatctatgacgaaatgccttcggaagagagggaaaacgccgtcttgattgtatcggcgcacagccttcccgaaaaaatcgtcgaaatgggtgatccgtatcctgaacagcttaaagaatcagcgaagctgattgccgaagcggcgggagtaaaagattacgccgtcggctggcaaagcgaaggaaacacccctgatccgtggctgggaccggatgttcaggatttgacgcgcgacttgtcagagcaaaaagggtacagcgcttttgtttatgctcccgtcggctttgtagccgaccatttggaagtcctttatgacaatgactatgagtgcaaagtcgtcacggacgatatcggagcaagctattacagacctgaaatgcctaacgctaaacatgagtttatcgatgctttagcggatgttgtattaaaacaattgg

SEQ ID NO: 1011 - DNA, 774 bp, Bacillus licheniformis
atggggaaagtatatatcgttggggcaggtcctggagaccccgatttactgacgatcaaagctttaaaagccatccagacagccgatgtcattttgtatgacaggcttgtgaataaacagattttacagcacgccaaggagggagcggatctcatctactgcggaaagcttccggactaccacatgatgaagcaggaaacgatcaatcattttctcgtcaagtatgcgaaaaaagggaaaaccgttgtcagactgaaaggcggcgatcctttcgtattcggcagaggcggcgaggaagcgcaaaccctcgctgagcacggggttgcttttgaaatcgtgccgggaatcacctcgggaatagctgccgctgcttatgcgggcattccggtgacacaccgggaagcgagttcaaacgttgctttcgtgacaggccattatcaaaaagaagaaaactttgaagagaagtggaaagcgttagccacagggatcgatacgcttgtcatttatatggggattaaaaacgtgaagcaaattgaaaggcttctgatcgaaaacggcagagacccgtcaacgccagccgctttcatccattggggaacgacagacaaacaaaaaacggtgctttgcacggttgaaacgcttgccggtacagtcgaaagcgaaaagattgaaaacccgagcctgattgtcatcggggatgtcgttcaattcagctcgcagttaagctggtttgaacctgagctgaaagatccggcattaagcgaggcgctttaa

SEQ ID NO: 1012 - DNA, 699 bp, Bacillus licheniformis
atggtgcagtcaaaagaacagcgcgtacatggcgtgtttgaaaagatttataaaaattatgaccagatgaactccgtcatcagctttaaacagcataaaaaatggcgcgacaaaacgatgcagctcatgaacgttccaaaaggagccacagcgcttgacgtctgctgcgggacgggagactggacgatcgcgctcgctgatgcggcaggagagacaggggaaatcaagggccttgatttcagcaaaaacatgctgagcatcgccgaacaaaaaacggaaagctacagccagatcgaattgatccacggcaatgcgatggaactgcccttcccggataatacattcgactatgtcaccatcggcttcgggcttcgcaatgttcccgactatttaaccgtattaaaagagatggcgcgcgtggtaaaacccggcggccaggttgtatgccttgagacgtcccagcctgaaatgttcgggttcaaacagctatacttcctgtacttccgcttcattatgcctatgtttggaaagctctttgccaaaagcttcaaggagtattcatggcttcaggaatcggccagggaatttcctggtatgaaagagcttgccgcgttgtttgaagaggctggattaaaaaatgttcaatatcatccgttcacaggcggcgtagcggcaacacatgtcggctggaagcgatga

SEQ ID NO: 1013 - DNA, 973 bp, Bacillus licheniformis
atggacgaatttgaattaattcaaaggattacgccccgttcgctttctcatcgggaaatagaaatcggtattggagacgatgccgctgtttatcatacgaagaacaattatcaggagatcgttgcagtcgatacgatggtcgacggtattcattttttatcatcccattcatcgcctgccgatatcggatataaagcattggctgtgaatattagcgatattgccgcaatgggaggccgacccaagtactatcttgtgtcaatcgccgttccttccggttggggcgcgacggatattgaagccatgtatgaagaaatgaataaactggcgacactatatgaaatggatttaatcggcggggacaccgtatctgcaaacgggccgctcgttttgaccgtaacagcaatcggcgaaattgaaaagggcagatcttgtttaaggagccatgccgagcccggtgatgtcgtttttgtgacgggagaacttggctcatcagctgccggcctgtcttttatattgggccaaacatcggcgagagacgagacgcagtctcaatactttattgagcggcacaagaggcctgagccgagggtggaagcaggtttgatctgttcacgctatcaccatgtggcgcttaatgatatcagcgacgggcttgccagtgaattaaatgaaattgctgaagcgagccgtgtttccattgacatatataaagagttgattccggtccattcggatttacatatattgcacacaaaatgggaagagtgggtccttttcggcggcgaggattttgaactcgtcggtacgatttctaatgatcaatgggaacgttttagtcaggaatgctccgagcatgatgtgcgggttcatcaaatcggccgcgtcacaaaacaaggacaggcggaagtgttttatcatgacggacaggaccgcgttcttctcgaaaaaaaaggatataaccattttaaac

SEQ ID NO: 1014 - DNA, 914 bp, Bacillus licheniformis
atggaacgaaaaaaagtcggcctgttagtcatggcatacggaaccccttatcaggaagaagatatcattccgtattacacgcatatccgtcatggaaaacgaccgtccgatgatatgattgaagacttgaaaaaacgctacaagcatatcggcggaatctctccgctcgcgaaaattacgctcgctcaggcaaaagagctggaaaaaacgttgaacgagcgccaagataaagtcgaatacgtgatgtatctcggcttaaaacacatctctccgtttatcgaggatgcggttgaacaaatgaaaaaagaccaaattgaagaggccgtttccgtcgtcttagctccccactattccaccttcagcaccgaagtatacaatcggcgcgccaaacaggccgcagcagcaatcggcggaccacggatcgcatcgattgacgagtggtatcaggaagaaggctttattcgctattggtctgaagaaatcggcagcattttaaacgacatgtctgaaaaagagcgggaaaaagcggccgtcatattctcagcacacagcctgccggaaaaaatcagggagcatggcgatccttacccggatcagctcgagaaaacagcacaactaatcggagaacggctgtcatttgaccagatcgccgtaggctggcaaagcgagggcaacacgcccgatccttggctcggcccggacgtccaagacttaacaaaggaactgtatgaagaaggcttccggtcattcatttacgcaccagtcggttttgtatctgaccacctggaagttctgtatgacaacgactatgagtgcaaagtggttacggacgagcttggcgcaagctatcaccgtccgcctatgccgaacactgatccgcggttcatcgatacgcttgcttcagtcgtggagcg

SEQ ID NO: 1015 - DNA, 811 bp, Bacillus licheniformis
gtgaccggtaaacttgaaggatttttaaaatcgagaaaaacagtaattgaagagcgccttccgatgtatattaaagacttgcaagcgccgtccatcctcaaggaatccatgctgtactcattggaagccggggggaaacggctgagaccgatattggttcttgcgcttcttcatgcgtacggaaaagacgaagaagccggaattccagtcggatgcgcggttgaaatgatccatacgtattcattaatccatgacgacctcccttgtatggatgacgatgacctcagaagaggtaagccgacaaaccacaaaatttacggggaggcgacggccattctcgcgggagacgccttattaaccgaaagcttcaaaatgatcacttccaatatgccttctgatgtatccgctgaaaagcgcatcagactggtgaacgagctgatttcggcagcgggggccgaaggcatggtcggcggtcagattttagatatggaagcggaatcaaagtctgtatctcttgatgaactgcagcgaatccacgaaggaaaaacggctaaactcctcagcttcagcgtcattgcgggagccattcttgcagatgcatctgaaaaagagatcgaaaagctgcgcgaattcagccatcatatcggcatcggctttcagatcagagatgacattttggaccttgaaggctcggaggataagatcggcaaacggatcggatccgacgcttcaaacggaaagtcgacgtatccgtcgctcctttcgcttgagggcgccagccaaaaacttgatgaacatattgaaaaagcaa

SEQ ID NO: 1016 - DNA, 934 bp, Bacillus licheniformis
ttgaagacgatacatatttcccacccacacgacttgaagcgtaaggattttccgacatcagttatggcattaggttattttgacggtgttcacctgggacatcagcaaatgagtcttacagctatatacaccgcggcaagtgagagggtcattacgtccgagttgtcctttcatccccacccttcagccgtgctcaaaaaaggccgggagccgaaggatttaatcacgcctccgcaagacaaaatcagcatcacgcaagattaaggggccgatttttcacacgttgtcacattgacccctgaattcgcttctcaatcacctgaggaatttatcgatcaatacacactcggctttcaggtcactcatgtagaagccggatttgactttaccttcgggaaattcggcaaaggcactatggaaaacttccaggagtatgcgaaaggccgtgttaaaagcacgtctgtcgcaaaatattccaatcaggatcaaaaggtaagctccacgaggatccgcagcgttctgggagccggtgacgtcgagtacgctgctgaactgctcggcaggccgtaccatgtgaaaggctttgtgatccacggcgataaaagaggccgcacgatcggatttccgaccgcgaatatcggccttaaagacacatacatcgtcccgccgacaggtgtgtacgccgttaaagccgaaatcggcggcgctgtctacaacggcgtctgcaatgtcggatacaagccgacgttttacgaaaaacggccgggtcagccttcaatcgaagtcaacttattcgattttgaccgtgacatatacggctccgaaatcaaggttgaatggtataagcggctgaggagcgaaaaaaaattcggcagcgttgacgagcttgtcgaacagatttctagagacaaagaagaagcgatccgcttcttca

SEQ ID NO: 1017 - DNA, 1365 bp, Bacillus licheniformis
ggaaagtttattttgtcggggccggaccgggcgattcaggattgatcacattaaaaggaagaacgctgatcgaggcggcggatgtcatattgtatgacaggctcgtcaattcccggctgcttgagcatgcaaaagcatcatgcgaatttgtctactgcggcaagctcccggaccgccattatatgaggcaaagtgaaatcaatgcactgctcattgaaaaggggctgaaaggcctcaaagtggtccggctgaaaggaggagacccgagcgtgtttggcagagtcggggaagaagcggccgccgtcagcgaacacggcatcccgtacgagatggtgccaggcattacatcgggaatcgccgctcctctttatgccggactgcctgtgacccaccgcgatttcgcttcatcctttgccgttgtcaccgcccatgataaatcgggcaaaccggagatgaattgggaagggctggccaagggcgtccaaaccctcgtcttttacatggggatcaaaaaccttggttatatatgcgagcagctgatgaaacacggcaagtccccccttgttcccgcaatggccatccaatggggcacatggggccggcagcggagtgttaaagggacattgcagaatatcagggagaaaataaccgagcatcagatcaaaaatcccgcgattatcgtcatcggcgacatcgtatcattcaggcagaacagctggtttgaagaaaagcctttgatcgggctgaacatcatggcagtcaaaagctgtgaagaagaacaaattccagtggaggcgcttcgtgaacaaggcgctgaagttgtggaatggccgaaatggaaatcggccgaaacggtgcctgacgatgcacttttaggtcgaatcgcttgttttgacagcctgctgttcacctcaagtgcgtcactgcgcagatttttcagccggcttgctgctttgaagatcgatgtcagggaaatgcgcggaaggctttacgcttcagatcagcatgtaaaagcagctcttgaagaacggggatttgaagcctttctgcaaacggaaatgccggtctcgggcagctgtttgctgatcggcagccgggaagccgtgcaaaattacccgcactccgggtgcgaggtattgattacacatgacagggtgatcgacagccgctttacctcgatcatcaaacgggaaattgatgagtttcctattgatatagtgttgttttcaaatcgaacatgcgtcgagctgttcgtaaacgaggcggagacagtcggcctccatccggaaaaaacggctgcccgtcttcaggcgttctgcctcactgaagaagcgggggagagagctgcagccgtagggtttcagc

SEQ ID NO: 1018 - DNA, 797 bp, Bacillus licheniformis
atgagcatatataaagcattaacaatcgccggatcggattcaggaggcggagccggcattcaagccgacattaaaacatttcaggagcttggcgtcttcggcatgacagttttgacagcagtcactgcgcaaaatacaacaggggttcacggcgtctacccgctttctccggaagcgctcggcgcacagattgatgcagtggcagaagatttaaaacctgacgccgtgaaaacagggatgctgtggagcgcggagatgattgaggtcactgctgaaaaaattgcagcatatgagcttaaacgtgtgatcgtcgatcctgtcatgatcgccaaaggcggcgcttcactattgaatgaggaagctgttgaaacattgaaacggcgccttcttccgcttgcttatgcggtaacgccaaacattcccgaagccgaagtgctgacagggagaagcattcaaacaatggaagaccgcaaaaaagcagctcgtgacttgcatgaaatgggcgtccgcaacattatcatcaagggaggtcatcagcctgaggatggcaaagtaaccgatctcctcttcgacggagagacgttcacagaaaaaaccaattcctatattaagacgaaaaatacccatggaacaggctgtacatttgccgcggctcttacggcgcaatcagcgaaaggaaacgggattcaaggagctttccgcatcgctgaggctttcgtccacgaagcggttgtacacagccttgattttggagccggccacggaccgaccaaccattttgcatatcaaaagttatc

SEQ ID NO: 1019 - DNA, 805 bp, Bacillus licheniformis
atgaatatggaagatgccgcaaggggaattgagttagtcagaaagcaaaaaccgctcgtacacaatatgacaaacaatgtcgtcaccaactttacggcaaacggtttgctggctctcggcgcatcgccggtgatggcgtatgcgagggaagaggccgccgacatggcaaagatcgccggagcccttgtgctgaacatcggcacgctcagccgtgaatctgttgaagcgatgattattgcaggaaagtcagctaatgaacatggggtgccggttatttttgatccggtcggtgcgggggcgacgccgtttcgaacggaatcggctcaagcgatcatgcgcaaagtgaaggtttctgccgtcagaggcaatgctgcggaaattgccaacacgcttggggaagactggctgatcaaaggcgtggacgcgggtgaagagagcggcgacagaacggagctcgcaaaaaaagccgcgaaattatgggatacagcagtcatcataaccggtgctgaagacgtgataacggatggtacaaaaacgtataccgtgggcaacggacatcagctgcttacgaaagtgacggggacaggctgcttgtttacctctgtcatcggtgcgttttgcgccgttgaaaaagacgtttgccgtgccgctgtatctgcagccgctttttatggaacagcggccgagttggccgcggcgaaaacggaaagccgggggcccggaagtttccaaatcgagtttttgaatcagcttgctgccgttgaagctatggatataaaagaacgcggcaggatcagagaggtgg

SEQ ID NO: 1020 - DNA, 963 bp, Bacillus licheniformis
taagaaagaaactcattcaattgtttaccgaggcagacggcgaattcatttctggccagaaaatcagcgaagagctcggatgctcaagaaccgccgtttggaagcatatcgaagatctgagaaaatcgggatatgaacttgaagcggtccgaaagctcggctataaaatgataaaaaaacccgacaagatcactgaagatgaaatcaggctcgggttaaaaacgaaaaaaatgggacagacgatccattttcaggatgtcgtttcatcaactcaaaaaatcgcccacgaacttgcaaacaacggtgcgcccgaaggaacgatcatcgttgccgacaagcagactgaaggaagaggaagaatggcgagagcatggcattccccggaaggaaacggcatttggatgagcatcattttaaggcctgaaattcccgtgcaaaaaacgccgcagctgacgcttttagccgctgtagcgatcgttcaggcaatcgaagagcaaaccggcatcgcagccgaaattaaatggccgaacgatattttgatcaacggcaaaaaagtggtcgggatcttaacggaactgcaggcggaagctgatcaggtccattccgttattgtcggaacggggatcaacgtcaatcagcttgcagccgactttccggaggaattacaagaaacagcgacaagccttcgtctcgcaagcggtgaaaaaatcgacagagcggctttggtccaaacaataatgtcgacgtttgaaaaaaggtatgaagactatctcgcctacggttttgaaccgatcaagcttttgtgggaaagctatgctttgaccctgaaccgcgaattgacggcccggacgctgaacggaacgtttcacggcaaagcgctcggaatcgacgaagaaggcgtattgatcctggaaacgagtgacggcatcaaaaaaatatactccgctgatatcgatattaatc

SEQ ID NO: 1021 - DNA, 591 bp, Bacillus licheniformis
atgctgacaattggtgtacttggacttcagggagcagtaagagaacacattcgctcaattgaagcatgcggagcggccggaaaagtcatcaagtggccggaagagttaaaggaaatcgacggtttgattttgccaggaggcgaaagcacgacgatgaggcgcctcatcgatacgtatcagtttatgaagcctcttcaggaatttgccgcatccggaaagccggtatttggaacttgtgctgggctgattatcctggcgaagaacattgccggaactaacgatgcccatctcggggttctggatgtaacggtagagcggaattcctttggaagacaggtggacagctttgaagcagacttaaccgttaaaggacttgagggaccgtttacaggcgtatttatccgcgctccgcacattttggaagcgggcgcagatgtagaagtgctttcggaacacaacggaagaatcgtcgctgccaaacaaggaaatcttctcggctgttctttccaccctgagctgacggatgatcacagaatgacgaaattatttgtcgagatggtggaaaagcataaacgggaagccgtcgtataa

SEQ ID NO: 1022 - DNA, 585 bp, Bacillus licheniformis
cgatcaaaggaaaaagaatcggatttggcctaacgggttcacattgtacgtatgatgccgtttttccgcagattgaagcgctgatcaacaaaggggctgaagtcagaccggtcgtgacgcatactgtcaagtcgacggatacacgctttggagaaggggaagaatgggtcagaagaatagaagagctgactggatttgaagtcattgattccattccgaaagctgagcctctcgggccgaaaacaccgctggactgcatggttgttgcgccattgacgggaaattcgatgagcaagcttgcaaacgcccagacggacagtccggttctcatggcggccaaagcgacgatgagaaactcccgtcccgtcgtcctcggcatttcaacgaatgacgcgctcggcttgaacggcgtcaacttgatgaggctgatggcggcaaaaaatgtttactttattccgttcggccaggatgacccttacaaaaagccgaattcgctcgtcgccaaaatggatcttttagtgccggcggtcgaagaagcgctctcccataaacaaatacagcctatcctggtccataatgatcaat

SEQ ID NO: 1023 - DNA, 575 bp, Bacillus licheniformis
atggcaaagcaaccgattgatctactcatccagccgaaatggagaatcattgaccaatccagtctcggcccatattttgatgcaaaacaatcatttgcgatagatgatacgctgtgcgcttctgtcgggaaaggtttatctccggcgaccgcgcgttcctgggtgcaccatgacacgattgtgctcggaatccaggatacaaggctcccttatttacaagaagggatttcattgcttgaagaagcgggctatcaagccatcgtccgcaattccggcggactggccgtcgttttggacagcggggttttaaacgtttccctgatttttcaggataagaaaaacggaattgatatcgacagaggctatgaagcgatgtttgagctcgttaagcgaatgctgtcatcctatgacgcagcaatcgaagcctatgaaatcaaaggctcctactgtccaggaagctttgatttgagcatcgggggaaggaaatttgcgggaatttcccagaggcgcctgagaggcggagtggctgttcaaatttatttgtgcgctgatcaaagcggaagcgggcgcgctga

SEQ ID NO: 1024 - DNA, 772 bp, Bacillus licheniformis
atgcagcggttcatacttaggaacatgcttaaggaatttttcaaggaagatatcggccggggggatctcacttcagaagccgtttttgatgacaatcatcaatgcgaagctgtcatcacagcgaaggatgacggcttgtttgcaggagaattagtgattctggaaggctttcggctgcttgatgaaacgatcgccgtccacatgctgaaaacagatggcgaagcggttcgtaaaggggaaacgatcgcgcgactcacaggccgtgcagcttccctcatgaccggtgaacgggttgtgctgaatctcattcaaagaatgtccgggatcgccacattaacaaagcagtccattatcaggctgaatgatccgaatatcgcgatttgcgatacgagaaagacgaccccgggcctgcgcatccttgaaaaatacgcggtcaaaaccggcgggggcagcaatcaccgctttggattggacggcggcatcatgattaaagacaaccatattgccgcctgcggctcgatttcaaaagcggttgaaaaagcgcggtcagcgtgcggccatatggtcaagatcgaagtggagatcgaatctgaacaagagcttcatgaagcgattgaggccggcgccgatatcattatgttcgacaattgcccgcccgagacggtgaaagcatttgctgaaatgacacccgccggcattataacggaggcttgaggcggaatttgatttgaaaatctacccgcttacaggggaacaggggtgcactgggttg

SEQ ID NO: 1025 - DNA, 1512 bp, Bacillus licheniformis
tgtcaccgccttattcttttatcggtcttgctgccagctttatatcctggccgatcttggtaatggttgtgaattgcagtaaggggacatctttcatcgattgaaagccttcaccggagaggatgctgggagattgcagccctccgattaatttaggggcaagatagaagattatttgctgatagagtccttctttgacgaagcttgcgtgaaccgttgcgcctccttcgacaaagactgaagcgatgccgcggtctgcaaggtgcagaagcacgtcgcgcacctgaagttcatccgcatcgagcacggttacctgcacaccttctttttccacgttccgaaccttttcgggatctgccttggacgtcgtgtaaatccaagtaggcgcttctttatcctgaatcacttttgactggagcgggattgacagcgtcgtatcgagaacgacgcgcaccggctgattcaccgcaccggggagacggcatgtcaaacttgggtcgtctgcttttattgtgcccgatccgactaaaatacactggtggttttttcggtattggtgagcatccatccgcgcttcttcagaagtaatccatttgctgtcgcctgttgcggtggcggttttgccgtcaaggcttgcagcggcttttaatgtcacatacggaaggcctgtccgcataaaatgcatgaacttttcattcagctcttccgcctgttctttgagaacgcctgtttccacctcgatcccggcgcttctcagcatctcgattcctcttccggaaacgagcggattcggatcttccgcagccacgaccacccgcttcaaaccggaacgaataatcagttccgcgcaaggaggcgttttgccgtaatggctgcacggttcaagcgtcacatagatgacggctccttccgcatggcggcctgccatttgaatggcgtgcacttctgcatgtgcttcgccgtattttaaatgggctcccattccgaccacttcgccgtctttgacgacaaccgctccgacaagcggattggccccggtctggccttcgccctgcctcgccagctccaatgcaagattcatataatgcgcatccgtcatgaatttccctcccttctttcaaaaaaataaccccggatgttgatccgggggttgtttttgtgcatgagaaataaaactatgcttattcattattttttacatagtctcttcatccttctcccatccagactttcactgtcggcttcagcttttcactgaatccaccgctttgcacgaagcacagcgggtcacgggctctaaagctgtctctcgctttattaccgccggtcgggattttcacccagccccgaaggatacaatcgatatttacttgtccttatgcgtaattatagcggccgcatattaaaattgcaatgaaaactgcttgcacagaaaaaccctctgaaaaacagagggtttttattctgccaccttgacgacttttattaatccgtcgattctgttggcattag

SEQ ID NO: 1026 - DNA, 597 bp, Bacillus licheniformis
ggaaggaaaggggggcgcatatgaacatcatcgtcggaatcacgggcgcgaccggcgcggtatttggcgtgcggatgctggagtggctgaagaaaaccgacgcagagacacaccttgtcatctctccgtgggcagcggcaacgatcctgcacgaaacgggatatacgatgaaagacgtggaaaagctcgcatcttttacgtattcccacaaagaccaggcggcccgcatttcaagcggttcctttcaaacggacggaatgattgtcgcaccgtgcagtatgaagacgttggcgggcatccgcaccggtatggcggataacctcttgacccgttcggcggacgtcatgctgaaggaacggaaaaagctcgttctgttaacaagggagacgccgctgaaccagattcatcttgaaaacatgcttgagctgacaaaaatgggggcggtgatcctgccgccgatgccggctttttataatcatccccaaaatctgaccgaaatggtcgatcatatcgtatttcggacgctggaccaatttggcatccatctgtctgaagcgaagcgctgggaaggtatgaaacaggagaaataaggaggat

SEQ ID NO: 1027 - DNA, 648 bp, Bacillus licheniformis
atgtttacaggcatcattgaagaagtcggaacgattttggacatgaaaaaggcgggaagcgccatgtctttagtcattcaatccaacaaagtgatcgaagatgtgaagctcggcgacagcattgctgtcaacggagtctgcctgaccgtaaatgagttcggttccagcagtttcacggcggatgtcatgcttgaaacgctgaaagcaacatcactcggcacattgaaaaaaggaagccgcgtcaatcttgaacgggcgatggcggcaaacggccgcttcggcgggcatatggtgtcggggcatgtcgacggcactgcatcgatcgttcgcatagaaaaagcggcaaacaccgtatactatgatttaaaacttgacccttcactggccaaaatgcttgtgttaaaaggttcgatcgccgtagacggcgtcagcctcaccatattcggactgacggaggatcaggtaacagtctcgcttatcccgcacacattggatgaaacgatttttcctgcaaaaaaggtcggaagcatcgtcaacatcgagtgcgatatgatcggcaaatacatttaccgctttctccaccaaacaaaacaagaaaaacaggcacaggcattgactgaagcattctttaaagaaaacgggttttaa

SEQ ID NO: 1028 - DNA, 686 bp, Bacillus licheniformis
atgaagggtttttttgtaacgggaacagatacgggagtcgggaagacgtttatcgcttgcggtcttgccgctttactgaaagagcagcatgtagatgtcggcgtgtttaagccgtttttgagcggcgagctcgctagcgatccgcagagtgatacagctcttttaaagaacatgtctgaaacgcctcttactgatgaagaggttacgccttttatttttaaagagccgcttgcaccatacacagctgcgaagctcgaagggaggacagtcgggctggaagatgccgtgaaccattggaaaaagataaaggatcggcacgagtgcttcatcgttgaaggggcaggcggaattgctgtgccgctcggggaggattatttcgtcagcgacttgatcaaagcgctcgatttgccggccgtcattgtggcgcgtcccaatctcggaacgatcaaccatacgtatttaaccgcccaatacgcaaaacaaatggggatacgcgtgatcggcatcgtgatcaacggcatcagcagccggccgggacttgacgaacagacgaatccggacatgattgaaagattttgcggtgtgccgctcctcggcgttacaccgaagcttgaagacgcttcaccaacacaaattcaccacatgatcaaggatcatgtcgatgtttccttgattatgaatcaaat

SEQ ID NO: 1029 - DNA, 870 bp, Bacillus licheniformis
atgaatcattttatagaccttgagattcccaatgcggacttaaatcggacgctgcacgcttttctagatgcaaaggaccagttgcatttcagcgagcttgctttttatcattaccaaagtttcggcggcacggacaccgatgcggcagaaacccttggagcaggcattgaactcttgattcttgcgtttgatatattcgatgatttagaggatgaagacagccccgatgaaccttggatgaaaatcaaccgttcagtcgcaatgaatgcggcgactgcgctttatacaataagcattaaagtgatcggttcggtgtcgaaagaaccggtgtttttcgaaaagctaatggaatatacacttcaatcgatgcagggacagcatgacgatctcagcaaccgccctgccactgaagatgagtgccttgacatgatcaagcgtaaatccggggcgctgacagccttgccatgcgtgctgggagctatgcttgctacgggcaaatttgacccgacggttgaaaagtacgcctaccagctgggcattgcttcacaaattgaaaatgattataaagcacttttttatgattcaaaaagcgatatcgccaagaaaaagcggacgcttgcgtatttatatttgtcaagaaaatttaaccagccgtcgattgatttgttaaaaacatttgaaactgaggataaaattgccgataaagaaataaaatgctataaagagaaattgaaggcagcaggcgtcactcagtatatgtatgttatgaatcagctcgctattcagaaatttaagaagggaatcggggagcttgagttgggggatatggagaaagaacgtttgatgtctaccctgctgaataacaattaa

SEQ ID NO: 1030 - DNA, 790 bp, Bacillus licheniformis
atgaagcatgatcttcctttagagggaaagaaagtgctcgtcacccgcaataaagcgcaagcccaatctttcagggaaaaggtggaggctttgggcggggaagctgttttaacgtcattgatttcgtttcggcccgcccttccgccagaacaggcccggcgctttcgagcagatcttgaaagtgcggactggcttgtttttacaagcgtgaacggggcaaaattctttttttcttatttaaaggacgccgggttgtgcgatcctcccgcatcaaaggcgaaggttgctgctgtcggtgaaaaaacagcccggtatttgcgcgacaggggtctttctgtcgatctgatgccggagttatacgtggctgaacatttggcggaggcacttaagcaaaatgccggacgtcatgacaaagtggtcgttttaaaagggaatttatcccgggacgtcatcaagaaaaccatctctcctctcggaattcaagtttcggaatggattttgtatgaaaccgtgcgtgatgaaaggggaattctggacctgaaggaagcagcaaagcacgcgtcttttgattttgtgacgtttaccagttcttcgacggtacatacattcatgtccattctgaaagaggagagcttagcgtgggccgaaaagaaccggacggcttttattacgatcgggcctttgacaaagaaggcgctgtcggactacggaattccatcatatatgccggacgtctatacaatcgacggaatgctgcgcgaaatgtgccgcatttcaagaaagggagaat

SEQ ID NO: 1031 - DNA, 645 bp, Bacillus licheniformis
atgaaaacgatcaatattgtagcgggaggccccgatcatcttattcccgacttgctgcagtatcaggccggggatgcgctttgggtcggggttgacagaggcgctgtcacccttttggatgcggggatcgtgcctgatgaagcattcggggattttgacagcatcacagacgagcaaaaaaaagcgattgaaaaggccgctccccgcctccatatttatcaggcggaaaaagatcagacggatttggaccttgcgttgagctgggctgtcggacagcgtccttcatttattagaatgttcggcatttcgggaggcagagcagaccattttctcgggaatctgcaccttctttataccgcgatgaagcaaaacgtcaagaccgtcatgatcgaccgccaaaatacgatcagcatgcatcccccaggctcctataccgtcatgcatgatcaaacaaaaccgtatatttcattcctgccgtttgcggagacggtaaaaaacctttctctcgaaggatttaagtattctttaaataagtgtcatattgctctcggttcgacactatgtattagtaacgaactcatccattcacaaggtgctttttcgttttcagaaggcatattaataatgataagaagcactgattaa

SEQ ID NO: 1032 - DNA, 660 bp, Bacillus licheniformis
agatgacgcgagtctcagaagaagcaatgaaagatctgttgtcggtctattttattatggggtcaaacaataccgcaggggatcctttaactgttattgaaaaagctttaaaaggcggtgcgaccctttttcaattccgcgaaaaaggcgagggtgcgttgaaagccggagatcaaacggcgtttgcccgacaggtgcaggcgctgtgcaaacagttcaatgtaccgtttattatcaacgatgatgtagaactcgcgcttgaacttgacgcagatggcgtgcatatcggccaggatgatgataaggccgcagacgtcagagcgagaatcggggacaaaatcctcggcgtttccgcgcatacacttgaagaagtcttaaaggcggaaaaggatggagcggattacatcggtgcggggcctgtttaccctactgaaacaaagcgggatacaaaagctgtgcagggcgtctcgctcattcaagagatccgcaggcagggaattggcattcctgtggtcggaatcggcgggatcacggtcgaaaactgcgtccccgtcatcgaggccggggcggacggcatcagtgtcatcagcgccatcagcaaagccgccgatccaaagcaggccgccgaggcgtttagcgagaaagtccaagctaccaaac

SEQ ID NO: 1033 - DNA, 809 bp, Bacillus licheniformis
ttgggaaaaggattgaacggcagaagaattgccatcggagcatcgcgaaaaacggatgaaatgagcacgctgatcaaaaagcaaggcggggttcccctcattcgctcccttcagggtaccgtgtttttggccgaaaaagaagtaggccctgatttgcgtgccttcgttgaaacgggagccgactgggtgattttcacgaccggaatcgggacggaaacgcttgtcagcctagctgagaaacttgggatcggagagcgctatttacaagcgatccgcagggcgaaagcggcatcgagaggctacaaaacaatcgccgctttaaaaaagctcggcattacgcccgttgcggcggatgaagacggcacgaccaagggactgatcgactcgctccaatcccacgatttttccggcaaacgggtgatggttcagctccacggcgaaaacgctccgtcactgcttcagtttttggaagagaaaggtgcagacgttgttccgcttctgccgtatcggcatgttgctccagaccgggaaaccgtcgctttattgtgcagcgagatcatcaaccgtgaagtggatgcggtttgctttacaacggctgtccaagtccgctcgctttttcatttcgcgaaagaaaacggctatgcggagaaaattgttcaatcttttcaagacagcgtgttggcggccgctgtcggaaaagtgacggcagaagctttaagagaagaaggagtcgaacgccttctcgctccggatctcgaacggatgggagcgatgattgtggagctagcgcggttttatgaaacggaaga

SEQ ID NO: 1034 - DNA, 570 bp, Bacillus licheniformis
atgaggaaaatcgggatttttggagggacattcgatcctccgcacaacgggcatttattaatggcaaatgaagtcctgtacaaactggatcttgatgaaatctggtttatgcccaaccaaattccgccgcataaacaaaaaaactcgttttcactaagtatgcacagggttgaaatgctgaagctcgccatttcggggaaagagcaatttaaactggagacgatcgaactcgaaagggaaggcccttcttatacatttgataccgttcgcctgctgaaagaccgataccctgatcatgagttttactttattatcggcgcggatatggtggaatacctgccgaaatggtcaaacattgacaagcttgtcaacatgattcagtttgtcggggtgaagcggcccggctttcaaattgagacgccgtatccgctcgtttttgtcgatgtgcctatttttgaagtgtcatcatctttgctcagggaccgcattaaaaatcggcagccgacagattatttaatacctgacgaagtgaaggtctatgtgaaggagaatcgtttatatgaaacgtga

SEQ ID NO: 1035 - DNA, 546 bp, Bacillus licheniformis
acggccaggagccgacggttaccgcaagcgtgaaaaagcggacggatgtcctttgcggccgttcaagagaagggcatttcgacggtgtcgcaacagtgctcacaaagctgttcaatctcacgtctccgacaagggtttatttcggcatgaaggatgcccagcaggttgccgtcgtcgacgggctgatcaacgactttttcatggatatcgagctgatccctgtcgaaacaaaacgggaagaagacgggcttgccaaaagctcaagaaatgtcaatctgcgagctgaagaacggcaggaagcaaccgctctttaccgagctcttcagcgcggcgccgagctgatccgcaatggagagagagacccggaggccgttaagcgggagattcggagcattctggaaaaaacgagtggtgttattgattatgccgatatttattcatatcccgatctggagatcagggatccattgactggaaaagtcatcatagcggttgccgttcagttttccaaagcccgcttaattgacaatatcatcgtcgatatcc

SEQ ID NO: 1036 - DNA, 396 bp, Bacillus licheniformis
cgcaccatgatatggatgttgataagccaggcaaagatagctatgagctgcgcaaggctggcgcggcacaaaccatcgttgccagccagcaacgatgggccttgatgacggaaacaccagacgaagaagagctggatctacagtttctcgcaagtcgaatggatacctcaaagctggatttgattctggtcgaagggtttaagcatgaagagatcgcaaagattgtgctgtttcgcgatggagccggacatcgacctgaagaattagtgatagacaggcatgttattgctgtagccagtgatgtgccgcttaatcttgatgtcgcattactggatattaatgatgttgaggggctggctgattttgtggtggagtggatgcaaaagcagaacggat

SEQ ID NO: 1037 - DNA, 592 bp, Bacillus licheniformis
ttgacattggtcatcgggttaaccggggggattgccagcggcaaaagcactgtcgcgcaaatgttccagcagtgcggcatcacggtcgtcgatgcggacgtgatcgcgaaagaggccgttgaacaggggatgcccgcttatcagaaaatcgctgagacatttggtgaaggcgtgctgcttgaaacaggcgatatcgaccggagaaaacttggagaaattgtttttgctaatgaagaaaaaaggctgcagttaaatgcaatcgtccatcccgaagtgagaaaaatgatgatcaagcagcgcgacgaagccatccgggccggtgaacggtttgttgttctcgatattccgcttttatatgaaagcgggctcgaacatttgacagataaagtgatcgttgtctgggttccgatggagcttcagcttgagcggctgatgaaaagaaaccggcttaataaagacgaggcgctgaacagaattcacgcccagcaatctcttgacgaaaaaaagaaaagggcagacgcggtgatcgataacagcggcagtctgaaagatacagaagcgcagcttcatcagctgcttgatacatggtcaa

SEQ ID NO: 1038 - DNA, 454 bp, Bacillus licheniformis
ctgaacgatttatcataacaaaagacccgattgtcatcgaagatgtcgtcaaaaaagttgaaagaagggaagccggtgccgtcacgacgtttatcggaacagtgagagaatggaccaacggaaaaaagaccctctatctcgaatatgaagcttatgttccaatggcggtcagcatgctcgctcagatcggcaaagaaatcaatgaaaaatggcccggcacagctgcagccattacccatcgcatcggcaggctggacatttctgacgcggccgttgtcatcgccgtgtcgtcgcctcaccggaaagcggcgtatgaagcgaatgaatatgctatcgaaagaataaagcaaatcgtcccgatttggaaaaaagaacattgggaggacggcgagacttggatcggcgaccagcttgagacaactgaatacccggaagggaaaccggatattgaaga

SEQ ID NO: 1039 - DNA, 465 bp, Bacillus licheniformis
atgaataaaatagaaggtcatgtaattggaacagatttgaaaattgggatcgttgtgtcaaggttcaacgattttattacaagcaaacttctaagcggcgcagaagacacgctgttgagacatggggtcaaagctgatgatattgatgtcgcctgggttcccggcgctttcgaaattccgctcatcgccaaaaaaatggctgaaacgaaaaaatacgacgcagtgattacgctgggcacggttatcagaggagcgacaagccactatgactatgtctgcaatgaagcggctaaggggattgcagcgagcagcatgtcaacaggcgttccggtgatcttcggcgtattgacgacagacacgatcgagcaggcggtcgaacgcgccggaacaaaagccggaaataaaggtgcagaagctgccgcggcagcgattgaaatggcgaacctgacccggtcgcttcaataa

SEQ ID NO: 1040 - DNA, 503 bp, Bacillus licheniformis
atgatctcattgattgctgcaatggacagaaaccgcctgatcggcaaagacaatgatttgccatggcatctgccgcaagatttgaagtattttaaagaggtgacgaaagggcacgccgtaatcatggggagaaagacgttcgagtccatcggcagacctttgccccaccgcgagaacatcatcgtcacatccaataaagaactggatatcccgaattgtcaggtgatgcactcggcagaggaagcggtgcggtttgcgaaaaacagaaacgaagaatgttttgtcatcggcggttcaacactatacacggagattctgccttttgcggacaagctgtatgtgacaaaaattgatgaaacctttgaaggggaccggtactttcctgaattcagcgaagctgagtgggaaatcgtttcgaggcggaaaggcctgaaagatgacaaaaatccttatgactacgaattcctcgtttatcaaagaaaaggatagaggagaggattttc

SEQ ID NO: 1041 - DNA, 855 bp, Bacillus licheniformis
aaaaagccgccttccaaatcggatcagaggttgttattaacaaggtcgggcatccggacgagggcggttttgtacatggaaagatcgattgtctcgatattgaactgctgcctgaaaacctgcctgtcggaaaggtgtcggctgaagctggaaacgccgctttccatttcgtgaaaaaagcggttgagctcgctaaaaaaggctgtattcaagcgatttgcacagcgccgttaaataaggaggcgctgcataaaggcggacaccgatacccggggcatacggaaattctcgctcatttaacgaatacaacagactacagcatgatgctggcttcgccaaagctgaaggtgattcacctgacaacgcatcaagggctgatcgaggcgattcagtcgattacgccggagcggacctataaagtcatccgtctcgcacatgatacattgacaagagccggattcgaacagccgaaaattgctgtttgcggaatcaacccccatgcaggggaaaacggcctgtttggaagcggcgaggaagaacggcaattgcttccggggattgagcaggcggcagctgagggaatcgatgccggcggcccataccccgcagacacgctgttttacaaagctgtcagaggagatgttgaccttgtcgtagcctgctaccacgaccaggggcatataccggtcaaagtcctcgggttggaagagggcgtcaacattacagtcggattaaacggcgggatcatacgcacctctgtcgaccacggaaccgcatttgacattgcggggcagaacaaagccgatgaaagaagcatgctcgctgctttgcggtcagccgctgagctggcgccca

SEQ ID NO: 1042 - DNA, 384 bp, Bacillus licheniformis
atgtaccgtacgttaatgagcgcaaaacttcacagagcgagagtgacggaagccaatttgaactacgtcggcagcgtgacaattgatgaagatttgctggatgctgtcggaatgatggcaaatgaaaaagtgcaaattgtgaataataataacggggcccggctggaaacgtacattattcccggtgaaaggggcagcggcgtcgtttgtttaaacggagctgccgcccgccttgtccaggttggagatgtcgtcatcatcgtgtcttatgcgatgatgtctgaagaggaagcaaagacccataagccgaaggttgccgttttgaacgagagaaacgaaatcgaggaaatgctgggtcaggagccagcccgtaccattctgtag

SEQ ID NO: 1043 - DNA, 510 bp, Bacillus licheniformis
ccgtcggctatctttatacgggcgggccgtttccgatctcctatacgccgtttggtgaaattatgtcaggcgtttttatgggaatggtcatcatcctgatttcatactatattcaaaccggcgggctgacttggaacgtctttctgatctcccttccgattacgattttagtcggaggcatcaatctttccaacaatatccgcgatttggtcggagataaagaaaacggaaggaagacgcttccgattttggccggaagaaaaaacgccgtgcagattttaagctgggtttttgctgtttcctatatattgatcggtatatacatcggctttgagatcgtttctctgtggagctgcctcgttcttttaagcctgcctaaaccgattaaagccatccaggagttcaaggcaaaagaaaagccggcagaactgatggtcgccatgaaatcgactgcgcagacgaacacctttttcggccttctgctcgccatcgccctgcttattcagtacg

SEQ ID NO: 1044 - DNA, 984 bp, Bacillus licheniformis
atggacgaatttgaattaattcaaaggattacgccccgttcgctttctcatcgggaaatagaaatcggtattggagacgatgccgctgtttatcatacgaagaacaattatcaggagatcgttgcagtcgatacgatggtcgacggtattcattttttatcatcccattcatcgcctgccgatatcggatataaagcattggctgtgaatattagcgatattgccgcaatgggaggccgacccaagtactatcttgtgtcaatcgccgttccttccggttggggcgcgacggatattgaagccatgtatgaagaaatgaataaactggcgacactatatgaaatggatttaatcggcggggacaccgtatctgcaaacgggccgctcgttttgaccgtaacagcaatcggcgaaattgaaaagggcagatcttgtttaaggagccatgccgagcccggtgatgtcgtttttgtgacgggagaacttggctcatcagctgccggcctgtcttttatattgggccaaacatcggcgagagacgagacgcagtctcaatactttattgagcggcacaagaggcctgagccgagggtggaagcaggtttgatctgttcacgctatcaccatgtggcgcttaatgatatcagcgacgggcttgccagtgaattaaatgaaattgctgaagcgagccgtgtttccattgacatatataaagagttgattccggtccattcggatttacatatattgcacacaaaatgggaagagtgggtccttttcggcggcgaggattttgaactcgtcggtacgatttctaatgatcaatgggaacgttttagtcaggaatgctccgagcatgatgtgcgggttcatcaaatcggccgcgtcacaaaacaaggacaggcggaagtgttttatcatgacggacaggaccgcgttcttctcgaaaaaaaaggatataaccattttaaacaagacaggtga

SEQ ID NO: 1045 - DNA, 430 bp, Bacillus licheniformis
gtgcttacacaaatttatccgcaaccaagccatccttactcttttgaattaaataaagatatgcaaatgtcagctgcacattttattccgagagaggatgcaggcgcatgcagcagagtccatgggcatacgtatacaatcaatattacgattgccggggatgagttgaatgcatcaggtttccttgtcaacttcagcaccattaaaaaattgatccacggagaatacgatcatacgcttttaaatgatcatcaggaattttcaggtgaaagcgcggatcggatcccttcgacagaagtcgtggccaaaacgatttacgataaagtagaggcttatttgaaagatctcaacaaccgtccgcattgcgtccaggtgtttgtcagggaaacgccgacaagctatgtcgtgtaccgtccgaaaccgggtgttc

SEQ ID NO: 1046 - DNA, 879 bp, Bacillus licheniformis
tggcgtatcttgcaggagcagagcccgcatacttggaattcgttcaatttcatcctacattgcttgtcaaagacgggcgcgcgcacggacttgtttcagaagctgtgcgcggagaaggtgctgtgttgattgatgaaaacggacagcgggtgatggaaggcatacattctttgctggatttagcgccgcgggacgttgtatctcgggcgatacaccaaaagcttgcctgcggaagcagcgtatttttagatatttcccgcatatcagactttaaaagccgcttccctacgatttcttctctttgcgaaaaagccggtatttccattgaagagggccggattccggtttcaccgggcatgcattttttaatggggggcgtttctgtgaataaatggggagaaacggctgttccaaacctttttgtgatcggggaagccgcttgcaccggctttcacggtgccaaccgtctggcaagcaattctctcttggaatgcatcgtcttcggaaggagagcggcggagcggattcaagcctgccaaaaaccggagcctgtcagaggccaatctcctcagcctgagaatgtgacgtattctgttcctttgacagatgtgaaggatattcagaaacaaatgacagattatgcggcgatcgtgcgtacggaggatgaattgacgaaggtgaaagaatggcttgagcgaatgccggttcaaatcgtaaatgtgaaagaaatcacaatagaacagctcgagctagctcatttatggcagactgccaaacagatgacggcctcggcactgcttcgtacagaaagcaggggcggccattaccgttcggattgtccggcgcctgatgataaaaactggcacggcaagcaaatcg

SEQ ID NO: 1047 - DNA, 255 bp, Bacillus licheniformis
caaaagaagaaatatcgaaacaatggacgaccttcttgcgaacaacgtcgacatcatggcaatcggccagtatctgcagccgtccaaaaaacacattaaagtacagaaatattaccatcctgacgagtttgccgaactgaaagaaatcgccatggaaaagggcttcagccactgtgaagcaggaccgctcgtccgttcttcataccatgccgacgaacaggtgaatgaagcgtctaaaaaacgccaggcgcaggc

SEQ ID NO: 1048 - DNA, 333 bp, Bacillus licheniformis
catggagttttacggatatcacggtgttttcaaagaagaaaacaaactcggccagagattccgcgttgatctgacagcatttctagatttaagcgaagccgggaaaacggataatattgaggccaccattaattatgcagagctgtataagctgtgcaaagaggttgtggagggagagccggtcaaccttgtggagaccctcgcggaaacgattgccgcacaagtgctggagaattttgaagcggttcaggaatgtacggttaaagtcgtcaagcctgatcctcctatacctgggcactataaatcggtggccatcgagatgacgagaaagcg

SEQ ID NO: 1049 - DNA, 618 bp, Bacillus licheniformis
ttccatcttgtctaatcaagctcttgttcacaaatctgtactatgttaaagtgactaaagatgaagatttagcattttttatttaagcggttccaaagcagagggactcatccggcgctatgtcacaaatttcgtattgaacatgactactatccacaatggagatgatggaattggcaaagaaagacgagcacctaagaaagcccgaatggcttaaaatcaagctgaacacgaatgaaaactatacgggcttaaaaaaattaatgcgggaaaacaacctccatacggtctgcgaagaggcaaaatgcccgaacatccacgaatgctgggccgtcagacgtaccgcgacctttatgattctcggatctgtctgtacgagagcctgccgcttctgtgcggtgaagacggggctgccgacagagcttgacttgaatgagccggaaagagtcgcagattctgtgagcatcatgaacctgaaacacgcggtcattacagccgttgcccgtgacgatttaaaagacggaggagcgggggtattcgccgaaaccgtacgcgccgtccggagaaaaagcccatttacaacaatcgaagttctgccgtccgatatgggcggagact

SEQ ID NO: 1050 - DNA, 675 bp, Bacillus licheniformis
atgagcacggaatcaggcattcctgattttcgttcagccggcgcgatatggacggaagatctgtcgagaatggaagcgatgagccgtgattattacgaacgatatccaaaattgttttggccgaagtttaaagagctttttcaaatgaaaatgacgggaacttatcggccgaatgacgggcacctttatttagccgaactcgagaaaagcggtaaggatgtcagggtgttcacgcagaatatcgacgggctgcatcttaaggcgggaagccgccatgtatatgaactgcacggttcgattcaaacagccgcttgcccaaaatgcggggcgcgctacggtcttgaccacattcttcaagaagaagtgccaaggtgcaatcgcgtcaatggcaaggggagagcatgcggatttatattaaaaacggatgtcgtgctgttcggcgacgccgttcagcatttcgacacgctttttgaagtcctcaacgaatccgacctgcttctggtgatcggcacttcactcgaagtggcgcctgtcaggtttgttcctgaagaagcgcacctgatccccggtttgaagaaagccatgatcaatctcgatgaaacgccttacgatcatttattcgacattgtcatcaatcaaaaaatcgccgagtttgttcggaaactcaatcattaa

SEQ ID NO: 1051 - DNA, 284 bp, Bacillus licheniformis
atgaagggggaagcgtattacagtgtgagaatgagagcctccgagaacggtccccatgaagaggggggaaaacacatatccggaggagagcggcttgtgcctttcatcggtttaaatgatgccgtcagcgatttattggaaaaaggtatgtctcattcgcggggcaggccggactttatgcaaattcagttcgatcttgtaaacgaaccgataaagcttgttcaacctttgcgcattgaaacgaatgaaacggtatcagcggaagaaggacgagcgctcgccca

SEQ ID NO: 1052 - DNA, 236 bp, Bacillus licheniformis
atgaacaacacggcatatatagcgctcggctcgaatatcggccggcgggaagaatatttaaaaaaagctgtctctctcctccatcaacatccgtctgtagaggtgacagacatctcgtcaatttacgaaactgatcctgtcggttatacagaccaagatctatttttaaacatggctgcagctgttaaaacatctctttcaccgtttgaattgctcgatttgactcagcgtattaa

SEQ ID NO: 1053 - DNA, 435 bp, Bacillus licheniformis
atcgttttcatgttcctgcacaaaaagctggtatagccggtatgatgcacgacatcaggggtgtcatccctaatgaaaaaagaattgcggctgctgaagcgctcggtattgatattctgcccgaagaacggatattcccgatgatcatccatcaaaagctgtcgaaagtgatggcgcgggacctgtttcaggtggcggatgaagatattttaaatgcaatagaatgccatacgacgcttaaaaaaatccttcccagctcgaccttgtcctgttttcagcggacaaaatagaatgggatcagacggggactccgccttacataccagaagcttaatgaagcgcttgaaatttctctggaacacggggcgtttgtttatattcagcatttgttggaacaaaaagataaactgaaagtttgtccatccctggctgaaa

SEQ ID NO: 1054 - DNA, 269 bp, Bacillus licheniformis
atgaaagaaatacatgtcatattatcaggggggctttcgcgccgttttggggaacagaaggcgtttgcccgctggaaaggcaagccgctttatcaatggtgcaaacaggcgctgggagacgacgtcttgatattgagccgtccgggcttgacggagcggtttatagaactcgggaaaaaagcggtgctggaagatatcgacccgtacagagggaaagggccgcttgccggtatgtacacagccatggagcgggcggaaggggaatgcta

SEQ ID NO: 1055 - DNA, 339 bp, Bacillus licheniformis
gagaagaggaagagaaaattgtccttgccgttgaacgcgcacaaagtgaaggtatacaggcattcggtccgctgcccgctgacacgcttttcttcagagcagtgagaggcgactttgatatagtggtggctatgtatcatgaccaaggacacggcccgattaaggtgcttggccttgaagccggtgtgaacattgcagtcggcctgccgattatccgtacgagtgttgaccacggaacagcctttgatattgcgggaaccggcaaagccgatcctgcgagtatagaagaagcggtgagacaggcgatcatgctgtccggtacgcgtgagcggcatgcat

SEQ ID NO: 1056 - DNA, 513 bp, Bacillus licheniformis
atggtcagcacctctttctctgccggaagccgcctcttcaatatccggtttcccttccgggtattcagttgtctcaagctggtcgccgatccaagtctcgccgtcctcccaatgttcttttttccaaatcgggacgatttgctttattctttcgatagcatattcattcgcttcatacgccgctttccggtgaggcgacgacacggcgatgacaacggccgcgtcagaaatgtccagcctgccgatgcgatgggtaatggctgcagctgtgccgggccatttttcattgatttctttgccgatctgagcgagcatgctgaccgccattggaacataagcttcatattcgagatagagggtcttttttccgttggtccattctctcactgttccgataaacgtcgtgacggcaccggcttcccttctttcaacttttttgacgacatcttcgatgacaatcgggtcttttgttatgataaatcgttcagacaaacgccttcctcctttagatga

SEQ ID NO: 1057 - DNA, 195 bp, Bacillus licheniformis
cattcagctcaacggccggaaaatagagtggagagacgacggcggcacgatttatgatttgctcgcatcctacaatttggaaaatcgtgttgtcgttgttgaaaaaaacaggcggattatcggaaaagaccaatatcaaacggtcaaattggaagaacacgatgtcatcgaaatcgttcattttgtcggaggggg

SEQ ID NO: 1058 - DNA, 195 bp, Bacillus licheniformis
tgtgccgggaatttgctatgaccggagaggatacagaatcggctatggaggcggctattatgacagatacctggccggctttacaaaagataccgcgtcgcttgccttcgagtgccaagtgatcggtcatgttccaaatgagccgcacgacatcccggtcaagcaggttttgaccgaagacgccgtttacaactg

SEQ ID NO: 1059 - DNA, 382 bp, Bacillus licheniformis
atgattcagatctatacagcaaaagatatacaaaacttaacgaaaaattaccgcaaggaaggcaaaaccatcggtttttgtgccgacatgggcttccttcatgaaagtcatatgtcgctagtaaaaaaagcgcgaaaagacaacgatattgtcgtgatgagcatttttgtcaatctatgcagttcgggtccgggagagactatgaagcgtatccgagagatattgaaagagaccgtcactggccggcgcttaagagagggcccctttgtttccatcctgaccttgaaaaatgtacggccagtacccgacggttaccgtagcctgaaaaagcggacggttgaactttaaggtcgattataaaaaggtttttttccggatatac

SEQ ID NO: 1060 - DNA, 354 bp, Bacillus licheniformis
atgtttatttggcagattccccactttctggcgcttgcgattaagaaaacggaggaatacagagccgcaaatataccgatgctgcctgttgtacacggttttgaagtgacgaaaaggcagatcatcatttggattgcctgcttaatgccgctgccgtttttcctgggcggactcggactgccgatcgtcattttggggacggtgcttaatatcggctggctcgtttgcggtctggtcggttacagaagcaaaaatatcatgaagtgggcaacgctcatgtttgtatattcattaaattacttgaccattttcttcgttgccatggtcgtatttacactttttaaaattggatag

SEQ ID NO: 1061 - DNA, 309 bp, Bacillus licheniformis
ggaagaagaaaaaggcggaacccggtgatttcaagaatgcatttctgatcattcttgcgaccgatgaccatgaggcaaacaagcgtctcgccgcatcggcagctcctgagcagctcgtcaatgttgcgagtgaagcggagctgggaaatgtatatgttccaaaaataatcaacagaggaaacataaccatatccgtctcaacaaacggagccagcccgcgccacacgatcaggctggccggacagatcgatgatttgatcgatgatgagctcgtccaagagatcgacgagcttttccgaaaaagaagag

SEQ ID NO: 1062 - DNA, 303 bp, Bacillus licheniformis
atgcttgaagaaggcatcctggcacatgccgagacccacggcatcgacatcactgtcaaccgtctaaaaggcgcgctcaccgtatacttcacgaacgaaaaagtcgaaaactatgagcaagccgaaaatacggacggagacatgttcgcggcctttttcaaactgatgcttgagcgcggaatcaatcttgcgccttcaaaatatgaagcatggtttatcaccaccgcgcagacggaagaggacattaaagatacgctcaaagccgtggatgactcatttaaacaattgaaacagcgcatgtaa

SEQ ID NO: 1063 - DNA, 406 bp, Bacillus licheniformis
atgaacaacacggcatatatagcgctcggctcgaatatcggccggcgggaagaatatttaaaaaaagctgtctctctcctccatcaacatccgtctgtagaggtgacagacatctcgtcaatttacgaaactgatcctgtcggttatacagaccaagatctatttttaaacatggctgcagctgttaaaacatctctttcaccgtttgaattgctcgatttgactcagcgtattaaaaagaactcggccgcaaacgcgacattagatgggggccgaggactgcagaccttgacattttgttgtataatcgtgaaaatattgagacagagcaacttatcgttcctcatcctagaatgcatgaacgtttgtttgtactcatcccgctgcggagattatcggacacaag

SEQ ID NO: 1064 - DNA, 973 bp, Bacillus licheniformis; identical to SEQ ID NO: 1013

SEQ ID NO: 1065 - DNA, 1472 bp, Bacillus licheniformis
ttgatcatggattttgatgtattgattgcaggcggcggccccgtcggtctgctgacggcttccgagctggctttggccggcgtccggacctgtattgtcgaacggctgaatgagccttctccattctcaaaagcgctcacactgcatcctcgctcaatcgaaatacttgaaatgagggggcttggagaacgatttaaggaaattggcaagccgctcggttcggggcactttgcaggtctgaagactggattggatttttctgcgcttgacacgcgagccaattttacactgttcatcccccagtacgaaactgagaaggtgcttgaggaacacgcgaggaatctcggtgtctgcatccttcgcggtcatgaagttctcgctgtccgcgagcatgaagacaccgccgagcttgtcgtccagggtccggacggcctgtccttactaaccgcttcctatatcgtcggtgccgacggggccggaagtaccatccgcaagcaggcgcgcatcgctttttccggaactgatgcgaatatcaccgcaatgcttggtgatgtgtcgcttgaaaatccgccggaatcgcatttctatacttgcgtgaaccgtgaaggcggcgttgtgatcgtgcctttagacggcggcattttccgcgtcctcataacggcgccgcatatgccccaagctttgcttcacgagcccgtcacactggaagaattaaaaaaagaactcagccgcatttgcggtacggactttggaattaacagcccggtttggatgtcccgcttcggaaatgccagcaagttggcggagcattaccgttccggcagaatttttttagctggagatgccgcgcatatacattttcccgcaggtgggcaaggtttaaatgtcgggcttcaagatgcgatgaaccttggctggaagctcgcagcaaagatcaacggacggtgtcccggctggctgcttgacagttaccatcatgaaagacaccctgtcggcaaagcgctgatcgtcaatacacaaatccaaacaaagctgtttgattttacgcgtgaagggctgtacctccgtgaattgctatccggcatactcggattttcagacgtcaatcgctatctggcagaacaaattgcagcgctcagcgtgcagtatgaagcagatgaaaaaatgcctgaacatgagctgaacggtaaacgcctgcccgatattgacctgaccctttcagatggtactgtcaaacgactttacacatttcaccgcgatggacgtttcttattagcagcattcggaaaagaaccgaaggaattttccagactgcctcatgtccggctcatgcaactgaaagcgattgacggacggcctgaatggaatggcgtaaaagcagccctgatccgccccgacggccacatagcctgggctgtggacgaatccctggaaaacgcggagcaattgattgccgatggaatccgccgctg

SEQ ID NO: 1066 - DNA, 639 bp, Bacillus licheniformis
aaaccattttgcggacacaagtgggaattatcggagcgggacctgccgggcttatgctcgctaacctgctccaccgcaggggaatcgaagcggttgtgatcgaatcccgctcgcgaaaggagattgaagagaccgtccgtgcaggcgttctagaacagatgacggtagatttgctgaatgaaacaggtgccggtgaacggatgatgaaaacagctatgtttcatcaaggaattgagattcgctttggcggcaagcggcacagaattgatatgcacaagctgacgggggggaaatacattgccatctatccccagcatgaagtgatcaaagatttaatcgccgcccgcctgcaatcggaagggcgcatcgttttcaatgtgtctgacgtccgcctttcaaatattgatacagaagcgcctgtcatcacttatcagaatgaaaacggcgatacagaagaactgaactgcgatttcatcgcagggtgcgacggctttcacgggccgagcagacaaagcattccgaaggagatccgcaaagagtacgaaaaggtgtacccttacggatggctcggcatattggctgaagcccctccgtcctcgcctgaacttgtatatgcccatcatgaagacgggtttgccc

SEQ ID NO: 1067 - DNA, 812 bp, Bacillus licheniformis
atgatacgtacaacgaactttaacgcaggaccagcagcactgcctttagaagtgcttcagaaggcaaaagacgaatttcttgatttcaatggtgcggggatgtccgtgatggagctgtcccatcgcagcaaagagtatgacgccgttcatcaaaaagcgaaagctctgttaaaagaactgatggacatacctgatgattatgaagtcatgtttctgcaaggcggagcaagccttcagttttcaatgattccgatgaactttctctccaaagacaaaacggcccacttcattatgacaggcgcttggtctgaaaaagcgctggccgaagcaaagctcttcggaaacacatcgatcatcgcgtccagcaaagaagatacgtacagctatattcctgaagtaccggagattccggcagacggggcctaccttcacctgacttccaacaatacgatctttggaacgcagtggcaaaagttccccgacgctccgattccggttgtcgcggacatgtccagcgatattttaagcagaaaaatcgatgtttcccaatttgacatcatctatgccggcgctcagaaaaacctcggaccgtcaggggtgaccgttgtcatcatgaaaaaagactggctcggcaaggaaaatgagcaagttgccaaaattctgaagtactcaacacatgccaaagcggattcgctctacaatacccctccgacatttgcgatttatatgctgtctctcgtgctggagtggctcaaggaaaaaggaggcctcgatgccattgagaaacgcaaccgcgaaaaggccgaaatttt

SEQ ID NO: 1068 - DNA, 1132 bp, Bacillus licheniformis
ttggatctgttatcgataaaggaccctgcatttttgaagaacctttcaaatgaagaactggaaagcttgagcgctgaaattcgccgttttttaattgaaacgctttctgaatccggagggcacattggtccgaatctcggcgttgtcgagcttaccattgcattgcataaagaatttgacagcccgaaagataagttcttgtgggatgtggggcatcaatcgtatgttcataaactgttgaccggccgcggaaaggacttcgccacgctgcgccagcataaagggctgtgcggttttccaaagcggaatgaaagcgaacatgatgtctgggaaacgggccacagctcgacttctctctccggtgcgatggggatggcggctgcgagagacttaaaaggcacaaacgaatatatcatcccgatcatcggagacggtgcactgaccggcggcatggctcttgaagcgcttaaccatatcggccatgaacaaaaagatatgattgtcattttgaatgacaacgaaatgagcatcgctccaaacgtcggagcgattcattccatgctcggaaggctgcgtacagccggaaaataccaatgggtcaaagatgagctcgagtatttgttcaagcggattcctgctgttggcggaaagcttgccgctacagccgaacggattaaagacagccttaaatatctgctcgtatccgggatgttctttgaagagcttggatttacgtatttagggcctgtagacggccattcctacgatgaactgtttgagaacttgcagtatgcgaagaaaacgaaaggcccggtactcctccatgttattacgaaaaaaggaaaaggctacaagcctgcggaaactgataaaaccggaacatggcacggaaccggcccatataaaatcgataccggtgactttgtcaaaccgaaagctgctgcaccatcatggagctcgctcgtaagcgaaacggtcaggaagcttgcccgcgaggatgaacggattgtggccattactccggccatgcctgtcggttcaaaacttgaagggtttgcgagcgaatttccggagcgcatgtttgatgtcggcattgcggaacagcatgcggcaacgatggcggcgggacttg

SEQ ID NO: 1069 - DNA, 1536 bp, Bacillus licheniformis
atggggatggcggctgcgagagacttaaaaggcacaaacgaatatatcatcccgatcatcggagacggtgcactgaccggcggcatggctcttgaagcgcttaaccatatcggccatgaacaaaaagatatgattgtcattttgaatgacaacgaaatgagcatcgctccaaacgtcggagcgattcattccatgctcggaaggctgcgtacagccggaaaataccaatgggtcaaagatgagctcgagtatttgttcaagcggattcctgctgttggcggaaagcttgccgctacagccgaacggattaaagacagccttaaatatctgctcgtatccgggatgttctttgaagagcttggatttacgtatttagggcctgtagacggccattcctacgatgaactgtttgagaacttgcagtatgcgaagaaaacgaaaggcccggtactcctccatgttattacgaaaaaaggaaaaggctacaagcctgcggaaactgataaaaccggaacatggcacggaaccggcccatataaaatcgataccggtgactttgtcaaaccgaaagctgctgcaccatcatggagctcgctcgtaagcgaaacggtcaggaagcttgcccgcgaggatgaacggattgtggccattactccggccatgcctgtcggttcaaaacttgaagggtttgcgagcgaatttccggagcgcatgtttgatgtcggcattgcggaacagcatgcggcaacgatggcggcgggacttgcgacacagaatatgaagccgtttctggcgatctattcgacatttcttcagcgcgcctatgaccaggttgtccatgatatctgccggcaaaatctaaatgtatttatcggcattgacagagcaggtctcgtcggcgccgacggggaaacacaccagggcgtgtttgacattgcttttttacggcatattccgaatttggttctcatgatgccaaaagacgaaaacgaaggccagcacatggtcaacacggctgtcaaatacgacgacggcccgattgccatgcgctttccgcgcggaaacggactcggcgtcaaaatggataaagaattaaaaacgatcccgatcggaacgtgggaagtgctgcgacctgggacagacgcggtcattttaacgttcggcaccaccattccgatggcgcttgctgccgcggaggagctgcaaaaagaaggccgttcggtcagagtggtaaacgcccgttttatcaagccgctcgatgaaaacatgctgaaggaaatcctgaacgaggggcttccgattttaacgatcgaagaggctgtgcttcaaggcggattcggcagctcgatccttgagtttgcccatgaacatcagtcttacagtccgatcattgacagaatggggatacctgatcaatttattgaacacggcagcgtcgccaagcttctggaagagatcggaatgacaaaaggagacgtcatcagacgaataagacttttgacgcccgtaaagactcataaaggaattggatcatga

SEQ ID NO: 1070 - DNA, 585 bp, Bacillus licheniformis
  misc_feature (1)...(585): n = A,T,C or G
gttctaggcgatctattcggacatattttcagtgtggcttatgatcaggcttgtccatgatatctgccggcagcatcatgatgtattgatcggcattaacagagcaggtctcgtctgccatgaggggtccgcacgccagcgcgtgttgcgcattgatttataacggcatattccggatctggttctcatcatgccaaagctgagacntagggccagcacagtgtttacacggttgtgcaacaccattccgatggcattgccatgcgcttaccgcgtgcaaaaggaatccgggtcggtatgaatgagagaattaccgttgatcccgatcggtacatggaaactggttgaacgtggtcatgacgcggtcattttaacgtttggcgccaccattgcgagggcgttaagtgccacgcagcagctgcaacaataagtctgttcggtcacagtggtataccactgttttatctagccgattgatgataccagatcgaagtaaatcatgcgccagggtcttcaagtttttgcgatagaacagaatgtgattcaaggaggtcttgacagctatatcatttagttcgcccatga

SEQ ID NO: 1071 - DNA, 1132 bp, Bacillus licheniformis; identical to SEQ ID NO: 1068

SEQ ID NO: 1072 - DNA, 1194 bp, Bacillus licheniformis
atgatgatagaacgtcatgtcgtgtcagaagcgcttgcagatcagctgttaaaggaatatcaggccggtgcttcattctttttctcttcccctgagcggaccattctggcggaaggtgtttttgcttctgtttctcaaaccgaagagcaaagccttgctcagcggactgcggaagttctgaaaaaagccagggagaacgggcaggaaaatccgattgtagttggagctgtgccatttgacgatgcaaagccggtgcagttaaccgtgccggtcgaagcgtggcatgcggggccgctgacatgtgaagaagacgataaagaggtgcctgaacctgccctgcacccctatgatgtccagcagattccaagcccggaagcgtatatggccggagtcagacaaggattggcaggtatagcagcaggagaatacagcaagatcgtcctttcccggtcattgcagctgacctcgccgatcaaagtcgatatcggtcaattgctgcgaaatcttgcccgccgcaatacaagcgggtacaactttgccgttgatttaaccgggcagtcatctgaagcgcctcgcaccactttgataggcgcgagtcccgaactgcttgtatcacggtccgggttctgcgttacggcaaatcctttagcaggttcaagacctcggagcgatgatcccgaagaagatcgaagacgggcggctgaactgcttgcttcgcctaaagaccgtcacgaacatgcggtcgttgtcgaagcggttgcttccgcgctcaggccgttttgccggaagctggaggtgccggaaccgtcgctcatcagcacgccgacgatgtggcatctttcaacggaattgaagggagagcttacagacctctctgtatcatcattggagcttgccgccgcccttcatccgacgcccgctgtctgcggcacgccgacgaatgcggcgaaagaagcgattaaacagattgagccgtttgaccgcgggtttttcacaggtatggtcggctggtgcgacgcggacggtgacggagaatgggttgtaacgattcgctgtgccgaggcggaggaacacgcgcttcgactgtacgcaggtgccggaattgtcgccgggtcgaagcctgaagacgaacttgccgaaacgtctgcaaagtttcggacaatgcttcttgcgatgggaatgaacagtgagtaa

SEQ ID NO: 1073 - DNA, 1040 bp, Bacillus licheniformis
  misc_feature (1)...(1040): n = A,T,C or G
aagatcgcaagcagcattggaacggctaccaggaaggcgctttttttattcccgccgctatgctgacacaggacggagaggaaacattcataacggtcaatagatggaagactcctgaagaagacgtgcgcaaagtacttgaagaaataaagggcgctgcttcacagctgaccaaggcggacgattcccgttatccggaaaaaggtcatacgcaatataccgcccaggaagaacttgatgttcctgaatggcttgaancggtccggcgggcgacagacgacatttaaaacgggaagtacgataaagtcgtgctcgccagaaagatccttttaacgttcgatcagcctgtcgaacttcacagagtattattcaatctgatgtctgaacaaaaaacgagctatatattcgccattgaagaaaacggcaaaagttttgtgggcgcgtctccggaacgtcttgtcaaaaaagacggagagaacgttctgtcgacctgcctcgccggttcaatcaagagaggcgaaagtgagcaggaagaccggatgctcggtcttgagctgttaaacgatgaaaaaaatctaatcgaacatgacattgtcgtcaatatgattcatcaggcgcttttgtcaaattgcagcaatatcaaaaagccggccaagccgggactttacaaaacaaaaaatgtgcagcatttgtatacgccgattgtcggcaaaatgaatgcggagtcctcgatttttgatttaatcgagaagcttcacccaactcctgcgctcggaggagcaccacagcaaaaagcgattgaggttatcagggagttggaaccgatgtcaaggggctggtatgcggcaccggcgggctggatcgacatgtccggcaatggggaattcgcggtggcgatcaggtcgggacttatcgattcaaatgcggccagaattttcgccggctgcggggttgtggctgattccgatcctcttatggaatacgaagaaacacaaattaagatgaagccgatgctgtctgctcttggaggcgatatccgt

SEQ ID NO: 1074 - DNA, 2467 bp, Bacillus licheniformis
atgaaagaagacaggagagtttatttttttggagtaaaaatgaatgagtattcattcaaaggtgggggaggatctttcatggtcaagcatattcgaaaagccgccgttatcggttccggtgttatgggttccggcatcgcggctcacttagccaatatcgggattcctgtattactgctcgatatggtgccgcatgaattaacagatgaggaaaggaaaaaaggccgcacccttgaagacccggatgtgcgcaatcggctggcacggacagccgtacaaaagctgctaaagcaaaaaccggctccgctgacttcaaagaagaatatcagccgtatcagcacagggaacatggaagacgattttgaaaagattaaagatgccgactggattattgaagttgttgtcgaaaacctggagatcaaaaagcaagtgttttcaaaggtcgatcaatacagaaaacaaggaagcatcgtcagcagcaacacatcaggcatctccgtcaggcagatggctgagggaaggtccgctgattttaaaaagcactttttaggaacgcacttcttcaatccggcccgctatttaaagctccttgaggtgattccgattgacgaaacggagcccgaagtgctgtcctttatgaagaaattcggcgaagacgttcttggcaaaggggttgttgaagcgaaagacacgccaaactttatcgccaaccgcatcggaacctacggcttgcttgtgacggttcaggaaatgctgaaaggcggctacacgataggcgaagtcgattcgattacaggtccgctgatcggacgcccgaaaagcgcgaccttcagaacgctcgatgtcgtcggccttgatacattttcacacgttgccaaaaatgtctataaccaagtcacgggcgaagaaaaaaacgttttccggctccctgaatttattgaacaaatgctcgaaaaaggctggatcgggagcaaagcgaaacaaggtttttacaaaaaagaaggaaaagacatccttgagctcgatccgatgacgatgacctacagcgcgcgtcaaacattaaaaacatcgggactggaagcggccaagcaaatgaaaggcgcaggagcgagattgaaagcgcttgtttattccgatgacagggcgggaagcctcctttggaagattacagctccgacgcttgtatattcggcggagctgacaggggaaatcgccgacagcataacggcggttgatcaggcgatgaaatggggattcggctggtcggaagggccgtttgaaatgtgggacagcatcggtgtgaaaagctcggtgcaaaagcttgaagcagagggctggaaggtcgcggactgggtgaaggaaatgctcgcaaaaggacatgaaaccttctaccttaaggaaaacggaaagacgttctactactgttttgaaagcggcgaatacagggcgcttcaagaaaacaagaaaacgatccatttgtcgtcactcaaagaaacaaaaggcgtcatcaagaaaaacagcggggcaagtttgatcgatttaggcgatgatgtcgcactgctcgaatttcactcgaaaagcaacgcaatcggcctggacatcattcaaatgctgaaatttgctctcgaggaagtagacgccaactataaagggcttgtgatcggcaaccagggcaaaaatttctgcgtcggagccaatctcgcgatgatgctgatggaagctcaagacgacaactatatggaaattgacatgatcatccgtcagttccaagagacgatgatgaaagtgaaatacagttccaagccggtcgtcgctgctccgttcggcatgacgcttggcggggggactgagctatgcctgcctgctgcccgtgttcaagcctcaagcgaatcatacatgggcctcgttgaaacaggcgtcggtctgattccgggcggcggaggcaataaagagctttatttaaattacttgaaagggctgcctgaaggcgttaaaccggatatccaggaggccgccatcaagacgtttgagacaattgcccttgcaaaaacgtcgacttcggctcaagaagcgaaagaactgaacatcttaaccgcagaggatcaaatcagcatcaatcaggatcacttgttatacgatgccaaaaaactcgtcctgacactttccgaaagcggctaccgtccgccggtgaaagagaaagttccggtgacgggcgaaaccggctatgcggcgctcctgctcggtgctgaatcgttaaaactttccggcgccatctctgaacacgacatgaagattgcgaaaaaactggcgtttgtcatcgcgggcggccgagttccattcggcgccgaagtaacggaagaatacttgctcaatttggaaagagaagcgtttctgagccttgtgagcgaaccgaaatcgcaggcgagaatgcagcatatgcttgtgaaaggcaaacctttgcgtaatt

SEQ ID NO: 1075 - DNA, 1578 bp, Bacillus licheniformis
aagcggaagccggattatacgggagaataaaacgaacggagggacagccgatgccggccgaaaaggaattgtatgaacgcatccgccggattcaggagggcggcgcggagaaataccatgaagctaataagaaaaaagggaaattatttgtcagagaccgattaaagctgctgcttgacgaaggactcgacctagaggacgcgttttttgccaattgcatggctgacgggctaccggcagatggagtcgtcactggaatcggaaaaatcggcgggcgaaccgtttgcgtcatggccaatgattcaactgtcaaagcaggatcatggggagcgagaaccgttgaaaaaatcatccgcatccaggaaacagccgaaaaactgaattgcccgcttctttatttggtcgattcggcaggcgcaaggattacggatcaagttgacatgtttccggggcgaagaggagcggggcggattttttatcagcaagtcaaattatccgggcgcatcccgcaaatctgtctcttgttcgggccttcagcggcaggaggcgcctacataccggctttttgcgacatcgtcattatggtcgaaggtaacgcctcgatgtatttaggctcgccgcgcatggcggaaatggtgatcggcgaaaaagtatcgcttgaagaaatgggcggcgcgagaatgcactgttctgtttcaggctgcggagacattcttgccgacacggaagaagatgcgatcaagtcggcgcgccggtatctttcctactttccgtcgaactacaccgaaaaagcgcctgtcattgaagcaaaatccgcccgtccgtttgaccggtcattggaggacatcattccgaaaaaccaaaacgctccgtttcagatgatggatttaatcgatcggatcattgatgaagcgtctttttatgagatcaaaaaattgttcgcgccagagctgattaccggtttggcaaggattcacgggcagcctgtcggcatcattgccaatcagccgcgggtcaaaggcggtgttttgttccacgattcggcagacaaggccgcaaagtttatcaatttgtgtgatgcctatcatatcccgctgctgtttctggctgacatccccggttttatgatcggaacgaaagtcgagagggcgggtatcatcagacacggtgcgaaaatgatttcagcgatggccgaagcaaccgtaccgaaaatatccgtcatcgtcaggaaagcttatggtgcaggcttgtatgcgatggccggtccggcctttgaacctgactgctgtctggcgctgccgacggcgcaaattgccgtcatgggcccggaagcagcggtaaatgccgtttacgctaaaaaaatcgcagaattgcctgaagaagaacggtccgcattcatcgccgaaaaacggaaagagtaccaaaaagacatagacatttaccggcttgcttcagaaatgattgtcgacgggatcattccggccgactcgctgcgaacggaactcatcaaacggctgaatgcatatatgaccaaatacatgacatttacggaacggaagcatcctgtttatcccgtct

SEQ ID NO: 1076 - DNA, 1791 bp, Bacillus licheniformis
tcaacatgagctgggccgacggaggcttcattggggttgatatcttttttgttttatcaggatatttgattacatcgattatcctgccggcgtatggaaatgacatttccctcacattccgcgatttttgggtgcgccggatacggcggctgcttccagcggcgacgctcatgattttcgcaaccgtcatatgggtcgctttgtttaacagagagctgatgcataccgtacggggagatgcgatctcctctcttttgtatgtcagcaattggtggtttatctttcacgacctgtcatattttgatagtttcggatcgccgtctcctttaaaaaacttgtggtcactggcgattgaagaacagttttattttatctggccgatcattttgctgttgggcatctacatatttaaaaagcgggagaggtttgcagcggcggttgtgctgtgtgcgctttgttcagccatatggatgagcatcctgtacgtcccgggcggcgatccgagccgtgtatattacgggacggatacacgcgctttcgagctgttgatcggatgcgcattagcccttgtgtggccgatgaaaaggctgtctgggaacaggctccccaacagcctcaagcatgcattgcacggaactgagcttgccgctttcgcgctgcttatgatgtgcatttattttgtcgatgaattcagcccgtttctctatcacggcggaatgcttataatcagcataatcgcagctattttgattgcatgcgtcagtcatccgagcagcttcctgggctttgccctttccgtgaagccgctgcgctggatcgggaaaaggtcgtacggcatttatctttggcactatcccgttatcgtgctgagcacgcctgttcaggagattggaaatccggtgtactggcatgttgcgatgaaggtcgccgttacatttattctggcggaactttcgtatcgctttattgagaagccgatccgaaaagacggttttaaaccgtttgtcagccgggtttttctggataagatcacggaatggaaaacggcttccgttccaagcaaaatatcaatcggcctgatgtttgccgcgctcctcgtttttgcagggggtctgtcgggattggccgacgaaaagaaacagccgcagcaggcctattcaaaatcttatgaggaaacaagcgcctcagcggatcagccggctgacaaaagtgaagaacggcaggacgataagaaagcacaaactgagagcggaaatgagagtaaaaccggaaacggggaggaatcgtcagatacgaaagatgagcagtctgcggaaaaagagccggatcgcatcgaaaaagaagtattggctgtcggggattcggtcatgctggacatcgcttcaagcctgcgccggaagattccgggaatcacaatcgacggacaggttggaaggcaagtgagggaagcgcttcaattgacatcaacctacgcctcctttaatcatccggacaaagccgtcgtcattgaattgggaacaaacggctattttacggacggccaattggacgctttgcttgatgctttctcaaaagcggatgtctatctcgtgaatacgcgcgtcccccgacaatgggagagcaaggtgaatgaatcgcttcggaagcatgcggacagccgtcaaaatgtgacattggtcgattggcacgctgaagcactgcaacatcccgaatatttcaccgccgacggcgtccacctgatgccgaaaggtgctgaagccttggcatcgcttatcgtcaaagcgatgaaat

SEQ ID NO: 1077 - DNA, 1575 bp, Bacillus licheniformis
tgagaagagaagatttgattgcgccggagaagtataatgcggttgatgaaattgaaaaatttaaatcttcccgcgataagaccgcattgatctgggaagatgaatcagggcgtcaagtgtcatggtcctatgaaaaattgattgaaaaggcttacaaaatcggcagcatattgacccgttctggactgaaaaaaggtgacaagcttatcgtgatgatgccgcggataccggaaacgtatgccgtgtacatggccattttaaaagctggaatggtggtcatcccatgttccgaaatgcttcgggcgaaagacttggattacaggatcaagcatgcaggcgtcaaaggagccgtcgtatattcagcatttcttgatgcttttctagatgttcgttcaaaagaggcactgtcgttatttgccgtcggagaaagcagcgaagggtggatcaatctgctcgaaaaaatgaatcaggccattgcagcggattttcaagcggcggatacctctcgcgatgacatcgcatttttatcttacacatccggcacgaccggtcagccaaaaggggttgtacatacacacggctgggcttatgctcacttaagaacgacagcttccgcatggcttgacatttcggaaggggatctcgtctgggcgacagcagggccgggctggcaaaaatgggtatggagcccgtttttagcagtgctcggtagcggtgcaaccggctttatctatcatggaaaattcacgccggaaacgtatttgcggctgattgagcgccatcaagtcaatgtgctgtgctgtacgccgacagagtaccggttcatggcgaaagtcaatgatttgtcccgatttgacctgtcttctctgcacagcgctgtttcggccggagagccgttgaacagggaagtcatcgatacatttaaaaagcattttcatattgctgtgcgggacggatacggacaaacggagagcacgctgttggtggggattttaaaaggtatgaaaatcaagcctggaagcatgggaaaaccgacgcctggaaacttggttgatattattgacgggaatggaaagagctgtcccccgggcgaaacaggcgatattgccgttcacttaagcacgccggctctttttaaagaatattacaaagatcaagaacgaacgctccgacaaagaagaggggattactttataacaggggataaggcgcgaaaggatgaagacggctatttttggtttgaaagccgcaatgacgatgtgatcatcagctcaggatatacaatcggcccgtttgaagttgaagatgcgctgatcaagcatcctgaggtcaaagaatgtgctgttgtggcaagccctgatgaaatcaggggatcgatcgtgaaagcatacgttgtcttaaaggacccatcccgcggaaatgaacacctgacaaaggaattacaagaccatgtaaaagccatgacggccccttataaatacccccgggagatagaattcatcgaagaactgccgaaaacgccttcggcgaaaatcaagcgctttgaactaagacaacgggaaatcgcacttaaaa

SEQ ID NO: 1078 - DNA, 1446 bp, Bacillus licheniformis
tcagtatcacatcgatatttctcggttttatattagttttaaatacgcttttggcaatcgttgtgatctttagggaacgccgggatgcaagctcctcctgggcctggctcttggtgctcttctttattcccgttctcggctttatcctttatttgctcttcggccacaatttgagcaggaatcacctttttcaatgggaagaccgaaagaagatcgggattgaaaaaatattggaacagcagctgaccaagctgaaaaaccgcgagtttgaatttcgcaataaagcgacggcggacagcaaagacttgatttatatgcacattttgaataaccacgccgtttttacagaagacaatgcggtcgagctgttaacggacggacgccagaaattcgacaggctgcttcgcgatattgaaaacgccaaagaccatattcatcttcaatattatatttataaaggcgatgagatcggcaaaaagctccgggatgcgctcatcaaaaaagcaaaagaaggcgttgaagtccgcgttttgtatgatgaattaggatcaagaagcctcaggaaaagctttttcaaagagctgaaaaaagcgggaggatttgtcgaagtctttttcccgtcgcgctttaaatttatcaatttgcgcatgaattaccgcaaccaccgcaagctcgtcattatcgacggcgtcatcggctatgtcggaggatttaatgtcggagacgaatatctcggtctgaacccggcctttggctattggcgggacacgcacctcagaatcaaaggaacagcggtccactcgattcaaacgcgttttatcctggattggaatcaggcctcgcaccatcacgacattacatatatgccaaaccattttcctgacatcgactcccacggaaacatcggcatgcaaatcgtcaccagcggccccgattcagaatgggagcagattaaaaacggctatattaaaatgatatcaacggcaaagcggtccattcttattcagacgccttattttataccggacgcaagcctgctcgatgccctcaggatcgcttgtctgtccggcgttgacgtcaggatcatgattcctaacaaacccgaccatccgtttgtgtactgggcaacctattcttacatcggcgaacttttaaaagcaggcgcctccgtatttatttacgacaacggttttatccatgcgaaaacgattgtagtagatgaggaaatttcatcggtcggcacggcaaatattgatatgcgcagcttcaagctcaattttgaagtgaatgcatttttatatgatgaggaaattgcgagaagccttgtcctatcatttgaaaaagatctgcaagtgtcaagggagctgacctttgaggaatatttaaacagaagcaaatcgatccgcttcaaagaagccatttcgatcctgctgtcgccgattttat

SEQ ID NO: 1079 - DNA, 1512 bp, Bacillus licheniformis
ctatactagaagacgtgaaagctttcaggcaaaagacgctcgcagagcttcaaaacagacaaagatctgatggttcgtggcggttttgttttgaagggcccgtgatgacggacagttttttcattctgatgctgacatcactcggcgatcaggactcttctctcatcgcaagtcttgctgaacgaatccgttcaaggcagagcgaagacggcgcgtttcgcaatcacccggatgaaagagcaggcaatctgaccgcgacagtccagggctataccggaatgctggcttcggggctctatgaccggaaagctccgcatatgcagaaagccgaagcttttattaaggacgcaggcggattgaagggcgtccactttatgacgaagtggatgctcgccgccaacggtctgtatccatggccgagagcctatattccgctctcgtttttgctgatcccgtcctatttcccgctgcatttttaccatttcagcacatacgcaagaattcattttgtccccatggccattacgtttaatcggcgattctctttaaaaaacaaccaaatcggctcgcttcggcacctggatgaagccatgtcaaaaaaccctctcgaatggctgaacatccgcgcctttgacgaaagaaccttctattctttcaatctgcaatggaaacagctctttcaatggccggcttacgtccatcagctcggatttgaggccggcaaaaaatatatgctggacagaatcgaagaagacggaacgctatacagctatgcgagcgcgaccatgttcatgatttacagcctgcttgcgatgggaatatctaaaaacgcccccgttgtcaaaaaagcagtcagcggaatcaaaagtcttatttcatcatgcggaaaggaaggggcccatttggaaaactcaacttccaccgtctgggatacggccctcatcagctatgccatgcaggaatccggagtgcctgaacaacattcttccacctcatcggcagccgactaccttctcaaaagacagcatgtgaaaaaagcggactgggctgtctcaaatcctcaagcggtccctggcgggtggggtttttcacacatcaatacaaacaatcccgatttggacgataccgctgcggcattaaaagctattccgtttcaacggcgtccggatgcatggaaccgggggctcgcctggcttttatccatgcaaaacaaggacggagggtttgcggcatttgaaaaagatgttgaccatccgcttattcgaaatctgccgctcgaatctgccgctgaggcagcagtcgatccgtcaacggcagacttgaccggacgcgttcttcatctgctcgggcttaaagggcggttcacagataaccatcctgcggtccggcgcgccctcaggtggcttgatcatcatcagaaagcggacggctcttggtatggcagatggggcgtctgctttatttacggtacatgggccgcactcaccggtatgaaagctgtcggggtttccg

SEQ ID NO: 1080 - DNA, 1176 bp, Bacillus licheniformis
atgaaagaggcagttattgtatcgggggcgagaaccccgatcggaaaagcaaaaaaaggctcattgaggactgtccgtcccgatgatttaggcgcatatgcggtgagagagacgctgaaaagagcgggcggttatgaagggaatatcgatgatttgatcatcggctgcgctacgccggaagccgaacaaggcttgaatatggcgcgcaatatcggcgcgcttgccggtctgccgcacacagttccggccgttacgatcaacagatattgttcatcaggacttcaatcaatcgcttacggggccgaaaaaatcatgcttggagctgctgacacgatcattgcaggcggcgccgaatcgatgagcatcgtgccgatgatgggtcatatcgtcagaccgaacgcggctctggcggaaacggctcctgaatattatatgggaatgggccatacggctgaacaggttgccgtcaaatacggcgtttccagggaggaccaagatgcatttgccgtcaacagccatcaaaaagcagccaaggcgatcgcggaaggaaagttcgaagatgaaatcgtcccggtggacgtcaccgtcagagaagtggatgaacatcataacctgaaggagcggacgtttactttctctgccgatgaaggtgtacgcccggggacaaccaaagacgttctgtcaacgttgaaaccggcgttttcggcaaacggctcggttacggcagggaattcctcgcagacgagcgacggggctgccgcagtgatgatcatggacagagaaaaagcggacgcactcgggttaaagcccctcgcaaaatttcgttcgttcgcagtcggcggcgttccgccggaagtgatgggcatcggccctgtggaagcagtcccaagggcgctgaagatggcgggacttgagctgtcggatatcggtttattcgaattaaatgaggcgtttgcatcgcaagcgatccaggtcatcaggtcgcttggcattgatgaagaaaaagtcaatgtcaacggcggagcgattgcgctcggacatccgctcggctgcacgggtacaaagctgacgctgacattgatccacgaaatgcgccggagaagcgagcaattcggcattgtgacgatgtgtatcggcggaggcatgggagcagcaggggtattcgaattagtttaa

SEQ ID NO: 1081 - DNA, 1330 bp, Bacillus licheniformis
ttgtttaagaaagtactgattgccaaccggggagaaatcgccctccggatcatccgaacttgtcaacggctcggtattcagacggctgctgtctactctgaagcggatgcggagtccctgcatgtcaaagctgcggatgaagcctggctgatcggcaaaccgcgggtcagtgaaagctatttaaatattgaaaaaatcatcgaaaccgctaaaaaagcgggggtctgtgccattcatccgggatacggcctgctttccgagaacagccgttttgccgaaaggtgcctcaaggagaatattacgtttatcggtccgccgcctgacgttatcgccaaaatgggaagcaaaattgaagcaagacaagcgatggaacaagccggggttcccgtcgttcccggcgtgacaaaaagcttgtccggtctgaatgaagcccgggctcttgccgaatccatcggctatcccgtgatgctcaaggcttcttttgggggcggcggcatcggaatgcagctgatccgcaatgaaagcgaattagaaaaagcatatgaaggcaaccaaaaacgagccgccgattttttcggagacggggctatgtacatcgagaaatatatcgaacaggcaagacatatcgagattcagattttaacagacaaatacgaaaatgccgtctatctttgggagcgggactgttcgattcagagacgccagcaaaaaatcatcgaagaagcacctgctccgttattcgatgaaaccatgcgcacaaagctcggtgaagcggccgtgaaagctgcgctgtcgatcggctatgtcaacgccgggacaatcgagtttttagtagacaaggagaatcatttttattttcttgagatgaatacccgcctgcaagtcgaacacccggtgacagaggaaattacagggcttgaccttgtcgaagaacagctcaatatcgcagcgggaaaaccgctttcccataagcagaaagacattcggcgggacggacatgcgatcgaagtcagaatctgtgccgaagatccgaaaacatttttcccttcgccggggcggattaccgaccttaagctgcctgagcaaccgaatgtccgtcatgaatgcgcagcagccccgggtatgactatcaccccgtattacgacccgatgattgccaagatgatcgtcaaaggaagcagcagagaagaagccatctgcacattggccgaagcgctttcacaatatcaagtgaaaggcattaaaacgaacattccgctccttgaagacattgtaagttctgacgaattccgaaaaggcggggtccaaaccgattttatcagtcgctatc

SEQ ID NO: 1082 - DNA, 1138 bp, Bacillus licheniformis
atgaattttgaactaaccagagaacagcaaatgattcgtgaactcgcaagagattttgcgaaacaggaaattgcaccgcacgccgaacatgttgacaggacgggagaatttccgattgagacatttaaaaaaatgggggagctcggcctcttggggattccgtttcctgaaagctacggcggttcaggcggagatacgatttcctatgcacttaacgtcgaagaaatcggcaaagcgtgcggaagcaccggtcttagctatgctgcggctgtatcgctcggggctgcgccgatttattatttcggcactgaagaacaaaaacaagaatatctcgtcccgcttgcgacgggccgggcgctcggagcatttgggctgaccgaaccgaatgcaggttccgatgcgggcggcacccggacaaaagcccgctcggaaggggacagctatgtgatcagcggtgagaaatgctggatcacaaatgcaggatttgccaggaccgtcatcgtcaccgccgtcaccggaatagatgacaacggaaaaaacatcatttccgccatcatcgttccgacagattcggagggcttcaccattaaaagcgaatatgacaaaatgggtgtccgcggctccaatacatcacagctcatattggacaatgtccgcgtaccaaaacaaaatctattgggaagcccggaaaaagggtttaaacaatttctcaatacacttgacggcggcagaatttcgatcgcagcgctggctgtcggtattgcccaaggcgcatttgaggcggcgctcacatacgcgcgcgaacgaaaacaattcggccgaccgatctcttatttccaggcgattcagttcaagcttgccgacatggccatggaaattgagctcgcccgcaatatggtgctgaaggccgcctggctgaaagatcaaggacgtccgtttacaaaagaagcggcttttgccaagctttatgcctcagaaatggcgttcaggacatgcaatcagtccattcaaatacacggaggatacgggtatatgaaagagtatggagtggagcgcatgctgcgggacgcaaaattaatggaaatcggtgaaggcacttcagaaattcaacggctcgtcatcgcaaggcagctcggca

SEQ ID NO: 1083 - DNA, 1115 bp, Bacillus licheniformis
ttgaagaacatatgtctattgggagcgacaggctccataggagaacagacgcttgatgtcatcaaagcgcatgacgataagtttcggctgaccgccatgactttcggcaaaaacgccgaaaaagcggcagaaatcattgaaacctttaaaccgaagtatgtaggcgtcggggatgagcatacatatgaaacattaaaacagcattctttctcctacacctttaaaacagggatcggggaggaagctttaatcgaagcggccgttatcccggaagcggatatcgtcgtcaatgctctcgtcggcagcgtcggtcttcttccgactttaaaggcgatggagcataaaaaaacaattgcgcttgcaaataaggaaactctcgtgacagccggtcatatagtgaaagaacacgcccaaaaatacgatgtcccgctcctgcccgtcgacagcgaacattccgcgattttccaggcccttcagggggaaaatccgaagcatatcaaacggctgatcgtcacggcttcaggcggcagcttcagggacagaacaaggcgggaacttgaaggcgtcacagtggaagaagccctcaatcatccaaattggtcgatgggtgcaaaaatcacgatcgattcggctacaatgatgaataaaggactcgaggttattgaagcccactggctgtttgatctgccctatgaccagatcgatgtcctccttcacaaagaaagcattattcattcaatggttgaattccacgaccgcagcgtcatcgcccagcttggcacacctgatatgagagtgccgattcaatatgcgctcagccatccggaacgcctgccgtttaatgaagcaaaatccctcgatctctgggaagtcggacagctgaattttgcccaagctgattttgaaaggttccgctgcttacaattcgcttatgaatcaggtaaaataggcggtacaatgccgactgttttaaacgcggccaacgaggaagccgttgcggcatttctttcgggcaggatttcctttcttggaatagaagacatcattgaaaaggctttggaacgccatcaggtgatcgcaaagccgagccttcaagagatccgtgaagtggacaa

SEQ ID NO: 1084 - DNA, 1305 bp, Bacillus licheniformis
aacttagtggaaaaaaccgcccttttatctttttcaaagcctttaccgtcaccggcggagcgctcggagaaatgcacgccaaaaaaatagcggccgtcatggatcttgccctcaaaaataaggcgccgttcatcggtctgaacgactcaggtggtgcgagaattcaagagggtgtgctatcattagatggatacggtcatattttttaccgaaatgtcctttgctcaggcatcattccgcaaatctctgtcattctcggcccttgtgcgggcggcgcggtttattcccccgctttgaccgacttcgttttcatgagcgaaaaaaccggacagatgtttattaccggtccgaaagtcatcaaaacggcgacaggcgaggctgtcagctccggtgaattggggggcgcctatatacataattcaatcagcgggaatgcccatttttccggggattccgatgaggccgtcctccatgaggtgcgcaagctcttgtcctacatcctccagaatcacgaagaaaagcctcccgccaaggcgagaaaggcgaaagatcatgagataaggcctgctttaatgacgatcctgcctgaagacggtcagcgtccgtatgacgtcaaacagatcatcgcggaaatcgcagacggcggaacattttttgaagtgcagtgccattttgccaaaaacgcggtgatcggttttgcaaggatagcgggggaaacggcggcggtcgtggccaaccagccgaagtatttagccggaagcctcagcatggatgcggctgacaaaatcgcccggtttatccgtttttgcgattcctttcagatcccgattttgactttggttgattgtcccggttttcttccgggaatacgcgaagagcacggcggggtgatcaggcacggcgccaaaatcctttacgcgtatgcggaagccactgtcagcaaggtgacggtcattttaagaaaagcatacggcggagcatatgtcgctttaaacagcaaggcgcttggagcggatgccgtgtttgcgtggccgaatgcagaaattgcagtgatgggcgcctcggaagctgcagacgtgctgtttgcgaaggaaatcgaacggtcagacgacccgcgggccgcccgggaggaaaaaatccggaagtgcatgcaggcttcaagcccttttaccgctgcaagatacggcatggttgacgatatcatcgatccgaaagagacgcggaagaagctgatccaaacgtttgacatgctgaagagcaaaaaagaaatccggctggacaaaaagcatggaaatataccgcttt

SEQ ID NO: 1085 - DNA, 971 bp, Bacillus licheniformis
gtggctggagaattagaatttgaaaaaccggtggtcgaactgcgtgaaaagatctccgaattgaaaaagttcacacaggattccgatatggatttgagctctgaaattacgaagcttgaagctcgtcttgaaaggcttgaagaagacatttatacaaatctgaaagcctgggacagagtccagattgcaaggcacccgaaccgtccgacaacgctcgattatatcgaacatctctttaccgatttttttgaatgccacggagatcgttatttcggtgatgatgaagcaattgtcggcggaattgccaagttccggggtcttcctgtgacagtaatcggtcagcagcgcggcaaggatacaaaagaaaacatccgccgcaatttcggaatgccgcatcctgaaggctaccgcaaagcgctcaggctgatgaagcaggccgacaaatttaacaggccgatcatctgctttattgatacaaaaggagcatacccgggcaaagcagctgaagagcgggggcaaagcgaagcgattgccaagaatctttttgaaatggcgggactctccgtgccggtcatctcgatcgtcatcggggaaggcggcagcgggggagcgcttgcgctcggcgtcgcaaaccgcttattgatgctggaaaactcaacttattcggtgatctctcccgagggagctgctgctatcctctggaaggattcaggactcgcgaaaaaagcggcagaaacaatgaaaatcaccgctccggaccttaaagaattggatattatagatcatgttataaaagaagtaagaggcggagcacaccgcgatgtggagcagcaggctgcctacatcgacgaagcgctgaaaggcgagcttaaatccctgctgaaactggataagaacgagctgatccaacaaagatataacaagtataagtcaattggaaaaatttcgactgaaaaccaatatgttgggat

SEQ ID NO: 1086 - DNA, 960 bp, Bacillus licheniformis
atgggcaagattgcttttctattcccgggccaaggttcgcagcatatcggcatgggacacgaattgtatgaaaaagaaccgaatgcgaagaagatttttgaagaagcggatcaaacgcttgaaacaaaactgagcaccctcatgtttgaaggggatgcaaaggaactgacgcttacatacaacgcgcagccaagccttttaacggcgagcatcgcagcgcttgaaaaactgaaggaatacggcattaaagccgactatgcggcaggtcacagcctcggcgaatacagcgcattggtcgctgccggcgccttgtcgtttaaagatgcggtttatgccgtcagaaagcgcggcgaattcatgaatgaagccgtgccggcgggagaaggcgcgatggcggccattctcggcatggacagccaggcgctgaaagaagtgacggacaaaatttccgaagaaggaaaccttgttcagctcgccaatttgaactgccctgggcaaatcgtcatctcgggaacagctaaaggcgtggagctcgcttcagagcttgcgaaagaaaagggcgcaaaacgcgcgattcctctcgaagtcagcgggccgttccattctgagctgatgaagccggcagctgataagcttcgtgaagttcttgatgcgtgcacgatcaacgacgcagccattccggtcgtctccaacgtaacggccgactttgtaacggataaagacgacattaagaataaactgattgaacagctgtattcccctgtacgctttgaagaaacaatcagccgcctgattgacgaaggcgtcacgaccttcattgaaatcggtcccggaaaggttttgtcagggcttgtgaagaaagtgaaccgcagagtcaaaacgattgctgtatcagacccgaacacaattgaacttgccgttcaaacgttgaaggaggaaaacgaaaatgctggaaaataa

SEQ ID NO: 1087 - DNA, 1086 bp, Bacillus licheniformis
ctgatacggccggcaggacggcactcatctgggaaagtgaagacggaaaaacagaacagatcacctattcttctttacaccaacaagtcgcccgtgcggcggcaggctttaaaaagcaaggcatctcaaaaggggatgtcattgcgatttacatgccgatgatccccgaaacggtcatcgccatgctggccgccgctaaaatcggagcggtattctcaccggttttttcaggctacggcgcccatgcagcagcggcgagacttaccgctgccggagcgaaaatccttgtcacagcagatgcctttttgcgaaggggaaagaaggtctgcatgaagaaagaagctgacaaagccgcggaccgttcccccactgttcaaaaagtcgtcgtctgcaagcttcacggcggcgatcaagattggaattataagagagatatcgactggaatgaattgatgaaaaacgagcccatgcaaaacaccgaagaaatggacagttcagatccgctcatgctgctatacacatcagggacgacaggacagtcgaagggagcggttcatacccatgccggttttccgctgaaagctgcatttgatgcgggattcgggatggatgtcaaacaaggggacacatttttctggtttacagacatgggctggatgatggggccgtttttaatattcgggggcctcataaacggagcggctgttttgctgtttgacggagcaccggactacccggccccggatcggctgtgggagcttgtcagcagacaccgggtgacgcatctcggcgtctctccgacgctcattcgctcgctgatgcagcacggcgaagattttctctatcaatacaatctgaacagtctgaaggcaatcggctcaacgggcgaaccatggaattatgagccgtggatgtggctgttccgccatgttggaaaagaacggattcctatatttaattattcaggaggaacagagatctcaggcggaattttaggcaatgtgctcctgcggccgatcacgccgatgacgtttaattcgcctcttcccggcatggcggccaatgtcttcaatgaaaaaggagagg

SEQ ID NO: 1088 - DNA, 866 bp, Bacillus licheniformis
ttgcgtattttagagaaggcgccggctaaaattaatttgtcgctcgacgttcgccacaaacgtccagatgggtatcatgaagtagagatggtcatgacgacgattgatttggcggatcgggtcgaattaacagagctggcagaagataaagtaacggtttcttcgcataaccgctttgttcccgacgatcagcgaaaccttgcttatcaggctgcaatgctcatgaaagaacgctacggcattaaaaaaggggtttccatttttattacgaaagtgattcccgttgctgcgggccttgcaggaggaagcagcgatgcggctgccgtcttcagaggattgaaccggctgtgggatttgaagctttcgatgaatgaactggctgagcttggcgctgagatcggatctgatgtctccttttgcgtacatggaggaacggctcttgcaacgggaaggggagagaaaatccgtcatatcgagactccgccgcactgctgggtagtgctggcaaagccgacgatcggcgtatcaactgcagaagtgtacaagcagctgaaagtcgacgagattgaacatccggatgttcaaggtatgattgctgcgattgaagagaagaattttcaaaaaatgtgtgacaagctcggcaatgtactcgaatctgttacattgaacatgcaccccgaagtcgcgatgatcaaaaatcaaatgaagcggttcggcgccgatgctgtgctgatgagcgggagcggccccactgtgttcggacttgttcaatacgaatcaaaagtgcaaagaatctataacggattaagagggttttgcgatcaggtttatgcggtgcggatgatcggagaacaaaatgaacttga

SEQ ID NO: 1089 - DNA, 910 bp, Bacillus licheniformis
atgaaaattgctgtagatgccatgggaggagacaatgctcccaaagcggttattgaaggcgtgatgaaagcggtcgaagattttgaagacctcgagatcacgctgatcggcgaccgggaaaaaatagccgcccatttaacagaacacgggcggatcaccgtcaaacacgcggaagaagtcatcgaagcgacagacgagccagtcagagccgtcagaagaaagaagaattcatcgatggttctgatggccggagaagtcgccgaaggcagggctgatgcctgcatttccgccggaaacaccggagcgcttatgacggccgggctctttatcgtcggccggattgaagggattgaaaggcctgcgttggcaccgacattgccgaccgtctccggagacggctttctccttcttgatgtcggagcgaatgtggacgccaagcccgaacatctcgttcaatacgccattatgggatctgtttacggagaacaggtgctgggcgtcaaaaatccgcgcatcggacttttgaacgtcggaaccgaagataaaaaaggaaatgagcttgccaagcagacctttcaaaaattgaaggaaaccgatttgaatttcatcggcaatgtggaagcccgcgatatgctggacggagtcgctgatgtcatcgtcacagacggctttaccggtaacgttgccttgaaaacggtcgagggcgcggcgctgtccatttttaaaatgctgagaacgacgctgacttcgagcttcacggcgaagctcgccgcttctgcactgaagccgaagctgaaagaaatgaaaacgaaaatggattactctgaatacggcggagccggattgttcggcttaaaggcgcccgtcatcaaagcgcacgggtcatctgacggacgcgcaattttgcact

SEQ ID NO: 1090 - DNA, 983 bp, Bacillus licheniformis
atgatctttaagctgagcgaagagcaccaaatgatacagaagatggtgcgcgactttgcccatcacgaggtggagccgactgcgaaagagcgggatgaggaagagcggtttgacatggaactgtttgcaaaaatggcggaattggggctcacgggtataccgtggccagaggaatacgggggaatcggcagcgactatctcgcctacgtcatcgcggttgaagagctttcgaaagtctgcgcctcaacgggtgtcaccttgtctgcccatacatcgcttgcgggctggccgatttatgcatttggaacagaagaacagaaacaggaatatttaaagccgatggcccgcggcgaaaagataggagcctacggattgacggagcccggttcaggctccgatgccggcggcatgaaaacgaccgcagaaaaaaaaggcgatgaatatattttgaacgggacgaagatctttatcacaaacggcggaatcgcggacttctacatcgtgtttgccaaccttgccccggaacagaaacacaaaggcacaaccgcctttatcgttgaaaaggacttccccggcttttctgtcggaaaaaaagagaggaaactgggcatccgttcatcaccgacaaccgaaatcatctttcaggactgccgcgtgcctttaaaaaaccgccttggcggggaaggtgaaggctttaaaatcgcgatgaagacgctcgatggaggcagaaacggaattgccgctcaagccgtcgggattgcccagggcgcatttgaggcggcgaaaggcgtatgcgaaagagcggaagcaattcggcaggccgatcgccgagcaacagggcatcgtttttaaattgggtaatatggcgacgaagattgaagcttcaagggtttttaacctaacaggcggcatgggctgaaatcagaaggactgctttatggaaaggcttctgccatgtcaaagctttacgcaggggatacggc

SEQ ID NO: 1091 - DNA, 996 bp, Bacillus licheniformis
gatcagttattgcaggcggcgcacgcacgccttttggaaaactcgggggcgcgcttcagtcaaagacggctgcggagctcggcggaatcgccgtaaaagaggcattaaaacgttccggtgtaaatcctgaggatgtcgatgaagtcatcatgggctccgtacttcaaggcggacaggggcagctgccgtcgaggcaggccgcgcgttttgcgggactcccgtgggacgtcaaaacggaaacgattaataaagtgtgcgcttcaggtttaagaagcgtcacaatggcggatcagatcatcagggccggtgatgcggaggtcattgccgccggaggtatggaatcgatgtcaaacgccccttatttgcttcaaaaagcgaggtgggggctgaggatgggagacggggcggttaaagatttgatgatcgcagacgggctgacatgctcatttacgggcgttcacatgggctcctacggaaatgccgctgcgaaagagttggagattgctagggaagagcaggatcggtgggcgctcaggagccacatgcgagccgtacacgctgcggattcaggcgcgctaggagaagagatcgtcccggtcagcatccaagagaagcgggacggcgaattaacggtcgatcaagatgaagcaccgcggcgcgacacgtcaatggaaaggctgtcaaagcttgccccggtttttgaccataatgggacaattacggcgggaaacgcgccgggggtaaatgatggggcatgctcacttatcgtgatgaatgaagacaaggcaaaggaactcaatgtgaaggcgccggccgtcattaaagcgcacacatcaattgcagtcgaagcaaaagactttccgaaaacccccgggcttgtcatcagagaactgcttaacaaaacgggagctgagctttctgatatcaaactgtttgaaatcaatgaagctttcgctgcggttgctttggcaagcggaaagatcgcgggtcttgaca

SEQ ID NO: 1092 - DNA, 1977 bp, Bacillus licheniformis
atgaaacgaaaaggaggaaacggcatgggcgaaaaagcggtttggcagcctgatccggaatttgtaaaaacaacccggctgtttcaatggatgacagccctcggtttttccgactatgatgattttttgaaagcaagtacaaacgatatcgcctggttctgggaagaggccgaaaaagcgctcgggatcagctggtacaagcggtacagccaaacattgaatctcgacaaaggcataaaatggccgcaatggtttaccggcggccgcttaaatgccgtttacaacgccgtggaaaaatgggcccgccggcctgatacggccggcaggacggcactcatctgggaaagtgaagacggaaaaacagaacagatcacctattcttctttacaccaacaagtcgcccgtgcggcggcaggctttaaaaagcaaggcatctcaaaaggggatgtcattgcgatttacatgccgatgatccccgaaacggtcatcgccatgctggccgccgctaaaatcggagcggtattctcaccggttttttcaggctacggcgcccatgcagcagcggcgagacttaccgctgccggagcgaaaatccttgtcacagcagatgcctttttgcgaaggggaaagaaggtctgcatgaagaaagaagctgacaaagccgcggaccgttcccccactgttcaaaaagtcgtcgtctgcaagcttcacggcggcgatcaagattggaattataagagagatatcgactggaatgaattgatgaaaaacgagcccatgcaaaacaccgaagaaatggacagttcagatccgctcatgctgctatacacatcagggacgacaggacagtcgaagggagcggttcatacccatgccggttttccgctgaaagctgcatttgatgcgggattcgggatggatgtcaaacaaggggacacatttttctggtttacagacatgggctggatgatggggccgtttttaatattcgggggcctcataaacggagcggctgttttgctgtttgacggagcaccggactacccggccccggatcggctgtgggagcttgtcagcagacaccgggtgacgcatctcggcgtctctccgacgctcattcgctcgctgatgcagcacggcgaagattttctctatcaatacaatctgaacagtctgaaggcaatcggctcaacgggcgaaccatggaattatgagccgtggatgtggctgttccgccatgttggaaaagaacggattcctatatttaattattcaggaggaacagagatctcaggcggaattttaggcaatgtgctcctgcggccgatcacgccgatgacgtttaattcgcctcttcccggcatggcggccaatgtcttcaatgaaaaaggagaggaagtcgtcaatgaagtcggagagcttgtcctgacaaagccctgggtcggcatgacgaacggtttttggaaggagccgtcaagatacgaagaagcatattggagccgctggaccgacgtctgggtgcacggcgattgggcaaaacgggatgaaaacggctactggacgatcagcggacgctctgatgatgtgatcaatgctgccgggaaaaggatcggccccgccgaaatagagtccgttctggtcggccatccagcggtggcggaagcaggcgtcatcggcgttccggataagctcaaaggccaggctgccgtctgcttcgtcgtcctcagacagtcggaaaagccgtcggaagaattaaaagatgatttgctgaaccttgcatctgatgcgatcggtaaagcggtcaagcccaaagcggtttattttgtcagcggtttgccgaagacgagaaatgcaaaagtgatgagacggctgatcagagctgcctatatgaacgagcccgcaggcgatttgtcaactttggaaaaccgcgaaacatatgatgaaattgccggtctttcagtgcgaaaaaatctgtag

SEQ ID NO: 1093 - DNA, 933 bp, Bacillus licheniformis
tgaaggataaagcgaaatccggcgtatgcgtacgattgctgatcgaccggatcggcgcgatgaaggtgaagaaaaaaacgctctccggcctgaaacaaagcggtgtgcacgtttttttcgccaacaagccgggcttcccctatttcttttaccggctgaatgcgaggaatcatcgaaaaatcgccgtcatagacggaaagatcggctatgtgggcggatttaacatcgcgaaagaataccttggtaaaaaagcggaattcggaccgtggaaggattaccatttgcgaatgacgggagaaggcgttgccgacttgcagcacatttttatatcggacttcaaaagagaagcgccgcaggcaaagccggccaacagcgtatttccgccgctgcagcaaggagctgtcacccatacaacccatgcgacaaagggattttctctagaggaaaaatacatttcatttatcgaacaggcaaaagaaagaatcatgatttgcacgccgtactatattccgagcccggctttgcagcaggctgttctctcagccagggaaaggggcgtgatcgtgtcggttctcgtgccgatgaaacccgatcatccgcttgtcaaagaggccgcctacacgcactttccagcccttttaaaagcgggctgctatatttaccggtactacagaggcttttatcatgcaaaagcattaatcgtcgatgaccggcatgtgatgatcggaacatcgaattttgacaacaggagcctgtttctcaatgatgaagtgaatgtcgtcatccatgataaagactggacaaagcaattcttcgacgtcgtcaaggaaagcattgaacacgccgagcttctgacaaaggagcggtatgcgaagcggccggtgatgcagcggcccgtcgaatggctggcgaaatcgatttcattctttttat

SEQ ID NO: 1094 - DNA, 636 bp, Bacillus licheniformis
atgacaaaaaccctttacattaccgctcacccgcatgacgaaagggcatcctacagcatggcggcaggaaaagcgtttatcgaatcttacaaagaagctcatccggatgacgaagtcatacaccttgatctttatcgggaaaacattccgcagattgatgcggatgttttcagcggctggggaaaattgcagtcggggtcgggctttgaacagctttctgaacacgaaaaagctaaagtcggccgtttgaatgagctgagcgagcaatttatcgcgggagacaaatacgtgtttgtcacgccgctttggaatttctcttttccgccggtgatgaaagcgtacttcgatgcggtcgctgtagcgggaaagacgtttaaatataccgaacagggaccgatcgggctgttaaccgataaaaaagcgctgcacatccaggcgagaggcggctactattcagaagggcaggctgcggaacttgagatggggcaccgctatatcagcatcatgatgcagtttttcggggttccggaatttgaaggtttatttatagaagggcataatgctgagcctgataaagctgaagaaataaaacaaaatgcgattgtccgagccaaagaattgggcaggactttttga

SEQ ID NO: 1095 - DNA, 729 bp, Bacillus licheniformis
caatatttgtgaaaacggaaaggcagcaggaatggctcgataaaatcggaaaattggcggatgaatttgagaaaacagcagcgtactatgacgaacatgcacaatttcccgcagaacatattcaaaagctgcgggattcaggctacacagcgctgacggtcggaaaagattacggaggagaaggcatttcgctctacgatatgcttttgtttcaggaacggcttgccaaaggagacggaccgacggctctcagcatcggctggcacttaagcgtgatgggggaactggcggagggaaacagctgggaccgggatgtgttttcatcgctttcccatgaagcattaaagggcgcgctgatcaacagagcggcaagtgaagcgcagacaggcagcccgacaagaggaggacgccccggaacccatgcagtcaaaaagaacggcggctggattgtaaacggccgtaaaacattcacaacgatgtctccggttctcgactattttcttgtcaccgcttggattgaagagaagcaaatgatcggcgttttcttgatccataaagatgcggaaggcttggcaatagaagaaacgtgggatatggcggcgatgaggggcacgggaagccacgatttggtgctgaccgatgtccgtctggacgaatccatgcttgttgaactgttggctggtaaaagaaccgataaaatcaacggctggctgcttcatataccggctt

SEQ ID NO: 1096 - DNA, 837 bp, Bacillus licheniformis
tcatggtcatcggagccggccagatggggtccgggatcgctcaggtctctgcccaggccggatacaatgtttacatgtatgacgtatcacctgaacaaattgaaaaaggaatgaagcgcatttccggccagcttttcagacaggcggaaaaaggcaagctgccgcatgaagatgtgaagcaaatctaccagcgcctttctccgtcggctgcgctcgacgaagcgcgggaagcttttctcatcattgaagcggctgttgaacaaatggacgtaaaaaaagacattttcacgcggcttgatgaagtgaccgaagactcagcgatattggcatcaaatacatcgtccctgtcgattacggaacttgctgccgtcacaaaaaaacctcaaaacgtcatcggcatgcattttatgaacccggttcccgtcatgcagcttgtcgaagtcatcagggggcttgagacgagcggcgaaacatatgaaaccgtcgtggctgcggcggagcggatgaacaaggttccgatagaggtgcgggatttcccgggatttatctccaaccgcatcttaatgccgatgattaatgaggcggtttttgcactttatgaaggcatcgccgagaaagaaagcatagacggaatcatgaagcttggcatgaaccatccgatgggcccgttggctctcgccgatctgatcggtctggatacgtgtctgtatattatggagacgctgcatgaaggctttggcgacgataagtacaggccttgtccgctccttaaacaatatgtcagcgcaggacgactcggaaagaaaacgggccagaggttttatacgtatgaaaagc

SEQ ID NO: 1097 - DNA, 794 bp, Bacillus licheniformis
atggtgcagatgaaacagagaatattgacgggtgtgatcgcggcagcggtttttctgccgctcgtgattttcggcgagctgccgttcaccctgctagtttatgcaataggtatacttgctctatttgaacttttaagaatgaaaggcctgaagctgatcagcgctccgggtatcatcagcatgctgctgttggcggttttgctgtgtccaagccaatacgcggaagacgctgggctgggtataaccaaaggggaggtcgtctttttggcggtccttttgcttttggcatatacggtgctcagcaaaaactcgtttacttttgacgaagcggcattcgtggcgctggcagcagtttatatcggattcgggttttattactttattgaaatcagaaacatcggactcagctatgtcttttttgcgatcggcgtcgtctggtcaacagattccggcgcttattttatcggaaaggcgtttggaaagcggaagctctggcctgaaatcagccctaacaaaacggtagaaggcttttggggcggaattttgacagcggtcgttttttccgcgatttatcaggccgccacaggttttccgcacgcttatctgtttgtgctgatcattaccgtgcttttgtcaatcgtcggtcagatcggcgatttggccgagtctgcgttcaaaaggcattaccaggtgaaagactcgggccggatcctcccgggacacggcggaatgctggaccgctttgacagctttttatttgtcatgccggttctgtacttcctgcttgttctttt

SEQ ID NO: 1098 - DNA, 636 bp, Bacillus licheniformis
acctggacaaacgaggtacaggcgatatgtggttgctgaccgttgaagaatataaggaagcctcaactaagacaaaaataatgtaccgtttatacagaaatccgtttgttatgtttatgattgggccgatttacgtgttcgggattaccaatcgttttaatcgtaaaggggcaaaacgcaaagaacggatgaatacgtatgtaacgaacttgggaatcgccgctttgacagcacttttatgctgggctattggctggcaaaacttcctgctggttcaggcgccaatttttatgatatcgggatctctcggaatttggatgttttatattcagcatacgtttgaggattcttattttgaagaagatgagcattgggaatatgtaaaagcagcagttgaaggaagctctttttataagcttccaaaagtcatgcaatggctaacaggcaatatcggtttccatcatgttcatcatttaagcccgagagtcccaaactataagcttgaagaagtgcataacaacattgaaccattgcaaaacgttccaaccattacactggcaacaagtcttaagtcgttaaagttccgactatgggatgaagaaagcaaaaaatttgttggttttagccacttaaaaa

SEQ ID NO: 1099 - DNA, 738 bp, Bacillus licheniformis
cgctgctcccaacatggaatttactcataagaaaatttttaaagggagaaattcctgaacatatcgccattattatggacggaaacggccgctgagctaagaagccggcgttgcccccatcgcgggtcatcacgaaggcatgaaagtggtcagacagacgacaatgcttgccaatgagctcggtgtcaaagcgttgacgctgtatgccttttcgacggaaaattggaagcgtccaaagcttgaggttgactttctgatgaagctgcctgaagagtttctgggaacgtatctcccggagctggtcgaagaaaatgtccgggtccgcatgacaggcgatagggaaggactgccgccccacacgatccgcgcggttgaaaaagccatccgtgatacggagaacaatgacggacttattcttaattttgcattgaattacgggggacgtgcagaaatcgtcagagccgcaaagaaaattgccgaagaagccaaaaaaggcacattgaataccgaggaaatcgacgaaaagctattttccgattatttaatgacagaaactttgcaggaccctgatttgctgattcgcacaagcggcgagatcaggctgagcaacttcatgctttggcagcttgcctacagcgaatttttatttaccgatgtattgtggcctgattttaaagacgttcacttgcttcaggctatcggagaatatcagcgtcgcgggagaaggtttggcggaat

SEQ ID NO: 1100 - DNA, 672 bp, Bacillus licheniformis
caaacgtattgctgttgaagatgccattgccgatttgaaagacgaagcgaccgtcatgtttggcggatttgggggagtcggttcaccgccttctttcatccgggcgattttgaaaaaaggcgtaaaaaatttaacggtcatatgcaatgatgcaggatttcccggcatcgggatcggcccattaatcgtcaataaccgcgtaaggcggctgatcgcttctcatatcggttcaaatcccgttgcgggaaaacaaatgaccgacggttttctcgccgttgaattttctccgcaaggtacgctggccgaacgaattcgtgcgggcggcacaggtcttggcggcattttgaccgatatcgggatcgataatgacatggtgcgccaaggaaagaatatcgtttcattaaacggacgcgcataccttgccgaggaagccttgagtgcggaatacgctttcatttatggaaaaaccgccgatgaattcggcaatatcatctacgacaaaacggctcgcaacatgaacccgcttatggcgatggctgctgatcggacatttgccgaggtcgagcggatcgttcccattggagagctcgatgaagaagaaattgtaacacccggtgtttttgtcgaaggtgtagctgaaacggaaggggtgaactggaaatgggtttggga

SEQ ID NO: 1101 - DNA, 1716 bp, Bacillus licheniformis
atggggaaagcaaaacttcgatggaatgaacccttgatttctcaacacgaatcggctgctgaaggatttacaccggaagatttcacagaggaagatcgactgatttcaaaaacgacagaatcatttgtcaaaaacgaagtcatgccccttcttgaatcgattgatcagcaggatcacgaaagcgtgaaaaaattgtttcaaaaagcaggagagctcggtttgctcagtatcgaagttccggaggattgcggcggcctttcactcagcaagaagctttccgggttggtggcagagaaaatgggagccggcggatcgttcagcgtctcctttaatattcatgcgggagtcgggacactgccgtatatttattatggaacagaggaacaaaaacaaaaataccttccaaaactggcatcgggcgaatggatcggagcatatgctctgacagagccgggcgcaggatcggatgctttaaacgcaaaaacgacagccgtcttgaatagggaagggacagcctggattttaaatggggaaaagcagtggattacgaacgcgcaagtagctgatgtatatgttgtctttgcaaaaacggcggaaggcatgacagcatttatcgtcgaacgctcgtttaaaggtgtttccatcggacctgaagagaagaagatgggaatcaaagggtcttcgacagcaaccttaatcttggaggaagtcgaggtgccaagcgacaatgttctaggtcatatcgggaaaggtcatcacgtcgctttgaacattttaaacatggcccgcttaaagctcgcgttttcgaacattggaacggcaaaacaagcattgaaccttgctgttagctacgccaaacagcgaaagcaatttaacaagccgatcatcggtttttcaatgattcaagaaaagattgccgacatggcggtctcgattttcggcgcggaaagcgctgcttacagaacggcagattgcttggacaatgttttagattcggctctcccattagacgatagactgagaaaactcacaaactatgcatccgaatgtgcgatcaataaagtttactgctccgaaatcctcggccggatcgcagacgaagcggtgcagattcatggcggctacggatacatgcaggagtacgaagtcgaacgattgtaccgggacgctaggatcactccgattttcgaagggacaaatgaaataaaccgcttaacgatcgccaaactgctcatgaaagaagtgcagcaaaacggcatctcagagccggaagctcaactaggcagcgagggaaatcgaaaccggcgatttattcagctgtccaacaggcttttcggcaagacactgaaagcgcttatccgctctcgcgtgaacactcaagaagatcaggaatacgcacggcttctcgccgacatgaaaaaagaaatctatgtgatggaatccgccgcccgccgaaccgaaaaagctaggcaaatatacggtggtgaaaaagcacggttgaaagaaatgatgacgaatgtcatttgtgaagaaggctaccgcagaatcgaagagatggcggtgaccgccttatcaagcatagcatctgatgaagccgaaagaaaactcgcatttgaagaggctcgcagcgtttctttgcctcttttcagcaatctgtttactcaaaaacgcgaaatcgcagaaaaaatagccgctcatgaaaaatatacggtgtga

SEQ ID NO: 1102 - DNA, 615 bp, Bacillus licheniformis
  misc_feature (1)...(615): n = A,T,C or G
tgaaaaaaggcggcgcctttctgatcgaagaggtaacggctgatcagatgttcacaccggaagatttcacagatgaacataaaatgatcgccaaaacgactgaggattatattctcggagatgtgctaccgtacatcgacgaaattgaagagcacaatttcgatcattctgtcaggcttctgaaaaaagccggcgaactcgggcttctcggagctgacgttcctgaggagtatggcggactcggacttgataaaatcagctcggcgttaatcaccgaaaaattttcaagagcggggagcttttcgttatcgtacggggcgcacgtagggatcggcacgcttccgatcgtatttttcggaaccgaggagcaaaagaaaaagtatctgccgtcccttgcaacgggggaaaagtttgcagcctatgctttaacagagccgggctccgggtctgatgcattangggcaaaaacaacgggcggnttgaatgaggcggcaacccactatatatgagacggcgaacagccatggattacagactcaggctttgctgatatttggatcggctatgcgaggctcgacggggatcatttctggggcttttttgcggtccgtgact

SEQ ID NO: 1103 - DNA, 692 bp, Bacillus licheniformis
atgaattatgaagtcgtcattcctgccgccggacaaggtaaacgaatgaatgccgggaaaaacaaactgtttatcgaggcgaaaggaatacctgtgattattcatacattaaaggtgtttgaaaaccatgatgcctgcaaaaggatcattcttgtcatcaatgaacaggaattcggtgaattcaacacccttttaaaaacctatcattttaagactccgatcgagatggtgccgggcggaagagaacgccagcaaagcgtttttgcgggcattaaagcggccggcaaagaggaaacggtcctcgtccatgacggagcaagaccttttattaaacgggaatatatcgaacagcttgtcgagaaagcaaaggaaacaggggcagccatcgttgccgttcctgttaaagacacgatcaaacgcgttcaagacggtgagatagccggaacgattgaacgttcaagcttgtgggccgctcaaaccccacaagcttttcgtctttctattctgatgaatgctcaccttgaggctgaagcaaaaggtttcctcggtacggacgacgccagtcttgtcgaggaagccggaggtacggttgcaatcattcaaggggattatcaaaacatcaaactgacgaccccggatgacttgcttgtcgcagaagcgatattagaagcggaaaagaggaatgaacatgt

SEQ ID NO: 1104 - DNA, 491 bp, Bacillus licheniformis
atgactgaacaaaccattgcccataaacaaaaacagttgacaaaacaggttgctgcgtttgcacagcctgataccaagaacagtctgcttcagcttttgaatacgtttattcctttcttcggactgtggtttcttgcctatttcagcctcaatgtctcctatctccttactttaggaataacggtgattgccgcagggtttttgacgagaattttcattatttttcacgactgctgccatttatcctttttcaaacaaaaacgccttaaccatattctcggttttttgacaggcgttctgactttatttccttatcttcaatggcagcacagccattcgattcatcatgcgacaagcagcaacctggataaacggggaacgggtgacatctggctgctgacggtaaatgaatataaagccgcacctctgcgcacaaaaatcgcatacagactttacagaaatccgtttatcatgtttattctcggaccgat

SEQ ID NO: 1105 - DNA, 662 bp, Bacillus licheniformis
atgagtatattaagcaggttcaaagacattatggccagcaatattaacgctttgctggataaagcggagaacacggaaaaaatggtggatcagtatgtcaggaacttaaacagcgacttaaacaaagtaaaggcggaaacggcgtccgtcatggcggccgagcaaagggcaaaaagagaactggcggattgccgggcggaaatcgacaagcttgagcgctatgcaatgaaggctttggaagccggcagcgaggcggatgcccgaacatttttagaaaagaaagcggtgcttgaaacgaaggcatccgagttagaaactgcgtttcaaacggcgtcatccaatgcgaatcaaatgaaaaaaatgcacgataagctcgtttccgatatcggggagcttgaagcacgccgcgccgcgatcaaagcgaaatggacagcggcgaaaacacaggaaagaatgaataaactcggtgcatctgcagcgaatgccaaccattcaatgtccgctttcggcagaatggaagaaaaggcaaaccgggcgcttgatgaagcgaatgcgatggctgaattgaacgccgctcctcaagatgacatagaagacctgaaggctaaatatgacagcccttctaatgtggatgatgcgcttgccgcattgaaagcgaaaat

SEQ ID NO: 1106 - DNA, 546 bp, Bacillus licheniformis
cgggtgtgtacattgaaaaatacattgaagatttcagacacgtcgaaatccaagtgcttgcagacacacacggaaacacgattcatttgggggaacgcgactgctcaatccaaagaaggctccaaaagctgcttgaagaaaccccttcacctgctctggatgaaggaatcagggagcagatggggcaggccgctgtcaaagcggctgaagccgtgaagtacacgggagcgggaacggtagaatttattttcgattaccgcgagcagaagttctactttatggaaatgaacacgcgcattcaggttgagcatccggtgacagagatggtgacgggcgttgatttgattaaagagcagatcagagtggcgtcaggcgaaaaattaaccctcacccaggatgaagtcacctttaacggatgggcaatcgaatgccggattaatgcggaaaaccctgagaaaaacttcatgccttctccgggaaaaatcgagatgtatctgcctccgggagggctcggcgtcagagtggactccgcggcttatccgggat

SEQ ID NO: 1107 - DNA, 657 bp, Bacillus licheniformis
tgtgtacgcacccgaagaggcggacggggatctgcctgttatggtgtggattcatgggggcgctttttatcgcggcgccggaagtgaaccgctctatgacgggactcagcttgcaaagcagggaaaggtgatcgtggtcaccatcaattatcgcctcggtccgttcggttttttgcatctatcctcaattgatgattcctacagcagcaatcttggcctgctggatcaaatcgcggctctcgagtgggtgaaagacaatatcgctttctttggcggagaccgtcatcacattacggtttttggagagtcggcgggatcgatgagcatcgcttcgcttttggcgatgccgaaagcaaaggggctttttcaacaggccattatggaaagcggggcttccgcaactatgtccgataagcttgcgaaagctgcagcagaaagattcttaaggattctcgatattgatcatcatcatctggagcgccttcatgatgtatctgatcaagaacttcttgaagccgccgatcagctgcgcactttaatgggagaaaatatttttgaattgatttttctgcctgcgcttgacgaaaaaaccttgccgctgaagccggaggtcgccgtcgcaaaaggcgcggcaaaagagatcaatctattaatcgg

SEQ ID NO: 1108 - DNA, 555 bp, Bacillus licheniformis
agtcctataatagggcgacgtcagaggcgaaagcggcctttggcaatgatgaagtttatgtcgaaaagctgattgaaaagccgaagcacattgaagttcaagtcatcggagataaagaagggaacgtggttcacctttacgaccgcgactgctctgtgcaaaggcgtcatcaaaaggtcatcgaagtggcgccgagcgtttagctttctgaatccctccgggaaaagatttgcgatgctgccgttaagcttgcgaagaatgttgaatatgtcaatgccggtacagtcgaatttttagttgcgaacgatgagtttttctttattgaagtgaacccgcgtgttcaggtggagcataccattacggaaatggtaacgggcgtcgatatcgttcagacgcaaatcctgatcgctgccggtctcagtctggacagcagcgaaatcagcattccgaaccaggatgcgatcacgctgcacggatatgcgatccagtcaagggttacgactgaagatccgtcaaacaatttcatgcctgacacaggcaaaatcatggcatatc

SEQ ID NO: 1109 - DNA, 548 bp, Bacillus licheniformis
atgaaaaaaacggtcggatttatcggactcggtgtaatgggaaacagcatggcctcgcacattttagccgcgggctatcccgtcagcgcctatacgagaacgaaacacaaagcggacagcctcgtggaaaaaggggcggaatggaaatcatccgtcaaagcactggcgcagtcgtctgatgtgatcatcacaatggtcggctacccaaaagacgttgaagaggtttactttggaagcgaaggcattattgaaaatgccaaaaaaggttcctaccttatcgatatgacgacttccaaaccttcgcttgccaaacaaatcgagactgccgcaaaagagaaaggactttacgctttggatgctccggtttcaggcggggacgtcggcgcgaggaacggcacgctcgctatcatggtcggaggagaacggaaagcttatgatgaatgctacccgctcttttcgatcatgggtgaaaacatccagtatcaggggccggccggaagcggccagcatacgaaaatgtgcaaccagattgcgattgccgcagggat

SEQ ID NO: 1110 - DNA, 512 bp, Bacillus licheniformis
atgaagaagtatacgatgaatgaaatggtgcacttaacgaaaaatatgctgaatgagcgcggggttgcgattgaggatatcgcgctgatcgtacaaaagctgcaggaaaaataccatcctgatctcccgcttgatgtatgcattgaaaatgtcgaaaaggtcttaaataagagggaaatcgttcatgccgttttaacggggatagcgcttgaccagctggccgagaaaaagctgttgcctgaaccgcttcaatatttggtcgaaacggacgaacccctttacgggatcgacgagattatccctctatctatcgtaaacgtctacggttcgatcggcttgacgaacttcggctatctggataaagaaaaattcggcatcattaaagaactggacgactgtccggacgatgaggttcatacgttccttgatgatatcgtcgcagctttggcggcagcggcggcaagccgaattgcccattcgcatcaggatcttgaggatgaagtgcaggaaga

SEQ ID NO: 1111 - DNA, 609 bp, Bacillus licheniformis
tcccggggtgatgctgaatcaatacgtacgcgacatggaaagcgatatcgccaaggcgaagcataccatcgtcaagcagcagacaattgaacatagttttaaaggaaaagtggaagaagctgaaaagcttgctgtcaagcgaagaaaccaggctcagctcgcttttgatgcgggtgaagaagagcttgttaaaaaggcgctctcagaaatgaagtattttgaagaaaaagctgctgaatacaaggacgctcaccagcacgcgaaaaagcagcttgctgaattaaaggaacagctggagacacttgaggttaaactgcgcgatatcaaagaccgaaagcatgcgctgatcgccagggcaaacgcggtgaaagcgaaagaacatatgaatgcatcatttaataaaatcgacagcgaaagcgcctaccgggaatttatgagaatggaaaaccggattgaagagatggaaacaagggtgaacagctatgctgaattatcagcttcatcaagcagcccattcggccgccttgaatatgcaaaagaagtggaagaagagctggaaaaaatgagggctaaaaagacaggcttggaaaagcagacacctgcgggaaa

SEQ ID NO: 1112 - DNA, 828 bp, Bacillus licheniformis
ttctggggcggttctatctgtacacacgtcaattgtcaccattcccatcttttaaccggtaatgagcggcaaaaagagcattacgttaaaaagctggcagcagggcagtacttgggagctttttgtttaaccgaacccgagtgccggttccgatgcgggcagtctaaaaaccagggccgaaaagcgcggcgatacctatgtgctgaacggaacgaaagtttttattacaaacggcggagccgcggacatttatcttgttttcgcttcaaccgatccggaggcgggaacgggaggcatttccgcttttatcgtggagaagggcacgccgggctttttcatcggaaaaaatgaagagaaaatggggctccacggttcgctaacggtcactttaaattttgataacgctgtcattcccgcccggcagctgctgggggaggaaggaatgggattcaaaatggccctgtccaacctggataccggccggatcggaattgcggcgcaggctctgggtatcgccgagggagcgctttctgaagccgttcaatttctaaaaaaacggtatccggacggagagctgtataagaacggccaagcgcttgcctttaagctggccgacatggcggcgaggacagaggcggccaggcttctcgtctaccaggccgcctcgttgaaacagcaaggcatgcagacggggaaagctgcttcaatggccaaattgttcgcttcggaaacggcgatgtatgtcgccggagaggccgtgcagctgctcggagatttcggatacacaaaggatttcagcgctgaacgatatttcagggatgcgaaagt

SEQ ID NO: 1113 - DNA, 483 bp, Bacillus licheniformis
ggttaagcagcagcaaagcggcattgccggtctcattttatcatccccttgtctcgggctgcaattaaagccgaacaaatttctggacttgatttccaaggggctcaacgttttggcgccgtctatgcggtttgaatccgggatcacgcctgataaagcgacgagaaacaaagaagtcatcgaaatggacatcaacgattcattatatatcacaaaagtttctgtcagatggtatcaagaaatgttaaaagcgttgaaaagcgcgatggagccgacggacgcctttctcaacatcccgctctttgtcatgcaggcgggcaccgactggcttgtcgacaaaaaaatggtcgtcaagtggtttaaccagcttgcttcccacaataagacgtacagggaatgggatggcttgtaccacgaaattttcaatgagcctgaacgggaagacgtttttaaagcggccagagcgtttgcggagcagtatat

SEQ ID NO: 1114 - DNA, 504 bp, Bacillus licheniformis
atgatgccggaaaacaacagcatgcatcagatcgaaacagcagcaaaagaatggcttgagaaacggggcgtcaagatttcggaaattgccgatcttgtctacgtattgcagaagaaatatcatccaaacttaacaaaagaagaatgtgaagagaatgtcaaccgggtcatgaaaaaacgtgtaggtcaaaacgccgtgatcacagggattcaattggatatgctgggcgagcaaagaaagctcatggaaccgctccaaaccttaatcgagacagatgaaagcctgtacggcgtcgatgaaatcttatccttctccattgtgaacttgtatggatcgattggttatacaaattatggatatattgataaaatcaaaccgggagtgctcgcacgtttaaacgataaatcaacaggcgaatgccacacgttcttggatgatatcgtcggagcgattgcggcagccgcatccagcagactggcgcatcgagcaaaagatgcggaataa

SEQ ID NO: 1115 - DNA, 1044 bp, Bacillus licheniformis
tcaagatgtccgatgacgtgctgttttccgtcaatcaaaacggcgccgcagcgattgttctgaatcgcccgaaagcgctcaactcactcacatacgacatggtccgtctgattggtgaaaagttaaacgagtgggagacagatcaaaacgtttctatcgtggtcatcaaaggtgcaggaccaaaaggactatgtgccggaggggatattaaggcactctatgaagctcgttcgtcaaaacaggccctgcaagatgccgagcgcttttttgaaacagagtacgaagtcgatatggcagtccatcgattttcgaaaccgatcatcgcctgcttggacgggatcgtcatggggggaggcgtcggcctgacgtacggggccagccaccggatcgtcacggagaggacaaaatgggcgatgcccgaaatgaatatcggcttctttccggatgtcggggcagcctattttttaaacaaagccccgggccgcttagggcggtatcttggattaacggcgtctgtcatccatgcagccgacgtgctgtatatcaatggggcagacgcctacatggagagcggcgctttagaacgattgcttcaagcagtggaacaaaccgattggcgccttgcaagcgttgaagaaaagctcgatcagctgatccgcgaatcgaaaacggagccctcccaggagagcacgctcgcccgtgatcagcaagcgattgaccgtcattttaagtatgataagctggaagagatccttcaatcgctcgaaagcgagggaagcacctttagctcgaatgtgaaaaaaacaatgctttccaaatcgccattttcattaaaaatcacattgaaacagctggcggacggacgtcaaaaaacactggaagaatgctttgccacggatctggtgctggcaaagaactttttgaagcacaatgatttcttcgaaggcgtcaggtccgtcctgatcgaccgtgatcaatcaccgaactacaagtaccggaacgtttcagatgtaaccgatgaagcggtggaccggtttttccaac

SEQ ID NO: 1116 - DNA, 385 bp, Bacillus licheniformis
atgcttgatgctcagcaaattaaagaaatcattccccaccgctatccctttctgctggtagaccgtgtgacagaagtagaggaaggaaaacgggccgcgggttataaaaatgtgacagtaaatgaagagttttttaacggacactttccggattatccggtgatgcctggtgttttaattgttgaagcgcttgcgcaagtaggtgcggtggcgcttttgatgaaggaagaaaaccgcggaaggctcgcgttttttgcgggaattgacagctgccgcttcaaaaagcaggtgaaaccgggcgatcagctccatcttgagcttgaagtgcttcgtttccgcggttccatcggcaaaggaaaaggagtcgcaaaagtggacggagaag

SEQ ID NO: 1117 - DNA, 774 bp, Bacillus licheniformis
acagcttgaaaaagcggctttaccggtttttgattgagttgacgaataaaaagggcgtgtcccggatgctggaaaagtttgctcagtcaaagctaagcaaacctctcatcccctcctatatcaaaacctttcatattaatacagaagagatgctggaagatgtccgctcttttaacagcctgcacgagctgttcatcagaaaattaaagagcggtgcacgcccccttcccgctgatccaaacagcctggtcagccctgtggacggcgtcatcgaagaaatgggcaccatcacgcgcgacaagcaatttaccgtcaaacaaaaactctattctgtagaagaaatgatcggacgatccgagatcgtgaaccgctatgtcggcggaacctatatcattatctatttaagtccgagagactaccacagaattcacagcccggcttacggcacacttgaaacgcagtattcgctgggaagcacgtcttaccctgtgaataaaatcggtttgacatacgggaaatcgccgctgacaaaaaactaccggatgatttccgaatttaagcatcaatatgggtccgccctgcttgtgaaggtcggagcgatgtatattaactcgatcgtgatgctccaggagtcaaaagaatggcgccgaggcgacgaaatcgcatatttctctttcggctcaaccgttattctgctgtttgaaaaggatacctttattcctgatgaacgccttcacccctctcttcaagtcaaaatgggagaggtgttaggat

SEQ ID NO: 1118 - DNA, 548 bp, Bacillus licheniformis
  misc_feature (1)...(548): n = A,T,C or G
atggaatatatcaaatggaaagacgaagacgggatttttgaaattgtactgaatcgctctgaggcgtacaatgccttgaatgaaaaaatgcttgaagaactgaatgaagctttgcgtgttgcagaggaaagcgaatcgctgcttctccttgtgagaggcagcggcaaaggattttcggcaggcggagacattaagatgatgctgtcttccggagatcaagacagctccgcccgcgtcattgacacaatttctgaaattgcggtgaagctttacagcatgccgaagatgacgacagcggctgtccacggtgcggctgcgggtctgggattgagcctcgcgctcagctgcgaccatgtactggtcgaaaaagaggcgaagctggcgatgaattttatcggcatcgggcttgttcccgacggaggcggacacttctttttagagcggagaatcggtgaaactgcggccaaagaattgatttggagcgggaanaaattgacgggggccgaagcgcacgagcttcggatcgcagacgccgtattcagcgggga

SEQ ID NO: 1119 - DNA, 417 bp, Bacillus licheniformis
cggcggattacgcttttccaagcacggcatgccaggttcaggaacacttcggatggaacgaagtgggcgcggtcgatgtaaatgcgacctgcgcaggattagcgtacggattgcatatggccaacggcctcatcacttccggactgcatagaaaaattcttgtgatcagcggggaaaccttatcaaaaacaaccgactatacagaccgcacgtcttgcattttgttcggagacggcgcaggcgccctgcttgtcgaacgggacgacaaagacccaagctttattacttttgcccaggacacgaaaggtgacggagcccgccatttatacagaaccggcttgcgaagcgaccttaaaggagagccgctttcaggtgaagggaaaatggttcaaaacggccgcgaagtgtataagtggg

SEQ ID NO: 1120 - DNA, 1089 bp, Bacillus licheniformis
atggatgtcgtcaggcagacatttgtcgaatttccgtttgacggcgtgatgacactgtttgaaccggctttgcctttcacggcaaaagctgctgaagctttgaatctgccggggcttcctttcacaacaatggaaaactgccgcaataaaaataaaacccgcagcatacttcagcaaaacggattgaatacgccggtttttcacgagttccatacgctcgctgacctggaaaacaggaaactgtcgtatccattagtcgtcaagccggtcaacggcttctcaagccagggcgtcgtccgtgttgatgatcggaaggagcttgaggaggccgtccggaaagtcgaggccgtcaaccaaagggacctcaatcgattcgtgcacggcaaaacgggcatcgtagccgagcaatttatcgatgggccggaattcgcgattgaaacgctgtcgattcaaggaaacgtacatgttctttcgattggatacaaagggaacagcaaagggccgttttttgaagaaggggtctatattgctccggctcaattgaaagaagagacgcgccttgcgatcgtcaaggaagtgacgggcgccgtttcagcgctgggcattcaccaggggccggctcatacagagctgaggctggacaaggatggaacaccttatgttatcgaggtgggcgccagaatcggcggttcaggggtttcccattacatcgtcaaagagagcacaggcatcaactttatgcagcttgtcttgcaaaatgcattaaagccgctggagagcagcgagtttgaaggcgagatcaggcctgtaaggacagccggcaattatatcattcctgtacagggctccggcacttttgaaaaaatcgacggactggaagaagtcaaacagaggcaggaggttaagcgggtgtttcaatttatgagaagaggcgcaaagatcctcccgtacccgcacttttccggttatccggggtttatattaacaagccatcattcttatgaagaatgtgaagctttctaccgggagctggatgatgagcttcatatcatttatcaaaataatttgacgggtacaataggaggttaa

SEQ ID NO: 1121 - DNA, 747 bp, Bacillus licheniformis
aacatggcatcacaaccgtgacgttgaacaatccgccggcaaatacactttcttcttcctgtatcgccgaattgcgctctctttttcgggaattggcccgcgacgaggagacaaaagcaatcatcattactggagaaggccgcttttttgtggcgggagcggatataaaagaattcgtttcaaaacttggggaccaaaaacaaggattggcgctcgcacaagggggccaggcgctctgcgatgaaatcgaagcttccaaaaaacccgtcattgcggcgataaacggaccggctcttggcggaggcctggaactcgcgatgagctgccacttcagaatcgtatcagacgatgcaacagtcggtcttcccgaattaaagctcggcttgattcctgcatttggtggtacacagcggcttcgcaacataacggacacagcgacagcactcgaccttatcctgacgggccgatcgctttcagctcaagaggcggtagagctgaaaattgcacagatggctgtaaagggagaggaactgatgaagacggcagctgctgtcgcgtcgtcttttatcgaaggaaaaagcatgaccagcgtgaggcgcgccgtcgaatgtgtcgtacagggcgccagcgaaagcatggaacaagcactggagagggagcgaaacagattcgccgagctgtttgtcacttcagatgccaaagaaggaattcacgcatttgtcgaaaagcgcaaaccaaactttcatc

SEQ ID NO: 1122 - DNA, 633 bp, Bacillus licheniformis
catagagcgggagagaatcgcgaaacgggcggcccgcgaaatcaaaagcggaatgattgtcaatctgggcattggcattccgtctttagttcccaactttttagacccgggcacttccgtaatgatccaatctgaaaacgggcttctcggcatcggcggatcgcctgaaaaaggaaaggaagatgagaatctttgcaatgcggcaggctggcctgtcaccgtagtaaaaggcgcttcttattttgattcagctctgtcgttcggcatgatcagaaagggtgcgattgatgtcaccattcttggttctctgcaggtcagccagtcaggagatctggccaactggatcgtcccaggcaaaaaggttcctggaatgggaggggcgatggagcttgcccaaaaggcgaaaaaagtcattgtcgtgatgagccataccgataaaaacggtgcacccaaacttgtcgctgactgtactctgccgctgacagcaaaaggctgcgtcgacatggtaattacagaaaaagccgtgatcaccattgacagcggcggttttgtattacaagagctgatgaatgaagaggatcttgatgatgtgctgcggctgacggagggaaagatccggatcgacgggccgct

SEQ ID NO: 1123 - DNA, 777 bp, Bacillus licheniformis
aaatggcagcattatcatacgccgtagacggccatgttgcgacgattacgattcagcacccgccggcaaatgcgctatcgacgcaagtgcttgaagatctttcggcatgccttgatgaactttcagaacgtcaggatgtcagaagcgtcgttattcacggggaaggaagatttttctcggcaggcgctgatattaaagagtttacatcattgatggacgggtctgattatgcaaatttggctgataagggccagcagattttcgaaaaagtagaatcttttccaaaaccggtgatcgccgcgattcacggggccgctcttggaggcggtcttgagctagcgatggcatgccacatccggattgccgaggaaagcgcaaagctcggccttcccgaactgaatctcggaatcattcccggctttgcgggaacgcagcgccttcccaagtatgtgggcaccgccaaagcgcttgaaatgatcgggacatcagagccgatatccggcaaggaagcttttgaatacggtcttgtcacgattttggcggcgaatgaagaagaagtgctgcaaaaggcaaaagagctcgcacaaaaattcgctgaaaaaagtccgcagacgatggcttatgtcattgaactcctgaattcgagcaaagtgtattcgtatgaaggaggcctcaagctagaagggaaatacttcggcgaagtgttccaatccgaggatgcgaaggaagggattcaggcatttcttgaaaagcggaagccgcattttaaagggaaat

SEQ ID NO: 1124 - DNA, 465 bp, Bacillus licheniformis
tagaataggccaaggatttgacgtccatcaactagtggaaggcaggccgctcataatcgggggaattacgattccttacgaaaaaggccttctcggacattcagatgcagatgtgcttttgcacacgattgcggatgcatgtctcggtgccgtcggcgagggcgatatcggaaaacactttccggataccgatcctgaattcaaagatgccgactccttcaaactccttcgccacgtctggatgatcgtgaaggaaaaaggctatacgctagggaacctggattgtacaatcatcgcccaaaagcctaaaatggcgccgtatatcgaagacatgagagccagaattgccgaagggctagaggcggaaatttcccaaattaacgtaaaagcgaccacaaccgaaaagctcggatttacgggaagagccgaaggaatcgccgcccaggcttccgttctgctccaaaa

SEQ ID NO: 1125 - DNA, 621 bp, Bacillus licheniformis
ttaaaccgggatcaatgggcaagccgattcccggtgtagaggctgcaatcgtcgacaaccagggaaatgaactgcctccttacagaatgggaaatctcgccattaaaaaaggctggccgtcgatgatgcattcgatctggaacaatcctgaaaaatatagctcctattttatgccgggcgattggtatgtgtcaggagattccgcctacatggatgaagacgggtacttctggttccagggacggatcgacgatgtcatcatgacatcgggcgaacgcgtcggcccgtttgaagtcgagagcaagcttgttgagcatcaggccgtcgctgaagcaggcgtcatcggcaaaccggatcccgtccggggtgaaattattaaagcgttcatcgccttgagggacggttatgaaccgtcagatgcgttaaaagaagaaatcaggcagttcgtgaaacaaggcttggccgcacatgccgcgccaagggaaatcgaatttaaagataaactgccgaagacaagaagcggaaagatcatgagacgcgtcctgaaagcatgggagctgaaccttccggcaggcgatctctcatcgatggaagactgatgtctcattgacaatgcaaaaa

SEQ ID NO: 1126 - DNA, 474 bp, Bacillus licheniformis
  misc_feature (1)...(474): n = A,T,C or G
caacgagnatttagaagaatacatgggtaaagaggccgccgaagccgcctcctctctgtatccgaggtcattggaaggccatgttgatatgatgacagatctgatcttttggcatccgtctgttgtgttcgcttcggctcaatcacgatatgcatctgtctttatgtaccggtttgactggcatgcggattcagagcagccgccgttcaacaaagctgcgcacggcttagagattccgtttgtatttggaaatatggacattttggaacagctgacaggtacgaaggccggtgaagaagcgcagctgcttgctgaacagatccaggctgcctgggtgtcttttgcccgatccggaaatccgagcaccgatgatgtcagctggcctgattatgatgaagattcacggaaaacgctgatttttgatcaagaggtcgcagttgaaagcgatccttattcagataagagaaagatgtt

SEQ ID NO: 1127 - DNA, 331 bp, Bacillus licheniformis
atgtttaatttaccgaataaaatcacgctttctagaatcgcattaattcctgtttttatggtcatcatgcttgtgccgtttcagtggggggctgtctccttcggcagcgagtcgattccggtcacccatttgatcggcgcactgctgtttattttcgcttcggtcaccgattgggttgacggctattatgcaagaaagctgaaccttgtaacaaactttgggaaattccttgacccgcttgcagacaagctgctcgtgtcttccgctttgattattctggtgcattaccatcttgctccggcctggatggccattgtcattatcagccggg

SEQ ID NO: 1128 - DNA, 897 bp, Bacillus licheniformis
atgacgaatcatataaaagaaatcaactgggagcaaaacaccaactcttacattcagctcataccgaatattgagtacacaaaagtggaagacacttctttgacattacatttgctggtgtaccgcaatccaatggatgcgttatttaacaggaaaggcaatcaggaaacatacccgctgatcatttatttgcaagggtgcggatggggctggacaaaacaggatacatccgcctttatcccccaactggttccatttgtcgagcaaggatatgtcgtggcaagcgttcaatacagaggcagcggagaggcggtgtttccggctcagcttcatgatgtgaaaacagcagtccgctttttaaaagcaaatgccgcccgctataacatcgatcctgatagagtcggagtctggggggattcttcaggcggccatttggctcttttgcttggattgaccgaaggaattgaagaatttgaaggcccggacgaataccgtcatgtatcgagcaaagtcgatgcggttgcggactggttcggtccggtcgaccttctgtccatgagcaagtatccgtccatcttcgatcatgattcacccaattcaccggaatccaagctgatcggcggagctgttcaagaaaacagagtacaggcgaaacaagcgagtccgataagctatgttcacagggaagcgcctcccattctgattatgcacggggatcaggacgatgtcgtcccttatcaacaaagcgtccaattgtttgaagccttaataaaagaaggccatgatgcccttatgtataaaataaacggggccggacataacggttttacccaggctcataccctggacatcgtcaaatcgttcttccgcaaacatttaaagcctggaaaagcctga

SEQ ID NO: 1129 - DNA, 888 bp, Bacillus licheniformis
atgaaacgattaaggatgaggaagcatttactgatagctgtctgtactttggcacttcttctaagttccccgattgtaagcgatgcgagcccggcaactaaaccaacaactgcagattcgccgcaatcttccggatttttcgtagaccattacaaaaataatatctctgccaatacgacggcggaatccaatcctgtcatcggcctgctttccgaatttaataaactttggactcccggaaagacatggaataccggtactaaactgaacagcagggtgctggatgccaacattcaaaaagtcgtggatattgctgaacgccgcacgatgcttgaggaaaatgctgcctattttgatgatcggcggagccagagctacagtataattgacggcctcggcaagcttgccggcgtctatcgaatgaacgcgggagcgacgacaacgatcaccagcattccggcagatgcctcgattagaaaatacaatgatgaaggaaccaattcgggcagcaccagctctgaacttggaaatgtcgtaagtttggtcaatactttacgcggcaactattcttcatcgaatccggctaaaagctatttcaactatccccgcccgtttcgctggaaagacaattcgatcattgttccaacgcttatccccgtcatcaatcctgatccgaacaaagacggaggttttccaagcggacacacgaacgccgcatatctcatcgcttttgctatggcctatgcgataccagagcgttatcaggagctgctgactcgcgcttcagaactccgtcataaccggattgttgccggtatgcattccccggctggacgtcatggggggacgagtaatggcaacagctttgtgtgcagcaatcctgtctga

SEQ ID NO: 1130 - DNA, 399 bp, Bacillus licheniformis
  misc_feature (1)...(399): n = A,T,C or G
ttgttaaaagatatattcagcaaaaagaaaaaaaaatacgcttccgttcccgcggaatcagcgaacaangatgtaccggaagggatcatgacaaagtgcccggattgtaaaaaaatcatgctcacaaaagagctggataaaaatttaagggtctgcatgaattgcggttaccatcttcaaatgaacgcgaacagacgtataaaaagcctgctggacgatggctcctttgaagaattcaatcaggatatgatgtctgaaaacccgctggagttcccgggataccttgaaaaattgcaaaaagaccgggaaaaaacgtcgctgaatgaagcggttgttaccgggaaagggacgattgacggatctccggcggtcgtggccgtgatggattcatctttcaga

SEQ ID NO: 1131 - DNA, 855 bp, Bacillus licheniformis
atgggtctgccaatgtcgaagaatctgcttcaggagaactttacggtttatggaatggaccttaacaaagaagctgaattggccttgcatcatgcaggaggaacgatcgggatttcagttgaaaaaatggttgaagagtgtgacgccatcctcacaagccttccttcctcaaacgctgcagaggaggtttttctgggaaaaaaagggctcgtacacctggctgaaccgggcgtcctcctgatcgatacaagcacggtcgctcctgaactgaatatccgaattgcggaggaagcgaaaagcaaaggtatcgattttcttgcggcgccggtcagcggcggtgtgatcggggcggtcaaccggacgctgacctttatggtcgggggtccgaagtccgtttttgataaagcgttgcctgttttcaatgcattgggcgagaatatttttcatgtgaacgaaaacatcgacagcggaacgaatacaaagctgatcaacaacctcttaatcggtttttatacagccggcgtcagtgaagccttgcaccttgccaaaaacagcaatctcgacctcgaccaattgtttgagatgctgaacgtcagctatgggcagagccggatctatgagcgcaactataaaagtttcatagcggatgaaaactataaacctggcttttctttgaagctgctgctgaaagaccttggctttgcattggatttggctgagaagaacaacgttgaactgccggtgagcaagattctcttcggcatttacgaagaagccgatcagaacggatacggggaaaaagatatgtctgttttatacaaaaaaataagcgaacagaagacaacttatcagtaa

SEQ ID NO: 1132 - DNA, 489 bp, Bacillus licheniformis
aatgccggattttcctcggtatgaacagattatttcatcaaaaaacactcaaccgttattttcgttcctcaactcatttgggaggggctatgtgcacgatttctgcctgcctgtctctcttgctgttcggctcgggaagtgttcgtacagcggggatggccagcgcccttgcacttttggtcagccaccttcaagtcatgctgatcaaaaagctgtatccgagaaagcggccgtatttaacgctaaaggaaactcaggttttgcaaaatccgctcaaggatcattcttttccatccggacatacgacagctgtattttctgttattacaccgttaatgatattctttccgatactcgcgcttttattaataccggttggcgtcagtgtggggctctccaggatttatctcggtcttcattatccatcggatgttctggcaggcacagccctcgggatttcagtcggaaccttgtcggcgatgatcttct

SEQ ID NO: 1133 - DNA, 270 bp, Bacillus licheniformis
catgggtcggcagaacgtcaatggaggtattcgtcaaagtcattaaagagcatttgctgacaggcgaacgaaagcttgcggcgacatcctttttaacctttgtggcgcttgatcaggacggcaatcctcaggccgttccccaagttgtaccgcagtctgaagaagaaatcatgctgctctataccgcccggcagcgcgccgaagaacggaaaaaccatcgcaaacacagcaaagcgctggcccaggcgctggctgttgacaaaccttggt

SEQ ID NO: 1134 - DNA, 729 bp, Bacillus licheniformis
atgttctttattccataaacgagcagtcggtcgccgtgttgacgctgaacaggccgcaggctgcaaatgccctctcgcttgggcttctcgacgactttcagcgcatccttcgagatattcgttcaaacccggccgtccgctgtgtcatcataacgggaaaaggggacaggacgttttgtgcaggcgccgatttaaaggaaagagcccgcatgagccaaacagaagcgaagcaggctgtttccctgattcaacgcgtggtcagcgaaacggaaaaactgccgcagcccgtcatcgcttcattaaacggaagcgctttaggaggggggctggagcttgcattggcgtgcgacatcaggatcgcagccgaacatattgaactcggcctccccgaaacaacgctcgcaatcattccaggggcaggagggacacagcggctgccccgcttgatcggcaggggaaaggcgaaagaaatgatctttaccggctgccgcatcagcgccgaagaagcgcaaaagatcagcctggttgaacatgtcgttccgctttcgaagttaaaggaagcgagtgaaagcatcgcggcgaacatcgcggcgaacggaccggtagccgtcagacaagcgaagtttgccatcaatcaaggccttgagacagctatcgaaacagggcttgccattgaacaaaaagcctatgaactgacgattccgacgaaagacaggacagaagggctga

SEQ ID NO: 1135 - DNA, 630 bp, Bacillus licheniformis
atgcaggaatacgaagtggagcgggcttaccgcgattcacggattaaccggatttttgaaggcacaaacgaaatcaaccggctcatcgtcccgggcacctacatgaaaaaagcgatgaaaggcgagcttcctctgtttgagaaagcaaaggctcttcaggaagaactgatgatgctcatgcctgaagaaccaggtgacggcgttctcgaacaggaaaagtatctgctgagaaacgccaaaaagaccgcgctcatgatcgcgggactcgccgcgcaaaaatacggaaaagcgctcgaccaggagcaggaaatcctcgtcaacatcgccgacattgtcagccagatctacgcaatggaagcagctattttacgtactgaaaaagccatccgggcaaccggcgaagacaaaaacgcacagaaaattctttatacgcaaatttttgcgcaggaagcctttcaggaaattgaaagccatgccaaagaatcgctcattgcgatggaatcaggcgattcgctgcgcatgatgctgtccgcgctgcgcaaattgacgcgctttacgcctgtcaacgtgattgagaaaaagcgccaggcagccaagggagtctttgaagctgagaaatatatcgtttaa

SEQ ID NO: 1136 - DNA, 627 bp, Bacillus licheniformis
atggagaccggggcggacctgctccggtttttcctatattatttgcccggcaggggagccgggtgtaaaatgtttaaaaacaatgtcaaggaggcactgacttttctaatgtataaagcactattttcagcagctgtctttgtcatcatggccattcttatccgcatcccggcggttcaatcatttgatgtgagcgtgatacaggctctcgagtctgtcagacatccggttctcacagcggtttttaaagcgctgacagagctggggtcaagcggcttcatgctgccgctgatgcttgctttaaccctggttctcgccgtctataaaaaagcagcggcatcactgtatctttatttgctgttttttgttgaaagaacggccaatgaagccttaaaaggctggattgccagagagcggcccgcgataaacccgctcgtgcacgaaccgtcatacagctttccgagcggccattcgatgaatgcggcgagcatgtatccgtttatcgcatttctccttttgctctgcattcctttttttcaaaacacagtcgcgcggtttacgtgtggacgggccttctcgtcggactcatcggaatcagccgcatgtatctcggcgttcattacatga

SEQ ID NO: 1137 - DNA, 211 bp, Bacillus licheniformis
atgaatactgttgtcaccaatatggcaggaaacgtgtggaaaatattagtgaaagcgggggacaaaatcgaaaaggggcaggaagtcgccattttagaatcgatgaagatggagattccgattgtcgccgaaacggccggaacagtcaaaaccgtcagaaagaacgaaggtgattttgccgatgaaggggatgtcttattggagcttcaat

SEQ ID NO: 1138 - DNA, 153 bp, Bacillus licheniformis
cattgatgtcgtagacaaggcgatgagagtcgtcggagcgaaaagtctcgcaagaacgaacccgctccaaagattctaccgcgatgtccgggcgggcctccacaacccgccgatggatgatgcgacaatcgccaagcttgcaggaattgcatt

SEQ ID NO: 1139 - DNA, 322 bp, Bacillus licheniformis
atgaacaaccctgtactgccgcatcgatacccatttctattcatagattgtgttgtagagagtgagccgggaaaatgggtgaaaggctataaattcataacggaaaacgactggttcatcaccgaaaatcaaaaggaaatgccattttcatcttaatagaagcgctggctcagaccgcagcatttactgcgttgaaagaaccggctgaaatcggctttctgtcttcggtgaaaaaagccgaatgcaccggcaaggccgttgtgggagacaaacttgatctatactttgaagtttcccgctataaacgggggtttttattcgg

SEQ ID NO: 1140 - DNA, 342 bp, Bacillus licheniformis
atgaatggcagagaagtgttcaagtttgccgtccgccaaatgggtgaatccagtgtaaatgttattgaaaaagcgggattatccaaagaggatgtcgactttttggtgccgcaccaagccaacatccggatcatggaagcggcgcgcgaacgtttggagcttccggtcgaaaaaatgtcgaaaacggttcataaatacggaaacacatcagctgcttctattccgatttctcttgtggaagagcttgaagctggtaaaataaaagacggtgacgtcattgtgatggtcggcttcggcggaggtttgacatggggagccatcgccatgcgctggggccgctaa

SEQ ID NO: 1141 - DNA, 603 bp, Bacillus licheniformis
agcagaccgaaaaaataagaagagggggacacaacacaagcgactacgcgtagacaagcagcgaagtgaggcgcgttcaacgcgggacgagagccagaatacgaagctcaagcgcacagaaagacacaaaaaaaaaggaggaagagataaagacgggggagagagaagcaaggcggcgggagcaaaccggaagcggaaggaagccaaaagcaacgcacggagaagagaccagtagtaggagagacacgagacgaaaaaaacggagcgaacccggaaaaggggcaacagacggatgacggccggaagggaccgaaaagcttccatcgaacaaaacggggagcacgggatgcggcgcagccgcaacaactcacgtccgcaattgcaaaggcaagagaatcaacaagcacctttcatcatttttaccgcatcagacggtgcaagaaagcaggaaggccttgtcagcttgatgcaaatggctaaaacgagatccgctttgaagctgttcagcgaagagcagggcttgatcatttcagtgatgacgcatccgacaacaggcggcgtatccgcaagcttcgcatccctcggcgattacaaccttgccga

SEQ ID NO: 1142 - DNA, 135 bp, Bacillus licheniformis
cgtgcaaatattcggcgggtacggctacacaaaggattatccggtcgagcgctttatgcgcgatgcaaaaatcacacagatctatgaaggtacgcaggaaattcagaagctcgtcatttcgagaatgctgatgaa

SEQ ID NO: 1143 - DNA, 950 bp, Bacillus licheniformis
atgggcaagattgcttttctattcccgggccaaggttcgcagcatatcggcatgggacacgaattgtatgaaaaagaaccgaatgcgaagaagatttttgaagaagcggatcaaacgcttgaaacaaaactgagcaccctcatgtttgaaggggatgcaaaggaactgacgcttacatacaacgcgcagccaagccttttaacggcgagcatcgcagcgcttgaaaaactgaaggaatacggcattaaagccgactatgcggcaggtcacagcctcggcgaatacagcgcattggtcgctgccggcgccttgtcgtttaaagatgcggtttatgccgtcagaaagcgcggcgaattcatgaatgaagccgtgccggcgggagaaggcgcgatggcggccattctcggcatggacagccaggcgctgaaagaagtgacggacaaaatttccgaagaaggaaaccttgttcagctcgccaatttgaactgccctgggcaaatcgtcatctcgggaacagctaaaggcgtggagctcgcttcagagcttgcgaaagaaaagggcgcaaaacgcgcgattcctctcgaagtcagcgggccgttccattctgagctgatgaagccggcagctgataagcttcgtgaagttcttgatgcgtgcacgatcaacgacgcagccattccggtcgtctccaacgtaacggccgactttgtaacggataaagacgacattaagaataaactgattgaacagctgtattcccctgtacgctttgaagaaacaatcagccgcctgattgacgaaggcgtcacgaccttcattgaaatcggtcccggaaaggttttgtcagggcttgtgaagaaagtgaaccgcagagtcaaaacgattgctgtatcagacccgaacacaattgaacttgccgttcaaacgttgaaggaggaaaacgaaaatgc

SEQ ID NO: 1144 - DNA, 1086 bp, Bacillus licheniformis; identical to SEQ ID NO: 1087

SEQ ID NO: 1145 - DNA, 921 bp, Bacillus licheniformis
tatcgccgcgcggctattgctccggtgtcgtcgacgccatggtcatcgcaaaaaacgcggctctcgataaaagtctgccgagacctatttatattttaggaatgatcgttcacaatagacatgtcacagacgcatttgaaaaagagggcatttatacgcttgacggcccgaataggctcgagattttgaatcaggtcgacaaaggaacggtgatcttcaccgctcacggcgtttcgcccgaagtccgcaaaatagctgaggataaaggtcttgtcgcgattgacgccacctgccctgatgtgacaaaaacacacgatttaatccggaaaatgaaagccgaaggctatcacgtcatctacatcggaaaaaaaggacacccggagcctgaaggagcggtcggcgtcgccccggatatcgttcatcttgttgaaaccgaagaagatgtggaaaggctggacattgaagcggagaaactgattgtcacgaaccaaacgacgatgtcccaatgggatgtccacgatattatggaaaaggtaaaagaaaaatatccggatgttgaattccaccaggagatttgcctggccacccaagtgcgtcaggaagcggtgtccgaacaagcgaaaaaagccgatttgacgatcgttgtcggcgatccgaaaagcaataactcaaaccgcctcgcccaggtctccgaagaaatcgcgggcacgaaagcataccggatcggtgatttaagcgaattaaagctggaatggcttgacggcgtaaaaaccgtcgctgtaacggccggcgcatcgacaccgaccccgattacaaaggaagtcatccgctttttagagcaattcgatcatgaagatccggccacttgtattatcagacacgaattaccgttgcttttaatctggcctaatgtaaaagcat

SEQ ID NO: 1146 - DNA, 1239 bp, Bacillus licheniformis
atgaatagtaaaagagtagtcattaccggattaggagctttatcacctcttggtaatgacgtcaaaacaagctggaacaacgcgatcaacggggtttccggagtcggcccgataacaagggtgaacgcggacgagtatcctgctaaagtagccgcagaactgaaagattttaagatagaagattatatggataaaaaagaagcgagaaaaatggaccgcttcacacaatatgccgttgtgtcggcgaaaatggccgtggaagacgcgggcctcgacattaacgaaagcaacgcagaccggatcggcgtctgggtcggttccggaatcggcggccttgaaacgcttgaacagcagttcgaaacatttttaacaaaaggaccgcggcgcgtcagcccgttctttgtaccgatgatgattcctgatatggcgaccggccagatttcgatctctctcggtgcaaaaggggtcaactcttgtacggtgacggcttgcgcgacgggtacaaactcaatcggcgacgctttcaaggtcattcagcgcggcgatgccgatgtcatgatctccggaggaacggaagccccgcttacaagaatgtcatttgccggcttttcagccaataaagcgctatccactaatccggatccgaaaacggcaagccgtccgtttgacaaaaaccgcgacggcttcgtcatgggagaaggagctggaatcgtcgttcttgaggagcttgagcacgccttaaaccgcggagcgacaatctacgcggaagtggtcggctacggatcaacgggagacgcctatcatattacggcacctgcgccaaatggagaaggcggcgtcagagccatgaaagaagcgatcaaagatgcgggtctgtcccctgtggacattgattatatcaatgctcatggaacaagcacgccgtacaatgataaatttgaaacgatcgccattaaagaagtgttcggagagcatgcctacaagcttgccgtcagctcgacaaaatcgatgacagggcacttgctcggggctgccggaggcatcgaagcgattttctccgtccttgccattaaggaaggcatcattcctccgacaatcaatatcgaaacgcctgatgaagattgcgatctggactatgtaccggatcaagcccgccgccaggacgtgaatgttgtgctcagcaactcgcttggtttcggcggacacaacgcaacgctgatcttcaaaaaatatgaataa

SEQ ID NO: 1147 - DNA, 1435 bp, Bacillus licheniformis
atgctgatggaccatccgaattggcttaaacagcgagcagaactgacacctgacaggatggctgtgattcagggagatcacaagctgacttttattcaattatttcatgaagcaaaaaaaacggccggccggctgaagagctttggtctgaagaatggggatacagcggctttacttctcacaaaccggatggagatggtcatcgccgtccatgcctgctttcttctcggcgttcgcatcgttttgctgaatacgaagctgtcaatggccgaacgatcatatcaaattgaacattctgaagcaaagctattgcttacagagaagcctttcatagaagagcatagagggggacagccggctcgcgctgttgacattgaagacgttcaaaacgccgcttgcccgccggttacagaaatcgaaagcattcatttggacgatgcggcaacaatcatgtatacgtctggaacgaccggacggccgaaaggggttatgcagacatttgcaaaccattatttcagcgcggtttcatccgccttgaatttggggctccaagaacacgaccgctggctgatcgccttgccgcttttccatatcagcggcttatcggcgctttttaaatcggtcatttacggaatgactgtcgttttgcatcaaaggtttgacgcggaagaagttcttcgttcgatcaaagaccagcaagtaacgattgcatcggtcgttcagacgatgctgtcgaggcttgcggcaaaagtcgacagatgccccggatcattaaggtgcctgttattgggcggagggccagcaccgctttctctccttgaggaatgcaaaagaaagcggctgcccgtcgtacagtcgtacggaatgactgaaacgtgctcacagattgcgaccctcgccccggaatactcgattgaaaagctcggttcagccggcaaaccgctgtttgcatcaagcatcaaaatcgaaaagaacggaacggaatgccaacccggagaacatggtgaaataaccgtaaaagggccgaccgttatgaagggctacttgaaaaatgaggcggcaaataaagactcattcaatgacggctggtttaaaaccggtgatatcgggtattttgacgatgacggatttttatatgtgctggacaggcgttcagacttaatcatatcaggaggagaaaacatctatccggctgaagtcgaggccgttcttctgtcacaccccaatgtcgcggaagcgggggtgaaaggagtcgatgacaaaacttggggaaaggttccccacgcctatctcgtcgccgacagccccgttgatgaagaggagctgagcgaattttgcaaagaacggcttgcttcatataaagtgcctaaagcatttcattttgtcgataggctgccgagaaatgcttcaaataaactgatgagacataaattgt

SEQ ID NO: 1148 - DNA, 1602 bp, Bacillus licheniformis
aaaacaaacgatcggcgggcttttaaaatcaaccgccggccggtttccgaatcatgaagcggttgtatattctgagctcgatttaagatactcgtatcaggagcttgttgaagaaacttctaaaattgcaaaagggctgctcgcgctcggcattcaaaaaggggagcatgtcgccatctgggcatccaatattccggaatggattctgctccagtttgctacggcaagaatcggcgctgtgctcgtcaccgtcaatacgagctatcaggcgagagaactcgagtacttattggaacattccgattccaccaccctctttctgatggacggctacaaaggaacatcctatatcaatatgatcgatgagatcatgaaaaatcctgaaaagctgccgaagctgaaaaatctcgtctaccttggcaagaacgagacccctgaacatatgacggcttttgccgagatcgctaaaatgggcgaaacggtctctgatgccgacctttttgaacgagagcagtcactcacacacgatgatgtgattaatatgcagtatacgtcgggaacgaccggctttccaaaaggtgttatgctgactcactacaatatcgtcaacaatgcggcgatcgttgccgacagaatggggctgacgagcgaagacaggctgtgcatcccggttcctctttttcattgcttcggctgtgtgttaagcacgcttgcctgcgtcgcgtcaggcgcggccatgctgccaatcatcgaattcaagccggacatcgtcctgcaaacggtcgaaaaagaaagatgtacagggctgcagggtgtaccgacaatgtttatcgccgagctcacccaccccgatttcgcaaactatgacctctcttctctgcggaccgggatcatggcaggctccccgtgccctagagaagtcatgaaaaaagtgatgaagcaaatgaatatgacggatatcacaatcgcatacggacagacggagtcttcacccgtgattacgcagacaaccgtcaccgacacgatcgaacgccgcgtcgagaccgtcggaaaagtgcatccgcatgtagaaatgaaaatcgtcgatcctgacaccggggaaacgctcggcccggatgagcagggcgaactgtgcacaagaagatacctcgtcatgaaaggctactataaaatggatcaagccacaaaaaaggccatcgatgaagacggctggctccataccggagatttggcagaaatggaccgggacggatacgtgaggattaccgggcgcttaaaagatatgatcgtccgcggcggggaaaacatttacccgcgtgaaatagaggaattcctttatgaacatgaggatattgtcgatgtacaggttgtcggcgttccggatgaaaagtacggggaaaaaacggctgcctttattaaatgcaggccgggcaaaaagctgacgctcgaagacgtcagagatttttgcaaaggacagctttcgtattataaaattccggagtacgtatttctgatcgacgaatacccgctgaccgcatccggaaaagttcaaaaatatgtgctgcgcgaccgcgcagcagaactgcttgcgagcccggtgca

SEQ ID NO: 1149 - DNA, 1479 bp, Bacillus licheniformis
ggctgcgtcattatcccgaacaaattcctcacgagctgcaatttgaagatcaaacactccattccatcctgcaacaatccgcccagcagttttcagaaaaaacagcgattcattttctaggaaaaaaacgttcgtaccgggaagtttacgaggatgctttaaaaatggcagattacctgctgtcgctcggcattcaaaaaggagacagagtatcgatcatgctgccgaactgcccgcaggcggttatcgcgtattacggcgttcttttctccggcggcatcgtcgtccagacaaatccgctgtatacggaaagggagcttgaacatctgcttcatgacagcggggcaaccatcatcattacgctcgacatgctgtacccggcggcatataaaatgaaagcgctaacaagcattaggcacatcattgcgacaagcataaaagattacctgcctttccctaaaaatctgctgtacccgatcgttcaaaaaaaagagaatcaaatgtccgttgagatcaatgaaaatgagacgacccaccttttccgcaccatcatgaaacgccccgttccaagcggaccgcccggtattgaaattgatccggcccacgacattgccgtcctgcagtataccggaggaacgacaggcacgccaaaaggcgtcatgctcagccaccgcaacatactagccaacatggagatgtgcgccgcctggttttatcaattgaataaaggggaggagaaggtgctggggatcgttccgttttttcacgtctacggaatgacggccgtcttgaatttcacgatcaggcaggggtatgaaatgatcctgctgccgagatttgacgcgcgcgcagcgctgaaaacgatcgataaagaaaagccgacgatatttccgggggcgccgacgatttatatcgccctgttgaaccatcccgaccttcaccaatacgatctgtcatcgattaagagctgtttgagcggatctgcggcgcttcctgttgaagtcaaacagcagtttgaaaaggtgacgggcggaaggcttgtcgaaggttatggaatgtctgaaacgtcgccggtcactcacgccaattttatttgggatttgaataaagcgggcagtatcgggtgtccttggcctggtacagacgctgctatctattcggaagaaaccggcggttttctcgggccttatgagcatggagaaatcgctgtcaaaggaccgcaggtgatgaaaggctactggaacaatgatgaagaaaccgctcagagtctaagggacggctggttttttaccggagacatcggctacatggataaagacggcttcttttatatcgtcgaccgcaaaaaagacgtgatcattgccgggggatacaacatctacccgcgcgaaatcgaagaagtgctctacgagcatgaagccgttcaggaggcggtcgttgccggcatccctgataatacaggggggaaacggttaaggc

SEQ ID NO: 1150 - DNA, 1419 bp, Bacillus licheniformis
ggacaacgttggcagagctgctccatttgacaattggaaagttattggagaaaaccgcggcagacgcccctgatcacgaggctgtcgtctatccggaccgcggcctgcgttatacgtaccgggaatttgaccagttgtgcagaaaagtcgcaaaaggactgatggcgctcggtattgataaaggtgaacatgtcgcaatttgggcttccaatactccggaatggctcaccgcccagtttgcttcggcaaaagcgggtgctgtactagtcacagccaacacgaactatcaattatcagagcttgaatatgtgctgaaacagtcagatgccacaacactcattttaatggaatcataccggggcacttcctacattgatatcctttgcaaactgattcctgaattaaaggagggcgaaccgggcaggcttgcatctgaaagactgcctttcttaaaaaatattattttgctgggggatcaaaggcatcccggcatgtacctatgggatgatttattaaagctctcagggtcagtaagcgaaaaagcgcttgatcgcaggatggaacggctcaaagagcatgatgtcattaatatgcaatatacatcaggtacgacaggctttccgaaaggcgtgatgctcacccattccaatttggcaaacaatgcggcaaatattgcggaatgcatgaatttatcgaaaaaagacagaatgtgcatccccgttccgtttttccactgcttcggctgtgtactggggactctcgcttgcgtcaccgccggcgcgacgatggtgccggtacaagaattcagtccgaaagaagtgctttcagccgtcgaaacggaaaaatgcacggcgcttcacggtgtaccgaccatgttcatcgccgaactgaatgatccagatttcgcatcatatgacctgtcttctttaagaacgggcatcatggccggttcaaactgtccgatcgaagtcatgaaaaaagtgatcgataacatggggatgtctgaaataacgattgcatacggacagacggaagcctcaccggtcattacccagactagggtcaacgattcgctcaaaagaagggtcgaaaccgtagggcgcgctttgccgaatgtagaagtcaaaataactgaaccgggtacgaaccgggaggttgaaagaggcgttcaaggcgagctgtgcacacgcggctaccatgttatgaaaggctactacaaaaatcctgaggccacggcagcggtcatcgatgaggatggatttttgcatacgggagatttagccgtaatggatgaagaaggctactgccggattaccgggagattaaaagacatgatcatcagaggcggtgaaaacatatatccgcgggaaatagaagagtttttatacaagcatcccgacattctcgacgtccaaattg

SEQ ID NO: 1151 - DNA, 1386 bp, Bacillus licheniformis
  misc_feature (1)...(1386): n = A,T,C or G
atgaatttagtttcaaaattaggggaaacagctcaatcaaagcctgacagaaccgcttatatttttggagagcaaacggaaacatacgggggattgcagcagaaaattgattgctttgccgaagggctgcgcgaaatcggggtggaaaagggagatcatgtcgctttgctactcggcaatacaccgcattttgtgattgcgttttacggcgcgctgaaggccggggctgtcgtcataccgatcaatccggcctatacgccgactgagatcggctatatgctgacaaatggcgatgcaaaagtgatcgtggctctgggacagctgcttccgctttacgaaaaggtgcatgaatcccttccgaaagtcggctgcgtcgtgctttgcgaaactggagagccgcttcaggaaccggaaaacacagaggttaagatgaaattgaaatcgtttacaagcattatgaaacctcctgtccggccgtttcctgaaatcgatgacgaagatacggccgccatcctctatacgtcaggcaccacgggaagaccaaaaggggcgatgctcacacatcaaaatctattttcgaatgcaaatgatacagcccgctatctgacaatgaatgaatctgaccttgtcgtcgccgccctgccgatgttccacgttttttgtttaacggtctgcatgaatgcaccgctcatgaacggcgcagcgattttgatcgtgccgaaattcagtcccgccgaggttttcaagctgattaaaaagcatcaggcgacgatcttctcaggcgttccgacaatgtacaattacctgtaccagtatgaaggagcggatgaaacaggctttcggtccatcaggctttgcatctcaggcggagcggccatgcctgtcgctctcctgaaaagctttgaagaaaggttcggcgtcctcgttttagaaggctacggcttgtcggaggcttctcctgttacatgctttaacccgttcagcaccggccgcaagccaggatcgatcggcacgaacattctcaatgtgaaaaacaaagtcgtcaatgaactcggggaagagctgcctgccggccaagtcggcgagctgatcgttaaagggccctatgtcatgaaaaggtactacaaaatgccggatgagacggcccatacgataaaagacggatggctgtatacaggtgatttggcaaaacgggatgaagacggttatttttatatcgtcgacagaaaaaaagatatgattatcgtcggcggctataatgtctatccgagggaaatcgaagaggtgctctacctcccatccaanaatcgcagaagcggttgtgatcggagtgcccgatccgaatacgggagaagccgttcattgctatgtcgttccgaaggataa

SEQ ID NO: 1152 - DNA, 813 bp, Bacillus licheniformis
ggattcccgaacgtttgaattcctgcaggagatcgagaggaaacgcattcatatgatgatgcgttcccttcggttatacactaacatgttggaggaaatgaaaagacatccattcgacctgtcatctgtgaaaatgcttgtttccggcggcaccaaggggccggcgcggttgattaaggagtacaatgaccatggaatcatgatggtgcaggggtacggcagcacagaagcatggacggtcagcgtatggcggcctgacatgggctgggataaagtcacttcagccggcaagccgattccgcaagtcagcataaaaatcgaagaccctgatacacatgaagagctgccgacgggagaagtcggagaagtcgtcgtcaaaagcccgtatgtttttgaagggtattaccaaaatccttccgccacgcaaaaggtgctgaaagacggctggttctatatgggggactccggcaaactcgatgaagacggatttttatatattaccggccggtataaagacgtcattgtctacggaggcgacaacatttatccggaccaagtggaagaaatcatcgatcaagtgcccggagtagttgaatctgccgtcatcggcgtcccggatgaaatgtacggcgaggttccgagggcgtatgtggtgaaaaatgaaagcgccggcctcaagaaggaggacattatcgcgtattgcaaagagcgcctgtccgactataaaattcctgaaatcgtctttatcgacagccttccgaaaaacaggctcggcaaaatcgtcaaaaaagatctgcgtgaactggcagtcaa

SEQ ID NO: 1153 - DNA, 236 bp, Bacillus licheniformis
atggattttaatcaagaagtactttcagttttagcagaggtatgtcaggacgatatcgtaaaggaaaatccggatattgatatattcgaagagggaatcctcgattccttcggcacggtggaattgctgctcgcattcgaaagccattttaacatcacagtgccgattacagagtttgaccgggatgcatggaacacgccaaatcaaatcataaagcagctgaatgagttgagata

SEQ ID NO: 1154 - DNA, 2178 bp, Bacillus licheniformis
ggggctttctaaagcggtgcgcgaagtatttgtaaagctttatgaaaaagggctgatttaccgcggagaatatatcattaactgggatccggcaaccaaaacggctttgtcagacatcgaagtcatctataaagacgtacaaggtgcgttctatcatatgcgatatccgctgaaagacggttcaggctcgattgaaattgcgacgacccgtccggaaacaatgctcggcgatacagcggttgcggtgcatccggaagacgagcggtacaaacacctaatcggaaaaacggtcattctgccgatcacgggcagagaaatcccgattgtcggagacgactatgtcgatatggaattcggttcaggcgccgtcaaaattacgcctgcccatgatccgaacgactttgaaatcggaaaccgccacaaccttgaacgcattctcgtcatgaatgaagacggcacgatgaatgacaatgcccttcaatataaaggcatggaccgttttgaatgccgcaagcagatcgtgaaagatcttcaggaagagggcgtgctgttcaagattgaagaacatacgcattcggtcggccacagcgaacgaagcggagcagtcgttgagccgtatttgtcaacacagtggttcgtgcaaatgcagccgcttgccgacgccgccatcgaattgcaaaaaagcgaaggcaaagtcaacttcgtccctgaccgttttgaaaaaacgtatctgcactggatggaaaatatccgcgactggtgcatttcccgccagctctggtggggccatcggattccggcatggtaccataaagaaaccggtgaaatctatgtcggcgttgaagcgccggaagatgcagaaaactgggagcaggacaaagacgttcttgatacatggttcagttccgctctttggccgttttcaacgatgggctggcctgatatcgatgaggaagatttcaagcgctactatccgacgaacgtccttgtcacaggctacgatattattttcttctgggtatcgagaatgatcttccaaggtatcgaatttaccggagaacgtccgtttaaagatgtcttgatccacgggctcatccgcgacgaccagggccgcaaaatgagcaaatcgctcggaaacggcgtcgatccgatggatgtaatcgacaagtacggagcggattcgctgcgctacttccttgcaacaggaagctctccgggtcaggatttacgcttcagctttgaaaaagtagagtcaacatggaattttgcgaacaagatttggaacgcatcaaggttcgctctgatgaacatggacggcatgacatacgaagagcttgacctgtcaggggaaaaatccgttgccgataagtggattttaacaaggttgaatgaaacgattgaaaccgtgacacagctggccgacaagtacgaattcggcgaggttggccgccatctctacaattttatctgggatgatttctgtgactggtacatcgaaatggctaaacttccgctttacggcgaagatgaagcggcgaagaagacaacccgctccattttagcgtatgtgctggatcaaacgatgcgcctcctgcatccgtttatgccgttcctgacggaagagatttggcagcatcttcctcacgaaggggaatccattacagtcgccaaatggcctgaggccgtcaaagaatatacggacaccgaggccgcggcggatatgaagcttctcgttgaagtcatccgcgccgtacggaacatccgcagcgaagttaacacgccgctcagcaagcagattgaactttatattaaaacgagcacgccggaaatcgctgaacgacttgaagaaaaccgttcgtacgtagaacgctttacgaatccgagccttcttcagatcggaacggatattcaagcggtcgataaagcgatgaccgctgtcgtatctggcgccgagctgatcttgccgctcgaaggtctgattaacattgacgaagaaatcagccgccttcaaaaagaactcgataagctgacgaaggaagttgaacgggttcagaagaaattaagcaatgaaggatttatgaaaaaagcacctgcacatgtcattgaagaagagcgggcgaaagaagccgattatacggcgaagcgtgaagctgtagaaaaaagaatcgccgaattgaa

SEQ ID NO: 1155 - DNA, 1932 bp, Bacillus licheniformis
  misc_feature (1)...(1932): n = A,T,C or G
atgtcagatatggtaanaatcaaatttcctgacggagcggttaaggagtttgcaaaagcgacgacaacagaagatatcgcggcatcaatcagtcccggcttaaagaaaaaagcgatagcggggaaattaaacggcaaagaaatcgatctgcgcgcaccgatccttgaggacggcgccatcgaaatcattacagaaggcagcgaagaagcgcttgaaatcatgcgccacagtactgcacacttaatggcccaggcgatcaagcgcctgtataaaaacgtgaagctcggggtcggcccggttatcgaaaacggcttctactacgacgtggatttggaagaagcgctgactccggaagaccttccgaagattgagaaggaaatgaaaaaaatcgtcggggaaaatctgccgatcgtaagaaaagaagtcagccgagaggaagccagagccctgtttgccgaaatcggcgatgatctgaaattggaactgcttgatgcgattccggaaggcgagacggtatcgatctatgagcagggcgaattcttcgatctgtgccgcggtgttcacgttccttcgacgggcaaaatcaaggagttcaagctgctgagccttgcgggggcatactggcgcggagacagcaacaacaagatgctccagcgcatctatgggacggctttcttcaaaaaagccgagcttgaagagcatcttcgcctccttgaggaagcgaaagaacgcgaccacagaaaactcggaaaagaactgaagctgttcgccaattcgcaaaaagtcggccagggtctgccgctttggctgccaaagggtgcgaccatcagacgcgtcatcgagcgctatatcgttgacaaagagctcgcgctcggctatgagcacgtgtacacccctgtcctcggcagcaaagacctgtatgaaacatcaggccactgggatcattatcaagacggcatgttcccgccgatggagatggacaatgaaacacttgtgcttcgtccgatgaactgtccgcaccatatgatgatttataaaaacgacattcacagctaccgtgagcttccgatccggatcgccgagctcggaacgatgcaccgctatgaaatgtcaggggctctttcagggctgcagcgcgtccgcggaatgacgctgaatgacgcccacattttcgtccgtccagatcaaatcaaagacgagttcattcgaactgtccgcctgattcaggatgtatacgaagacttcggactggaagagtattcattccgcttgtcttaccgcgaccctgaagatacagagaaatactacgatgacgatgaaatgtggaacaaagcgcaatcgatgctgaaggaggcgatggacgagatcggccatgattattacgaagctgaaggggaagcggccttctacggaccgaagcttgacgttcaggtcaaaacagcaatcggcaaagaggaaactctgtcaactgttcagctggacttccttcttcctgaaaaattcgatctgacatatgtcggggaagacggaaaacctcatcgtccggtcgtcattcacagaggtgtcgtatcgacaatggaacgctttgtcgctttcttaattgaggagcataaaggcgcattgccgacatggcttgcccctgttcagttccaggtcatccctgtatcgccgtctgtgcatcttgactacgccaaaaaagttcaagagcgcctgcagcgtgaagggcttcgcgttgaagtcgatacccgcgacgagaaaatcggctataaaatccgtgaagcgcagatgcaaaaaatcccttacatgcttgtcgtcggcgaccaggaagttgaaaacgaagccgtcaacgtccgcaaatacggagagcaaaaatcagaaacggttgcaattgcagactttatcaaaaaagccgttgctgaagcaaagaaataa

SEQ ID NO: 1156 - DNA, 2115 bp, Bacillus licheniformis
gggaaaaggcgtattaacaaccgccgaaaagaattgtcatttggacgacaacgcccgtggacaatcccggccaacctcgggcatcgccgtacatcctgaactggagtacagcgtcgttgctgccggcggcgcgcgctacgtgatggcaagcgcattgattgaaagcgtggcaaaagcgatcggctttgaagatcatgaagtcgttcagactgttaaaggtaaagatttggaacatatcgtcgcagttcatcctctatacggcagagattcgcttgtgatgctcggcgaacacgtaacaacagatgccggtacaggctgcgttcataccgctccaggacacggggaagacgactttatcatcggtcaaaaatacgggcttgacgtgctttgtccggttgatgaaaaaggacatatgacgagcgaagcccctggttttgaaggactgttttacgatcaggccaacaagccgattacagaacagctcgaagaaaaaggcgctttgctgaagcttgatttcatcactcactcctatccgcacgactggagaacgaaaaaaccgactattttccgtgcaaccgcccaatggttcgcttccatcaaagactttagagacgagcttcttgaagcggttaaaaaaactaaatgggtgcctgaatggggcgagacacgcctctacaatatgatccgcgaccgcggcgactggtgtatttcaagacagcgcgcatggggcgtgccgattccggtattttatgcggaaaacggggagccgatcatcacggacgaaacgatcaaccacgtttctgaactattcagggagcacggttcgaacatttggtttgaaaaagaagcgaatgaactgcttccggaaggctttactcaccctggaagcccgaacggcaagtttacaaaagagcaggacatcatggacgtctggtttgattcaggttcgtctcatcaggccgtactggaagagcgcgaagatcttgtaagacctgccgacttgtatctggaaggatctgaccaataccgcggctggtttaactcatcgatttcgacagcggttgccgtaacaggcaaagcaccttataaaggcgtgctttcgcacggttttgctcttgacggagaaggccgcaaaatgagtaaatcactcggcaatgtcgttgttcctgcaaaaatcatgaaccagttcggggcagatattttaaggctgtgggttgcgtctgtcgactatcaggcagatgtccgcgtgtctgacgcgatcttaaagcaagtcgcagaagtgtaccggaagatccgcaacacgttccgcttccttcacggaaacattgctgattttgacccggcgaaagatgcaatcgctgtggaagatctgagagaagtcgatcagtacattttgatcaaactgaacagcctcattgaaaaagtcaaaaaagcgtatgaagaatacgattttgcggtcatttaccatgctgtccacaacttctgtgcgatcgagctcagctcattctatatggactttgctaaagacgtcgtttatattgaacacgccgatcataaagaccgccgcagcatgcagaccgttttttacgaaacgctgcttgcgcttgtcaagctgatcgcgccgattctgccgcatactgcggacgaaatgtggagccacttcacattcgtatcggaaaaaagcgtgcagcttacagatatgccggaaacaagagacattccgaatgcaaaagagacggaagagaagttcgacagcttcatgaagctgcgcgacgatgttcttaaagcgcttgaaacagcacggaatgaaaagatcatcggaaaatcttcggttgccagcttgacgctgtatccgaatgaagaagctaaagcgctgctttcttcaatcaaggaagacgtcaaacagctgttcatcgtgtcggagcttgccatcggcggaacggaagccgatgcgcctgaggatgcgcagtcgtttgaaacaggaaaaatcgtcgttgctcaggcagaaggcgagacttgcgagcggtgccgcatggtttccaaagaaatcggcgaggatcccgatcatccggaactctgccctcgctgtgctggaattgtgaagacgtattatca

SEQ ID NO: 1157 - DNA, 2021 bp, Bacillus licheniformis
atggcaagagagttctccttagaaaaaactcgtaatatcggaatcatggctcacatcgatgccggtaaaacgacaacaactgaacgtatcttgttctacacaggccgtatccataaaattggtgaaactcacgaaggggcttcccaaatggactggatggagcaggaacaagaacgcggtatcacaatcacatctgctgcaacaactgcacagtggaaaggctaccgcgtaaacatcatcgacacaccaggacacgtagacttcacagttgaggttgaacgttccctgcgcgtacttgatggtgccgttgccgttcttgacgcacaatcaggcgttgagccgcaaactgaaacagtttggcgtcaggcgacaacttacggagtacctcgtatcgtatttgtcaacaagatggacaaaaccgggtgcggacttcctttactctgtaggaactcttagagaccttcttgaggcgaacgctcacgcgatccaattaccgattggcgccgaagaaattttgaagggatcatcgaccttgtagaaaacgttgcgtactactatgaagatgaccttggaacacgctctgaagcgcgtgaaatccctgctgagtacaaagacaaagctgaagagcttcgcgctagcttgattgaagctgttgctgagcttgatgaagagcttatgatgaagtacttggaaggtgaagaaatcacagttgacgagctgaaagcagcaatccgcaaaggaacttgtaacgttgagttctatccggttctatgtggttcagctttcaaaaacaaaggtgttcaattagtgcttgacgcagttcttgactacctgccagctccaactgacgtaccagcaatcaaaggtactctgcctgattctgatgaagaggttactcgtgagtcttctgacgatgcacctttctcagcgcttgcatttaaagttatgactgacccttacgttggtaaattgacgttcttccgtgtgtactcaggaacacttgattccggttcatacgtaagaaactcaacaaaaggcaaacgtgagcgcgtcggccgtatcctgcaaatgcacgccaacagccgtgaagaaatctctactgtgtacgcaggggatatcgctgctgctgtaggtttgaaagacacgactacaggggacacgctttgcgacgagaaaaaccttgttatcctggaatcaatggaattccctgagcctgttatccacgttgcaatcgagcctaaatctaaggctgaccaagacaaaatgtctactgcactggctaaattggctgaagaggatccaacattccgtgcgcatactgaccctgaaacaggtcaaacgatcatcggcggtatgggtgagcttcaccttgatatcatcgttgaccgtatgaaacgcgaatttaaagttgaagccaacgtcggtgctcctcaagttgcgtatcgtgaaacattccgtgcgagcgcgcaagttgaaggtaaattcgtacgtcagtctggtggacgcggacagttcggacacgtttggatcgaattctctccaaacgaagaaggaaaaggctttgagttcgaaaacgcaatcgtcggtggtgtcgttcctcgtgaatacattccggctgttcaagcaggacttgaagatgcacttcaaaacggtgtagtcgcaggttaccctgttatcgacatcaaagcgaaactttttgacggttcttaccacgatgtcgactctaacgaaatggcgtttaaaatcgctgcttccatggcgcttaaaaacgcggcaagcaagtgtaacccagttattcttgagccgatctccaaagttgaagtcgttatcccagaagaatacatgggagacatcatgggcgacattacgtcacgccgcggtcgcgtagaaggtatggaaggacgcggaaacgctcaggtcgttcgcgcgatggttccactttctgaaatgttcggttacgctacggctctccgttcaaacacacaaggacgcggtacgttcacaatggtctttgaccacta

SEQ ID NO: 1158 - DNA, 1671 bp, Bacillus licheniformis
atgaacatagtcgaacaaatgaaagatgtgctgaagcaggaaattaaggaagctgtcatgaaagccggcctcgccgaagaaagcgagattccagaagtcgtactggaagttccgaaagacaagtcgcatggcgactattccactaatatggctatgcagctggcgagaatcgccaaaaaagcgccgcggaatattgccgaagaaatcgtcgcatcctttgacaaaggaaaagcgtcgatcgacaaacttgatatcgcaggacctggctttatcaatttctacatgaacaatcaatatttaacgaagctgattccggctgtgcttgaagcaggagaggcctacggtgaaacaaatatcgggggcggggaacgcgtccaggtggaattcgtctcagcaaacccgacgggcaacctgcaccttggacatgcccgcggagccgctgtcggagattccctctgcaatgtacttgaaaaagcggggtatgaagtgagccgcgaatattatatcaacgatgccggcaatcaaatcaacaacctcgcgttatccgtcgaagcccgttactttcaggcgcttggaaaagataagccgatgcctgaagacgggtatcacggcgaagatattaaggaaatcggccaaaagctcgccgacgaattcggcgatcgttttgttcatgaagaagagagcgaacgcctcgcgtttttccgcgaatacggcttaaagtacgaattgggcaaacttcgtgaagacctggagaatttccgtgtcccatttgatgtctggtactctgagacatcgctttaccaaaacggaaagatcgatcaggcgctcgaagcccttcgcgaaaaagggcatatctatgaagaagacggagcgacatggttccgctcgacggcgttcggcgatgacaaagaccgcgtgctgatcaaaaaagacggatcctacacgtatcttctgcctgacatcgcttatcacaaagacaagcttgaccgcggcttccaaaagctgatcaatgtatggggagcagaccatcacggctatatcccgcgcatgaaagcggctattgaagcgctcggttatgacaaagaaacgcttgaggtcgagatcattcagctcgtccacctttacaaaaacggcgaaaaaatgaaaatgagcaaaagaaccggaaaagccgtcacaatgcgcgatcttattgatgaggtcggccttgacgctgtgcgttacttctttgcgatgcgcagcgccgatacccatatggactttgaccttgatctggccgtctcaacatctaatgagaatccagtttactacgcgcagtacgcccatgcgagaatttgcagcatgctgcgccaaggcgaagaaaaaggcatttcttttgaagggaaccttgatcttacgaagatcggttctgagaaagagtatgatctgcttaaagtgatcggctcgttccctgaggccgtcgctgatgccgcagagaagcggattccgcaccgcattacaaactatatttttgaattggcatctgtgcttcacagcttttacaatgctgagaaagtcctcgatccggcagatgaagaaaaaagccgggcccgtttatcattgatgaaagcaacgcaaatcacattaaataatgccctcaagctgatcggcgtatcagcgcctgaaaaaatgtaa

SEQ ID NO: 1159 - DNA, 2415 bp, Bacillus licheniformis
atgtttgtttcatataaatggctgcaagaatacgtgaatttagacgggatgactcccgagattctcgctgaaaagattacaagaagcggaattgaagtggaaggcatcgaatataagggagaaggaattaaaggtgttgtcattggacatgtgctggagcgcgaacagcatccgaacgccgacaaattaaacaaatgcctcgtcgatatcggcgaagaagagcctgtccagatcatctgcggggctccgaatgtggacaaagggcaaaaagttgccgtcgccacggttggcgcggtattgcccggcaattttaaaatcaaaaaggcgaagctccgcggggaagcgtctaacggcatgatatgctctttgcaggagcttggcattcaaggcaagcttgtgccgaaagaatatgcggaaggcatattcgttttcccgggcgatgctgaaaccggggcggacgcccttcaaagcatggcgctagacgatgcggttctcgaactgggactgacgccaaaccgcgccgacgccatgaacatgctcggcgttgcctatgaagtggctgcgattctcggccgcgaagtcaagctccctgagacggcttatcaggcaggcgccgaaaaagcggcggactatatttccgtcaaaattgaagatcctgaagccaatcctttatacgcggcgaaaatcattaaagacgtcaaaatcggcccgtcgccgctttggatgcagacgaagctgatcaacgccggcatcagaccgcacaacaatgtcgtcgacgttacgaactttgtgctgctcgaatacggccagccgctccacgcgtttgattatgaccgcttcggctcaaaagaggtcgtcatccgcaaagcgtacgagaacgaaacgataacgacgctcgacgaacaagaaagaacgctgaccactgagcaccttgtcatcacaaacggctcttctccgcaggctgtcgcaggcgtaatgggcggagcggaatcagaagtccgcgaagatactgcgacagtgctgctggaagcggcgtatttcaacggccagaccgttcgcaaagcatcaaaggacctcggtcttcgcagcgaatcaagcgtccgctttgaaaaaggcatcgatcctgcacgggtgcgcctcgctgcagaacgcgcggcagatttgatcagccggtatgccggaggaaccgtcttggaaggtacggtcgaagaaaaccatcttgacatcaaagagaatgtcatccgcctttccgttgataaagtgacgaaggttctcggcatgtccatcagcaaagaagaaatggtcaacatttttgaaaggctcggctttgcagttgaagacgctgaacgtgaactggtcgtgacggttccgtcaagaagaggcgatattgcgattgaagaagatttgatcgaagaggtcgcaagactgtacggatatgacaacattccgtcgacactgccggaagtaacaggctttgcgggcggactgacaccttatcaggacaagcgcagaaaagtaagacgcttcctggaaggagcagggctttcccaggcgatcacatactcattaacaaacgataaaaaagcgacggcttacgcattggaaaaatcgtttaaaacgatcctttcactgccgatgagcgaggaaagaagcgtgctgaggcacagcttgctccctaatctgctcgattcggttgcatacaacttggcaaggcaggccgattcagctgctttttatgaaatcggttctgttttcttgaaagccgaagaacatacgaaaccggtcgaaaaagaacacgtcgccggagccgtgacaggcctgtggcacaaaaacctctggcagggcgagaaaaagccggttgatttcttcgtcgtaaaaggcatcgtcgaaggtctgttggaaaagctcggaatcaccgaaggcatcgaattcgctcaatctgaaagaaaagagcttcatcctgggcggacagccaatattttgcacaacggctcattagtcggcttcatcggccagctgcatccgtcagttgaaaaagagctggacctgagcgacacgtatgtgtttgaactggacctgcacgagctcctccgattggatgtaccggagatcacgtatacaccaattccgaagtatccttctgttacaagggacatcgcgcttgttgtagacaaacaaacaacggccggccagcttgaggacgtcatcaaaacagcaggcggcaaatggctgaaagaagtccatgtctttgacgtctatgaaggcgagcacatggaagaaggcaagaagtccgtcgccttcagcctgcaatatttgaatcctgaacagacattgacagaagaagaagtgacaaaagtccacgaccaagtgctgaaagcgctggaagataaatatcaggctgtattgagaggataa

SEQ ID NO: 1160 - DNA, 1584 bp, Bacillus licheniformis
acggcgtcgaagtcgaagaagtgatcgtccatgaagaaaccgaattcgaaaaatacgaagagccggataacgaagaagacctcgaaatccgtcctcctgtcgtaacgatcatgggtcacgtcgaccacggaaaaacaacgcttctcgacagcatcagaaaaacgaaggtcgttgaaggcgaagccggaggcatcactcagcatatcggcgcttatcagatcgaggaaaacggcaagaagattaccttcctcgacactccgggccacgccgcgtttacaacgatgcgcgcacgcggtgcggaagttacggacattacgattctcgtcgtagctgcagatgacggggtcatgccgcagacggttgaagcgatcaaccatgcgaaagcggctgaagtgccgatcatcgtcgctgtcaacaaaatcgacaaaccgacggcaaaccctgaccgcgtgatgcaggagctgactgaacacggtcttgttcctgaagcatggggaggcgagacgatttttgttcctctttccgcactttcaggagagggaatcgatgagctgatcgaaatgatcctgctcgtcagcgaagtcgaggagctcaaagcaaatccgaaccgcagggcaaaaggaacggtcatcgaagccgagcttgataaaggtaaaggttctgtcgcaacgttgctcgttcaaaacggaacgcttcacgtcggagatccgatcgtcgtcgggaacactttcggacgcgttcgtgcgatggtcaatgatgtcggcagacgcgtgaaatcggcgggaccgtcaactcctgttgagatcaccgggttgaacgaagttccgaacgcaggggatcagttccttgtgttcaaagacgaaaaaacagcccgttccgtcggcgaagcgcgcgctaccaaacagcttgaagaacagcgcagcgataaagcgaagctcagccttgatgacttgtttgaacagattaaacaaggcgatgtcaaagaaattaacctcgtcgtaaaagccgatgttcaaggctctgttgaagcgctggccgcagctttgcaaaaaattgaggtcgaaggcgtcagagtcaaaatcatccacacaggcgtaggtgcgattaccgaatcagacattattttagcttctgcatcaaatgcaatcgtgatcgggtttaatgtcagacctgacggaaatgctaagagtaccgccgaagccgaaaatgtggatatccgcctccaccgcatcatttataaagtcatcgatgagatcgaagcagccatgaaaggcatgcttgatcctgagtatgaagaaaaagtgatcggcatggttgaagtccgtcaaacattcaaagtctctaaaatcggaacgattgccggaggctatgtaacggaaggtacgatcacgcgcgacagcggaatccgcttgatccgcgacggcgtcgtcatctttgaaggggaagtcgatgtgctgaaacgctttaaagatgatgtcaaagaagtttcacaaggctatgaatgtggtatcaccattaagaaatacaacgacatacgcgaaggcgatatgatcgaagcgtatgtcatgcaagaaattgaaagaa

SEQ ID NO: 1161 - DNA, 1530 bp, Bacillus licheniformis
atgaatgagaaacagcgcattgaaagcggacaggtcaatccatcggacaaaaaatccgagaaggattacagcaagtacttcgaagctgtttatgttccgccttcattaaaagatgcgaaaaaacgcggcaaagaagaggttaaataccataacgattttaaaatctcagagcagttcagaggcatgggcgaaggacggaagttttacatccgcacgtacggctgccagatgaatgagcacgataccgaagtgatggcagggattttcatggcgctcggctatgaaccgaccgactcgacggaagatgcaaacgtcattttgctcaacacgtgtgcgatccgggaaaacgcggaaaacaaagtgtttggcgaaatcggccatttaaaagctttgaaaaaagacaatccggatttgatcctcggagtctgcggatgtatgtcccaggaagaatcagtcgtcaaccggattttaaagaaacatccgttcgtcgatctgattttcggtacacacaatatccaccgcttgcccgaacttttgtcagaggcttatctgtcaaaagaaatggtcatcgaagtgtggtctaaagaaggcgatgtcattgaaaaccttccgaaagtccgcaccggcaaaattaaaggctgggtcaacatcatgtacggctgcgacaagttctgtacgtactgcatcgtgccgtacacaagaggaaaagaacgaagcagacgtcctgaagacatcatccaggaagtgagaaggcttgcggctgaaggctacaaagaaatcacgcttctcggacagaacgtcaacgcctacggcaaagattttgaggatatggaatacggactcggccacttgatggatgaactccgcaaaatcgacattccgcgaatccgcttcacgacaagccatccgcgcgattttgacgaccatctgatcgaggtgctcgcaaaaggcggaaaccttctggaccacatccatctgcctgtccagtccggaagctcggatgtcttgaaactgatggcgcgcaaatacgaccgggagcgctatcttgagcttgtcgccaaaattaaaaaagcgatgccgaacgcatccttaacaacggacattatcgtcggcttcccgaacgaaacagacgagcaatttgaagaaacgctctctttatacagagaggttgaatttgacagcgcctatacgttcatctactcgcctcgcgaaggaacgcctgctgccaaaatgaaagacaatgttccgatgcgcgtgaaaaaagaacggcttcagcggttaaatgaagtggtcaacgaaatttccgcgaagaaaatgaaggaatatgaggggcaggttgtcgaagtgttagtagagggtgaaagtaaaaacaaccctgatatccttgccggctatacacggaaaaacaagcttgtcaacttcaaaggaccaaaagaagcgatcggccagcttgtcaacgtgaaaatccaccaggcgaaaacttggtcgcttgacggggaaatggtaggagaagcaatcgaggtgaagtaa

SEQ ID NO: 1162 - DNA, 1691 bp, Bacillus licheniformis
atgagacagagcaggactttaattcctacgctccgcgaagtgccggctgatgctgaagcgaaaagccatcagcttcttctcagagcagggtttatcagacaaaacacaagcggtgtatacagctatatgcctcttgccaataaagtcattcataaaatccagagcattgtccgcgaagaaatggagaaaatcaatgccgtcgaaatgctgatgccggcgctccagcaggcggaaacttggcaggaatcgggaagatggtatacgtacggtcctgagctcatgaggctgaaagaccgccacggccgtgaatttgccctaggcgcaacacacgaagaggtcatcacaagcatcgtcagagatgaagtgaaatcgtacaagcgccttccgctgaccctttaccagatccaatcgaagttccgcgatgaaaagcgcccgcgcttcggtctgttgagaggccgggaattcatcatgaaggatgcgtattccttccattcctccgccgaaagccttgatgaaacgtacaatgatatgtatcaggcgtatacgaatgtgtttacgcgctgcggcctgaatttcagaccggtcattgcagactcaggcgcgatgggcggaaaggatacccatgaatttatggcattgtccgatgtcggtgaggatacaattgcgtattctgatcagtcttcatacgccgccaacattgaaatggctgaagtgaaggaaacagatgccggcgagcaggcagaaatgaaagagctgcaggaagtccacacaccttcggtcaaaacgatcgaagaggttgccgcatttcttggcatatccccgtcagactgcattaaatcaatgctgatgaaagcagacggacgttttgtcctcgtcttgacgagaggggatcacgaagtcaatgatgttaaggtgaaaaacctgcttcaagcagaaataatcgaattcgcgagcgccgaagaggttgcagagataacaggcactgaacccggttttgtcggaccggtggggctcgaccgcgaaatcgaaatctttgcagactttgctgtgaaggcgatggcaaacgcagcagctggagcgaataaaacagattaccattatcaaaacgtgaatatcagccgggatgcgcacaatgtgacattcgccgatctccgctttatccaggaaggagacccttcaccggatggaaaaggaacgatccgttttgcaaaaggaatcgaagtcggacaagtctttaagctcggcacccgctattctgaagcgatggacgccacataccttgatgaaaacggacgcgctcagccgatgctgatgggctgctatggaatcgggatttcccggacgctttcggccatcgttgagcagcatcatgacgataaaggcttgatctggccgctggaagtgacgccgtatgacctgcatatcctcgcgcttaatatgaaaaatgacgcgcaagttcagcttgccgaaaagctgtatgaagaatttaaagcgaacggctatgacgtactgtttgatgaccgtgccgaacgggccggcgttaaatttgcagattccgatttgatcggtctgccgatccgcatcacggtcggaaaaagagctgacgaaggcgttgtcgaagtgaagatccgcaaaaccggagaatcctttgaaatcgctgctgatgagctgtttgactttatcgaaaaaca

SEQ ID NO: 1163 - DNA, 1399 bp, Bacillus licheniformis
ctgtgacactaacattgtataatactctcacacgaaaaaaagagccgtttgtgcctcttgaagaaggcaaggtcaaaatgtatgtgtgcggtccgacagtatataactacatccatatcggaaacgcaaggccggctatcgtgtttgacactgtcagaaagtatttagagtataaaggctatgaagtccaatatgtctccaattttacagatgtcgatgacaaattaattaaagcggcaaatgaacttggagaggaagtgccggtcatcgccgaacgctttattaaggcatacttcgaagatgtcggttcactgggctgcacaaaagctgactgccatccgcgcgtcactgaaaacatggatgagatcatcgactttattcagacgctgatcgataagggctatgcctatgaggcggacggagatgtttattataaaacaagatcgtttgaaggctatggaaagctgtcgcatcaatcggtcgatgagctgagatcaggcgcccgaattcaagtgggcgaaaagaaagaagatgcgctcgattttacactatggaaagcggctaaagataacgaaatctcctgggatagcccttggggaaaaggccgtcccggctggcatatcgagtgctctgcgatggcgagaaaatatctgggcgattcgatcgacattcacgccggcggtcaggatctggccttcccgcatcatgaaaacgaaattgcccaatcggaagcattaacagggaagcctttcgcgaaatattggcttcataacggctacattaatatcgataatgagaaaatgtcaaaatcgctcggcaactttgttcttgtgcatgacattattaaagagcatgacccccaagtgctgcggtttttcatgctgtctgttcattacagacatccgataaactattcggtcgaacttctcgagaacacaaaaaacgcttttggacgtctaaaaacagcttatagcaatttgcagcatcgcctaaaaagcagtacaaatttaacagagggcgattcagaatggcttgaaaaaatcgaagagcagcgaaaagccttccaaacggctatggatgatgatttcaatacagcgaatgccatttccgtcctgtttgacctggccaaacatgccaactactatttgcaggaaaagaatactgcagaacatgtcattcaggcgtttatacagctgtttgacgagatctgctcagtgctcggcttctccctcaaggaacaggaacttttggataaagacattgaagaactgatcgagaagcggaatgaggcccggagaaaccgcgactttgcaacatctgatcagattcgcgaccagttgaaaagcatgaatattatcttggaggacactccgcagggcacgcgctggaaaagaggaga

SEQ ID NO: 1164 - DNA, 1458 bp, Bacillus licheniformis
atgtcactgtttgaccataaaatatctgaattaaaacgtctcatacataataaagagatcagcatatcagatttagtcgatgaatcttacaaacggattcacgaagttgacggaaaggtacaagcctttttgcagcttgatgaagaaaaagcccgcgcatatgccaaagaattggacgaagcgcttgatacccgggatgagcacggtcttcttttcgggatgccgatcggcattaaggacaatatcgtaacaaaagatctgcggacaacgtgcgcaagcaaaattctcgagaattttgatccgatctatgatgcaaccgttgttgagcgtcttcatgaagctgaagcggttaccatcggaaagctgaatatggatgaattcgcgatgggctcttccacagagaactcaggctttaaaaagacaaaaaacccgtggaacctcgaaactgttcctggcggatcaagcggaggctcagcggctgcggttgcggccggggaagtgccgttttcacttggatctgacacgggcggatcgattcgccagccggcatctttctgcggcgtcgtcggcttaaagcctacatacggacgcgtttccagatacggccttgtcgcatttgcatcttcattggatcaaatcggcccgatcacaagatctgtcgaagacaacgcctaccttctgcaggcgatttcaggcgttgacaaaatggattcaacgagcgccaatgtggacgtgcctgactacctgtctgcgctgacaggcgatattaaaggcttaaaaatcgccgttccgaaagaatatctcggcgaaggggtaagcgaagaagcgaagcagtccgtgcttgaagcgctgaaagtgctcgaaagccttggcgcgacatgggaagaggtatcgcttccgcacagcaaatacgcgctggcgacttactacctgctttcttcatctgaagcgtcggcaaacttggcgcgcttcgacggcatccgctacggctaccgcacggacaatgccgacaacctgatcgacctgtacaaacagacgcgttccgaaggattcggaaacgaagtcaaacgccgcatcatgctcggtacgtttgctctgagctccggctattacgacgcatactataaaaaagcgcagaaagtcagaacgctgatcaaaaaggactttgaagacgtatttgcaaactatgacgtcatcatcggaccgacaacgccgacgccggcatttaaaatcggcgaaaaaacgagcgatccgctgaccatgtacgccaacgacatcctgacgattcctgtcaaccttgcgggcgttccgggaatcagcgtaccgtgcggatttgcgaacggcttgccgctcggcctgcaaatcatcggcaaacactttgacgaaagcacagtataccgcgtcgcccacgcattcgaacaggcgacagaccaccataaagcaaaacctgaactgtaa

SEQ ID NO: 1165 - DNA, 1289 bp, Bacillus licheniformis
gtgaaaacaacaataaaccaagtgtacaagcatgttggtgaagaagtaacaatcggcgcttggatcgccaacaaacgttcaagcggcaaaattgcgtttttgcagcttagagacgggacaggctttatccaaggagtcgtcgtcaaagcggaagtggacgaagaaacatttcaaaccgctaagtctgtaacacaggaaacatcattatatgtaaaaggcgtcgtcaaagaagacgagcgttcgcctctcggctacgagcttgctgtgacgtcgcttgaagtcatccatgaagcgacagattatccgattacacctaaagaacacggaacagaatttttgatggatcacagacatttgtggctccgttcaaaacggcagcatgcaacgatgaaaatccgcaacgagattattcgcgctacatacgaatttttcaataaggaaggctttgttaaagtcgatcctccgattttgacgggaagcgcacccgaaggaacgacagagctttttgcgacaaagtattttgacgaagatgcctacctttcgcaaagcggccagctttacatggaagctgctgcaatggctttaggaaaagtcttttcattcggaccgactttcagagctgagaaatcaaaaacgaagcgccatctgatcgaattctggatgatcgagccggaaatggcttttgtcgaattcaacgaaaaccttgaagttcaagagaactatgtctcttttatcgtccaaagcgtgcttgaaaactgcaaaatagaactgaatacgctcggcagagacacttccaagctggagcttatcaaagcgcctttcccaagaatcacgtatgatgaagcaattcagttcttaaaagagaaaggctttgacgatattgaatggggcgatgacttcggcgctcctcacgaaacggcgattgctgaaagctatgacaagccggtatttattacacactatccgacatcattaaagccgttttatatgcagcctgcacctgacagggaagatgtcgtattgtgcgctgacttgattgcgcctgaaggctacggcgagattatcggcggatctgaacggattcatgatctcgagcttctcgaagcgcgcctgaaagagcacggtttagaatcggacgcttatcaatggtatgcagagctgagaaaatacggctcagttccgcattcagggttcggactcggacttgaacggacggttgcctggatctgcggctctccgcacgtccgcgaaacgattccgttcccaagactgttaaatcgcttatatcc

SEQ ID NO: 1166 - DNA, 1566 bp, Bacillus licheniformis
taaaagttcaattcaaagaaggaaatacgaaggaatttccgaaggggataacaataaaacgtattgcagaatccattagtacaactttaagaaagcacgctgttgtagcaaaggttgatgaaaaattcgtggatttaagctatacccttgacaaggatgttaaactcgatatttttactctagattcgaaagaaggtttgtcggtgttaagacatacatccacccatatattggcacacgctgtgaaaaggctttacagtagtgtaagtttgggtattggaccagtaattgaagatgagtttttctatgatttgaaacttgaacacagtttgtctcccgaggatttactagcaattgaacgtgagatggaaaagattattaaggagaatatagaaattaaacgaattgttgtctcttatgaggaagctgaaaagttatttgaagaaaataatgaaccattaaagcttgaaatattaagaggaattccaaaaggccaagaaataactctttaccaacagggagaatttattgatctttgtcgcggtccacaccttccatcaactggtttcattaaagcatttaaattaactcgtgtatctggagcttattggagaggaaatcgccaaaaagaagttcttcaacgagtttatggagtagcttttaaaaagaaagacgatttaaatgaatatctatattttttagaacaagcagcaaaacatgatcatcgacagttaggaaaacaattagatttatttatgttctcagaggaagcaccgggaatgcccttttacctacctaaaggacaaattgttagaaaagaattggagaaattatcccgtgaacttcaaaataatgcatcgtacgatgaggtccatacaccgtttatgatgaattatcgattatgggagaaatccggtcattgggatcattaccaagaaaatatgtacttttctgaggtcgataatacaaagtttgcaatcaaaccaatgaattgtcctggacatatgctaatctttaaaaataatctttactcctatcgagatctacctattcgattggcggaatatggacaagttcatcgacatgaatttagtggttcattaaacggattgcttcgggtacgcacattttgtcaggatgacgctcacatctttgttcgagaagatcaaattgaaagtgaaattaagaaggtatttcatttaattgaccaagtgtatcgtactattggttttgagtattcagtggaactgtctactcggccagatgattcattaggaaataatcacctatgggaggtttctgagggatcattaaaaaatgtgcttgacgatttagcaatcaaatatcaagttaatgaaggtgatggggctttttacggaccaaaaattgatttccatattaaagatgctttaaaacggagtcatcagtgcggaacaatccaacttgattttcagatgcctgaaaaatttgatttgacttatattaatcataataacgaaaaagttcgtcctgttgttatccaccgtgctatttttggttctattgatcgtttttttggaattttat

SEQ ID NO: 1167 - DNA, 1356 bp, Bacillus licheniformis
atggcaaccgctgcatttcatacacttggctgcaaggtcaaccattatgaaacagaaacaatctggcagctttttaaacaagccagctacgaaagaaaacaattacaaagttcggctgacgtatacgttattaatacatgcaccgtgacaaatacgggtgataaaaagagccgccaggtgatcagacgggcgatccgtcaaaatcctgacgccgtcatttgcgtgacagggtgctacgcccaaacttccccggcggaaatcatggctatccccggcgttgatatcctcctcagtacacaagaccgcgaaaaaatgctccgctctattaatcagtaccaggaagaaagacagccgattaacggcgtcagcaatattatgaaagcgagagtgtttgatgagcttgatgttcctgcatttaccgacagaacgcgtgcttctttgaaaattcaagaaggctgcaacaatttctgcacattctgcatcattccgtgggcgcgcggcctgcttcgttcccgcgaccctgaggaagtcatccgccaggcgcagcagctcgttgatgccggctataaagaaatcgttttgaccggtatccataccggcggttatggagaagatatgaaagactacaactttgcgcagctgttgaaagaattggacagccgtgtgaaaggtctgaaaagaatccgtatctcttcaatcgaagcgagccaaattacagacgaagtcatcgaagtgcttgaccgctcagacaagatcgtcagacaccttcacatcccgcttcaatccggctcaaacagcgttttaaagcggatgagaagaaagtatacgatggagtttttcgccgaccggctgacaaaactcaaaaaagctcttccggggcttgcagtcacctctgatgtgattgtcggcttcccgggtgaaacggaagaagaattcatggagacgtataactttatcaaagaacacaagttttccgagctccacgtcttcccgtacagcaaacggaccggaacccctgcagcacgcatggacggccaggttgacgaaaacgtgaaaaacgaaagggttcataaactgatcgctctttcagaccagcttgcgaaagaatatgcatcagactatgaaggcgacgttctggagatcattccggaagagccgttcacggaaacgggcgaaggcaacctgcttgtcggctacacggacaactatattaaagtcgttttcgaaggttcagaagacctgatcggccagcttgttaaagtgaagatcttaaaagccggctatccgtacaacaaaggacagttcgtccgcgtcgcggaagacgacgtccgcgaaaacatccgcttatcgtcataa

SEQ ID NO: 1168 - DNA, 1278 bp, Bacillus licheniformis
atgcttgatgtcaaactgctgcgggcaaattttgaagaaatcaaacaaaagcttgcccacaggggagaagatttatcagattttgatcaatttgaggaattggatacaaagagaagagaattgatcgtcaaagtggaagagctgaaagggaagcgcaatgaggtatctcagcaggttgccgctttaaagcgcgagaaaaaagatgctgaccacctcattaaagaaatgcgcgaagtcggtgaagacattaaaaaacttgatgaagagctgagaacggtcgagtcttcgcttgataaaatcatgttgtctatcccgaacatcccccacgagtctgttccggtcggtgagactgaagacgacaacgtggaagttcgcaaatggggcgaactccctgagttttcgtttgagccgaagcctcattgggatattgccgatcaattggatattctcgattttgaacgggccggcaaggtaacgggaagccgtttcgttttctataaagggctcggcgccagacttgaacgcgcattgtataactttatgcttgatctccacgtagacgagtacggctatacggaagtcatcccgccgtacatggtgaaccgcgcaagcatgacaggcaccggacagctgccgaagtttgaggaagatgcttttaagatcagggaagaagattatttcttaattccgacggcggaagtgccgattacgaacctgcatcgcgatgaaattttgtcagctgacgagctgccgatcaattatgcggcgttcagtgcgtgcttccgttcagaagcaggctctgccggacgtgatacgcgcggtttgattcgccagcaccaatttaacaaggttgaactggtgaaatttgtgaagcctgaggattcatatgaagagcttgaaaaactgacaaatcaagcggagaaggttcttcagctgcttgagcttccttatcgggtgatgagcatgtgtacgggcgatctggggtttaccgctgcgaaaaaatacgatattgaagtatggattccaagccaaaacacatatcgcgaaatttcatcatgcagcaactttgaagctttccaggccagacgggcgaatatcagattcagaagggaagcaaaaggcaagccagagcatgtccatacgctaaacggatccggcttggcagtcggcagaacggttgccgcattattggaaaattatcagcaggaggacggaagcgtcatcatccctaaagcgcttcgtccatacatggggaacagagacgttattcaaccataa

SEQ ID NO: 1169 - DNA, 1377 bp, Bacillus licheniformis
caaaaaaggatcatcagcagaattaaaagtcggacagcaatttccgctgacgatcaagcgcctcggcatcaatggcgaaggcgtcggctacttcaagaaaaaagtcgtcttcgtccccggcgcgctgccgggagaagaagtcgtcgtcgaggcgacaaaggttcatccgaaattttccgaagggcgggtcaaaaaggtgcgcaaacgttcagagcaccgcgtcaagccgccctgcatcatctatgagcaatgcgggggctgccagctccagcatctggcttatgaagagcagctgaaaggaaaacgggacatcgtcattcaatcgctcgaacggcacacccgttttgacatcggcaaaatggacatcaggccgacgatcggcatggaaaacccgtggcactatcggaataaaagccagtttcagctcgggctttcgaaaaacggaaagatggtggccgggctgtacggccttgactcgcaccgtcttgtcccgattacggaatgcattgttcagcatccggcgacgaacaaaacgacgcaaaccgtcaagcaggttcttgaagacttcggcatttccgtctacaacgaacggaagcgcacgggcgatgtccgcacgatcgtgacgagggtcggcttcgagacgggggaagtgcaggttgtccttgtcacgtcaaaagaagacctgccgcgcaaggagctcattgcagaagaaatcaagaagcgtctgcctgaagtgacatctgtgattcaaaacgtcaacaaagccaaaacatcggttgtcttcggcgatgatacaaggctcttagccggcaatatggtcattcaggaatttctcggagaggtttcatttgagctgagcgcccgcgctttttttcagctcaatccgatccagacagtcaagctgtatgacgaagtgaaaaaagcggcaaaactgaccgggcgcgaaaaagtcgtcgacgcatattgcggcgtcggcacgatcggaatgtggatcgccgacggggcaaaagaaatccgcggcatggacgtcatcaaagaatcgattgatgacgccaaccaaaacgccaaaaagcacggaatcgaaaatgcgcgctatgtaacaggaacggccgagcactggctgccgaaatggacaaaagaaggcttcaggcccgacgtcgtcatcgtcgatccgccaagaacaggctgtgaccgcacgttccttgatacgatcaggcaggttaagccgaagcggttcgtttatgtctcatgcaatccgtcaacacttgcgaaagatttgcagtacttggcgaaggattaccatgtagaatacattcagcctgtcgatatgtttccgcagacggcgcacgtcgaatcggtcgtatcgctgaagctgaa

SEQ ID NO: 1170 - DNA, 1420 bp, Bacillus licheniformis
atgagtaatcaagatttgcttttagaaatcggattagaagaaatgccggcgcgcttcatgcatgacagcatgactcagctgggtgagaagctggaaagctggctcaaggaaaaaaatattgccttcggttccgtcaagctgtataactcccctagaagactggccgttcttgtcgagaacgtggcggagaagcaggatgatgtgaaagaagaagcgaaaggaccggcaaagaaaatcgcccttgacgaaaacggcgaatggacaaaggcggccatcggcttttcacgggggcaaggagcaagtccggaagatttgtattttaaagacatcaaaggaacggaatatgtatttgtgcaaaaattccaaaaaggccaggatacgttttcattgcttcctgagctccgcgatttggtgacaagcctccactttccgaaaaacatgcgctggggcagcgaagatttaaaatatatcaggccgattaaatggatcgtcgcgctgttcggaagtgaagtcgttccgttttcagtcgctcatgtcgaaaccggacgcacaacgcagggacaccgcttcctcggaaaagcagccgacttgagcgcaccttctgaatacgaagcgacactggaaagccagtttgtgattgccgatccggccaaacggaagcagctgatcgttaagcagcttgacgaactggctgctgagaagtcctgggacattccgagagacgaggatctgctggatgaggtcaaccatctggttgaatatccaacggtactgttcggttcttacgaagaggaatttctcgcaattcctgaagaggtgctcgtgacaacaatgaaagagcatcagcgttatttccctgtcaaagatgaaaacggcagcttgcttccttactttgtgaccgtccgcaacggagacagccgcgcccttgaaaacgtggcgagagggaatgaaaaagtgctgagagcaaggctttcagacgcttccttcttctataaagaagatcaaaaattaaacattgacgagaatgtgagaaagctcgaaaagatcgttttccatgaagaactggggtcgctcggagataaagtgagacgcactgaggcgcttgctgaacggatcgctgaagtcatcggtgccgatcaagagacggtgcagctgatcaagcgcgctgcgcacatttcaaaattcgaccttgtgacacacatggtttacgaatttcctgagctgcagggcatcatgggtgaaaaatatgcgcggatgctcggtgagaaagaagaagttgcgctcgcagtcaatgagcactatatgccgagacaagccggaggacaaacgccttcatcaatcgccggcgccgtcgtcgcattggcggacaaactcgatacggtcgcttcattcttcaaaatcggcgtcattccgacaggca

SEQ ID NO: 1171 - DNA, 1269 bp, Bacillus licheniformis
atgatgacacacatacttgatgatttgtccttcaggggactgattcagcagcaaaccgatgaagcaggcttgagagaactgctcgataaagagaaaatcagcttatactccggatttgatccgacagctgacagtctgcatatcggccacctgctgccgattttaatgcttcgccgcttccagctggccggacatcgtccgattgcgctcgtaggcggggcgacgggccttatcggcgatccgagcggaaagaaagcggagcgcacgctgaacaatgaagaaatcgtccgcgaatggtcgcagaaaatcaaaaaccagctttcgcgtttccttgattttgaagctgaagagaacccggcgatcatggcgaacaactatgactggatcggcaaaatgaacgtcattgatttcctgcgcgatgtcggcaaaaacttcggaatcaattacatgcttgccaaggatacggtaagctccagaatcgagacaggcatatcttatactgaattcagctacatgatcctgcagtctctcgatttcttgaatttgtacagaaaccaggaatgcaagcttcagatcggcggaagcgaccagtggggcaacatcacatcaggtctcgaactcatccgcaaatccgaagagaatgcaaaagctttcggattgacgattccgcttgtgacaaaagcagacggcacgaagttcggaaaaacggaaggcggcgcgatctggcttgataaagagaaaacgtcggcgtatgagttttatcagttctggatcaataccgacgacagggatgtcgtgaaatacttaaaatacttcactttcttatcaaaagaagaaattgaagatctcgctgaaaaaacagagacggcgcctgaaaaacgcgaagcgcaaaagcgcctcgccgaagaagtgaccgttcttgtacacggccgtgaagcgtttgagcaggccgtcaacatctcaaaagcactgttcagcggagatatcaaacaattgacagctgaagaagtaaaagtcggctttaaaggggttccttccctggaggtcgagaaagcggatgaacttcctcttgttgaaatactcgtccaatcaaagctgtctccgtctaaacggcaggcgcgcgaagatatcacgaatggcgcggtatacgttaacggcgagcgccgcaccgatgttgcggacgtcctcaccgccgacgaccgcatcgaaggacagtttaccgtcattcgccgcggtaaaaagaaatacttcctgctgacttataagtaa

SEQ ID NO: 1172 - DNA, 1257 bp, Bacillus licheniformis
ttaatattccaaggggaacacaagatattctccccggagaatcggaacgctggcaatatgtcgaaaagattgcgagagaaacgtgtcatgcgtatcaatataaagaaatccggacgcctatttttgaacatacagaactattttcccgcggggtgggagaatcgaccgatattgtgcaaaaagaaatgtatacattcgcagacaaaaaaggaagaagcctgacgcttcgtcctgaaggcactgcatctgcagtacgctcttttgtggaaaacaaactttttgcaaatccggttcagccgacgaagctttactacattggaccgatgttccgctatgaaaggccgcagacgggccgctaccgccaattttatcaattcggcatcgaagcgatcggttcgaacgatccggcgattgacgcggaggtcattgctttggcgatgagtgtataccggaaagcgggtctcagcaacctgaagcttgtcattaacagcctcggcgacaaagagagccgaaccgctcacagagaagcgctgatccgccactttgagccgcggatcgacgagttttgttcagactgtcaaaaacggctccggcaaaacccgctgcggattctggactgcaaaaaagacagggatcatgaactgctgaaaacggctccgtcgattcttgactacttaaatgaagaatctaaagcatattttgcaaaggtacagcaatatctgacggacatcggcattgcatttgaggtcgatccgaatctggtgagagggcttgactattacaatcacacggcctttgaaatcatgagcaatgccgaaggcttcggagcgattacgacgcttgccggcggggggcgctatgacggccttaccgaggagttcggcggtccgaaagcgccgggcatcggctttgcgatgagcatcgaacgccttctcgccgcactggatgctgaaaatgtaaaagtcggagcggatgaaggcattgactgctatatcgtgacacttggcgacaaagccaaagactattccgtatcccttctctataaactgagagaagcggggatatccgcggaaatcgactatgaacagaaaaaaatgaaaggccagtttaaatccgccgaccgtctcaatgcgaaatatatcgctgttttgggcgaggatgaactgaaccaaaatcaaattaatgtcaaagatgggaaaacaggagatcaacaggccatcggccttgatgatttcatccgttttttgaaaacaaaca

SEQ ID NO: 1173 - DNA, 1125 bp, Bacillus licheniformis
tgcacagcggagtcgtgacgctgaaaaaatattttgacggacgggttgtgccggagaatccgcgcatctgcaacgctcaaaaatcaatcaggacgaacgatattgagaatgtcgggaaaacagcccgccaccatacgttctttgagatgctcggcaacttttcgatcggcgattatttcaaagaagaagcgatcgagtgggcatgggaatttttaaccgatcaaaaatggatcggcttcgatcccgaacgcctgtcagtcacggtgcatccggaagatgacgaagcgtatgaattatggtcaaaaaaaatcggcatacctgaggaacggatcatcagactggaaggaaacttctgggatatcggcgaaggcccgagcggaccaaataccgaaatcttctatgaccgcggtgaagattatggaaatgatccgtctgatccggagctttacccgggcggggagaacgagcgttacctagaagtatggaaccttgtgttctccgagttcaaccacaatcctgacggaacatacacaccgcttccgaagaaaaacattgataccgggatgggtcttgaacggatggtatctgttattcaagacgccaagacgaactatgatacggatttgtttatgccgatcatcaaggcgacagaagccatttcaggagaaaagtacggcacatctgctgaaaaagatacggcgtttaaggttgtggccgatcatatccggacggctgcgtttgcggtcggcgacggagcgcttccgtcaaacgaggggcgcggctatgtcatcagaaggctgcttcgccgcgctgtccgctatgcgaagtccatcaatatcaaccgtccgtttatgtatgagctcgtaccggtagttgccgacatcatggccgctttctacggcgaagtcaaagaaaaagcggactttatcgcgaaagtcatcaaaacagaggaagaacgcttccatgaaacattgcacgaaggcttggcgattctctcagaagttattcaaaaggaaaaagcaaaaggaaaccgcatcatttccggggaagatgtctttaaactgtatgatacgtatggattccctgttgaactgaccgaagaatacgccgaagatgaaagcattg

SEQ ID NO: 1174 - DNA, 1227 bp, Bacillus licheniformis
ttgatcaactgacaactgccgaaaagcgggaagtcgaaaggcagcttcacttatatatggacggagcggaggaggtcattcccccggaggaactgcgggcaaagctggccaaatcgattttgaccggcgaaccgctgaaaattaagctcggcctcgatccgtctgcgcctgacgtacatttgggccacaccgtcgtcttgaataagcttcgtcagtttcaggaaaacggacatatcgtccagctcctgatcggcgatttcacggggaaaatcggtgatccaacaggaaaatccgccgccaggaaacagctgacggacgaagaggtccgccgcaatgccgaaacatactttcaacagtttggaaaagtgcttgatcagaacaaggtcgagcttcactacaactcaaaatggcttaaacgattaaccttggaagacgtcattgagctcgcgggcaaaattaccgtcgcccgtttaatggaacgcgatgattttgaagaaagaatcgccatgcaaaagccgatttcgcttcatgagttcttttacccgttgatgcaggggtatgattcagtcgttctggacagcgacatcgaactgggcggaacggatcagcattttaacgtgctcatgggcagacactttcaggaaaagtacggaaaagaaaaacaggtcgtcattctcatgccgctgcttgaagggcttgacggcattgaaaaaatgtctaaatcaaagaacaattacatcggcatcgatgaagaccctcatgaaatgttcgggaaaacgatgtctctgccggacagtttgatgaaaaagtatatccatcttgcgaccgacttggaggcggaagaaaaaaaacgtcttgtcaaggatttggaaacgggggccgttcatccgagagacgcgaagatgcttctcgggaaaaccattgtcaacatgtatcatggaagcaaggcggcagaagcggccgaacagcagtttaagaaagtttttcagcaaaacagcgcgccggacaatataacagccgtacactggcaaggtggcggaacggtgccggtcaccgatttattggtgacgctcgaactccttccttccaaaagtgaagcccgccgcatgatccaaaacggcggcgttaaaatcaacggcgccaaagcggaatcgattcatgcggacattgcactcgaacacggcatgatcatccaagtcggcaaacgaaaatttgtcaaattgcaaa

SEQ ID NO: 1175 - DNA, 1092 bp, Bacillus licheniformis
acgggtggtcgtcggaatgtccggaggcgttgattcctctgtggcggctttgcttttgaaagagcagggctatgatgtcatcggaatttttatgaaaaactgggatgacacagatgagaacggtttttgcacagcgacggaagattacgaagatgtcataaaggtatgtaatcaaatcggcataccgtattatgcggtgaattttgaaaagcagtattgggaaaaggtttttcaatatttccttgatgaatataaagcgggcagaacgccgaatccagatgtcatgtgcaataaagaaattaaattcaaagcctttttggagcatgctttgtcgcttggagccgattatttggccaccggccactatgcgcgggtcgaccgtacggacgggcgtgttaaaatgctcagagggcttgatgaaaataaagatcaaacctattttctaaaccagctgacagaagagcaactgagcaaagtgctgtttccgatcgggcagcttcaaaaaagccgcgtcagggaaattgcaaaagaagcggggcttgcgacagctgccaaaaaagacagcacaggcatctgctttatcggggaacggaatttcaaaacgtttctcagccagtaccttccagcacagccgggagatatgcggacgatggaaggcgaatttaaaggccgccacgacggtttaatgtactatacgattggacaaaggcacggcctcggcatcggcggaagcggagagccgtggttcgtcgtcggaaaagaccttgaaaaaaacatcttgtatgtagatcaaggtttcgacaatccgctgcttttctccgataagattacggcgacaaacgtaagctttgtgcataagggcgtcttcggcggcgaagaggagctcgcctgcacggccaaattccgctaccgccaagccgatcatgaagtcactgtcagaatgaccgggacggatgaagcggaggtcgtctttaaagagccggtccgcgccgtgacgccgggacaagcggttgtcttttacaaaggcgaagaatgcctcggcggcggaacgattgatgatgtgtttaaagacggacaacaactttggtatgt

SEQ ID NO: 1176 - DNA, 1066 bp, Bacillus licheniformis
gtgttagaccgtttaaaatcgatagaggaccggtacgaaaaattaaatgaactattaagcgatccggaggttgtcaacgatccgaagaagcttagagaatattcgaaagaacaatctgatttacaggaaacagttgaagtatacagacgttatcgtagcgcgtcggaacagctgagcgatgctaaagcgatgcttgaagaaaagcttgactccgacatgcgcgagatggtgaaagaggagatttccgaactgcaggaagaaatcgagtcgctcacagatcagctgaaggtattgctgatccctaaagatccgaatgatgacaaaaacgttatcatggaaatccgcggcgcagcgggcggagaagaggccgctttatttgccggcaacctttaccgcatgtacagccgctacgcagagctccaaggctggaaaacagaagtgatggaagcgaatatgacaggtacaggcggatataaagagatcatttttatgatcaatgggaacggcgcatactcaaggctgaagtatgagaacggcgcacaccgcgtacagcgcgttccagagaccgaatccggcgggcgcatccatacatccacggcaacggtagcctgcctgcctgaagcggaagaggtagaagtcgatatacatgaaaaagacattcgcgtcgacaccttcgcatcgagcggtccgggagggcaaagcgtcaatacgacgatgtcagccgtccgtctgacccaccttccgacaggtgttgtcgtgtcttgccaggatgagaaatctcagatcaaaaacaaagaaaaagcgatgaaggttctgcgcgcgcgaatttacgacaaatttcagcaggaagctcaggctgaatatgatcaaaaccggaaatccgccgtcggaacaggagaccgctctgagcgcatccgcacgtataactttccgcaaaaccgcgttaccgatcacaggatcggcttgacgatccaaaagctcgaccaaatccttgaaggcaagcttgatgaagtgattgacgccctgattgtagaggatcaggcaagcaagcttcagcaggcggaga

SEQ ID NO: 1177 - DNA, 1021 bp, Bacillus licheniformis
atgaactttgaaacggtaatcggacttgaagtccacgtggagctcaaaacaaaatcgaaaattttctccagttctccaacgccattcggcgcggcggccaacacgcagacaagcgttatcgacttaggctatccaggtgtactgcctgtgttgaacaaagaagccgtcaatttcgcgatgaaagccgcaatggcgctcaactgcgaaattgcgacagatacgaaattcgaccggaaaaactatttctaccccgacaacccgaaagcttatcaaatttcacaatttgataaaccgatcggcgaaaacggctggatcgaaatcgaagtcggcggaaaaacgaagcgcatcggcattacccgccttcatttggaagaggatgcgggaaaactgacgcatacaggcgacggctactcccttgtcgactataaccgccagggaacaccgctcgttgaaatcgtctccgagcccgatatcagaacgcctgaagaagcttacgcctaccttgaaaaactgaaatcaatcattcagtatacaggcgtgtccgattgtaagatggaagaggggtcgctccgctgcgacgccaacatctcgctccgtccgatcggacaagaggagttcggtacaaagacagagctgaaaaacctgaactcattcgcctttgttcaaaaaggccttgagcacgaagaaaaacgccaggcgcaggttcttttgtcaggcggtgtcattcagcaggagacgcgccgctatgatgaagcgtccaaaacgacgattttgatgagggtcaaagagggatctgacgactaccgctacttccctgagcctgatcttgtcgagctttacatagacgacgagtggaagcaacgcgtgaaagacagcattcctgagcttccggacgagcgccgcaagcgctacatcgaagagcttggcctccctgcctatgacgcgaaagtgctgactttgacaaaagaaatgtccgacttcttcgaagcggccgttaaaaaggcgcagacgcgaagctggc

SEQ ID NO: 1178 - DNA, 989 bp, Bacillus licheniformis
atgggaaacgaagttcgggttcgttatgcgccgagcccaacaggccatttacatatcggaaatgccagaaccgctctttttaattatttgtttgcccggagccaaggcggaaaattcatcatccgcattgaagatacggaccgcaagcgcaacattgaaggcggggagcaaagccagctgaactatttaaaatggctgggcatcgactgggatgaaagcgtggatgtcggaggagaatacggaccataccgccaatccgaaagaaacgacatttacaaaacatattacgaggagcttcttgaaaaagggctagcctacaaatgctactgcacggaagaagagcttgagaaagagcgtgaggaacaggctgcccgcggagaaatgccgcgctactccggcaagtgccgcaatttaacaaaagaagagcaggaaaagctcgaagctgaaggaagacagccgagcatccgctttaaagtgcctcaaggtgaagtcatccgctttgatgacatcgtcaaaggagaaatttcttttgaaacagacggaatcggcgacttcgtcatcgtgaagaaagacggaacgcctacttacaactttgccgtagcggtcgatgactatttaatgaaaatgacgcatgtcctgcgcggcgaagaccacatttccaatacgccaaagcagatcatgatttacaacgcccttggctgggatatcccggcatttggacatatgacattaatcgtcaatgaaagccgcaaaaaactgagcaaacgtgatgagtccatcattcagtttatcgagcagtacgaagagctcggctatttgccggaagcattgtttaacttcatcactcttctaggctggtcgccggtcggagaagaagaactgtttacaaaagaacagtttattgagatatttgatgtaaaccgtttgtcaaaatcaccagcggtgtttgatacgcataaactgaaatgggtcaacaaccagtatgtaaa

SEQ ID NO: 1179 - DNA, 1119 bp, Bacillus licheniformis
ttgggaagaccccacatcgactccggttcctgaagaagagctgccgctgatcttgccgaaaacgtcggaaatcaaaccgagcggaacgggtgagtcccctcttgcgaatattaaagaatgggtggaagtgacagattttgttacaggcaaaaagggaagacgcgaaacgaatacgatgccttattgggcgggaagctgctggtacttcctgcgctacattgatccgaagaacccgaacgagctggcttgccctgaaaaattaaaggaatggcttgctgtcgatatgtatatcggaggggcggagcacgccgttcttcacttattgtgtgcgcgcttgtggcataaattgctttatgacatgggggtcggtgcgacgaaagagccggtggaacaggtttataaccaagggatgattgttggcgaaaacaatgaaaaaatgagcaaatccaaaggcaatgtcgtcaatccggacgaaattggggggacgcatggcgcggacacgctccggctgtacgaaatgttcatgggacctttggatgcatcgatcgcctggtcaacgacagggcttgacggagcccgccgcttccttgaccgcgtatggcgtttgtttatcgatgacaatggcgggttaaacgagaagatcgttgaaggagccggcgaaacgcttgagcgcgtctaccatgaaacggtcatgaaagtaacggaccatttcgaaggtctgcgctttaatacaggcatttcacagctgatggtcttcatcaatgaagcatataaagctgatcagcttccgaaagaatacatggaaggcttcgtgaaattgctttctcctgtcgcgcctcatttggctgaagagctctggaaccgcctcggtcatgaggaaacgatcgcgtatgaagcatggcctgtctatgatgaagcgaagctcgtggatgatgaaattgaaatcgtcgttcagctgaacggaaaggtgaaagcgaagctgaacgttccagccgacgcggacaaagaacagcttgaagagctggcgaaaaacaatgaaaaagtaaaagaacagctagaaggaaaaacgatcagaaaagtgatcgctgtgcctggaaagcttgtaaatattgttgcaaa

SEQ ID NO: 1180 - DNA, 1049 bp, Bacillus licheniformis
atgccggaacaatttgcggtgccccgttctgtcgaatgggaagaaacatcggtaaaaatcctgaaccagcaaaagcttcccgaaaagacggagtacctgcatctcacaactaaagaagacatctatgatgcgatccaaacgctaaaagtgaggggagcgcctgccatcggcataacagccgccttcggactcgccctttgcgcacaaagcatcgatacatctgatgtttccgcttttctgcgggagctccgcaaaatcaaagatgaactcaatcaggcaaggccgacagccgtcaatttatcctgggccctcaatcggctgttaaaaagcgcagagggcgcaaaatcggtcaatgaggcaaaaacaaacctcgtccacgaagcgattcagatccaggttgaagacgaagaaacatgccggcagatcggacagaatgctctgcatttgttcaaatcgggcgacagcatcatgaccatctgcaacgccggctcgatcgcgacaagcaggtacggaacggccctttccccgttttaccttgccaaaacaaaggatctcgaccttcatatttacgcctgtgaaacaaggcctgttcttcagggggcgcgcctgacggcgtgggagcttatgcagggggggattgacgtgacgctgattacagacagcatggctgcccatacgatgaaggaaaagaacatttcagccgtcattgtcggagcggacaggatcgcaagaaacggagatacagccaataaaatcggaacgttcggcttggcaatcctcgccaaagcctttcaaatcccgttttttatcgctgctcccctgtcaacttttgatgtctcgatttcatgcggcgacgacattccgattgaagaacgcgatccggatgaagtcagacggataaacggaacgcaaatagcgccgcaagaggtgcctgtgttcaatcctgcttttgatatcacgccgcacgatttaatctctggaatcatcacggaaaaagggattatcacagatagatttgaagaagaaatcgaagcgctgttttccgctga

SEQ ID NO: 1181 - DNA, 975 bp, Bacillus licheniformis
tgtcggtgaagagcagtacgaatggtttaaaagctctgacctcggggacatcgtcggcgttacaggcgtcatgtttaaaacgaatgtaggcgaattgtctgtaaaagcaacatcttttgatttattgacaaaagctcttcgtccgcttccggacaaatatcatggattaaaggacatcgagcagcgctaccgtcagcgttatttggatttgatcgtaaatccggaaagcaaaaatacgtttattacacgaagcaaaatcattcaatccatgagaagatacttagatgaccacggatacttagaagttgaaacgcctacgatgcacgcgattccgggtggcgcatctgcccgtccgttcattacacatcataatgcgctggatatgccgctttacatgaggatcgctatcgagctccatttgaaaaggctgatcgtcggcgggttggaaaaagtctatgaaatcggacgtgtattccgaaatgaaggggtctccacacggcacaatcctgaatttacgatgatcgaactttacgaagcttatgctgactataaggatattatgagattgacggaaaatctcattgctcatattgcacaagaagtgctcggcactacgaccgttcaatatggagattatgaagtcgacctcaagcctgaatggaagagactccatatggtcgatgctgttaaagaagccaccggtgtagacttctggaaagaagtatcggtagaagaagcaagagcatatgccaaagaacacggaattgaaatttctgaaggcatgtcagttggacatatcattaatgaattcttcgagcaaaaagttgaagaaacgttgattcagcctacttttatatacggacaccctgtggagatttctcctctggctaagaaaaatctctgaagacccgtcgatttacggaccgttttgagctgtttatcgtgggccgtgagcacgcagaatgcatttactga

SEQ ID NO: 1182 - DNA, 936 bp, Bacillus licheniformis
atgaaatggtccgaaatctgcattcacacgacacatgaagcggttgagcccatctcgaatattttgcatgaagctggtgcgagtggagtagtgattgaagatccgcttgatttaattaaagagcgtgagaatgtatacggagaaatctaccagctcgatcccaatgattatcctgatgaaggagtcatcatcaaagcgtatcttccgatcaacagctttttgggggagaccgtagaaggaatcaaagaaacgatcaataatctgctgctgtatgatattgaccttggacgcaacaaaatcaccatcagcgaggttaacgaagaagaatgggcgacagcatggaaaaaatattatcatcccgtgaaaatttccgagaagtttacgattgttccgacttgggaagagtacacaccggttcatacggatgaactcatcatcgagatggacccgggaatggcgtttggaacaggcacccacccgacaaccgtcctttgcatacaggcgcttgaaaggtatgtgaaagaaggggattcggtcgtggacgtcggaacgggaaccggcattttgagcattgcttcagccatgcttcgcgccaaacaggttgaaggatatgatctcgatcctgtagccgttgaaagcgcccgcttgaactccaagctcaataaagtcagcgatcatatcgagattaagcaaaataatctgcttgacggcgtcgaaggcgaaaaagacatcatcgtcgccaatatcctggccgaggtcatcttgcgctttacggatcaagcatacagcctgttgaaagacggcggctatttcatcacttcggggatcatccagcagaaaaaacaggaagtcaaagatgcactggtgaaagaaggctttacgatcgttgaggttctttcaatggaggactgggtcagcatcatcgctaaaaaataa

SEQ ID NO: 1183 - DNA, 987 bp, Bacillus licheniformis
ctgccgtcttaccgagcagaacattgaccaacttccgccgccagatcagagcgctcggcttttcgtatgattgggacagagaagtcaacacaacagatccggactactataaatggacgcagtggattttcttaaagctttacgaaaaaggtctcgcttatgtagatgaggtccctgtaaactggtgtcctgcgcttggaaccgttcttgccaatgaagaagtcatcgacggcaaaagcgaacgcggcggacatcctgtagaacgccgtccaatgaagcagtggatgctgaaaattaccgcttatgccgaccgcctgcttgaagacctggaagaactcgactggccggaaagcattaaagaaatgcagcgcaactggatcggccgttctgaaggggcgcatgttcattttgcggtcgacggcaccaatgaaacgtttacggttttcaccacgcggcctgacacattattcggtgcgacatatgccgtgctggctccggagcatgatttggttcaaaaaatcacaacgcctgaacagaaagacgcagtcaacgcctatattgaagaagttcaatcaaagagcgacttggagcggacagaccttgccaaaacaaagacaggcgtcttcacaggtgcatatgcggttaatccggcaaacggagaaaaaattccggtctggattgcggactatgtcttggctacatacgggaccggggcggtcatggccgttcctgcccatgatgagcgggaccatgaatttgcatcagcattcgggctgccgatcaaagaagtcgtcaaatgcggggatgttgataaatgaagcatatacaggcgacggcgaacatatccattcagattttctgaaacggtccttgataaagtggctgcgatcgaaaaaatgatccagtggctttatgtaaacgggaagggcgagaaaaaatttacataccgccttcgctgctggctgttcaccgtcatcgctacctggg

SEQ ID NO: 1184 - DNA, 1005 bp, Bacillus licheniformis
tattggatcagcagttgtttaaactccttgatcaggaggggcagacgctcgtgttaaggcctgatatgacggctccaatcgccagggtggcggcctcaaagcttcataaagacgatcatccgctcagagtaggctatgctgcaaatgtgttccgggcacaggagcgtgaaggaggacgccccgccgaatttgagcaagtcggcgttgaactgatcggcgatggatcgacaagcgctgacgcagaagtgattgcgctcgtcattttttcgcttaaaaatgccggcctgacttcatttaaaatctcgatcggccatgtcggtattttagacgccttgtttgtggaagttttagggaatgaagaaagggctcatgtcctgcggcgctatttatacgaaaagaactatgtcggctatcgggagcatgtaaaatccctcaatttatcctcaattgataaaagcaggctgctggagcttttggagctgaggggcggtattgaaacgtgcagcagggcggcatccatcgtcgattctgaaaaaggaaaacgtgcggttttagaacttgaaacgctatgggagacgctcggcgattatggttgcacagacgacattaagctcgatttaggcatggtcagccatatgagctactataccggtgttttgtttgaaatctatgctgaaaacgtcggctttccgatcggaaacggcggcagatatgatcagcttctcggccgcttcgactcacccgcaccggcaaccggtttcggcatcaggactgacaggctgctggaagcattgaagccggcggaagaacaagaaaagatcgatgtcgtcatcttcagcacagaacagagaaaagaggcaatcagatttgccgaagaagaacgaagaaaaggcaaaaaagtcgtcatgcaggacttagcgggaatcggagatattgatcaaatgacaaagtcttttcaaaacgtgacctattttatcggagccagaaaggaagagaagcatgggt

SEQ ID NO: 1185 - DNA, 867 bp, Bacillus licheniformis
cacaaatggtaaaagagcttcgcgaaaaaacgggcgcaggcatgatggactgcaagaaagcgttaacggaaacggacggcaacatggataaagcgatcgatcgtctaagagaaaaaggaatcgcaaaggctgccaaaaaagctgaccgcatcgcggctgaaggcttgactttgatcaaaaccgacggcaacacaggcgttattcttgaagtgaactctgaaacggacttcgttgcgaaaaacgaaggcttcaaggagcttttgaacgacctggctgaccacattctggctgaaaagcctgaaagcgttgaagctgctatgggtcaaaaaatggctaacggttcaactgtagaagaatacatcacaagcgcggttgctaaaatcggagaaaaaatcacgcttcgccgcttcgctgtcctgacaaaaggcgatgacgctgcattcggcgcatacctgcacatgggcggaaaaatcggcgtattgactgtccttaacggcacaactgacgaagaaacagcaagagacatcgcaatgcacgttgcagctgtaaaccctcgcttcatttcccgcgaccaagtgtcagaagaagaagcgaaccgcgagcgcgaaatcttgactcagcaggcgcttcaagaaggcaagcctgaaaacatcgtcgcaaaaatggttgaaggccgcctgaacaaatatttcgaagaaatctgcctgcttgatcaagcgttcgttaaaaacccggatgaaaaagtgaaacaggtcgttgctgcgaaaaacgcaacggttgaaacgttcgtccgctacgaagttggagaaggtatcgaaaaacgccaagaaaactttgctgaagaagttatgaaccaagtgaaaaaat

SEQ ID NO: 1186 - DNA, 986 bp, Bacillus licheniformis
atgaaaaaaacgattttttccggtatccagccgagcggctctgtcaccctcggcaactatatcggagcgatgaagcagtttgtcgacttgcaggatgactacaactgttacttctgcatcgtcgatcagcacgcgatcacagtaccgcaggaccggctcgcgctgagaaagaacatccggaaccttgccgcgctgtatttggcgatcggcctcgatccgaaaaaagcgacgctgtttatccaatcggaagtgcctgcacacgcccaggcgggatggatgcttcagtgtgtcgcctacatcggcgagcttgagcgcatgacgcagttctctacttatcagccgaaaaagaagctgtcgtctcggggcttttgacatatcctccattaatgcctgcggacattctgctttatgaaacagacgtcgtccctgtcggcgaagatcagaagcagcatcttgaataacccggaacttggcggagcgtttcataagaaatataatgacatttttacggttccggaggttaaaataccgaaggtcggcgcccgcattatgtcacttgccgacccgctcaaaaagatgagcaaatcagatccgaaccaaaaagcgttcatcaccctgctcgacgaaccaaaacagcttgagaaaaaaatcaaaagcgctgtcacggattccgacggaatcgtcaaatatgataaagaaaacaaacccggtgtatccaaccttctgacgatctattcgattctcggacaagcctcaatcgaagagcttgaagcaaaatacgaaggcaaaggctacggcgaatttaaatcagaccttgccgaagtcgtcatcggcgcgctgaaaccgattcaagaccgttaccacgaattgatcgaatctgaagagctggaccggattttggacgaaggcgccgaacgcgcaaatcaaacagcaaacaagatgctaaaaaaaatggaaaacgcgatgggactcggccgaaaaagacg

SEQ ID NO: 1187 - DNA, 798 bp, Bacillus licheniformis
aacacgatgaagaaacgctgaaacaagtgaaagacattttgtcccagcttgttaaaaatgaagtgcgccgtctgattacggaggaaaaagttcgtcctgacggcagggctgtcgatgagatccgcccgctttcttcagaagtcggactgcttccgagaacacacggttcaggactttttacaaggggacagactcaggcgctcagcatttgtacgctcggtgcgcttggcgatgtgcagattttagacggtctcggcgtcgaagaatccaaacgctttatgcaccattacaacttcccgcagttcagcgtcggggaaacagggccgatgcgcgggccgggacgccgcgaaatcgggcacggagccctcggggaacgagcgcttgagccgattgttccgtctgaaaaagacttcccgtacaccatccgcctcgtctctgaagtgcttgaatcaaacggttccacttcccaggcgagcatttgtgcaagcacgctagcgatgatggatgcaggggtgccgattaaagccccggttgccggaatcgcgatgggtcttgtcaaatcaggtgacaactataccgtcttaaccgatattcaaggtatggaagaccatctcggggatatggactttaaagtggcgggaacgtccaaaggcgtcacagctctgcaaatggatattaagatcgaaggcttatcgagagagattttggaagaggctcttcagcaggcgaaaaaaggcagaatggagatccttgaaagcatgctgagcacattggctgaatcaagaaaagagctttctc

SEQ ID NO: 1188 - DNA, 1189 bp, Bacillus licheniformis
atggaggatctctttttgaaggctcttcctctccttcgtgagctgaaaaaacacggctggcaggcctactttgtaggcggagccgtcagggatgcccaaatgaacagagatgtcggcgatattgatatcgctacagatgcatccccggaagaaatcgaagccatttttccgaaaaccgttgatgtcggaaaggaacacggaaccatcatcgtcctctttgagggagaatcctacgaggtgacgacctttcgcgcagagcttgaatatgaggattacagaaggccgagcggcgttcagtttatcaaatcgctgaaggaagacctgaagaggcgggatctgacgattaatgcgatggcgatggatgaagaaggcagactgatcgactatttcggcgggctccgcgacatacgggaaagattgattcaaacggtcggcgacccggcggagcgttttcacgaagatgcgcttcgcatgctgcgggcgctccgttttatgagtcagctcgagtttgagctttctccaaatacaaaaaaagcgatttgcgaaaaccgtccgctcctggcccatatttctacagagcggaaaacggttgaattcgaaaaacttttaaaaggaaaagcagcaggccgggctctggaagcagcggctgaaacagggctttacaaggagcttccggggctggacggcaaaaaggagcgcgttctggctgcccgagcttttcctttttatcaacttcaaaaaagtgccgatatatgggcggctttcattcacatgatatcgatcaatcccgctgaagcgcaccggtttttaaaagggtggaagcttccggggaaagtcatcagacaggcgctccatacggctgaacggatcgatcaaaaatgggatgccgtctcgatgtatgaggcgggggaagagacgctgctggccgcatctgccattcgcagcttgagggacaagcaggcaatcgatgaagagcagctggctgaaatcagacagtcgtaccaggcgcttccgattaaaagcctgaaagacctggcggtatctggaagcgatctgctgaatttcagaaagaagccggccggaaaatgggtgtccgatgatttgaaacggattgagcgggccgtgttaaacggggagcttgccaatcaaaaaaaagccatagaggagtggctggattcatgcagtcaaa

SEQ ID NO: 1189 - DNA, 872 bp, Bacillus licheniformis
atgaataaagatatcgccaccccaattaggactaaggaaattctcaataaatacggattttcattcaaaaaaagcctggggcagaacttcttgattgacacgaacatattggacagaattgtcgaccatgccggtgtgacggagcgtacaggcgtgattgaaatcggtccggggatcggggcattgaccgagcagctggcaaagcgtgcgaagaaagtaacggcctttgagatcgaccaacggcttctgccgattttagaagatacgctttctccgtatgataatgtgactgtcattcaccaggatgtcctgaaggccgatgtccgagcggtaatggacgaacagtttcaagactgcgatgaggtgatggttgtcgccaacctcccgtattacgtcacgactccgatcatcatgaagcttttacaagaaaatctgccgctgaaaggaatcgtcgtcatgcttcaaaaagaggtggcggaccgaatggctgcaaaaccttcttcaaaggaatacgggtccctttccatcacggtgcagttttatacggaggccaaaacggtcatgaatgtaccaaagaccgtatttgaccctcagcctaacgtagattcctcggtcatcaggctgacgctgaggaaagagccggctgtggccgttcaagatgctgcctttttctttcaagtcgtaaaagcaagctttgcacagcgtcgaaaaacgcttttcaacaacctcgtcaacaatctgccgaatggcaaagagaataaatcaaaaattgaaagagcgcttcaggattcacatatcgacggaaaacgacgcggagagtcgcttagcattgaagagttcgcggtcttatctgaccgcttgagagaagtcct

SEQ ID NO: 1190 - DNA, 750 bp, Bacillus licheniformis
  misc_feature (1)...(750): n = A,T,C or G
gaaaaagcgatggaaatccaaaaacgccctcggctcggatattatgatggcgtttgacgaatgcccgccatacccggcagagtacgattatatgaagaagtctgttgaacgcacgagccgctgggcggaaaggtgcctganagctcacaatcgccctgacgagcaggggcttttcggaatcgttcaaggcggcgagtacgaaaatttgagaaaacaaagtgcgaaagacttgatttcattggatttcccgggatatgctataggtggactatccgtcggagagccaaaagacgtgatgaaccgtgtgctggagtttacaactccgctgcttccagcggataaaccgcgctacttaatgggtgtcggttcaccggactcactgattgacggagccatccgcggagtggatatgttcgattgcgtgctgccgacaaggatagcgagaaacggtacgctcatgacgagcgaagggcgcctcgtcgtcaaaaatgcaaaatatgaaagagatttcaggccgattgatgagcagtgcgactgctatacgtgccgcaattactcgcgcgcttatatcagacatttaatccgctgcaacgaaacgtttggaattcgtttaacttcttatcataatctttattttctgttaaaattaatggggcaagtgagagatgccattcgtgaagatcgtttaggtgatttccgggaagagttttttgagcgctacggttttaataaaccaaatgctaaaagttt

SEQ ID NO: 1191 - DNA, 741 bp, Bacillus licheniformis
atgtcagtcatttctatgaagcaattgctcgaagctggtgttcacttcggccaccaaacgcgccgctggaacccaaaaatgaagcgttacatcttcacggagcgtaacggaatctacatcatcgatcttcaaaaaacagtcaaaaaagttgaagaagcatacaacttcacgaaaaaccttgcagctgacggaggaaaaatccttttcgtcggtacgaaaaagcaagctcaagactctgttaaagaagaagcggaacgttctggaatgtactatgtcaaccaacgctggcttggcggtacattaacaaactttgaaacgatccaaaagcgtatcaaacgccttaaagatatcgaaaaaatgcaggaaaacggcacatttgacgtacttcctaaaaaagaagtcgttcaattgaaaaaagaattagagcgtcttgaaaaattcctcggcggaatcaaagaaatgaaagagcttcctgacgcactgttcatcatcgatcctcgcaaagagcgcatcgcggttgcagaagcgcgcaaactgaacattccgatcatcggaatcgttgacacaaactgcgatcctgatgaaatcgatgttgtcatccctgcgaacgatgacgccatccgcgctgttaaattgctgacttctaaaatggcagatgccatccttgaagcaaaacaaggtgaagaatcagctgaaacagaagcgaaagaagcagaaacaactgaaacaacaactgcttaa

SEQ ID NO: 1192 - DNA, 870 bp, Bacillus licheniformis
tgaatattcaagaaatgattctgaccctgcaaaagcattggtccaatgaaggatgcgtacttttgcagtcgtatgatgtagagaagggtgcaggcacgatgagcccatatacatttttgcggagccttgggcctgagccttggaaagtcgcttatgtggagccgtcaaggcgccctgcggacggaagatacggtgacaatccgaacaggctttatcagcaccatcaatttcaggtgatcattaagccgtctccagaccacatccaagagctttatttagattcattaaaagcccttggaatcgaccctctggagcatgatatccgctttgtcgaggataactgggaaaatccgtcgctcggctgcgccgggcttggctgggaagtatggcttgacggcatggaaattacccagttcacctattttcagcaggtcggcgggcttgagtgcaaaccggtttccgtggaaatcacatacggtatcgaacgccttgcttcttatatccaagataaagaaaacgtctttgatcttgaatggacgaacggctatacgataaaagacctgttcaagatggctgaatacgagcattccgtctatacgtttgagacatctgacgtcgacatgctgttcgaattgtttgcaacgtacgaaaaagaagcaaatcgccagatggatcagggacttgtccatcctgcatatgattatgttttgaaatgctcgcatacgttcaacttgcttgacgcaaaaggggcgatttccgtcacggagcgcacaggatatatcgcaagggtgagaaacctggccagaaaagtggcgaaaacgtattatgatgaacgcgaaaagttgggtttcccaatgctgaaggaggaag

SEQ ID NO: 1193 - DNA, 750 bp, Bacillus licheniformis
atgagtcagcagcatgattacgtcataggaaaaaacgcggtcatcgaaacattaaagtccggccgggaattgtataagctgtggatggcggaaaacacagtgaagggacaggctcagcaagtcgtcgatctcgccgccaaaaatggcgtcacgattcattatgtcccaagaaaaaaactcgatcaaatggtttccggacagcatcaaggcgtcgtcgcccaggtagcggcttacgagtatgccgagctggatgatctttttcaaaaggccgaagacagaaatgaacagccgtttatccttgtattagacgaaattgaggatccgcacaacctgggctctattatgcgcaccgcagacgcggtcggggctcacggcatcgtcattccgaaaaggcgcgcggtcggccttacaacgactgtcgccaaagcctcgacaggagccatcgaacatattccggtcgtcaaggtgaccaatctgtcgcggaccctggaagaaatgaagggacggggcatttgggtcgtcggtaccgatgcgtctggacaacaggactacaggtcgctggacggaaatatgccgcttgcgcttgtcatcggcagcgaaggaaaaggcatgggaaggcttgttaaagagaaatgtgattttctcattcgcctgccgatggcgggaaaggtcacatccctgaacgcctcagttgcagccggcctgctgatgtatgaagtgtaccggaaacgaagccctctgggagaatag

SEQ ID NO: 1194 - DNA, 748 bp, Bacillus licheniformis
gtgattgtaacgaatgaccaagagctggaagggctcaagaaaatcggcagaatcgtcgctttagccagggaggaaatgaaggcaaaagcagctcccggcatgagcacaaaagagctggatctcatcggaaaagaagtgcttgaagcccatggcgccgcatcggctccggaaaaagaatacgacttcccgggaacgacgtgcatcagtgtgaacgatgaagtcgcccacggcatcccaagcgaatccagaattttaaaagaaggggatttgatcaacatcgacatctccgctgaatttggcggctactattctgatacgggcatttcttttgtactcggaaaaggcgatgaaatgctgcacaagctttgccaaagtgcggaaagcgcttttcaaaaggggcttttgcaggcgcgcgccggcaagaaacaaaaccaaatcggcagagccgtatacaatgaagcaaaagcaaacggatttaccgtcattaaaaacctgacgggacacgggattggaaggaacctccatgaagcgcccaaccatatcttaaattactatgacccgtttgataatgcgctctttaaaaacggaaccgtcatcgcccttgagccgtttgtttccacaaaagcagaacataccatcgaagccggagacggctggacattcaaaacgcctgacggcagctttgtggcgcagatcgagcatacgatcgtcatcacgaaaaacgaaccgatcattttaacacagcttg

SEQ ID NO: 1195 - DNA, 747 bp, Bacillus licheniformis
atgattatttgtaaaactccccgagaaatcgaaatcatgcgggaggccggacgaattgtcgctttaactcatcaggagctaaaaaagcacattaaacccggcatctcgacaaaagaattggatcaaattgccgaacgttttattacaaagcaaggtgcaatcccatcttttaaagggtataatggttttcgcgggagcatttgcgtttcggtcaacgaagaactcgtgcacggtattccgggaaaacgagtccttcgcgacggggacatcatcagcatcgatatcggtgcgaagctaaacggttatcatggtgactccgcttggacttatccagtgggtacgatcagcgatgatgatcagaagctgctggatgtgacagaggagtctttatatagaggcttgaaggaagcaaaaccgggagaacgtttgtcgaatatttcccacgcaatacaaacgtatgtcgaaagcgaacaattttcagtcgtcagggaatatgtaggacacggggtagggcaggatctgcatgaggatccgcaaattcctcactacggtccgccgaacaaaggcccgcgtttaaagcctggcatggtcttggccattgagccgatggtcaatgcaggtacacgctatgtcaaaacattggctgacaactggacggttgtaactgtggacgggaagaagtgtgctcactttgaacacacgattgccattacggatgccggttttgagatactgacaaaagcctag

SEQ ID NO: 1196 - DNA, 651 bp, Bacillus licheniformis
gtcaaaaggtaaatccagtcggtcttcgtattggggttatacgtgattgggaatctaagtggtacgctggcaaagattacgctgacttccttcacgaagatctgaaaatccgtgaatttattaatcaacgcctgtctgacgcttcagtttctaaagtagaaatcgagcgtgcggcaaaccgtgtaaatattacgatccacacagctaagcctggtatggttatcggtaaaggcggttccgaagtcgaagcgcttcgcaaagcccttaacagccttactggcaagcgtgtacacattaacattcttgaaatcaaaagagctgatcttgatgctcagctagttgctgataacattgctcgtcaattggaaaaccgtatctctttccgtcgtgcgcaaaagcaacaaatccaacgcacaatgcgcgctggtgcacaaggaattaaaacaatggtttccggtcgtcttggcggcgctgacatcgctcgttctgaatactacagtgaaggaactgttccattgcacacacttcgtgcagacatcgactatgctacatctgaagctgacacaacttacggtaagcttggtgtaaaagtctggatctatcgtggagaggttcttcctactaagaagaaaactgaggaaggaggaaaat

SEQ ID NO: 1197 - DNA, 1084 bp, Bacillus licheniformis
atgagatacgatggaagaaaaaacaatgaactgcgccctgtcacaatggacctcgactttattacgcatccggaaggatcggtcctgattacagtcggcgggacaaaggtgatatgcaacgcgtctgtggaagaccgcgtaccgccctttttgagaggagaagggaagggctggatcaccgcggaatacagcatgctgccgcgggccacgaaccaaaggacgatcagggaatcgtcaaaagggaaaatctccgggcggacgatggaaatccaacggctgatcggacgagctcttcgggcggttgttgatttggaaaagctcggtgagcggacgatctggatcgactgcgacgtcattcaggcggacggaggtacgagaactgcgtcgattaccggagcattcaccgccatggcgcttgccgtcggaagactcgtcgaaaaaggcgcgctgaaggagatgccgatcaccgactttttggctgccacttcagtgggcatcgataaggaaaaaggattgatccttgatttgaactaccaggaagattctgcagctgaggttgatatgaacgtcgtcatgacaggcgaaggccgctttgtcgaacttcagggaacaggagaggaagcgacattctcaagaagtgaactggacgggcttttagagctggctgaaaaagggatcgccgaactcctcgaaaagcagaaagaagtgctcggcgacgttgcattatctattcaacaataacatgagaaaggctgatacacgatgaaggaagtcatcattgccacgaaaaacgaagggaaagtcagggaattcaaagcgatgcttgaaccgaggggctacgatgtcaaatctttactggacatcggctatacacccgaaatcgaagaaaccgggcagacttttgaagaaaacgctgtgattaaagcggaaacaatttcgaaagaaaccggaaaaatcgtgattgccgacgactccggcctgtctgtcgactatctcggcggcagccccggcgtatactcggcccgctatgcaggagaagagaaaaacgatctcgccaatctgaaaaagctattgaaagagctcg

SEQ ID NO: 1198 - DNA, 744 bp, Bacillus licheniformis
atgagaatgaagtgcacgatttcatatgacggacaccttttttacggctaccaagtgcagcctgggcaaagaacgattcaggatgagcttgaaaaagcgctgcaaacgctccataaagcgaaggagcgtattcctgtcgtttcatccgggcgcaccgacagcggcgtccacgcagtcggacagacgattcattttgacagtccgctatccattcctgaggcgaaatggccgtatgcattgaatgccctgctgcccgatgatatatcggtccgcaaggcggaagctgtcaatgatcaatttcatgcgaggttttctgcgaaaagaaaagaataccggtatatgatatacaggggcagacatccggacgtttttaaacgctactatgcataccatgttccttatgaccttgatatggagaaagttaaggaagcctcccgctatctggtcggaacccatgacttcacaagcttttgtgcgaccaaaaccgaagtgaaggataaagtcagaacggtccatgaactggaatggtctgacacaggggacggactgcagatgagaattgtgggaagcggatttttgtataacatggttagaatcattgccggtacgcttcttgatgtaggaaccggcaaattttcccctggtgacattgaaaagatgattcttgccaaaaaccgcgatgccgcagggcgcactgcaccggcacacggcttatatttatggcgtgttatctatgacaactaa

SEQ ID NO: 1199 - DNA, 852 bp, Bacillus licheniformis
  misc_feature (1)...(852): n = A,T,C or G
gtcgtctggagatgttctactccctgaatatgcgctatatcgtctctaaatctgtccgtcgctttttggatgacaacggctttcttgatattgaaacgcctgttttaacaaaaagcacgcctgaaggcgcgcgcgactatcttgtaccgagccgggtgcatgaaggggaattttatgcgcttccgcaatctccgcaaatctttaagcagctcttgatggtgtcagggtttgaccgctattatcaaatcgcccgctgcttcagggatgaggacctgcgcgccgaccgtcagcctgagtttacgcaaatcgatatcgaaatgtcatttatgagccaggaagacatcatgaagctctcagaagaaatgatggcgcatgtgatgcgtgaaacgcacggcattgaaatctcgcttccgcttcctagaatgtcgtatgaggatgcaatgaaccgatacggctcagacaaaccggatacgcgcttcggcatgctgttgacggatgtgtcagaagcagtgaaggattcggactttaaagtgttcgcttcggctgtggcgaacggcggagcggtcaaggcgatcaatgtaaaaggagccgctgcaaactactctcgcaaagatatcgatgcgcttggagagttcgctgcaaactatggagcaaaagggctggcttggctgaaaacagaagcggatggacttaaaggaccgattgcgaagttttttgccggcgaaaaacaggaggcacttgttcaggcgcttgacgccgcagacggggatctgcttctctttgtggccgacaagctcgaagtcgccaatgacgcgctgggagcgcttcgtttaaagntgtgtaaagagctaa

SEQ ID NO: 1200 - DNA, 699 bp, Bacillus licheniformis
aaagcgaaagagccatcatggccggcattgtctatacgactgaaaacagactggacaagccgggcgaaaaggtcgaccgcacgatcccgctgaccgttaaaggaaacccgttaaaatacgtctcaagaggcggattaaaacttgaaaaagcattaaaggagtttcagctctccgttcaaggcaagctgatgattgacatcggctcgtccaccggcggctttacagactgtgcgctgcaaaacggcgctctttgctcatatgccgttgatgtcggttataatcagctcgcctggaagctgaggcaggatgagcgggttgttgtgatggaacgcaccaatttccggtattgcacacctgccgattttacggaagggctgccggagttcgcgacggtcgatgtctcttttatctcactgaaaatcatcctccctgtgctgaagaacattttagtgccgggaagcgactgcatcgctctcgtcaaaccgcagtttgaagcagggcgggaatccgtcgggaaaaaagggatcgtccgcgatcccctcgtccataaagctgtgcttgatgacatcagccggtttgcggctcgagaaggatacgactgccgaaacgcctcgttttctccgattaccggcggcgacggcaacatcgaattccttctccatttgcattgggacggagaggcgcaatccggaacgccga

SEQ ID NO: 1201 - DNA, 867 bp, Bacillus licheniformis
atgaaaacaatttttgaagccctcaggtgggcttcttcttatttgacggaagcgggaagagaccggaatgccgcggaaattttgctgacagatcagctgaacatcgaccgcagcaaactgttggcaagcttccatgatgtcatatcagagtctgattttgcgaggtttaaaaaatctgtcgagcttcatcatcaaggagtgcctgttcaatatatcaccggaaaagagtccttttacggaagggaattttcggtaaatgaacacgttctgattccgcgtcctgaaacagaggaagtcgttgaagctgtcctttccgaagcggaaagagtttttcacgggacagatcgtcttaaagctgtcgatgtcggtacaggaagcggggcgattgcagtgacccttgcgcttgagagcccgcgtttttccgtcacggcgacggatatttcggaacaagctttaagtaccgcaagacacaacgctgaccggcttggggcgaaagtggatttcctctgcggtgatttgcttgaaccgcttatcgcgcgacagaagaaagctgatgtcatcgtttcgaatccaccttatatatccgaggaagacatgaggacgctgtcagatgtcgtccgtctccatgaacccgccggggctttaacggacggtgctgacggattgcagttttataagcgtttcatgaaggaaattccatctgtcatcgcagatcaggcactggtggtgtttgaaatcggctggactcaggggaatgccgttaaagacatgtttcaccggttctttcctgatgctgacgtgcgggtgaagaaagatcttaatggaaaagaccgcatcgtctgcgcggtaattgaacaacatagttaa

SEQ ID NO: 1202 - DNA, 810 bp, Bacillus licheniformis
aaaagagaggcgaaagcatcgaagacctgtcattcaatactggatcgcaaacgagaaagttaaagtgaatcataaatcggtgaatcataacgttcggctggagagcggagacagcgtgatgatcgatctcagagaggaggaagaaagcggaatcgtccctgaatacggggaacttcccgtcctgtttgaagatgatcacatgcttattgtcaataagccggcgggaatggcgactcatccgaatgaagccggccagaccggcacgctgagcaaccttgtggcgttttattttcaaatgaacggggaggagcgaaaagtccggcacgtccaccgtctggacaaggatacgagcggcgctgtcgtttttgcaaagcaccgcctcgcccacgcgcttttagacgaacagctgcaaagaaaagaactggcgcggacatatgtagccgtagcggaagggaaattcagaaaaaaaacgggaaccatttcggcgccaatcggcagagacaagcaccaccccgtcagaagaagggtgtcccattccggacagcccgctgtcacccattttgaatcgaaaggatatgacagccgtcacgatgttacactgtgcagacttcagctggagacaggccgaacccaccaaatacgcgttcaccttgcaagcatcggtcatcctttgtcaggcgacaccttatacggcggttcaaaggggctttttcagagacaggctcttcacgcaatcgagatcaatgtcacccatccgatcacaaaagaacgtgtcactgtcgcggcaccgcttccggatgatttaaaaga

SEQ ID NO: 1203 - DNA, 533 bp, Bacillus licheniformis
atggaaaccctttatacagaaagattgactttgagaaagatggaattggaggatgcagatgtcctctgtcaatactggtcagacccggaagtcacaaaatatatgaatatcgcgccttttacagacgtctcacaagcgcgggacatgatccaaatgatcaatgatttaagccttgaagggcaggcaaaccgcttttcgattattgcaaaggaaacgggtgaagtcatcgggacatgcggctttaatatgatcgaccaggaaaacggcagagctgaaatcggctatgacttaggaagaaatcattggggaaaaggctttgcttccgaagctgtcaaaaaactgatcgactacggctttacaagcttgaacctcaaccgaatcgaagcgaaggtagagcccgaaaacacgccttcaatcaaacttctcaactcgttatcctttcaaaaggaaggactgttaagagaatacgagaaagcaaaaggaagactgattgacgtatacatgttttcactgctgaaaagagaatacgctgg

SEQ ID NO: 1204 - DNA, 634 bp, Bacillus licheniformis
atgtataacggagtccttctattacataaaccggtcggcatgacctcgcacgactgcgtcatgaagatccgcaaactgctgaaaacaaaaaaggtcggccataccggtacactggatcccgaggtgtcgggcgttctcccgatctgcgtcgggagggcaaccaaaatcgtcgagtatttgaccgaaaagtccaaaacatatgatgcagaggtcacgcttggctgttccacggagacagaggatcagacgggggaagtcacagaaaagaaacccgtcttagcgccgcctgatgaacagaccgtgcagagcgtcctgagatctcttgaaggaacgattgagcaggttccgccgatgtattcagctgtcaaggtaggcggcaaaaagctgtatgaatacgcgcgggctggaatcgaggttgaacggccgaagcggaccatcaccatccatcatatcgaactgacatccgagatccgccatgagggggataaagcccgcttccggtttgttgtgacatgttcaaaaggcacatatgtcaggaccttggcggtaaccatcggggagaagctcggatatcccgcgcatatgtccaatctggtcaggaccgcgtcaggccctttcacccttgacgaatgct

SEQ ID NO: 1205 - DNA, 723 bp, Bacillus licheniformis
  misc_feature (1)...(723): n = A,T,C or G
gatcttcaaaaaaggggacgagctgttcattcagtttcttccggaaaaaatgagcgaatcttgcaagccggaagaagtgccgcttcatatnttgttcgaagatgaccatgtcttcgtcttaaatacacagccatgcatttcgtcgattccttcgcgtgagcatccatcaggcagtgtggcgaacggtttgattcattattaccagcggacgggcgtacacgcgaccgttcacctggtgagcaggcttgaccgcgatacatcgggtgtcatgcttgttgccaagcaccgcttcgcccactcgcttttatcggggctgcaaaaaaagggagccgtcaaacggcaatatcgagcggtcgtccacggtttgatcgcggaagagcagggaacgatagatgcgccgatcgggagaaaatcatcgagcatcatcgagcgggcggtaatcccggacgggcaaaaagcagtgacgcatttttgggtgaacaggcgtttcagcggcatgacggatgtctctatccgtctggaaaccgggcgaacccatcagatccgcgtccatatgagtcatatcggatatcccttgtgcggtgatacgctgtacgggggaacccgcggcttcatcaatcggcaggcgctccacagtgagaggctgacattttttcatccgttcacaatggaagagctgacgttccaagcgccggtgccgaatgatatgagacagttgataga

SEQ ID NO: 1206 - DNA, 567 bp, Bacillus licheniformis
atgcttgtgtttgcaggattgggcaatccgggtaaaacatatgaaaatacgagacacaatgtaggttttatgacgattgacgagctctcgaaagagtggaacattccgcttgataaaacaaagttcaacggacaatacggaatcgggtttgtttccggcaaaaaggttctacttgttaagccgcttacatatatgaatttatcgggagaatgtttgaggccgcttttggactattacgagatccctgttgacaatttgaaagtgatttacgatgatttggatcttccgaccggaagaatccgtctgaggacgaaaggaagcgcaggaggccataacggcatcaaatcgacgattcagcatctgggaacaagtgagtttaaccggatcagaatcggaataggccgtccggtaaacggcatgaaagtcgtcgattatgtgcttggcgcttttacagatgaagaagagccggcgataaaagaggccgtcagacaatcggccaaggcctgtgaagcttctttggaaaaaccttttttagaagtcatgaatgaatttaacgcaaaggtataa

SEQ ID NO: 1207 - DNA, 612 bp, Bacillus licheniformis
cggtactacgcggatgatccccgatccattacgccattctggaaggcaaagagaaaacaggcgtgacgatcatgtacatggtcgaaaaattggatgcaggcgatatgctcgccaaggttgaagttgacatcgaagaaacagataatgtcggcacgctccacgataagctgagcaaggccggagctgcgcttctttccgaaacggttccgagaatcattgacggttcggtaaccccggaaaaacaggatgaacagaaagcgacatacgcgccgaacattaaacgcgagcaggaactgatcgactggtctaagcccggcgaagtcctgtacaaccaagtcagaggcttgaatccttggcctgtcgcatacacggtcttaaacggccagacgctgaaagtatgggccgcgaaaaaatgccaagccttaaaacaggcagagccgggggagatcgtcaccgttgaaaaagacggcattgtcgtcgcaaccggaaatgacaccgcgttaaaattaacggaagtgcagcctgccggcaaaaaaagaatgaaggctgaagattttgtcaggggagcgggtcttcaagccggaatgaaattgggtcatgacgatgaaaaat

SEQ ID NO: 1208 - DNA, 671 bp, Bacillus licheniformis
atgggacaagagaaacatgtcttttccatagattgggccggccgcaagctcacagtagaaaccggccagcttgcaaaacaagcaaacggagctgtcatggtgcgttatggagacactgcagtgctcagcaccgcaacggcttcaaaagaacctaaaaccgtagactttttcccgttaaccgtaaattacgaagaaagactttacgccgtcggaaagattccgggcgggtttattaaaagagagggaagaccgagcgaaaaagcgattctcgccagccggttaatcgacaggccgatccgcccgctgttcgcagacggcttccggaatgaagttcaagtcgtcagcatcgtcatgagcgttgaccaggattgttcgtcagaaatggcggcaatgtttggatcatctcttgcgctgtgcgtatccgacatcccgtttgaagggccgatcgccggagtgacggtaggccgggttgacaacaaattcatcatcaatccgacacttgaacagcttgaaaaagcgacattcatctcgtcgtagcgggaacgaaggacgcgatcaacatggttgaagcgggagcagacgaagttccgggagagatcatgcttaagcgatcatgttcggtcacgaggagatcaagcgcgcgatgccttccaggaggaaatagtcgccgc

SEQ ID NO: 1209 - DNA, 645 bp, Bacillus licheniformis
ttatcctgtggcgcttgagctgattagacaggccggcgttccggtggctgccccgagcgcaaatctgtccggaaaaccgagtccgacgaaagccgagcatgtcgtcaacgatttgaatggacggattgcgggtgtcgttgacggcggccctacaggagtaggggttgaatcaacagttgtttcatgcaccggtgaaattccggtcattttgaggccgggcggcgtcacaaaagagcagctcgaagaagcggccggccccgtcttgattgaccagggcctcaccgacgaaaaaaaggcgcctatgtctcccgggatgaaatatacgcattatgcaccggaagcacctcttgctattgtgaacgggggagttgaggatattcaacggctgatcgaccaatatcagaaagacgggatgaaagtcggtgtccttacgacagaggaacgggccgatgtctatcaggccgatgccgtccgcatctgcggcagaagagaccgacttgaaacggttgccgccggtttgtatgacgttctccgcagctttgatgaagaacgtctcgattttatttttgcggagtcttttcctgaggaaggagtgggccgggcgattatgaaccggctgttgaaagcggccggccaccgcgtaat

SEQ ID NO: 1210 - DNA, 756 bp, Bacillus licheniformis
  misc_feature (1)...(756): n = A,T,C or G
aaaaggtttttgcccacgggtggctgctgatgaaagatggaaaaatgtctaaatcaaaaggcaatgtggttgacccggtcacattaatcgacagatacggactagatgcattgcgttattatcttctccgcgaagtgccgttcggttctgacggcgtatttacaccggaaggatttgtcgagcggattaactatgatttagcgaatgatttaggcaacctgctgaacagaacggtcgccatggtcaacaaatactttgacggccggattcagtcgtatgaaggcccggttaccgcttttgacgaaccgttgtcatcattctcgcaaaagacaattgaagcgtacgagcaggcgatcgaaaatatggagttttccgttgcgctttcatcattgtggcagtttgtcagcagaacgaataaatacatcgacgagacagccccttgggtactggcaaaagataaggataaagaaaaagagcttcaatcggtcatgtaccatttggcggagtcattgcgcatcactgctgtattgctgcagccgttcttaacgcagacgcctgaaaagattttcgcacagcttggcgttacggatgcgtcactgaaaacctgngacagcattcaaagcttcngccagctgaaatctgtgacagttcaaaaaggagaaccattgttcccgcgtcttgaagcggaagacgaagtcgcttatatcaaatcaaaaatgcagggaacggcttcaaaagaagaacccaagcaggaag

SEQ ID NO: 1211 - DNA, 558 bp, Bacillus licheniformis
atgttgatcacaatggaaaacattgtccgcgacggtcatcctgctttgagaaccgtcgccgaagaagttcaattgccagcaagcgaagaagaaatcaaacagctgagcgaaatgatcgagtttgtcaaaaacagccaggaccccgaaatcgctaaaaagtacaaccttcgtcctggtgtcggtctagccgctccgcaaattaatatcaataaacgaatgatcgccgttcatgccgaaagcgaagacgggacactatacagctatgcgcttttcaatccgaagatcgtcagccactctgttcaaagatgctatttgacaagcggcgagggctgcctgtccgtcgacgagccgattcccggatatgttccgcgctatgaacggatccgagtcaaaggaacgacgcttgaaggcgaaaacatcgacatccgcttaaaaggatatccggcgatcgtattccagcatgagatcgatcatttgaacggcattatgttttacgaccacatcgacaaagaaaacccgctgaaacaacctgaaaatgcaacgcctgtaggcaggtaa

SEQ ID NO: 1212 - DNA, 561 bp, Bacillus licheniformis
atggagttcaacgtcagaggagaaaatattgaggtaacaccagcgttaagagaacacgtcgagaagaagattggaaagcttgagcgttattttgaaaataacgttgatgcgattgttcacgtcaacttaaaattctacaatgatcaggaatcaaaggtggaagtgacaattccaatgacagacctctctctccgtgcggaagttcaccacgaagatatgtacaatgcaatcgatctcgcaacgaacaaactggaacgtcaaatacgcaagcataaaacaaaagttaaccggaaattccgcgaaaaaggttcttcgaagcatgtttttgcagaaggaaacggcatcggaacggccgtgcaggaagacattgaggatgaacagccgcaggttgtccgtcaaaagcgctttaatttaaagccgatggataatgaagaagcgattttacaaatgaatatgcttggacacagcttctttgtattcacgaacgccgaaaccaatctgaccaatgtggtctaccgaagaaacgatggaaaatacggtttgatcgagccgaacgaataa

SEQ ID NO: 1213 - DNA, 471 bp, Bacillus licheniformis
atgccacgtaaaggtcctgtagcaaaaagagacgttttacctgatccgctttacaactctaaactggttactcgtttgatcaacaaaatgatgatcgacggtaaaaaaggtaaagctcaaacaatcctatacaagtcattcgatattattaaagaacgtaccggcaacgatgcaatggaggttttcgaacaagcattgaagaacatcatgccagtgcttgaagttaaagcacgccgcgtaggtggtgcgaactaccaagtacctgtagaggttcgtcctgaacgccgtacgactcttggacttcgctggttagtaaactacgctcgtcttcgcggagaaaaaacgatggaagagcgtttagctaacgaaatccttgatgcagctaacaacactggtgctgctgttaagaaacgtgaagatactcataagatggctgaagcaaacaaagcgttcgctcactatcgctggtaa

SEQ ID NO: 1214 - DNA, 549 bp, Bacillus licheniformis
gtgggcatttcgcttgagaaaccggacgtttacttttatcagcgacagcggagttttttcaaaaagagaagtggactttggctcaaggctgctgattgaagctttccgggaaccggatgcagaaggtgattttttggatgtaggctgcggctatggcccgattggtctttcgcttgctgcggatttcgaagatcgaatggttcacatgatcgatgttaatgaaagagctgtcgaactttcgaaggaaaacgcgttaaataatcagatcgacaacataaagatctaccagagtgatctgtttgccaacgtcgaacctgcaaaaaaattcgcttctattattactaatccccccatacgcgccgggaaaaaaactgtgcacgccatctttgaaaaaagcgctgaacatttgcggccttcaggagagctgtgggtcgtcattcagaaaaaacaaggcgggccttctgccattgaaaaattaaaagaactttttgcggacgttgaagtcgttcaaaaaaagaaagcgtactatatcatcaaagcaaaaaaagt

SEQ ID NO: 1215 - DNA, 535 bp, Bacillus licheniformis
  misc_feature (1)...(535): n = A,T,C or G
atgcaggaagagctgaaacggcttgaaaaagaagcggttgaaaaagtggaagccgctggttcattaaaagaagtcaacgatgtccgcgttgcgtatctgggaaaaaagggaccgatcacagaagtgcttcggggaatgggaaagctgtccgctgaagaaaggccgaaaatgggggccttggcgaacgaagtaagagagaaaatcgccgcggcgatcgccgaaaaaaatgcccgccttgaggaagaagacgtgaaaaggaagctgaaagagcagacgattgacgtgacgcttccgggaagccctgtgaaaacaggagcgcggcatccgctgacgatcgttattgaagaaatcgaagacttgtttatcagcatgggatattcagtggaagaagggcctgaagtggaaaccgactattataacttcgaagcgctcaaccttccgaaagagcacccggcccgggatatgcaagacagcttttatattacgggagatacgctgatgagaacacagacgtctnctgttcagacgcgcacga

SEQ ID NO: 1216 - DNA, 495 bp, Bacillus licheniformis
gcagcgcaattgaaacaaaaaaagttgttgttgaagaaattacttctaaactgaaagaaagtaaatcaacgatcatcgttgactatcgcggccttaacgtagctgaagtaacagaacttcgtaaacagcttcgcgaagctaacgttgagttcaaagtgtacaaaaacacgatgactcgccgtgcggttgaacaagctgaacttgatggtttgaacgatttcttaacaggaccgaatgcgattgcattcagcactgaagatgttgtcgctccagctaaagttcttaacgagtttgctaaaaagcacgaagctcttgaaatcaaagcgggcgtaatcgaaggcaaagtgtccacagttgaagaagtgaaagctcttgctgaacttccatctcgcgaaggcttgctttctatgttgcttagcgtacttcaagctccagttcgcaatcttgctcttgcaactaaagctgttgcagaacaaaaggaagaacaaggcgctt

SEQ ID NO: 1217 - DNA, 1479 bp, Bacillus licheniformis
atgggtcacgtcgaccacggaaaaacaacgcttctcgacagcatcagaaaaacgaaggtcgttgaaggcgaagccggaggcatcactcagcatatcggcgcttatcagatcgaggaaaacggcaagaagattaccttcctcgacactccgggccacgccgcgtttacaacgatgcgcgcacgcggtgcggaagttacggacattacgattctcgtcgtagctgcagatgacggggtcatgccgcagacggttgaagcgatcaaccatgcgaaagcggctgaagtgccgatcatcgtcgctgtcaacaaaatcgacaaaccgacggcaaaccctgaccgcgtgatgcaggagctgactgaacacggtcttgttcctgaagcatggggaggcgagacgatttttgttcctctttccgcactttcaggagagggaatcgatgagctgatcgaaatgatcctgctcgtcagcgaagtcgaggagctcaaagcaaatccgaaccgcagggcaaaaggaacggtcatcgaagccgagcttgataaaggtaaaggttctgtcgcaacgttgctcgttcaaaacggaacgcttcacgtcggagatccgatcgtcgtcgggaacactttcggacgcgttcgtgcgatggtcaatgatgtcggcagacgcgtgaaatcggcgggaccgtcaactcctgttgagatcaccgggttgaacgaagttccgaacgcaggggatcagttccttgtgttcaaagacgaaaaaacagcccgttccgtcggcgaagcgcgcgctaccaaacagcttgaagaacagcgcagcgataaagcgaagctcagccttgatgacttgtttgaacagattaaacaaggcgatgtcaaagaaattaacctcgtcgtaaaagccgatgttcaaggctctgttgaagcgctggccgcagctttgcaaaaaattgaggtcgaaggcgtcagagtcaaaatcatccacacaggcgtaggtgcgattaccgaatcagacattattttagcttctgcatcaaatgcaatcgtgatcgggtttaatgtcagacctgacggaaatgctaagagtaccgccgaagccgaaaatgtggatatccgcctccaccgcatcatttataaagtcatcgatgagatcgaagcagccatgaaaggcatgcttgatcctgagtatgaagaaaaagtgatcggcatggttgaagtccgtcaaacattcaaagtctctaaaatcggaacgattgccggaggctatgtaacggaaggtacgatcacgcgcgacagcggaatccgcttgatccgcgacggcgtcgtcatctttgaaggggaagtcgatgtgctgaaacgctttaaagatgatgtcaaagaagtttcacaaggctatgaatgtggtatcaccattaagaaatacaacgacatacgcgaaggcgatatgatcgaagcgtatgtcatgcaagaaattgaaagaaagtga

SEQ ID NO: 1218 - DNA, 447 bp, Bacillus licheniformis
ttgccaacaaaccagaaaaaggacacgttgcaaaagcggaaactgctcctaagcgcttcgttaaggaattacgcggagtggatatggatgcgtatgaagttggtcaggaagtcaaagttgatattttctctaacggagaaatcgtagatgtaacaggaacatcgaaaggtaaaggtttccaaggcgctatcaaacgccacggacaatctcgcggaccaatgtctcacggttcacgctaccaccgccgtcctggttcaatgggaccggtagaccctaaccgtgtattcaaaggaaagctgttgcctggacgtatgggcggagagcaaatcactgttcaaaaccttgaaatcgtaaaagtagatgcagagcgcaaccttcttttagttaaaggtaacgttcctggtgccaaaaaatcactagtcactgttaaaagtgctgttaaatcta

SEQ ID NO: 1219 - DNA, 438 bp, Bacillus licheniformis
atgcgtacaacacctatggctaacgcaagtaatattgaacgcaagtggttagttgttgatgctgctggcaagacgctaggacgtctttctactgaagttgcatctatccttcgcggaaaacataaaccaacttacacaccacacgttgacactggagatcatgtgatcatcatcaacgctgaaaaaatcgagttaactggtaaaaagttaacggacaaaatctactaccgtcacactcaacatccaggcggtttaaaatcaagaactgctcttgaaatgcgtacaaactaccctgagaaaatgcttgaacttgcgatcaaaggcatgcttccaaaaggttctctaggtcgtcaaatgttcaaaaaattgaatgtataccgtggttctgagcatccacaccaagcacaaaaacctgaagtttacgaacttcgcggttaa

SEQ ID NO: 1220 - DNA, 435 bp, Bacillus licheniformis
atgttaatgccaaaacgcgttaaatatcgcagagagcatcgcggaaaaatgcgcggacgtgcgaaaggcggcactgaagtgcatttcggtgaatacggtatccaagctcaagaatcttcttggatcacaaaccgccaaatcgaagcagcacgtattgcgatgactcgttacatgaaacgtggcggtaaagtttggatcaaaattttcccttctaagccttatacagctaagcctctagaggttcggatgggttccggtaaaggtgctcctgaaggatgggtagctgtagtcacaccgggcaaagtaatatttgaaatatctggtgtgtctgaggaagtcgctcgcgaagctcttcgtcttgcatctcacaaattgccaattaaaacgaagttcgtaaaacgtgaagaaattggtggtgaatcaaatgaaagctaa

SEQ ID NO: 1221 - DNA, 441 bp, Bacillus licheniformis
atgaaacttcatgaattaaagcccgcagaaggttcacgtaaaacgcgcaaccgcgtaggtcgtggtattggttctggtaacggtaaaacagctggtaaaggtcataaaggtcaaaacgctcgttctggcggcggtgtacgtcctggattcgagggtggacaaatgcctttattccaacgtcttcctaaacgcggtttcacaaacatcaaccgcaaggaattcgctgtggtcaacctagacaaactcaacagctttgcagaagggacggaagttactcctgaacttcttttagaaacaggtgtaatcagcaagttgaaatctggagtgaaaattcttggcgacggtaaattagaaaagaaattaactgttaaagccaataaattctccgcttctgctaaacaagcaattgaggctgctggcggtacagctgaagtgatctaa

SEQ ID NO: 1222 - DNA, 473 bp, Bacillus licheniformis
atgaaagtagaattattcgattttgacttgcctgaacgcctcatcgcacaggttcctttaaaagagcgggatgcgtccaggctgatggtgctggataaaaaaacaggggagatcactcacagcacgtttaagcacgtgattgattttctgaacgcgggcgattgcatcgttctgaacgatacgagggtgctgccggcccgcttgtacggagtcaaggaagagacgggagcaaaggttgaagttcttctgttaaaacaggaggaaggggacgtctgggaaacgcttgtcaagcccgcaaagcgggtcaagcgcggaactgttctttcgttcggtgacggccgtctaacggcggtctgcacagaagagctcgagcacggcggcagaaaaattgaattccgctatgaagggattttttgcgaggtgctcgagtcgctcggtgaaatgcctgtgcctccttatattaaagaacagct

SEQ ID NO: 1223 - DNA, 505 bp, Bacillus licheniformis
atgaaatacggtattgtgctatttccatcaaaaaaacttcaggacattgcaaattcctaccgaaaacgctatgacccgaattacgctttaattccgccccaccttacattaagaacgccttttgaagtgtctgaagacgagatctcaggcgtcgtccgacacttgagagagctttcaaaagagctgaaaccggtcacgctgaagattacaaaattcagttcctttgcccccgtcaataatgtcatttacatgaaagccgaaccgacagaggaattgatgcagcttcatgaaaaaatgtacagcggcgttttggaagacaaacccgaatacgcgtttgttccccatgtcacagtcgcacaaaagctgtcagatgatgagcattccgacgtcctcggcacgctgaaaatgagagacgcgtcacacgaagaagtcatcgaccgctttcacctgctttaccaattggacaacggatcatggaccgtctatgaaacttttattttaggag

SEQ ID NO: 1224 - DNA, 381 bp, Bacillus licheniformis
tgcgtctgacatctatctgattgttgaagaaggattctacaagcgtaccttggatattcaccgaacactagggttgctcttgcacactcaagtctcgattcagcaattgcttaagctgccagcggaatgctttcatcctaaaccaaaagtaaacagtgtcttaataaaacttacccgccataccacagatgttccagataaatattggaagctatatacgtactttgtttcaaaatgggtcaatcgagaatatcgtcaactgtttactaaaaatcagtttcatcaagcaatgaaacacgccaaagtaaacaatttaagtaccgttacttatgagcaagtattgtctatttttaatagttatctattatttaacgggaggaa

SEQ ID NO: 1225 - DNA, 710 bp, Bacillus licheniformis
atgagattggataaactgttgtcaaacagcggctatggttcgagaaaagaagtcaaaaaaatgctgaaaaacggcgcggtgcgcgtcaatgatcaattagtcaaagacgccaaaaagcacgttgacccggaatcagacgacatcacggtatacggggcacccgtcatgtaccgggaatttatttacttaatgatgaacaagccgcaaggagtgctgtcagcaacagaagacagccggcaggaaacggttgtcgatttgctcgacccggagctgctgaggtttgagccgtttcctgtcggaaggcttgacaaggatactgagggactgctgcttctgacgaatgacggacagttggcacaccagcttttatctccgaaaaaacacgtacctaaaacgtatgaagtccatgtcaataagccgattgatcaagcggcacttgatcagcttgaaaaaggggtcgatatcggtgaaggatatgtcacgaaacctgctgaagcatcgcttctggcaagcgaaaacggcgtagaacgcctgcttttgacaataacggaaggaaaatttcatcaggtgaaaagaatgctgaaggcggtcggccatgacgtcatctatttaaagcggctgaaaatgggggatgtcgatctcgatgaagagctattgccaggggaatacagggagctctctgaacacgagcttgccgcattgcaaaacaa

SEQ ID NO: 1226 - DNA, 396 bp, Bacillus licheniformis
atggctgctgcacgtaaaacaaacacgcgtaaacgtcgcgtgaaaaagaatattgaatctggaattgctcatatccgttcaactttcaacaacacgattgttactatcacagatgttcatggcaatgctctttcttggtcaagtgccggagctttaggatttaaaggttctaaaaaatccactccattcgctgcacaaatggctgctgaaacagctgctaaaggttctatcgaacatggacttaaaactcttgaagttactgtaaaaggaccaggttccggccgtgaagctgcaattcgtgcacttcaagctgctggactagaagttacagcgatcagagacgtaacgcctgttcctcataacggatgccgtccgccaaaacgtcgccgcgtgtaa

SEQ ID NO: 1227 - DNA, 387 bp, Bacillus licheniformis
cacaggttcaatattacggtactggccgtcgtaaaagctctgtagcgcgcgtgcgtttagttccaggagaaggccgtatcatcgtgaataatcgtgaaatcagcgagcacatcccatctgcagctctaatcgaagatatcaaacaaccattaactttgactgaaacagctggtacttatgacgttttagtaaacgtacatggaggcggcttctccggtcaagctggagcaatccgtcacggtatcgcccgcgctttgcttgaagcagatccggaataccgttcaactctaaaacgtgccggtctactgactcgtgacgcacgtatgaaagagcgtaaaaaatacggacttaaaggcgcacgccgtgcacctcagttctcaaaacgtt

SEQ ID NO: 1228 - DNA, 609 bp, Bacillus licheniformis
cgttgttactgagaagacagacgaccggcatcgtccaaatcctgcttgaccggaactggggcatttcattcaaagaactggctgcgtttgccggacaggaagcaaacagcgaactgctcgaattctttaaacagcgcctcaaatatgtattaacagcggaaaacatccgatacgacgtcgtggatgccgtgctcgaaagcacgaaccttgagccgtattcggctgtcaaaaaagccgccgtccttgaatcggctgcagccaaaccggaatttaaagaaacggctgaagcgctggcaagggttatttcgatcagcaaaaagagcgaaacgagcgccattgacgcttcactgtttgaaaaccctcaagaagaggagcttttcaaagcttatgaggcgtgcaggcagcaaatagagaccctttaccaagcaaaagattatgagggcgccttcagtgagctgtccaagctgaaagagccgattgaagcgtattttgatcatacgatggtacatgccgaagatgaaagattaaaagcaaaccgcctggcgcaaatggcaagcttggcggagctgatccgatcttttgcaaacatcaatgccatcattgtaaaat

SEQ ID NO: 1229 - DNA, 378 bp, Bacillus licheniformis
atgacaaaggttgttcagacaaaagaagcaccggcggcgatcggaccgtattcacaaggaattgttgtcaacaatatgttttacagttcggggcaaattccgctgaccccgtcgggtgaaatggtgactggagacatcacagaacagacgcaccaggttttccgcaatttaaaagccgtgctgaaagaagcgggcgcctctctggagactgtcgtcaaagcaaccgtgtttctggcggatatgaatcaattcacagaggtgaatgaagtttacggacagtacttcgatacccacaaaccggcgagatcatgcgttgaggtggcgaggctgccgaaagacgcgcttgttgaaatagaagtcatcgcattagtgaaatag

SEQ ID NO: 1230 - DNA, 450 bp, Bacillus licheniformis
tcagggaaaaaggcgtgcatattgcgtttatcacccttcatgtcggtcttgggacattccggcctgtcagtgcggaaaatgtagaggaacacgacatgcatgccgagttttatgaaatgtcggaagaaacggcagcattgttaaaccgcgtcagacaggaaggcggaaggatcatttccgtcggcacgacatcgacgagaacgcttgagacaatcgcttccgagcatgacggccgcttccgggaagcgagcggctggacatcgatttttatctatcccggctacacattccgggcaatagacgggatgattaccaattttcatcttccgaaatcgtccctcattatgcttgtcagcgcgctcgcaggcagagagcatgtgctttccgcctaccggaccgcagtggaacacgaataccgcttcttcagctttggagacgccatgttgatca

SEQ ID NO: 1231 - DNA, 359 bp, Bacillus licheniformis
gtgaatactttggcattgcatgtcgtactatatcaaccagaaattcctgcaaacacaggaaatatcgcacggacttgtgcagcaacagatacaacacttcatttaatcagaccgctcggcttttcaaccgacgataaaatgctcaagcgggcaggtcttgattattgggaattcgtcaatgtcgtctaccacgactcattggatgaattgtttgatgcccatcctgaaggccgttttttcttcattacaaagttcggtcaaaaaccgcacacttcatttgattattcagatcaaaacgaagattacttctttgtcttcggcagagagacgaacggcttgccgaaagagctgttccgaga

SEQ ID NO: 1232 - DNA, 552 bp, Bacillus licheniformis
atgattggagcgcttttataaaccgggatctgatggtcgatccgccatcggctgaaggaagcttgaaaaaactttcgtttgcggtaaaggatgtgtttgctgtagagggccatgctaatgcggcgggaaaccctgattggctgaggacgcacgaacctgccgaaaaaaacgcggaagccgttgacttgctgctgcgggaaggtgcaaggcttaagggtgctgcgcacacagatgagctgatgtacagcctcgacggagaaaatgtccattatggtacacccgtcaatccttgtgccatggacaaaattccgggagggtcttcaagcggatcggctgtggcggcagcctctgggatgaccgatttcgctctcgggacagacaccgggggatctgtcagaatcccttcttcatactgcggaattttcgggtttcggccgacgcacggcgaggtgtcggttgatggtgtcataccgctggcaaagagttttgacaccgtcggatggatgtcaaaagatattggagtccttcatgcggcgggccgcgtcctgctta

SEQ ID NO: 1233 - DNA, 366 bp, Bacillus licheniformis
atggctcgtattgctggtgtagatatcccacgtgataaacgtgttgttatttcattaacatacatctttggaatcggtcgtacaacggctcagcaaatcttaaaagaagctggagtttctgaagatactcgcgttcgtgatttgactgaagaagaacttggtaaaatccgtgacgtgatcgacaaattgaaagtagaaggtgaccttcgccgtgaagtgtctcttaacatcaaacgtctgatcgaaatcggaagctaccgcggaattcgtcatcgtcgcggattgcctgttcgcggtcaaaatactaaaaataacgcgcgtactcgtaaaggtccgcgtcgtactgtacctaacaagaaaaaataa

SEQ ID NO: 1234 - DNA, 370 bp, Bacillus licheniformis
atgattcaacaagagactcgtttaaaagtagctgataactctggtgcccgtgaagtgttaacaatcaaggtgcttggtggttctggacgcaaaacagctaacattggtgatgtcattgtttgcacgggttaaaccaagcaacacccaggaggcgttgtcaaaaaaggtgatgtcgtgagagctgtagtcgtacgttctaagagcggtgcacgcagaaatgacggatcttacatcaaatgcgctgagaatgcatgtgttatcatccgtgacgacaaaagcccgcgcggaactcgtatcttcggacctgtagcacgtgaacttcgtgataacaacttcatgaaaattgtttctctagctccagaagtacttt

SEQ ID NO: 1235 - DNA, 498 bp, Bacillus licheniformis
tccgttgggttagaacagtatcgagcttttaaaattcttgcgcgctgaggccaaaaatacgattatcaatttggatataaacggtgaccaacactctgttatggtgatgaagctgcagacggatccgttaaaagattcaatcgtacatgccgattttaaagtggttgatatggaagcggaaatggaggcgacggttcctgtaaaccttacgggtgaagcagagggcatcaaacagggcggtgttcttcagcagccgctttacgagctgtctgtcacagcaaagccgaagaacattccgcagacgatcgaggttgatatttccagtctcgaagtcaatgatgttctaaccgtcggcgatattccgaccaaaggcgattattcatacaaccatgagcctgatgaagttgttgcatccattcttcctcctcaaaagcaggaagaaacagaagccgaatcagctgctcaagacgttgaggaaccagaaaaaggcactgaaga

SEQ ID NO: 1236 - DNA, 343 bp, Bacillus licheniformis
atgacgatgagagctacccgtgtgggagagcagatgaaaaaagaacttggtgacattatcggcagaaagctgaaagatccgcgaatcggatttttaacagtcaccgacgtcagggtctcaggtgatttgcaaattgccaaagtgtatatttccgttttaggcgatgaaaagaaacgggaagaaacgctcaaaggcctggcaaaagcaaagggctttattcgttccgaacttggaaaccgaatcaggcttcgcaaaacacctgaaatccattttgagttcgatgaatcgatcgattacggaaaccgtatcgaaacattgattcacgagctgaacgcaaacaaag

SEQ ID NO: 1237 - DNA, 363 bp, Bacillus licheniformis
atgtcatacagaaaactaggacgcactagtgcacagcgtaaagcaatgctgcgtgatcttacaacagacttgatcatcaacgagagaattgaaacaacagaagctcgcgcgaaagaacttcgctctgttgtagaaaaaatgattacacttggcaagcgcggagatttacacgcacgccgccaagcagctgcatacatccgcaatgaggttgcagatgcagagaaaaaccaagatgcacttcaaaaacttttctctgatgtagcacctcgttatgaagagcgccaaggcggatacacacgtattatgaagcttggtcctcgccgtggtgacggagcaccaatggctatcatcgaattggtttaa

SEQ ID NO: 1238 - DNA, 339 bp, Bacillus licheniformis
attttcgcacaggtttaacgattgaagtagacggagggatttggcgcgttgttgacttccagcacgttaagccgggaaaaggcgcggcatttgtccgctcaaaattgagaaatcttcgcacaggtgcgattcaggaaaaaacattccgcgcaggtgaaaaagtggcccgcgcccaaattgaaacaaaaacgatgcagtacttgtatgccaacggcgatcagcacgtttttatggatacgacatcttacgagcagcttgagctgaacgagaagcaaatcgaacacgagctcaaattcctgcttgaaaataggtctgttcagatcatgatggtatcagaca

SEQ ID NO: 1239 - DNA, 323 bp, Bacillus licheniformis
gtgtaggtaagaagctacttgagattccttcaggcgttacagttactctgaacgacaacactgtaaccgtgaaaggaccaaaaggagaattaactcgtacgtttcatcctgatatgaagattaaaattgaggacaatgtacttactgtagaacgtccttcagataataaagaacaccgtgcgctgcatggcacaactcgcagcatcatcggaaacatggttgaaggtgtatctaaaggttttgaaagaggtttggaattagtcggtgtcggttaccgtgcttctaaatccggaaacaaacttgttttgaacgttggatactct

SEQ ID NO: 1240 - DNA, 599 bp, Bacillus licheniformis
acacccgaatacggattaaaaaatatttctgagcctgaattgtatgggccgtcgcgaaatccttggaacactgattattcacccgggggttcaagcggcggttctgcggctgcggtggcggccggaatcgttccacttgcaggggcaagcgacgggggaggctccatccggataccggcttcctttaccggactattcggtctgaaaccgacccggggcagaacgcctgtaggaccgggcgccggacggcagtggcagggggcatcgatcgattttgtgctgtcccgtacggtcagggacagcgcggcgctcctggatattctgcaaaccattcagcctgaagccgcttttcaaacgcctttatttccaggtcagtatgaagaggatatgaaaaaagggctggagcgccctttgaaaatcgcattatctgtagaatcacccgtcggaacgcctgtcagcgatgaagccaaacaagccgtccgccgcaccgttcgatggctggaagcgcagggacaccatgtcgaagagcagacgaacggcgttgacggaatccggttaatggagaactactacttaatgaacagcggtgaaatttccgc

SEQ ID NO: 1241 - DNA, 312 bp, Bacillus licheniformis
atgcatgttaaaaaaggcgataaagtaatggttatctctggtaaagacaaagggaagcaaggtgtaattcttgcagctttccctaaaaaagaccgcgtaatcgttgagggtgtcaacatggtgaagaagcactcaaagccgactcaagcaaaccctcaaggcggaattttaaatcaagaggcgccaattcatgtgtcaaacgtaatgccgctcgatcctaaaacaggtgaagtgactcgcgtaggatacaaagtagaaaatggcaaaaaagttcgtattgcaaaaaaatctgggcaagttctagataactag

SEQ ID NO: 1242 - DNA, 989 bp, Bacillus licheniformis
  misc_feature (1)...(989): n = A,T,C or G
atgtccattcaaaattcggtagtaaatggaagttttgaagcgggatcactctctccttgggcggggcaaaatgctgcggtcaccactcaattttcccattcgggcttttggtcggcaacattattgggtggagcaacggtatctttcattgcccaatttgttccagtagatgaaggggaagggcttgagtttcttgtttcgttggctaaatcaggaatcctaccatctccccaggtgcagattcaagtatcatattttgatagtatgtttaatttcttgggtcagggactttttattaatattccgtttaatagattacctgtcgtgcaaaataatgcatggcttgaagtttatcaaacgacatctccggctccttcaggttctacaatggcatttatcttaataaatacactgcctcaagcaggaacagcaaatgtcatagtagatgatgtagctttgttagatatagaagttgcagatgtaatcggcccaaccggcccgaccggagcgacgggtccaacgggagcgacgggtccgaccggagcgacaggcccgacaggagcaacgggagcgacaggcccgacaggagcaacgggagcgaccggcccgacaggagcaacaggagcgaccggcccgacagggagcgacaggcccgacaggagcaacgggagcgaccggcccgacaggagcaacaggagcgaccggcccgacaggagcgacaggcccgacaggagcgacaggcccgacaggagcaacaggagcgaccggagcaacgggnagcaccggcccgacaggcccgaccaggagcacagggcgacaggccgacaggagcacgggagcgacggggccgacgggagcacaggaacgaccggcccgacagagcgaccggnagcacagaacgaccggnacaccaggaacgacaggaccgacaggaacaccaggacgacccggaccaccgggagaaacggcccgcacgggcccaacaggac

SEQ ID NO: 1243 - DNA, 964 bp, Bacillus licheniformis
atgaaacaaaaagcccccgttcaaaaaaatgaatattacaatgtcgtatttgaagatttaacacacgaaggagccggcgtcgccaaagtcgacggcttcccgattttcgtgccgaacgcgctgcctgacgaaaaggcgcagattaaagtgacccgggtcaaaaaaggcttcgccttcggccgcctcatcgacttgaaagaaaaaagccgctttcgcacggacgcgccgtgcccgatctacaagcagtgcggcggctgccagctgcagcacatcaattacgaaggccagcttctctacaagcagaagcaagtcaaagacgtgctcgagcgaatcggcaagctcgatttaagccggatcaccgtccacccgaccctcggcatggaagacccgtggaactaccgaaacaaagcgcaggtccctgtcggcgaaagagaaggcggcctgatcgcaggcttctaccagcagcgcagccatgagatcatcgacatgaacgaatgcctgatccagcaatcggaaaacgaccgcgtcgttcaagcgattaaagagatctgcggcaaatacggcatcaaagcgtacaacgaagaacgccacaaaggctggctcagacacatcatggtcagatacggcgccgtcacaggcgaaatgatggtcgtcttcatcacaaggacaaacgacttcccgcacaaagcgaaaatcgtcgaagagatcaccgcggcattcccgcacgtcaaatcgatcgtccaaaacatcaacccgaaaaaaacaaacgtcatcttcggcgacgaaacaacggtcatctggggagaagaatacatttacgacacaatcggcggcatcaaattcgccatctccgctagatcgttctaccaagtcaaccctgagcaaacgaaagtgctctacgacaaagcgcttgaatacgccgaattgaacggcgaagagaccgttcacgggggacctgtagaga

SEQ ID NO: 1244 - DNA, 552 bp, Bacillus licheniformis
atgtttaaattaatggtacgtgatgatctgtatttaaaaatgctcgaaccaaaagatgccagggccgtttatatgcagatccaacagtctaaagatgtgttgcggaaatggctgttttgggtggacggcacaaagcagctggaagataccgaagcttttatcgaagaaagcatgaaacaggccgctgcaaacaacgggtttcaagcgggaatatggcatcaaggccaatttgccggaatcatcggactccattacattaactggatcaaccgcacgacttcgatcggctattggctcggggagccttttcaaggaaaaggaatgatgacggatgcctgccgggcgctgatcgatacgcttttcagcgaatacgatttaaaccggattgaaatcagggccgctgttcaaaacgtaaaaagccaggccattccggaaaggctcggcttcacgaaagaaggctgcctcagacaatgcgagtggctccacgaccacttcgccgaccatttcgtatacgggcttctgaaagaggaatatgaggcccgcagcaaatga

SEQ ID NO: 1245 - DNA, 444 bp, Bacillus licheniformis
atgagattagttgttcagcgcgtcacagatgcaagcgtttcggtaggaggcgagactgtcggcgaaatcggcctcggcttgatggtgcttgtcggcgtgacgcacgaagatacgagcgaggatgccgcatatttggcggagaagcttgtcaatctgcgaatttttgaggatgaaggcgaaaagatgaacctgtcgcttttagatgtcgggggctccgttttatcggtttctcagtttaccttgtacggcgacacgaaaaaaggaagacggccgaattttacaaaagcggcaaagcccgatcaggcgcttcaattgtacgaagagtggaacagcatgcttcgcgcaaaaggcgtcactgtcgaaacgggaagatttggagaaatgatggatgtcaagctgacaaattcgggtcccgtcacgtttattatggattcgaaagcataa

SEQ ID NO: 1246 - DNA, 279 bp, Bacillus licheniformis
atggctcgcagcttaaaaaaaggaccatttgtcgatgatcatctaatgacaaaaatcgagaaattaaatgaagcggataagaaacaagttgtgaaaacttggtctcgccgttctactattttcccgcaatttatcggtcacacaatcgcagtctatgatggacgcaaacatgtgcctgtttacatctctgaagatatggtaggtcacaagttgggtgaattcgcaccgactcgcacttacaaaggtcatgctagtgatgacaagaaaacaagacgctaa

SEQ ID NO: 1247 - DNA, 379 bp, Bacillus licheniformis
atgaaaacaaaagtatgtactgtggatgtaaaacgcgatttgtccacaaactgtccacaaattgcacaggcggcaagactgcttcagcaaaatgaaacggttgcttttccgacagagactgtttacggtcttggtgcaaacgccaaacacagcgaagcagtagctaaaatatacgaagcgaaagggcggccgagcgacaatccgctcattgtccacatcgctgaaattgaacagcttgcagaatttgcggaagttgattcgcctcaggccgaaatgctgatgaagcgtttttggcccgggccgctgacccttgtgctgccgtgcaagcccggggtgttatccacaagggtgacggcggggctcgacacggtcgcggtat

SEQ ID NO: 1248 - DNA, 576 bp, Bacillus licheniformis
ttttgacacagcgtgcggttgtagaaaaatagcagtcataaagaaaacaagaatttcttcaaacgctggaattcggacaggtgcttgaaggaaaagtacagcgcctgacagacttcggtgctttcgttgacatcggcggcattgacggtcttgttcacatcgcccagctctcgcattcacacgttgaaaaaccgtcggacgtcgtcgaataaggccaggatgtcaaagttcaaagtgctgttccgtcgaccgcgacaatgatcgaatttcgctatcgatcaaataaacgcttcctggaccttggtccaacatcggtgaaaaggtgaagcctggtagtacgtattggacggaaaagttcagcgcttggtgagcttcggtgcatttgtcgaattgcttcctggagtgaaggcctcgtccacatttcgcaaatctccaacaaacacatcggaacgcctcatgaagtgcttgaggaaggccaggacgtaaagtgaaagtgcttgatgtcatgaagaggaaagcgcatttctttaagcatgaaagagcttgaacaaaacaccgataaagttagcaggaaga

SEQ ID NO: 1249 - DNA, 873 bp, Bacillus licheniformis
atgcctacgggttcgaagcgggcagaacaaatctgccggattcatatgatcccgccgaagcagacgatccgcgtcaacaggctgaaaaacgaccgggatacgcttctttcccgtctgaatgaagcggggattgaggcggaagaaggcgacttgtccaaagacgctgtcaaactgctgaaaggaacgattgcgtccactccttttttcaaagaaggcgaagtcaccatacaagatgaaagctcaatgctagtagcgagagcccttggacctgagcggggagaaacagtgctggatgcatgcgcagctccgggaggaaaatccactcatatcggcgaactgctcgaagatacgggaaaggtcgtctccctggaccttcatcagcataaagtaaagctgatcaaagaagcggcaggccggattggactttccaacattgaagcaagagcgctggatgccagaaaagccggagaagtcttcgaaccggaacagttcgaccggatcctcgtcgatgccccgtgttcgggattcggcgtcatccgcagaaaaccggatctcaaatacagcaaaacgcccgaagacagcgcgcgtctcgccgggattcagcttgcgattttaaacgaaatcgcacctttattgaaaacaggcgggacattggtttacagcacatgcacaatggacccgaccgaaaatgaacaagtcatgcatgcttttttggaagaacacgacgaatttgaagcggaccccaccctcgccgagcggctgcccgaaaaagcggcgccgtatgtcaaggatggaagcattcaaatccttccccactactttggaacggacggcttctttatttgcagcatgagaaagaagggatcacaataa

SEQ ID NO: 1250 - DNA, 471 bp, Bacillus licheniformis
gcttattttgcgaaaaatgaggcgcgatgacgccgaaaacctgctcgaaatcttttctgacccgatagcaatggaatattatccatcgacaaagaatgaaaaacagacattgcaatggatcgaccggacgcttgaaaactatgaaaaacacggaaccggtctgtgggttgccgaacataaacaaacgggcgaatttttaggccaatgcggcatcgtgccacaggaagtcgaaggatcgaacgaaatggaaatcggctatttgtttaaacggagcgtctggaaaaacggctatgcaaccgaagcagcatcagcatgcaaacaatatggatttgagtcatttcatctgaaaaaaatcgtatctttacctgatgcgcaaaatctgccgtccagaaaagtagccgaacgaatcggcatgactttagaaaaaacaatacataaatggggaaaagaaattgccgtatattcagtgta

SEQ ID NO: 1251 - DNA, 289 bp, Bacillus licheniformis
atgtcgcgtatttctatagaagaagtaaagcatgtcgcccatcttgccagactggcgattacggacgaggaagcggcgatgtttaccgaacagcttgacagcattatttcatttgcagaagagctgaacgaagtcgatacagagaatgttaaaccaacaacgcacgtattgcaaatgaagaatatcatgagggaagatgtacctgataaagggcttccggttgaagacgtcgtcaaaaatgcgcctgatcataaagacggctacatccgcgtgccgtcaatcttggact

SEQ ID NO: 1252 - DNA, 264 bp, Bacillus licheniformis
atgagcgaacgcaatcagcgcaaagtctaccaaggacgtgttgtttctgacaaaatggataaaaccattactgttgttgtagaaacatacaaaaagcattcactctacggtaaacgcgtaaagtactctaaaaaattcaaagcacatgatgaaaataaccaagctaaaatcggagacatcgtaaagatcatggaaactcgtccattatctgcgactaaacgttttcgtctagttgaagttgtcgaagaagctgttattatctaa

SEQ ID NO: 1253 - DNA, 280 bp, Bacillus licheniformis
  misc_feature (1)...(280): n = A,T,C or G
atgctaagattagatcttcagttttttgcatctaaaaaaggagtaggttcaacgaaaaacggacgtgactctgaagcgaagcgcctaggtgctaaacgtgcagacggtcaattcgtatctggccgttcaatcctttatcgtcagcgcggaacaaaaatctatccaagtgaaaacgttnggcgcggccgatattacactctatttgcaaaagtcgacggaactgttaaattcgaacctttcggccgtacccccaaaaaagtgagcgtatatcctgtagcct

SEQ ID NO: 1254 - DNA, 243 bp, Bacillus licheniformis
tggaagataacaaacaaggcatcatccgtgttttcttgaaatacggacaaaacaacgagcgtgtcatcactggccttaaaagaatcagcaaaccaggtctgcgcgtttacgctaagtcaaacgaagtgcctcgcgtgcttaacggacttggaatcgcaattctttctacatcacaaggtgtgttaacggataaagaagcccgcgctaaacaggctggcggagaagtattagcatacgtttggt

SEQ ID NO: 1255 - DNA, 238 bp, Bacillus licheniformis
atgacaagaataaaaggcggaactgttacacgcaaacgtcgtaaaaaggttctcaaattagcaaaaggttattttggttcaaaacatacattatataaagtatctaaccagcaggtcatgaaatcaggaaactacgctttccgcgatcgtcgtcagaaaaagcgcgatttccgcaaactttggatcactcgtatcaatgctgcagcgcgcatgaacggtctttcttacagccgtttat

SEQ ID NO: 1256 - DNA, 507 bp, Bacillus licheniformis
gatcacatttcaaaaagcggactatgaaagagacatatcgctcgtctaccgctggatgcaggaggagcatgtcattccgttttggcatttaaacatgccgtttgcaaaatttgaagcccattttcacaaggccatcacagaccctcaccaaacgctgtacatcggctttatcgacggtgtgccgatgagctactgggagtcgtactgggtcaagggagacatcattgaacaccactatgacaatgaaccttttgaccagggcatccacctgttgatcggtgaaaaagcgtatttgggtaaaggtcttgcccttccgctattaaaagcgatggtcaacatgcaatttgccgtgcctgaaacaaaaaaggtgatcgcagagccggatatccgcaacaaaaaaatgattcatgtttttgaaaaatgcgggtttcgccctattaaacctgtgaatctccctgataaaaccggattattgatgttttgcgaacgagaacgtttttttgaaaa

SEQ ID NO: 1257 - DNA, 858 bp, Bacillus licheniformis
ttctggaaaaaacgccgttctatgctgaaagcggcggacaaatcggtgataaaggctgggttaaaagcggtgatgcggctattcgcgtcacagacgttaaaaaagcgccaaacggccagcacctgcatgaagggatcgtggaaagcggcgcaattaaaaaaggcatgagcgtgaccgcagaagtcacggagcggctcagaaaagacatcgtcaaaaaccataccgcgacacacctgcttcaccaggcgctgaaagatgtgctcggtacgcatgtcaaccaggccggctcgctagtcactgacagccgtctgcgctttgacttctctcactttggacaggtgacaaaggaagaactcgaacaaatcgaaacaaaagtgaacgagaaaatttgggcatcgattccggttcaaatcgacttaaaaccgattgctgaagcgaaagcgatgggagccatggcactgttcggcgaaaaatacggggacatcgtccgcgttgttcaagtcggcgactacagcatcgagctgtgcggaggctgccatgtgagaaatacggctgaaatcggcctctttaagatcgtatccgaatcaggaatcggggctggcacccgcaggatcgaagctgtaacagggcagggcgcttacgaagagatgaacgccaaactggagcttctcgaacaggcggcagaagtcctgaaaaccaacgtgaaggaagtgccgaaacggatcgaagcgctccagtctgatctgaaagatgctcagagagaaaacgaatctttattggcgaaactgggcaataaagaagccggagagattttggaaaaagtaaaagaaattgacggaatcaaactgctcgcagaaa

SEQ ID NO: 1258 - DNA, 240 bp, Bacillus licheniformis
atggcaggaggacgcagaggcggtcgtgcgaaacgccgtaaagtgtgttatttcacttccaacggcattacgcacatcgactacaaagatgtagatcttcttagaaaatttatctctgagcgcggtaaaatcttaccacgccgtgtaacaggaacaagcgcgaaataccaacgtaaattgactgttgcaatcaaacgcgctcgtcaaatggctttacttccatacgtagcaggcgagtaa

SEQ ID NO: 1259 - DNA, 272 bp, Bacillus licheniformis
ttggcagtaaaaccgatcgtaacgtatccggcggaggttcttgagacccctgccgaacccgttgcgtcttttgataaatcattaaagaaactactcgacaatatgtatgatacgatgcttgagctggacggagtcggactggccgctccgcaaatcggcgtttcaaaaagagcggcagtcgtcgatatcggcgatgacacgggaagaattgaactggtcaacccggaggtcatcgaagagagcggtgaacaaacgggtcctgaaggctgttt

SEQ ID NO: 1260 - DNA, 264 bp, Bacillus licheniformis
atgagactcgacaaatttctcaaagtatcaaggctgattaaaagacggacgcttgcaaaagaagtggctgaccagggaagaatttcgatcaatggccagcaggccaaagcaagctctgttgtcaaagcgggggacgagcttgcggtgcgtttcggccaaaaacttgtaaccgtcaaagtcaatgaattgaaggatacgacaaaaaaagaagaagccgctgatatgtataccgttctcaaagaggagaagctgggaggagaatag

SEQ ID NO: 1261 - DNA, 384 bp, Bacillus licheniformis
tcaaaccgcattactttattggaattccaattccggcggagcttagtgatccgctttatcaaacggtcagcagccgtccggaattttcttttcatagatgggtgcatcctttggactaccacatcaccctcgtgttcctcggctctgctgaaaaggagcagctggcgatgcttgctggcagcctcaagctgatctccgatgagacggctccgtttcagcttgcgataaaacgtttcggaaccttcggaaagccgtcggagccgagaattcttcatgtggaaccggaatactcagccgctctctttcatgtgagggaacaggtgaagcatgcagcggatgcggcgggctttgaaattgaaaaacggccttttcatccacatgtac

SEQ ID NO: 1262 - DNA, 213 bp, Bacillus licheniformis
cgaaagacgatgtaattgaagtggaaggtactgtagtcgaaacgctgccaaacgcaatgttcaaagttgaacttgagaatggccacacggttttggctcacgtatctggtaaaatccgcatgcacttcattcgcattttacctggagacaaagttacggtagaattatctccatatgacttaactcgtggtagaattacgtaccgttacaaat

SEQ ID NO: 1263 - DNA, 261 bp, Bacillus licheniformis
caaacattaaatcagcgatcaaacgcacaaaaacaaacaacgagcgccgcgcgcacaacgcaacaatcaaatctgcaatgcgcactgctatgaaacaagttgaaactttcgtaagcaacaacgaagcagacaaagcgaaagcagctctatctgcagcagcaaagaaaatcgataaagcagctaaaaaaggtcttgtccacaaaaacaccgccgctcgttacaaatcaaacctagcgaaaaaagtgaacggactttctgcat

SEQ ID NO: 1264 - DNA, 327 bp, Bacillus licheniformis
aagggacaaacatttacatcaggccgctcacggctgaagacgccgaggcatgcctcgaattgcagaacgcaaaccgcccgttctttgaacagttttcaatggagcggaacgaggagttttatacaatcgaaggacaaaagaagaggcttcaaagattatatgaaaatatggagaacgatgaagattattattttggcatctttgatccggcaaacgatgcgctgatcggaacgatcaaccttttccaagtagctcgcggttccttgcaaagcgccttcatcggctattttttggatcagaagcacaacggcaaaggctacacgaccg

SEQ ID NO: 1265 - DNA, 705 bp, Bacillus licheniformis
atgccttttcttcttacctctttttttcaaaggcagcttatgatagactcatattatcaaaaattttccactggtcgatggagagcaatgatgcaaacgggcgccgagttcgacggacaggccttttggatcacgtcgcctgcggtggcaacatttcatgaaaaacacctgcgggaggaatactttatgaatccgatactgctcgattttccggacagcttcgaaacagagcgcctgctgatcagagcaccgcgcgccggtgacggcaaggcagtatatgatgctattgcagcttcgttttcagaactaaagccgtggatgccgtttgcaagggagatccccgaggaagagcgtgtagaaatcaacgtcaggcgggcacaggccgattttattttgcgcaacgatttgcggatgcatattttccataaagaaacgggaaaattcgtcggcagcaccggtcttcaccgcatggactggaaagcgaaacggtttgaaatcggctattggcgcagttccgaattttccggacaagggtacatgacagaagcgcttaacggtctcattgatttcgcgagaagacacgtcagagccaagcggcttgagatatgttgtgacagcatgaacacgaaaagcagaaaaatggcggagcgcctcggtttcgagcttgaagccgttttacaaagcgatgaccttcgaacgatttga

SEQ ID NO: 1266 - DNA, 390 bp, Bacillus licheniformis
aaaagtgaaattgcgtacgatcacaatggatgacctgcccggattatggagaatgatttacggaactaaaaaccctgaatggaaaaaatgggatgccccttattttccgcttcagcccgaaccgtttcaatactttatcgattcttttgtgccggctttaaaagaaaaaccgccgcgctatttggcgatagagatcggcggagagctgaaaggaaccgtttcttactattgggaatcccggccgacacgctggctggaatgcgggatcggcatctatgatccgcggttttggaacgggggatacggtacggaagccgtagaattatggatcggcttcctgtttgaaaacgtcgatgtgccgagaatcggaatgacgacgtggtcaggcaa

SEQ ID NO: 1267 - DNA, 197 bp, Bacillus licheniformis
aaacaaacgggctggatcgaaattctcggcgctggaatggtgcatccgaacgtgctcgaaatggccggattcgattccaaacaatatcagggatttgcttttgggatgggcgttgaacggatcgcaatgctgaagtacggcattgacgacattcgtcatttctatacgaacgatgtcagatttttatctcaatttaa

SEQ ID NO: 1268 - DNA, 315 bp, Bacillus licheniformis
gcttggtagagctggtcgaattgattatattccaggcgggcggagtttcaaatataattgatcccgagcatcaagggaacggttattcgtcaagcgcaacatatttggcaatgaactacgcattttccgtcttgaacttgcacaaattgtatttgatcgtcgacgaagataatgcaaaagcgattcacttgtataaaaaggcagggttcactatcgagagcgagctgcaggatgaatttttcgtcgacggctattatcgtaacgccattagaatgtgcatttttcaggatgagtttttatcacttaaaaaaagca

SEQ ID NO: 1269 - DNA, 536 bp, Bacillus licheniformis
gtgacatatatcttgatgaatatgagggctggtacagcatccctgacgaaacgttttacaccgaaacccagctcgttgatgtcgagcgaaacgagaaaggcgaagttatcggagggaaaagtcctgacagcggccaccccgttgagctaatcaaagaggaatcttacttcttccgcatgggaaaatacgcggatcggcttctcgctttctatgaagaaaatcctgaattcatccagcctgaatcccggaaaaatgaaatgatcaacaactttatcaaaccgggtcttgaagatttggctgtttcccggacgacgttcgactgggggataaaagtgcccggaaatccgaagcatgtcatctatgtttggatagatgcgctgtttaattacattacgggacttggctttaatacggaaaacgatgaaaattatcaaaaatattggccggcagacgttcatcttgtcggtaaggagatcgtacgcttccataccatttactggccgattatgctgatggcattggaccttccgctgccg

SEQ ID NO: 1270 - DNA, 185 bp, Bacillus licheniformis
atgagaaagtacgaaatcatgtacatcatccgcccagacgttgatgaagagtctaaaaaggctgttgttgagcgttttaacaacattttaacaactaacggtgcggagatcactgaaacaaaagattggggaaaacgccgtcttgcatacgaaatcaacgatttccgcgacggattctaccaaat

SEQ ID NO: 1271 - DNA, 216 bp, Bacillus licheniformis
tacgctatgagttcataaaagcatgtaaacaaacaggagcaaggctggggagagtgcacaccccgcacggctcttttgaaacgccggtgtttatgcccgtaggaacgctcgccaccgttaaaacgatgtcgccggaagagctgaaagaaatgggtgcagacattattttaagcaatacgtaccacctttggctgagaccgggccatgacatcgtca

SEQ ID NO: 1272 - DNA, 600 bp, Bacillus licheniformis
atgcgcatacggagatctgacggtggaagaattagaaacggtttatcgggaattaacgtctccataatcaataaaataagggggaggagaagcatgaaagacatgatcatgaagacagaccggcttattttgcgaaaaatgaggcgcgatgacgccgaaaacctgctcgaaatcttttctgacccgatagcaatggaatattatccatcgacaaagaatgaaaaacagacattgcaatggatcgaccggacgcttgaaaactatgaaaaacacggaaccggtctgtgggttgccgaacataaacaaacgggcgaatttttaggccaatgcggcatcgtgccacaggaagtcgaaggatcgaacgaaatggaaatcggctatttgtttaaacggagcgtctggaaaaacggctatgcaaccgaagcagcatcagcatgcaaacaatatggatttgagtcatttcatctgaaaaaaatcgtatctttacctgatgcgcaaaatctgccgtccagaaaagtagccgaacgaatcggcatgactttagaaaaaacaatacataaatggggaaaagaaattgccgtatattcagtgtatcgctaa

SEQ ID NO: 1273 - DNA, 462 bp, Bacillus licheniformis
gggtgctgaatgaagcaggccaaaaagtgtcggcagccgaatttacagcaagccttgcttcctgggatcgagcagctgcacaaatggcggcgtttcatgagacctatgatctgtatgtgaccccggcaacggcttaccccgctccaaaggtcggcgagctcacccataccgaaaaagaagccgaagcgctcctgaaagtaagtgagctggaaaaaatcgagcagcagtccctgatttatcacacgtttacgaactgcttgacatatacaccattcacacagcttgccaacttaaccggacagcctgcaatgagcgtcccggtccatctgacaaatgaacgtttgccgctgggtgttcaagtgacggctccgaaaggaaaggaacattggctgctgcgcaccgcccatttattagaacaatcagacttatggatcggaatgaaaggaaatccaatgctcggca

SEQ ID NO: 1274 - DNA, 237 bp, Bacillus licheniformis
tcttgggctttgaaatatcgggacatgcgaattttgctgaacatggtcaggatctcgtttgcgcaggggcgtcggcggtcgcctttggagccgtcaatgccgtaatgaagctgacgggcattgagccggtcattgacctcggggaagacggggggtttttatctttccgcttcccggacggtacggatcgtgaggcttttgaaaaggcgcagctccttctcgaaggcatgatcgtct

SEQ ID NO: 1275 - DNA, 205 bp, Bacillus licheniformis
atgaaccgccttaaagaaaagtacaattcagaaattacacctgcattaatgaaaaagttcgaataccaatctgtgatgcaagtgcctaaaatccaaaaaatcgtaatcaacatgggtgttggtgacgctgttccaaacgctaaatctatctatagcgctgttgaagaactaacgtttatcgctggtcagaagcctgtcgttacac

SEQ ID NO: 1276 - DNA, 192 bp, Bacillus licheniformis
gctggagccctgtcagcgtactgttctcatactatgtcagcgaatttgcaaactacagtgcgacatacggaagcctcggcggcatcatcgtcctgatgatctggttttatttaagcggaatgatgattattcttggaggggaaatcaatgcccttttacataagcgtaaaatcattcctgaagaaaatccgc

SEQ ID NO: 1277 - DNA, 173 bp, Bacillus licheniformis
atggctaaattagaaattaccctcaaacgcagtgtaatcggacgcccggaagatcagcgcattactgtaagaacgcttggtttaaagaaaacaaaccaaactgtcgttcatgaagacaacgctgcaatccgcggtatgattaacaaagtatctcatttagtttctgttaaaga

SEQ ID NO: 1278 - DNA, 519 bp, Bacillus licheniformis
aaggaaacgacgccaaaagtgatcggcctgattgaggaaacgagggatcacttcacagccaaatccaaaggacgtacggagccggaaaaagaatgagttttttgaaagagctgggctggcgttttttccttcatgaaggaccgagcaaatcggcggaacttgcctacttttttctattgtctctgtttccgtttatgattttcctattgacattgatcggctacctgcctgtcaaaacgggcgatgtcatcgggctgatcgaacagtatgccccagaagacacgatgtccgtcattgaagagaccctgaataccggaaacaggggcctgctttctttcgggatcattgcggcgctctggtctgcatcaaacggattgaacgcgattgtcagggcctttaaccatgcttatgaagtagaggaaaaccgctcttttatcatggttcggctgacatcgctccttttgaccgccgcgatggttttcacaatattggtcgcgcttcttctgcctgtattcggga

SEQ ID NO: 1279 - DNA, 537 bp, Bacillus licheniformis
atgttcaagagccgcaaggtttatctcagacctgttgaaaaaggcgatatggagagcttttacaaagccgttcaaaatgaagacatcaggtatatgacgggcacgacgcgcgaatatacgatggaagacctttatgagcactatgagagaatcacgagtgatgagacgcgctatgattttgccgtctgcttaaaggaggacgatcgtttgataggcgatctgtccattatggacattgaccggaggaatcgaaaagcggggtttagaattgctttgcacagccccgcttatttgaacaaaggctatgggattgaagcggtgcggctggccatgcagcttgctttcgaaaggctcgatcttaaccccctccagctcgaagtcttttcacacaatatccgcgcgctgaaagcatatgaaaaagcgggatttaaaatggaaggaaggatcagggaggctctttatatgaatgagcagtactcggatgaaatcattatggggatattgaagcgggaatacgaagagctgatgtcccgctga

SEQ ID NO: 1280 - DNA, 510 bp, Bacillus licheniformis
atgaaccactttctgcaaactaaacgcatcggcttttctttatggaagaaagagaatttgaatttggcaaagacattgtggggaaatcgagatgtgaccaattatctaacagcagacggaatcatgaccgaaggcgaaataagaaaccgtttgctgctggaaatcgaacaatataaaacacacggggttcttaaaacaagcaacaatgaattcgtcggatgctgcggccttcgcccctatgacccggaaaatgatgtgtacgagcttggttttcatctcgtccgttcagcttggggtaaaggttatgcatctgaagcggctgaagccatgattgagtacgcatttaacaaaatccgggcaaaaaagctgtttgcgggacatcatcctgaaaatacagcttcacgaaaacgattggagaaattaggattcgtctacatacatgacgaattttatccgtccaccggacttcagcatccgtcatacgaattaaaacagcctccgggacaataa

SEQ ID NO: 1281 - DNA, 507 bp, Bacillus licheniformis
atgaatatgcgtcgtattgacccaagcaaattagagttagaagaacgcttagttaccgttaaccgcgtagcgaaagttgttaaaggtggtcgtcgtttccgtttcgcagctctagtcgttgtcggtgacaaaaacggtcacgttggtttcggaactggtaaagcacaagaagttccggaagcgattcgcaaagctgttgaagatgcgaaaaagaatttgatcgaagtaccaatggttggaactacaattccacacgaaatcatcggacgtttcggtgcaggaaacatcttgttaaaacctgcttctgaaggtacgggagtcatcgctggaggcccagtacgtgcggtacttgagcttgcaggtgtatctgatatcctttctaagtctttaggttctaacacaccgatcaacatgatccgtgcaacagtccaaggtttaagcgagctgaaacgcgctgaggacgttgcgaagcttcgtggaaaatctgtagaagaactgttaggataa

SEQ ID NO: 1282 - DNA, 192 bp, Bacillus licheniformis
aaagattctatggaggtggctcattattagcaaagatcaattggttaatgagggtatccgtgcgcgtgaagttcgtttgatcggacaaaatggcgatcagcttgggatcaaatcccgccaggaagcactggaaattgcgggtcgcgcaaatcttgaccttgtgttggttgcagcgaatgcaaaaccgccgtt

SEQ ID NO: 1283 - DNA, 219 bp, Bacillus licheniformis
ctttaaatatcgaagaaatcattgcttccgttaaagaagcaactgtacttgaactgaacgacttagtaaaagcaatcgaagaagaattcggcgtaactgctgctgctcctgtagctgtagctggcggagctgctgcaggcggtgctgctgaagaaaaactgaatttgatcttgttcttgctggtgcaggagatcaaaaaatcaaagttatcaaagttgt

SEQ ID NO: 1284 - DNA, 156 bp, Bacillus licheniformis
aaccttgaacgagtctttacgcactcacaagaaagaccatcactcacgtcgcggtcttcttaaaatggtaggtaaacgtcgtaatcttcttacgtatcttcgtaacaaagacgtaactcgttaccgtgagttgatcaacaaacttggattacgtcg

SEQ ID NO: 1285 - DNA, 156 bp, Bacillus licheniformis
cgaagtggtcgcctacagttcgcggttgtgttatgaaccctaacgatcacccgcacggtggtggtgaaggacgcgctccaatcggacgtaaatcacctatgtctccatggggtaaaccaactcttggattcaaaactcgtaagaagaaagaacaaa

SEQ ID NO: 1286 - DNA, 171 bp, Bacillus licheniformis
atcagcttaaattgcgtccgcttgaaagagaagaccttccgtttgtccaccgtcttaacaacgatgcgaaaattatgtcatattggtttgaagaaccgtacgagacttttgttgagctgcaggatttatttgacaaacacattcacgaccaaagcgagcggcgctttatca

SEQ ID NO: 1287 - DNA, 477 bp, Bacillus licheniformis
atggtaatggattataaagacacgctcttaatgccgaaaacagattttccgatgagaggaaacctgccgaaccgcgaacctgaaatccaggggaaatgggaggatatggacatttacagcctcgttcagaaacgtaccgaaggccggccgatgttcgtgcttcatgacggaccgccgtatgcgaacggcgatattcatatggggcatgcgcttaacaaagtactgaaggatttcatcgtccgttcgagatcgatgagcggctatcatgcgccgtacgttccgggctgggacacacacggcctgccgattgaaacagcgctcacgaagaacaaaaaagtgaagcgcaaagaaatgacagttgccgaattccgcaaactttgcgaagatatgcatggcagcaaatcgaaggccaaccagtgcaatttaacaggttcggtgtcagagcagcttgggaaaatccatagcgtcaccgcttaa

SEQ ID NO: 1288 - DNA, 357 bp, Bacillus licheniformis
tgtacacacgaagtattcaacacgggatgggggccattacgtgccagctatggaacacaatgatgttctctatatttcagggcagttgtcgatgaatccagaaacgggaaaaattccagctgggggcataaaagaagaagcaaaacaggcattggcaaatatggagcttgtcctcaaggaacggggattagccaaggaagatgtgatattatgcagactttataccccagatgtaaagtattggccggatatcaatgaggtctatgctcatttcttcggcaatcataaaccggcaagagtagttgttccatcaaatcatttatatgccgggtgtcttgttgaagttgaagccattgc

SEQ ID NO: 1289 - DNA, 144 bp, Bacillus licheniformis
aagctaaagctgtcgcaagaacagtccgtattgctcctcgtaaggcacgtctagtaatggacctgattcgaggcaagcaagtaggtgaagcagtatcgatcttaaaccatacgccaaaagctgcttccccgattattgaaaaag

SEQ ID NO: 1290 - DNA, 336 bp, Bacillus licheniformis
aaaatcgaacggtcattatgccttagctgtgattcatcaaaacacggtctatgtatcagggcaatttgccattgatccaatcacgcaggaaaagaaatttggcaccattgaagaagagactttgcaggtattgtcaaatatagagtatatcttaaaaaaagccggcagtcataaaggaaaaattttaaagataaccttatatcttcacgatatcaatttgttagaccgtgttgacaatgtctgtcagggtttttttcacgattatcgcccagcacggtcagttgtttcgacgaccgagctgcattacggttttcaggttgaaattgaagcaatcgc

SEQ ID NO: 1291 - DNA, 131 bp, Bacillus licheniformis
cggagaaggcgatcggagaaaccgtcgttttaaaaggatgggttcaaaaaagacgcgatcttgggagcttgatttttattgatttgagagatcgtaccggcattgtgcaggtcgtatttaatccagacgta

SEQ ID NO: 1292 - DNA, 210 bp, Bacillus licheniformis
atttaaatgtaaaggtcttcccggatatgacgtatcatattcttgatgaagatgagtacgcggatcataaaagggcgatgaattatccgaaggaaatcgacggctttttaaggtaccatttaaatacgctgctgcattggatacaccaaaaaaaaggccttttgttttttgaatttatggatattgggtatgaacggtatttgctttata

SEQ ID NO: 1293 - DNA, 142 bp, Bacillus licheniformis
atggcacgtaaatgcgttattacaggcagaaaatcacgttctggctactctcgttctcacgcgatgaacgcttctaaacgcacatggggcgctaacgtccaaaaagtgcgcatccttgtcaacggcaagcctacaaaagtta

SEQ ID NO: 1294 - DNA, 114 bp, Bacillus licheniformis
tgaacgaaggccctacgttaaaaagattccgtccgcgcgctatgggacgtgcaagccaaatcaacaaacgtacgagccacattactatcgttgtatcagaaaagaaggagggat

SEQ ID NO: 1295 - DNA, 198 bp, Bacillus licheniformis
agacgattggaatcgaacttccgaacacggtcgaactgaaagttgttgaaacagaaccgggcattaaaggcgacacagcctcaggcggaacaaaaccagcaaaaacagaaacaggccttgtcgtcaacgtgccattcttcgtaaacgaaggagatacgcttgttgtcaatacttctgacggttcttacgtatcaagag

SEQ ID NO: 1296 - DNA, 219 bp, Bacillus licheniformis
aattcgcattaaactgcctgacgggtccgtcagagaatttgaggaggaagcaagtattgaagatgttgctgcttccattagctgcggtctggaacatgcggttgcaggtaaattaaacggaaagcttgtagatttatcaactccgcttcaggacggtgcactcgttgaaattgtcacccgggactcagcagaaggacagaagatcgtgcgtgaaaaatc

SEQ ID NO: 1297 - DNA, 116 bp, Bacillus licheniformis
atgacaggaaaaaaagaacggctcgacgttttattagtagaaagagggttaatggaaacgcgggaaaaagcgaaaagagccatcatggccggcattgtctatacgaatgaaaacag

SEQ ID NO: 1298 - DNA, 171 bp, Bacillus licheniformis
gtctctttgacctcgaaacaaaggaagcaagaatcagcgaattagacgagcagatggctgaccccgacttttggggagatcagcagaaagcgcagacgatcattaatgaagcgaatgcgttaaaagactatgtcaacacgtacaaaagtttaagcgagtctcataagaact

SEQ ID NO: 1299 - DNA, 153 bp, Bacillus licheniformis
aaagccgttcaaaaagaaacaggacatacaagggaaaaagctgtttatgccgatccgcgtagcgacgacaggccagacccacggtcctgaactgcctcagtccattgaattattggggaaagacaccgttttaaaacggctgcataacattat

SEQ ID NO: 1300 - DNA, 318 bp, Bacillus licheniformis
atgtcggaatcagaatggttttccttgctgggtctggcgaatcgagctcgaaaggtcgtgtccggagaagacctggttgtgaaagaaatcaggcattcgcgcgcaaagcttgttttgcttgcagacgacgcatcggctaacacggagaaaaaagtaaccgacaaatgcaggcactacgatgtaccggtgaaaaaagtcggtgatcgtgtgcttctgggccgttcaatcggcaaagaatcccgtgtggttgttgctgtcactgatcaaggttttgcgaatacgttgctccgaaagctcgattattttttttgggggtga

SEQ ID NO: 1301 - DNA, 312 bp, Bacillus licheniformis
gagcttgcggatgtcgaactcacactgaaggccttgccggattggtcaagctgatcgaaaaaggaacgatttcatcgaaaatcgcgaaaaaggtcttcaaagaattgattgaaaaaggcggagacgcagaaaaaatcgtcaaagaaaaaggccttgtgcaaatctctgacgaagcgacgctcagaaagcttgtcacagaagcgctcgacaacaatccgcaatcaatcgaagactttaaaaacggaaaagaccgcgcgatcggcttccttgtcggccaaatcatgaaagcctcaaaaggacaagcgaacccgc

SEQ ID NO: 1302 - DNA, 270 bp, Bacillus licheniformis
atgttttccgttcaaacaaaacatatttacgcacaagtgatcgatgacgtgaacggtgttacacttgtgagtgcatctactcttgataaagactttaacgctgaaaatggcagcgatacggctgcggctgcaaaagttggagagcttgttgcaaagcgcgcttctgaaaaaggtatcacaaatgtcgtgttcgaccgtggcggttacctttatcatggacgtgtaaaagcattggctgatgctgcacgcgaagctggattagaattttaa

SEQ ID NO: 1303 - DNA, 497 bp, Bacillus licheniformis
ttgtttttttgttttctttgttattgttcctttttgttccctcttgttccgagtttttttgttgtttttcttcctgttttccttccttttttcttgttctctccgtttgcgttttctctttttgctttttgttctctctgcttgcttcttttttcctcttttttttttgtcgtctcctcctttgcttctctctcctgcttggtctcgcgctgttttcttttcgttccggctttgggtggcttctgttcgttttgtcttcttctcttttttcttccccctgtctggtctttgttttcttgtgctcgctggtctgctctttgtgccgtgtcgctctctctcttcccttgtcttccttccgctctctttgtcgttgtttgtttttcttttttcttgtcgttttgctcttcgtcgtctgttccctcatgtgcgtccccgttcctctctgttcactcctttttctcgtccgcccgtctcgtcttggcttcgtgtttggcgct

SEQ ID NO: 1304 - DNA, 228 bp, Bacillus licheniformis
atgcccgcgtcttttagcgatttcaacggcttcaaaaagagcggcccggtcagggattttctccaggtattccatctgatacagcgacattctcaacagatggatgacccagtctttcaccttttccggctttttaataaacggcttcagcatataatcaagcgccagcttattctgaagggtgccgtaaacgagttctgtcaaaaggcctctgtctttgtcgcttaa

SEQ ID NO: 1305 - DNA, 225 bp, Bacillus licheniformis
atgattgctctttcacgtgaactttcagtgttgcttgtacttccggatggagcttcacgggaacattcgtatatcccaatgagcgaatcgcatcgtttaattcgattttgcgtttgtcgacttttaactgatggcctttttgcagcgcatctgcaatttgtttgcttgtcacggagccgaataaacggccgccttctccggacttggctgaaagctccaccgtaa

SEQ ID NO: 1306 - DNA, 438 bp, Bacillus licheniformis
gtgctgcagggactggagatttgggaggagcacggagctaggatcgagcgcacaaatccggtgttcggccctggaatcgcagaaaggtttgaatgggcgtcaagccttgtgataagcgatcatgtgcaagcgtttatgaaaagagaggcggtgagaaaaagactgtcggaatggctcggagaagacggcttgctcgttattccgactgcccccggcccgccgccgctccgtggtctgccggaaaacgaattaaatgagagaagggcgcgcacgatgaaactgacgtgtattgccgggctcggcgggcttccgcagatcaccgtcccgttgccggcaaaaaacggcgagcctttggggctttcatttatcgccggctgcaaacaggatctgaagcttctggcttggactgaaaagcacgtgctatctcctcaagtatga

SEQ ID NO: 1307 - DNA, 471 bp, Bacillus licheniformis; identical to SEQ ID NO: 1250

SEQ ID NO: 1308 - DNA, 1084 bp, Bacillus licheniformis; identical to SEQ ID NO: 1197

SEQ ID NO: 1309 - DNA, 1057 bp, Bacillus licheniformis
atggctaaagaaaaattcgaccgttccaaatcacatgccaacattggtacaattggacacgttgaccatggtaaaactacattaacagctgctatcactactgtgcttcataagaaatctggtaaaggtactgctatggcatacgaccaaatcgacggtgctccagaagagcgcgagcgcggtatcacaatttctactgcacacgttgagtacgaaactgacaaccgtcactatgcacacgttgactgcccaggacacgctgactatgttaaaaacatgatcactggtgctgcgcaaatggacggtgcgatccttgttgtttctgctgctgacggcccaatgccacaaactcgtgagcacatccttctttctcgtaacgtaggtgtgccttacatcgtagtattcttgaacaaatgcgacatggtagacgacgaagagcttcttgagctagttgaaatggaagttcgcgatcttctttctgagtatgagttccctggtgacgatgtaccagttatcaaaggttctgctcttaaagctcttgaaggagatgctcagtacgaagaaaaaatctttgaactgatggctgctgttgacgagtacatcccaactccagagcgtgaaactgacaagccattcatgatgcctgttgaggacgtattctcaatcacaggtcgtggaacagttgctactggacgcgtagagcgcggacaagttaaagtcggtgacgaagttgaaatcatcggtcttcaagaagaaaacaagaaaacaactgttacaggtgttgaaatgttccgcaagcttcttgactatgcagaagctggagacaacatcggtgcacttcttcgcggtgtatctcgtgaagaaatccaacgcggtcaagtacttgctcaaccaggtacaatcactccgcacaaaaaattcaaagctgaagtttacgttctttctaaagaagagggtggacgtcacactccattcttctctaactaccgccctcagttctacttccgtacaactgacgtaactggtatcattcagcttccagaaggcgtagaaattg

SEQ ID NO: 1310 - DNA, 3578 bp, Bacillus licheniformis
ttgacaggtcaactagttcagtatggacgacaccgccagcgcagaagctatgcacgcattagcgaagtgttagaattaccaaatctcattgaaattcaaacctcttcttatcagtggtttcttgatgagggtcttagagagatgtttcaagacatatcgccaattgaggatttcactggtaacctctctctggaatttatcgactacagcttgggcgagcctaagtatccggtagaagaatcaaaagagcgggatgtgacctattcagctccgctgcgggttaaagtccgcttaatcaacaaagaaaccggcgaagtaaaggatcaggatgtcttcatgggcgatttccctattatgacagacactggaaccttcattatcaacggtgcagaacgggtcatcgtatctcagctcgttcgttctccaagtgtatattttagtggtaaagtagacaaaaacggtaagaaaggttttaccgcgactgtcattccaaaccgtggcgcatggttagaatacgagactgatgcgaaagatgttgtttacgtacgcatcgatcgcacacgtaagttgccggttacggttcttttgcgtgctcttggcttcggatctgaccaagagatcattgatctcatcggtgaaaacgagtatctgcgcaatacgcttgataaagataatacggaaaacaccgataaagcgcttcttgaaatctacgagcgtcttcgtccaggggagccgcctaccgtagaaaacgcaaaaagcctgcttgattcaaggttctttgatccgaaaagatatgaccttgcgagtgtaggacgttataaaattaataaaaagcttcacatcaaaaaccgactttttaatcagcggcttgctgaaacgctagtcgaccctgaaacaggcgaaatccttgccgaaaaaggagcgattttagacagaagaacgcttgataaagttctgccgtaccttgaaaacggaatcggttttaaaaagctttatccgaacggcggagttgtcgaagacgaagtaacgcttcagtctatcaaaatctatgctccgacagaccaagaaggggagcagacaatcaatgtgattggaaatgcttatatcgaagaaggcgttaagaatattacaccttctgatattatcgcttccatcagctatttctttaacctgcttcacggagtgggcgataccgacgatatcgaccatctaggaaaccgccgtctccgttcagtgggagagcttctgcaaaaccaattccgtattggtttaagcagaatggagcgcgttgttcgtgaaagaatgtctattcaagatacaaacacgatcacgccgcagcagctgatcaatattcgccctgtcatcgcatcaatcaaagagtttttcggaagctcgcagctttctcagtttatggatcagacgaatccgcttgctgagctgacgcataagcgccgtctgtcagcgctcggaccgggcggtttgactcgtgagcgcgccggaatggaagtccgtgacgttcactattcacactacggccggatgtgtccgattgaaacccctgagggtccaaacatcggcttgatcaactcgctttcttcattcgcgaaagtgaaccgtttcggcttcatcgaaacgccgtatcgccgcgtcgatcctgaaactggaaaagtaacgccgagaatcgattacttgacagctgatgaagaagacaactatgtcgttgcccaggcaaacgcacgcctgaatgatgacggttcttttgtggatgacagcatcgtcgcccgtttcagaggggagaacaccgttgttccgaaagaccgcgtcgactatatggacgtttcgcctaaacaggttgtctctgccgcgactgcatgtattcctttcttggaaaacgatgactcaaaccgcgcccttatgggagcgaacatgcaacgtcaggccgtacctcttatgcagcctgaatcgccgatcgtcggaaccgggatggaatatgtatctgcgaaagactccggtgccgctgttatttgccgccaccctggaatcgttgaacgggtggaagcgaagaacatctgggtgcgccgctatgaagaagtcgacggccagaaagtcaaagggaaccttgataaatacagcctgctgaagtttgtccgttccaaccagggaacttgctacaaccagcgtccgatcgtaagcgtcggtgatgaggttgaaaaaggtgaaattttagctgacggtccgtccatggaaaaaggtgagcttgcccttggacgcaacgtcatggtcggctttatgacatgggatggctacaactatgaggatgccatcatcatgagcgaacgccttgtaaaagacgacgtatacacgtctattcatattgaagaatacgaatcagaggcccgggatacaaaactcggacctgaagaaatcactcgcgatattccgaacgtcggtgaggacgctcttcgcaatctcgatgaacgcggaattatccgtgtcggtgctgaagtaaaagacggagatcttcttgttggtaaagtaacccctaaaggtgttacagagcttacggcggaagaacgcctgcttcatgccatcttcggggaaaaagcgcgtgaagtgcgtgatacgtcgctgcgtgtacctcacggaggcggcggtatcatccttgatgtaaaagtgttcaaccgcgaagacggagacgaactgcctccgggcgttaaccagctcgtccgcgtctacatcgttcagaagcgtaaaatttctgaaggggacaaaatggccggacgccacggtaacaaaggtgttatttcgaaaattcttccggaggaagatatgccgtatctgcctgacggaacgccgattgacatcatgttaaacccgctgggcgtaccatcgcgtatgaacatcgggcaggtgttggagctgcaccttggtatggctgcacgccgcctcggtctgcatgtcgcgtcacctgtatttgacggtgcccgcgaagaagatgtgtgggaaacccttgaagaagccggcatgtcaagagacgcaaaaaccgtcctttacgacggccgaactggggagccgtttgacaaccgggtttctgtcggcatcatgtacatgatcaaactggcacacatggttgacgacaaattgcacgcacgttcaaccggtccttactcactcgttacccagcagcctctcggaggtaaagcgcagttcggcggacagcgttttggagagatggaagtttgggcgcttgaagcttatggtgcagcatatacgctacaagagatcctgactgttaaatcggatgatgtcgtaggccgtgtgaaaacatatgaagccatcgtaaaaggcgacaatgttccagaacctggtgttccggaatcgttcaaagtattgatcaaagagcttcaaagcttaggtatggacgtcaaaattctatcaagcgacgaagaagaaatcgaaatgagagacttggaagacgacgaagacgcgaaacaaaacgaagggctttctctgccgaatgatgaagagtccgaagagttggtttctgctgacgcagaacgcgatgtcgttacaaaaga

SEQ ID NO: 1311 - DNA, 2582 bp, Bacillus licheniformis
ttgctggatgtgaacaattttgagtatatgaacatcggtctcgcttcacctgacaaaatccgttcatggtcttacggagaagtgaaaaagcctgaaacaatcaactatcgtactttgaaacctgaaaaagatggtctattctgcgagcgcattttcggtcctcaaaaggactgggaatgccactgcggaaagtacaagcgggttcgttataaaggcgtagtctgcgaccgttgtggagttgaagtaacccgggctaaagtccgtcgtgagagaatggggcatatcgagctggcagccccggtttctcacatctggtattttaaaggaattccgagccgtatgggtcttgtgctggatatgtctccgcgcgcattggaagaagtcatttactttgcttcttacgtcgtaacagatccggccaatacaccgctcgagaaaaaacagcttctttctgaaaaagagtatcgggcgtacctcgataaatacggaaataaattccaagcgtcaatgggtgctgaagcgattcataagctccttcaagatatcgacctcgataaagaagtggatatgctgaaagaagagcttaaaacgtcacaaggacagcgccgcacacgtgcgatcaaacgtctggaagtattggaagccttccgcaattccggaaataagccgtcatggatgatcctcgacgttcttccggtcattccgcctgagctgcgaccaatggtacagcttgacggtggacgttttgcaacttccgatctgaacgatttgtatcgccgcgtaatcaaccgtaacaatcgtttaaaacgtcttctggaccttggagcgccaagcattatcgttcaaaacgaaaagcgcatgcttcaggaagccgtggacgcattgatcgataacggacgcagaggacgtcctgttacaggtccaggaaacagaccgttaaaatccctttctcacatgctgaaaggtaaacaaggccgtttccgtcaaaaccttctcggtaaacgtgttgactactcaggacgttcggttatcgtcgtaggtccgaacctgaaaatgtatcaatgcggtcttccgaaagaaatggcgctggaactgttcaagccattcgtcatgaaagagcttgttgaaaagggccttgcccacaatattaagagcgcgaagcgtaaaattgagcgcgttcagccggaagtctgggatgtccttgaatcagttatcaaagaacaccctgtgcttctcaaccgtgcacctacgcttcacagattaggtattcaagcgtttgaaccaacgcttgttgaaggccgtgccatccgtcttcatccgcttgtatgtacggcatacaacgctgactttgacggtgaccaaatggcggttcacgttcctttatcagcagaagcgcaagctgaggcgcgcatccttatgcttgctgcgcaaaacatcctgaaccctaaagacggaaaaccggttgttacaccgtctcaggatatggtacttggaaactactatctgacgctagaacgccctggtgcagtcggcgaaggtatgattttcaaagatacggatgaagcgctgcttgcttaccaaaacggatatgttcatttgcatacgagagtagccgtcgcggttaactcattgaaaaatgaaacgtttaccgaagaacagcgttccaagctgctcattacaactgtcggaaaactgatcttcaacgaaattcttccgccgtcgttcccatacatgaacgaaccgacgaagagcaacattgaagaaaaaacgcctgaccgtttcttcttggattacggtgcagatgttaaagaagccattaagaaccaagaaatcaacccgccgttcaaaaaaggcattttgggtaaaatcattgcggagatcttcaaaaggttccatattacagaaacatcaaaaatgcttgaccgcatgaaaaacctcggctttaaatactctacaaaagccggaattacggtcggtgtttccgatatcgtcgtattggacgacaaacaggaaatccttgaagaagcgcaaggaaaagtcgataacgtgatgaagcagttcagacgcggtctgattactgaagaagagcgttatgaacgggtcatttccatctggagtgcagctaaggatacgatccaaggcaagctgatgaaatccttggatgaaatcaacccgatttacatgatgagtgattccggagcccggggtaacgcatcaaactttacgcagcttgcgggtatgcgcggtctgatggccaacccggccggacggatcatcgaacttccgatcaagtcaagtttccgtgaaggtttaacggtactcgagtactttatctctactcacggtgcgcgtaaaggtcttgcggatacggcccttaagacagccgactcaggttacctgacacgccgtctcgtagacgtagcccaagacgtcatcattcgtgagactgactgcggcacagaccgaggcattcttgccaaagccatcacggaaggcacagaagtgatcgagcgtcttgaagagcgtcttgtcggccgattcgcgagaaagcctgttaaacatccggaaacaggtgaagtgct

SEQ ID NO: 1312 - DNA, 2304 bp, Bacillus licheniformis
gggggaatttatgaagagaaaacaatataagttttactataaactggtgaccttctttctcattctgagcaccattccggtcatcatcgtcggctttttttcctatcagagatcagcggaaacgattgaacaaaacgttacaaacgaaaagctccaaaccgttagccagacacagctaaatattgaacatattttaaaaacggttgaccattccttcaccaattacgtccgttcctatcctttaattcagacgctcagccgcaccattacaccagaacgctttcagctgtataaccaaatcaacaaggaattaaacgaactccagacattcgataccgatctgtcggatatcacgctgatcagccaagaaaaaaagtggtatatcaacaactccggtttataccctttagatcagggaaaacaagccatcacgctctcgctttacaacgctttaaaaagccgttccagctgggtgcttgaaaaaaacaacgaccttgtcgccacaaaagaaggggcttcgggaaactgcctgtacaacgtcaatctggtcaaacagcttcccctgaacagcatggaaaacagaggccttgcgatcgcgagcattccttcttgttcgcttgtcaagcgcatgccggatcattcaaaaacaaacagcatgatggtgcttgatgacaacggacggatcatccttcactcagacccgtcaatgatcgggcaatcgatcaaacaagaaaattacttcaaaacgatccgccggcaccaagaaaaaaacggccagtttgatacaacagtcagcgacaccgcctataacattacataccagaaatcagattataataattggatatacgtttcgttaacgaccattccggaactctatcagcagacggcatcaatcggctggttcacgtttacgatctgcctcattttgttagcgctttcatatttattctcctggtttggttcacgccatttttacaggccgatcaaggttttatacgaatccgtctccggcttttctccaggagccgattccgtccaagagaaaccgaaaaacgaatttgaactgattgaacggaacattaaagaaatgaaaaataaaaaccatgatctgaaggtgcgcgtcgaacagcaggtcacccagctgaagcagtattttttaacaaggctattgctcggcaagctgagcgaagaagaaatcaaagaccgctttactgggctcggcttccctgaagattggagccatctgtcggtattcacactgcaaattgatacattgaaagacacatcatacgaaaaaaaggatcttgatgtcctgctgtttgcgatcaacagccttgtcgaacgatctgtgcccaagaataagcgccttccgccggttgtcattgataaaacgcagaccatcatcatgctgaatcgcggacagccgctggaaaggtttcaggaagacttagagcataccgcatcagccattaaggataaaattcatgaagagcttgggttgttcgtcagcatcggcatcagccagccatttacaagtcttgcaatgtcaaagcgcggttatttggaagggcttgaagcactgacataccgtctgaaatccggaaaacacgcggtgattttctatgaacaccttgaccgcaacaaagcgtttttaacccagtttccgaagcagattcaaaatgaactgtttgaagccattaaaacgtgcaaccgtaaacaagcggccgaacagcttcaccttcttcttgagtcgatttgttctgaaaacatgaatccgcatcactgccagattgcgattgcaaggctgttgaacaacttgattgaatttatgcatttgctcggaatcgagatttttgaaccgaacgaaaatacgatgctgtacgacgacgtctttgagctgacgaccatcgaggaaattgaaagctggctgaacgcgcagattatcgttaaaatgatcgatacactcagcatcagagaagaatcgcaattctttaacatcgcagaaaaaatcgtccatattatccagcaggaattcgacacggacttgacgctcgaatcgatcgcaggaaggcttcattacaaccccaattatttaagcagcatcttcaggaaggaaatgaaaatatcgttcagcgaatacttgtcatcatacaggcatcatatcgcgaaaaactggctgacggaaacgactatgtccgtaaaagaaatctccgaaaaactgaaatacaaaaatccgcagaatttcatccgttcatttaaaaagctggaaggaatcacacccggcaaataccgcgagctgaa

SEQ ID NO: 1313 - DNA, 1122 bp, Bacillus licheniformis
atggctgataaacaagctcacgagaccgaaactgaattcacatttgaacaggtgagggatcaattaacagaagccggcaaaaagcgcggagtgctcacatatgaagaaattgcagagcgcatgtccagcttcgatatcgaatcagaccaaatggatgagtattatgaatttttaggagaacaaggcgttgaattaattagcgagaacgaagaaactgaggatcctaatattcaacagctggccaaggccgaagaagaatttgaccttaacgatttaagcgtgcctccgggcgttaagataaacgaccctgtccgcatgtacctgaaagaaatcggacgggtaaaccttttgtctgcaaaagaagaaatcgaatacgcaaaaaaaatcgaggaaggcgacgaagagtcgaagcgccgtctcgctgaagccaacttgagacttgtcgtcagcatcgcaaaacggtatgtcggccgcggaatgcttttccttgaccttattcaggaaggaaacatgggcctgatgaaggcggtggaaaagtttgactaccgcaaaggatataagttcagcacatacgcgacatggtggatcagacaggcgattacaagggcgattgccgaccaggcgagaacgatcaggattcctgttcatatggttgaaaccatcaacaagctgattcgtgttcaaaggcagctccttcaggatctcggccgcgagccaacgcctgaagagattgcggaagatatggatctgacgcctgagaaagtccgtgaaatcctaaagatcgcccaggaaccggtttcactcgagactccgatcggtgaagaggacgattcacatctgggagacttcattgaggatcaggaagcgacttctccatcagatcatgcagcatatgaattgctgaaagaacagcttgaagatgtgctggatacattgacagaccgtgaagaaaatgtgctccgccttcgcttcggccttgatgatggtcgtacaagaacattagaagaagttggtaaggtgttcggggtaacaagagaacgaattcgtcaaatagaagctaaagcacttcgtaaattaagacatccaagcagaagcaaacgcttgaaagattttctcgaataa

SEQ ID NO: 1314 - DNA, 1119 bp, Bacillus licheniformis
atgagtagtgagttgttagatgccctgactgttcttgaaaaagaaaagggaatcagtaaggacattattattgaagcaattgaagctgcgctcatttccgcttataagcggaacttcaaccaggcgcagaacgtcagggtagatttaaaccgcgacaccggttcaatccgcgttttcgcccgcaaagatgtcgtggatgaagtgtatgatccgcgccttgaaatctcgattgaagatgccgtaaacatcaatccgaactacattgtcggagatgtcgtggaaatcgaagtgacgccgaaagatttcggccgcatcgctgcccagacggcaaagcaggtcgtgacccagcgcgtccgcgaagcggagcgcggcgtcatctattctgaattcatcgaccgcgaggaagatatcatgacaggcatcgtccagcggatcgacaataagttcatctatgtctctttaggaaaaatcgaggcgcttctcccggttgcagaacagatgccgaatgaagtctacaagcctcatgaccggatcaaggtgttcattacaaaagtcgaaaaaacgacgaagggtccgcagatttacgtttcaagaactcatccaggtttattaaagcgtctctttgaaatcgaagtgccggaaatttacgatggaacggtcgagctcaaatccgtggcgagagaagcgggagaccgctcgaagatttccgtccgcacggataatcccgacatcgatcccgtcggcgcctgcgtcggaccgaagggtcagcgcgttcaggcgatcgtcaatgaattgaaaggcgagaaaattgatattgttcactggtcaaacgacccggttgaatttgtcgccaatgcgctgagcccttcaaaagtgctcgacgtcatcgtcaatgaagaggataaagcgacaacggttgtcgttcctgactatcagctgtcgctcgccatcggaaaaagaggtcaaaacgcccgcctggcagccaagctgacaagctggaagatcgatattaaaagcgaaacagatgcaagagagcttggaatttatccaagggagcttgaagaagaggagccggaagagcttttcttggaaagcgaaactccagaatcggatgaataa

SEQ ID NO: 1315 - DNA, 945 bp, Bacillus licheniformis
atgatcgagattgaaaaaccaaaaatcgaaacggttgaaatcagcgacgatgccaagtatggtaaatttgtcgtagagccacttgagcgtggatatggtacaactttgggtaactccttacgtcgtatccttttatcctcactccctggtgccgctgtaacatcgatccaaatagatggtgtactgcatgaattctcgacgatcgaaggcgttgttgaagatgttacaacgattatcttaaacattaaaaaacttgcactgaaaatctactctgaagaagagaagacgcttgagattgatgttcagggtgaaggagttgtaacagctgctgatattacccacgacagtgatgttgagattttgaatcctgatcttcacattgcgactcttggccaaaatgcgagttttcgagttcgcttaactgctcaaagaggtcgcgggtatacaccagctgacgcgaataaaagagacgatcagccgattggcgtcatcccgattgattccatctttacacctgtttctcgcgtatcttatcaagttgagaatactcgtgtgggtcagattacaaactatgacaaacttacgcttgacgtatggacagatggaagcactggaccaaaagaagctattgcacttggttcaaagattttgactgaacaccttaatatttttgtcggtttgaccgacgaagctcagcacgctgaaatcatggtagaaaaagaagaggatcaaaaagaaaaagttcttgaaatgactattgaagaactcgatctttcagtccgttcttacaactgcttgaagcgtgcaggaatcaatacagttcaagaacttgcgaacaaaactgaagaagatatgatgaaagttcgcaacctgggccgcaagtcgcttgaagaagtaaaagcgaaacttgaagaacttggacttggccttcgcaaagacgattga

SEQ ID NO: 1316 - DNA, 932 bp, Bacillus licheniformis
gtgaaagatgtatccatttcatctttggaaaatatgaaattaaaagagctgtatgagcttgcaaggcattataaagtctcttattacagcaaactgacaaaaaaggaactgatttttgccattctgaaagcaaacgccgaacaggaagatctgctgttcatggaaggcgtattggaaatcatccagtccgaagggttcggctttctcagaccgatcaactactcgcctagttcagaggatatctatatttccgcctcacaaatccgccgttttgatttgagaaacggtgataaagtgtccggaaaggtccgccctccaaaagaaaacgaacggtattacggcctgctgcacgttgaagcggttaacggcgacgatcctgaatcagcaaaagaacgcgtgcactttccggcattaacgcctctttatccagatcgccagatggtgcttgaaacgaagccgaatcacctgtcaacacggatcatggacatgatggcgccggtcggctttggacagcgcggtctgatcgtcgctccgcctaaagcgggtaaaaccatgctcttgaaagagatcgcgaacagcatcacaaccaatcatccggaagcggagctgatcgtgcttcttatcgatgaaagacctgaggaagtgaccgacatcgaacgttcggttgcaggagacgttgtcagctcaacgtttgacgaagttcctgaaaaccatatcaaggtggccgagcttgtattggaacgtgcaatgaggcttgttgagcataaaaaggacgttatcattttaatggacagcattacaaggcttgcccgcgcctataaccttgtcattccgccgagcggcagaacgttgtccgggggaatcgatcccggcgctttccaccgtccaaagcgtttttttggagcagcccgcaacattaagagggcggcagc

SEQ ID NO: 1317 - DNA, 1018 bp, Bacillus licheniformis
atgaatcaactaatacaggctcagaaaaaattattgccggatcttctcgatgtcatgcagaaaaggtacaaaattttgcagtacataaggctgactgaaccgatcggcagaagaagccttgctgccagcctcggcatcagcgagcggattttaagggcggaggttcagtttttaaaagaacaaaatctactagagattaaaacaaccggcatgatattgacacctgaaggatccgacctgctgaaagttctcgaagatacgatgaaggacgttttaggtttaactcatttggaaaatacattaaaagagaggttgaacctcgacgaagtcatcattgtatcgggagacagcgaccagtccccatgggtcaaaaaagagatggggagagcggccgtcgcatgcatgaaaaataggtttacgggggaaaatatcgtcgccgtaaccggaggtacgacacttgaggccgtggcagaaatgatgacgcctgactcgaaaaaccgcaagctgctttttgttccggcaagaggcggactgggcgaaaacgtcaggaatcaggccaatacgatttgcgcccatatggccgagaaagcttccggtacatacaaactgttatttgtgccggggcagctgagcaaagaagcatattcttctatcattgaggaaccttctattaaagaagtgcttcagacgattcaatcatccagtatggtgattcatggaatcggggatgctaaaacaatggcagaacgaagaaatacgccaaaggaagatttgaagaaaatagaagaaaatgaggcagttgcagaagcgttcggctactatttcgaccgccacggggaagtcattcacaaagtgcacagcgtaggcatccagcttgaggatctcgattcgatcccgaacatcattgcggtggcgggaggctcgtcaaaagctgacgccatagaggcatacttcaaaaagccgcgcaatacggttttgatcactgatgaaggagccgcaaaacagttattaagggaag

SEQ ID NO: 1318 - DNA, 1032 bp, Bacillus licheniformis
atgttaacaaatcgtcagctgttaatcttgcaggttatcgtcaacgatttcattcgttcagctcagccggtaggatcaagaacgctttccaaaaaggaagatatcacattcagctcggcaacgatcagaaacgaaatggctgacttggaagagctcggttttatcgaaaaaacccactcatcttcaggccggattccttctgaaaagggctatcgctattatgtcgatcatctgctttcacctggaaagctgtcaaaaacggacttaaacattattcattcgattttcaaagaaaaaatctttgaactcgaaaaagccgtgcagaagtcggcccaagtgctgtccgacctgacaaattatacatcgattgtcctcggtccgagactgagtgaaaaccatctcaaacagatccagattgtaccgattcagcccaagaaggccgttgccattctagtaacgaataccggccatgtggagaataaaacgattaatttcccggcggaggtcgatctttccgatctcgagaagctggtgaatatattaaatgaacgccttagaggcgtgccgatctcagaactgaaagacaggattttcaaagaggttgtcatcttcttgaagtcgcacattcaaaattacgatacgattttgcacgcgctcggcgcaacgctggattcatctgttcaaaccgaccggctgtttttcggcggcaagattaacatgctgaaccagcccgaatttcacgatattgacagagtgaaatcgctattgtcgctcattgagaaagaacaggagattctccggctctttcagtcgactgagtccggaattaccatcaaaatcggcaaagaaaacgactatgaagagatggaaaactgcagcctgattaccgcaacatacacggtcggctcaaaacagatcggctccattgcggtcatcggaccgacgcgcatggactactcccgcgtcgtcggcttgcttcagcacgtatcatctgacttgtcaaaagcgctgacaagtttgtatgatgggtaa

SEQ ID NO: 1319 - DNA, 939 bp, Bacillus licheniformis
atggacaaggaaaaacagcaattgagcattgaagcagcgaggctctactatcagtctgactacagccagcagcaaatcgccgaacagctgcagatttcaagaccgacggtatcaaggctgctgcagttcgccaaggaaaaggggtatgtccaaatccgcgttatggacccgtttgaagatatggatgcgctcggtgcgatgcttgaggaaaaatacgggcttctagaagcgcatgttgtcttttcgccgaccgcggattatacgaccatcacgcattatctcagccgcttcggggccgaatatatgcacggcgcagtcaaggacggcgacattgtcggcgtcagctgggggacgacgatgtaccaaatcgcccaaaatatgcagcctaaacaggtgaagggcgcagaggtcgttcaactgaaaggcggaatcagccattccagcgtcaacacttattcgtctgaaacgattcagctgtttgccgaagcttttcaaacgatgccgaggtatttgccgcttccggtcgtgtttgacaatccggaagtcaaacagatggtggaacaggacaggcacatcaagcggatcatagaaatgggaaaacaggcaaacattgcgttatttacagtcggcacggtacgcgatgaagccttgctgttcaggctggggtattttcatgaagaggaaaaagccctcctgaaagaacgtggagtcggcgatatttgttcgcgcttttttgatgcggaaggaaacatttgcagcgatgctatcgattcgcggacgatcggcattgaattggctgacttgagggaaaaagaacggtcgattctcgtagcgggcggcagccggaaaaaagccgctattcatggtgcgctcaaaggcaagtatgccaatgtgctgattattgatcagcacacggcgaaagaactgcttgatgactga

SEQ ID NO: 1320 - DNA, 1170 bp, Bacillus licheniformis
  misc_feature (1)...(1170): n = A,T,C or G
cttgaccaagtatcccttaaggcccgaattagtgcaaaaggggagttcatcaagatctcgggtcataaaaccgatcccggcatnggacattctttcngattattcataagcccggcctccccgggagactttccggctgaggcgatggaacaggccgggcaatacgcctgatacaatcgatgagaaagatcttgaaggcagacgggatctgcgcgatcaaacgatcgtcacgatcgacggcgcagatgccaaagacttggacgatgccgttaccgtcacaaaactcaaaaacggccattataaactcggcgtccacattgccgacgtcagccattatgtaacggaaggatctccgattgaccaggaagcgtatgaacgcggcacgagcgtctaccttgtcgaccgggtgattccgatgatcccgcacaggctgtcaaatggaatctgctccttgaatccgaaggtcgacaggctgacaatgtcatgcgaaatgctcattaatcctcaagggcaagtcgtcgagcacgaaatttttcaaagcgtcattaaaacgaccgagcggatgacttattctgatgtgaacaaaattttagtcgatgatgatgaagagctgaaacagaagtatgaggcccttgtcccgatgtttaaagacatggaagacttggctgcgattctgcgcggcaagcggatggaacgcggagccgtcgactttgactttaaggaagcgaaggttctcgtcgacgaagaaggaaaagcgaaggacgtcgtcttgagagaacggtcgactgctgaaaagctgattgaagaatttatgcttgtcgccaatgaaacggtcgctgagcactttcattggatgaatgttccgtttatttaccggattcacgaagatccagatcaggaaaagctgcagagatttttggagttcgttacgacattcggctatgtcgtcaaaggaacggcgggaagtatccatccgaaagcgctgcaaagcgtgcttgaagaagtcagggatcgtcctgaagaagccgtaatttcaacggttatgctcaggtcgatgaaacaggcgaaatacgatccgcaaagcctggggcacttcggcttgtcgactgaattctacacgcatttcacgtctccgattcgccgctatcctacttaattcgtccacagact

SEQ ID NO: 1321 - DNA, 951 bp, Bacillus licheniformis
atggcaacgttatctgatgtatcaaagaaagcaaatgtgtcgaaaatgacggtatcgcgggtgatcaatcatcctgagactgtgacggatgaattgaaaaagcttgttcattccgcaatgaaggagctcaattatataccgaactatgcagcaagagcgctcgttcaaaacagaacacaggtcgtcaagctgctcatactggaagaaatggatacaacagaaccttattatatgaatctgttaacgggaatcagccgcgagctggaccgtcatcattatgctttgcagcttgtcacaaggaaatctctcaatatcggccagtgcgacggcattattgcgacggggttgagaaaagccgattttgaagggctcatcaaggtttttgaaaagcctgtcgttgtattcgggacaaatgaaatgagctacgattttattgatgttaacaatgaaaaaggagcctatatggcaacacgtcacgtcattggtctgggcgtccgcaatgtcgtcttttttgggatcgatttggatgagccctttgaacggtcaagggaaaaaggctaccttcaggcgatggaaggcagtctgaaaaaagcagcgattttccggatggaaaacagttcaaaaaaaagtgaagcacgcgcgcgggaagtgcttgcatcctttgacgcacctgcagcggttgtttgcgcttcggaccgaatcgcgctcggggttatccgcgcggtgcaatcgcttggtaaaagaattccggaagatgtcgcggtcaccggctatgacggggtgtttctcgaccggatcgcttcgcctcgcctgacaaccgtcagacagcctgttgttgaaatgggagaggcttgcgcgagaatcctgctgaaaaaaatcaatgaagacggagcgccgcaaggcaatcaattttttgagccggagcttattgtccgcgaatcgactttgtag

SEQ ID NO: 1322 - DNA, 796 bp, Bacillus licheniformis
ttgatgatggcacaaccgtccaaaactacgaaactaactaaaaccgaagtcgacacgctgattaaaaaatatcaggagaaccaggatgaagacgctcagctgacccttgttcaaacatataaaaatctggtggaaacactcgccaaaaaatattcaaaaggaaaaagctttcacgaagatctatgccaggttgggatgctcggattgcttggagccatcaaacgctatgaccccgatgtgggaaaatcgtttgaagcgtttgccattccgaccatcatcggagaaatcaaacggtttctccgagataagacctggagcgtccacgttccgagaaggatcaaggagctcgggccgagaatcaaaatggcggtggatcatttaacgactgaaacgcaaaggtctccaagagtcgatgagattgccgagtttcttgacgttacagaagaagaagtgctggaaacgatggagatgggcaaaagctatcaggcgctttccgtcgaccacagcattgaagctgatgcagacggcagcacggtgacgatcttggacatcgtcggctcgcaggaggaaggctatgaaaaggtgaaccaaaagctgatgcttgaaagcgtattacacgtactatccgaccgtgaaaagcaaatcattgagctgacttacattcaaaacaaaagccaaaaagaaaccggcgaaatgctgggcatatcgcaaatgcacgtctcacggctgcagcgcaaagctgtcaaaaggctgagggaagcattggctgaagatccgtatatggagcttaaaccat

SEQ ID NO: 1323 - DNA, 874 bp, Bacillus licheniformis
atgcagcttcaagagcttcacatgcttgtcgttctggcggaagaattaaatatgcggaaagcggctgaacgtctgtttgtttcccagccggcattatcccagcggctgcagaccatcgagaaatcatggggaacgaaaatttttttaagatcgcaaaaagggctgactgtcacgtctgccggagaaaaaattatccagtttgcaaaagatgtaacattggaacaggaaaaagtgagagagaatatagatgagctggagggcgagatacacggtacgctcaaattggcggccgcttcgattatcgggcagcattggcttccgaacgttctgaaaacctacgttaaacaatatccgaacgtcaaaatctccctcgtcaccggctggagcagcgaaatgctgaaaagcctctacgaagaccatgttcatattggcattatcaggggaaacccggaatggaaaggccctaagcactacttgatgcgggacgaattgtaccttgtcgatacagagatccgaaacattgaggacattgccaaaacggaacggccgttcatccagttcaaaagcgacagcacgtactatcaggaaattcagcactggtggcaccaaaagttcaaaacatcgccgaaacaaaccattattgtcgaccaaattgaaacatgcaaacagatggctttccacggaatcggttatgcgatccttccatcggtgacgcttcacggaagcgggagccatgttcaccaaatccctttgcttgatgctaaaggaaaagcaatcggcagagatacgtggctgctcggttatgagccggctttccagctgaagcaagtacaggcgtttgtagaagttgtgaaagaatgtacggcaatggaat

SEQ ID NO: 1324 - DNA, 903 bp, Bacillus licheniformis
atggaattacgccaattgcattactttatggaagtagcggaaagagagcatgtatcggaagcggccatgcaccttcatatcgctcagtcggcgatcagcaggcagatcgccaatctagaggaagagctcggcgttgatttgtttgagcgcgaaggccggaatgtgaagctgactccgattgggaggcagtttttagaccatattaaaacggcgatgaaagcgatcgattttgcgaaggaacaaatcgacgagtatttggacccgaatcgcgggaccgttaaaatcggtttcccgacaagccttgcgggccagttcctcccgaccgtcatttccgcttttaaagaggagcatcctaatgtcgcttttcttttaagacagggatcttataaatttttaatcgaagcggtgaaaaacagggatatcgatttggcttttctcggtcccgtcccgtcaaacattgccgagattaaaggagacattttgttttcggagagccttctggcgctcgtgccggtcaatcatccgttgtcaggccagaaaagtcttcatctcggcgatctcagaaatgatcagtatgtgctgtttcctgacgggtacattctccgaaaaatggctgttgacgcatgcaagcaagtcggatatacgcctaaaatttcctcggagggcgaagatttggatgcgatcaaagggcttgtttctgctgatatgggggtgacgcttttgccggaaagcgcctttaatgaaacggcaccccgttttacaaagaagattccgattgattatccgcaggtaaagcgcacggtcgggatcatcacccctaaaaacagggagctttccccttctgcaaaagtcttttatcagttcgtaaagaagtttttttctcgccttcagcaatatcaataa

SEQ ID NO: 1325 - DNA, 1314 bp, Bacillus licheniformis
  misc_feature (1)...(1314): n = A,T,C or G
atgatgaacttgcatgtacagcagcagcaaacggcaaaacttcacttgacgcaagggcttgcccaagccattcatatgcttcagtattcgtcggccgagctgaacagccggattgatgaactctcattggaaaaccccctgatcgaacgaaaagactccgatattccccgatcattttaccataaaacgaatcgtcatttgcaaaatgaaggaataagccgctctgagacggcccattcccgtgaagatgttaaaagcgctttgaaacggcaggcgctcgatctccagctgtcaagccgcgaaaagcgggttttcagctatttggtcgaatcacttgatccaaacggatatgtgacagaagacatcgcctttatcgcttccgagctggctgtcaccagagaagaagctgaagaagtcttgggcaagctgcagactcttgatccggcaggcatcggggcgcggtcgctacaggaatgcatcctgatccaattaaagcgtctgcccaaggagacggcaaaagcggaaanagtcatttcctcatactttgacctgtttgccaaaaagggatggaaagagctgtcagagagagcggggctttcgctttcagagcttcaggacattcaagaccttgtcgcagaactgtcgccgcgtcccggattgatatatggcacagatgatggcgaagtctatgtcgagcctgatttaatcatttcagcagaggatggaaaattggtgcttgagctcagcagccgttcttttcccgacatccagcttaacgcgttttacgagccgtttttagagcgtcagtcaaaagacgaggcgaccgcttatatctctgataagttcaagcagtggaaatggctcgacaatgccctcaggcaaagacgggaaacgatgcggagggtgatggcggaaatcatggtgcggcaaaaagattattttttaaaagggaaagacgaactgaagccgctcacattaaaagagatcgctgatgccctcggcgttcacgaatcaacggtaagccgcgcagtcaaagggaaaatcgtgcagacgccttttgagctttgcgagcttaaacggtttttttcggcgaaggtaaaggacgccgctgacgggcatgcgtcaagtcacacagtcaaagcgcatctgcgccggctgatcgatgaagaagataaaatgaaaccgctttcagatcagaaactggccgaccttttaaacgaaaagcacggcgttgtcatatcgaggcggaccgtcgccaaataccgtgatcagctcaatatactgccttcgtctgtaagaaagagatatcaataa

SEQ ID NO: 1326 - DNA, 777 bp, Bacillus licheniformis
atgttgcttgttatagatgtaggaaatacaaacaccgtccttggcatctaccacgaaggagagcttgaatatcattggcggattgagacaagccgccataaaacggaagacgaattcggcatgcttcttcgttctttatttgattatgtcggactgatgtttgaccagatcgaggggattattatttcatcagttgtaccaccgatcatgttctccctcgaaagaatgtgtatcaaatattttcagatcgagcctcagattgtcggtccgggaatgaaaacaggattaaacataaaatacgataatccgaaagaagtcggagcagaccgcattgtaaacgcagtagccgctattcatctctatggcagccccttgattgtcgttgattttggaaccgctacgacgtactgttacattaatgagcgcaaggaatatatgggtggtgcgatcgcgccgggcatcacgatttcaactgaagcgctttattcaagagctgccaagcttcccagaattgaaattgcacggcctgatcatatagtcggcaaaagtacggtcagcgcgatgcagtccggaattctttacggctatgtcggacaggttgaaggcattgtcaaacggatgaaatggcagtccaagaaaaatccgaaagtcatagcgacgggcggccttgcttccttgattgcagacgaatcggactgcatcgatattgttgacccgttccttacgttgaaggggctagagctcatttatgaacggaatcgtgttgaaagtgtatag

SEQ ID NO: 1327 - DNA, 849 bp, Bacillus licheniformis
atgcctaaaggtctcggaaaagggattaatgcattgttttcaaatgttgatttatccgaagaaacggttgaggaaatcaagctgcaagacttgcggcccaacccttatcagccaagaaaaacgtttgatgaccaatcgttaaaagatttgaaggagtccattttgcagcacggtgttttgcagcccatcatcgtcagaaagtcaattaaaggctatgacattgtggccggagaacgccgtttccgggctgctgaaaaggccggattggaaaccattcctgcgattgtgcgcgagctgtcggaatccctgatgatggagattgccctattggaaaatcttcaacgagaagacctgtctccgcttgaagaagcaaaagcctatgaatctttgctcaaacatctcgatatgacccaggaacagctggcgaaaaggcttggaaaaagcaggcctcacatcgccaaccacttgcggctgctgacacttcctgaagacgttcaaaagttaatcgacaacggcacgttatcgatgggccatggccgaacattgcttggattgaaaaacaagaaaaagcttgagccgcttgttcaaaaggtcgtgtccgaacagttgaacgtccgccagttggaaaagttaattcaacagttgaacgctgatgttccacgtgaaacaaagaagccgaaacaagtcaaagatgcagtgatcaaggaacgggaatcgtatttgcgaaactattttggaacaccggtgaccattaaaaagcaaaagaaaaaaggcaggatcgaaatcgaattctactcaaatgaagacttggagcgtattctcgaattattggctcaagaagacgcataa

SEQ ID NO: 1328 - DNA, 869 bp, Bacillus licheniformis
atggatttgctgaagaacatgaatcaagccatggcgtatatcgaagaacacctgacggacagtatcgactttcaaacggttgcgaagctttcttactgctctgaatatcattttaaaaggatgttttcttttcttgccggggtttcgctgtccgaatacatccgccgcaggcggcttacccttgcagcgtttgaactgaagaacacaaaaagaaaagtgattgatattgcggtgaaatacggctatcactcgccggatgcttttacgcgcgcatttcaaaagctgcacggcattacgccgacagaggccagacacgatatcagcacactgaaagcatatcctccgatgaccttccagttaacaattagaggaggaaacgaaatgaactaccgtattgtagaaaagaaggcattccggatcgtcggaatcaaaaaaagagtccctgtcgtctttcacggaatcaatccggatatcgcctcgatgtggaaaactttaagcagtgaaaacatcgatgaattaaaggagctttcaaatgtggaaccgcttggactgattcaagcatcagcgaacttctccgaaggcaggatggaagagcagggagaacttgaccattatatcggtacagcgacaacgaaagaatgtccggaccaatatgaacagcttgaagttccggcctcgacatgggctgtctttgaagcggccggcccgtttccggacacccttcaaaatgtctgggggcgcatttatgctgaatggttcccgtcttcacattatgagcaaacgaaagggccggaaatcctctggaatcaggatcaagatatcagctccccaacgtttaaaagcgaaatatggataccggttcaaaaaag

SEQ ID NO: 1329 - DNA, 720 bp, Bacillus licheniformis
atgaaaaaactaaaattaaggttaacctatctatggtacaaacttttaatgaaactggggctgaaaagcgacgaaatttattatatcggcggaagcgaggcgcttcccccgccattgtcaaaagatgaagagcaggtgcttctccataagctgcctgacggtgatcaggcggcacgagcgattttgattgaacgaaatctcagactggtcgtgtacatcgcgagaaaatttgaaaatacaggaatcaatatcgaggatttaatctccatcggcacgatcgggctcatcaaagcggtgaatacgtttaatcccgagaaaaaaatcaaactggctacatatgcttccagatgcattgaaaatgaaattttgatgtatttaagaagaaacaataaaatccgttcagaggtatcattcgacgaaccgctgaacatcgattgggacggaaatgagctgcttctctcagatgtgctcggaacagaaaacgacattattacaaaagacatcgaagcaaacgttgacaagaagctgctgaaaaaagcgcttgaacagctcaatgacagagaaaaacagatcatggagctccgtttcgggcttgtcggaggggaagaaaaaacacaaaaagacgttgccgatatgctcgggatctcccagtcatatatttcccgacttgaaaaaagaattattaaaaggctccgaaaagaattcaacaagatggtttaa

SEQ ID NO: 1330 - DNA, 929 bp, Bacillus licheniformis
atggcaaatatcagggaaatagctgaagcggcaggggtttccatcacgactgtttcgagggttctcaacggccacccgtatgtcaaagaagaaaagcgtcaaaaagttcttgagacgattgaacgcctcgaatatgcaaggaatatgcatgccgttcatttatccaaaggcttttccaacatgataggcgttgtgctgccgaccatcagccttccttatttcggcgagctgctggaaggaatcgctgaagaagctgcgaaggaaggcgttcacttttcgctttaccaaacaaattatcaattggaaaaagaaatttttgcattggagcagctgaaacaaagacaggtggacggcctgattttctgttcaaaagcgatgtccgatgaagcgcttttggactggcgtgaaaccggcccgttcatcctgtgccaggactcaggcgagcagcactttgcaacggtcagcattccgcataaagaagcattcagacttggattggattttttaattgaaaaagggcacacaaaaatcgcgattggtttggcaaggaaaaacggcatgaacagccattttcgcctcaaggcatacaaggaagctttggccgcgatcggggagccttaccgggaagagtgggtatttgagcggtcgctgacaattaccgacgggcaaaaactgttctccgaatggaaagggatggaggagaagccgacggctgtttttgtcgcaaacgaccaagtatcagccggtatttttcttgaagcgcagcggcatcaagtggatattcccggaagcctcgctattttaagctgtgacaaccagccgatcagcgaagtgctcggcatttcaacaattgaaatcaatataaaggaaatggggaagcgcgcgtttcgccttctgcaaaaaagaatcggcggcgccgggccggaaaa

SEQ ID NO: 1331 - DNA, 810 bp, Bacillus licheniformis
agccgtttaagcacgagctagtgtttcatatcagggcaaacgggaagaaccgcaaattgctgctctccgcccatccgagttatgcgcgggtacacctgacaaacgaaacctacgacaacccgagcacccctccgatgttctgcatgctcctccgcaaacatctggaaggcggctttatcgaccaagtcgagcaaatcggcatggacagaatgatggtctttcatatcaggagccggaacgaaatcggcgacacgctgacaagaaagctgatggtcgaaatcatgggcaggcacagcaacatcgtgttaacagacggagaaaaagacgtcatcatcgacagtttgaagcatctgtcacctgcgatgaacagctaccgcaccgtgctcccgggatacgattacattctccctcccgcgcagaacaaattgtctccgcttgaagcggagactgaagatattctccgccatctgaatttccaggaaggcaaacttgacaggcagatcgtcgataccttctccggcgtctcgcctctgtttgcgaaggaagccgtctttcgcgcgggtctagccaacagggcgacactgccaaacgtcttgacggagatgttcagcgaaatcaaaagccggcgttttcagccccagcttgtcaccacagaagacggaaaagaatatttttaccttcttgagctgacccatataaaaggagacaacaggccctttcatacgctgagcgaacttcttgaccgctactatttcggaaaagcggagcgtgaccgcgtcaaacagcaggctcacgaatttagagcgtttc

SEQ ID NO: 1332 - DNA, 751 bp, Bacillus licheniformis
gtgaaaccagtgcttagccttttgtttaagacaggaaaaaggaaacaatcattagaagagtctgtaataagcatacaaaaaggaaatcagcagttgcaaaacgagcttatcgatcaatataagccttttgtggctaaaacggtttcatccgtgtgcaaacgatatatagatgaaaaagatgatgaattcagcatcggcttgattgcattcaatgaagccattgaaaaatattcttcagataaaggaaattctctgcttgcatttgcagagctgatcattaagcgcaaagtcattgattatatcagaaaagaagcgagaaatgcccagaacatcaatatggacatgcaagaaggagaagaacaggaatcctcccaaagcatgattgaagcggagctttccattcatgaattcaaccgcatgctcgaacaggagcaaaggcgggaggagattctccattttaaagaaaggcttaaaagttttggcctgtctttttccgatttgctggagcattccccgaaacatacggatgcaaggcaaaacgccatcaaagtggcatatacgcttgtcgaacatgaagaattaaaaaagatcttgtttgaaaagaagcagcttcccgtcaaacagcttgaaaagcttgtggctgtcagcagaaaaaccgtagagagaaaccgcaaatatatcatcgctatggcgatcattataacgggcgattatgtttaccttaaagattatctaaaaggggtgctcaatt

SEQ ID NO: 1333 - DNA, 642 bp, Bacillus licheniformis
  misc_feature (1)...(642): n = A,T,C or G
naaaaaaagacgaaagttcggcgttcccattttatttgaaaacgaagccaacgccggcgccgttggcgagaaggaatacggggaaggcggccagcttgagcatgccgtgtttgtcagcattaataccgggatcggtttagggattttaatgaatggaaaattgtttagaggtgtgcaaggttctttttgagaagccgggcacatgtccattcactttgacggtccgttatgccggtgcggaaatagaggctgctgggagctttacgcttcagaaaaagccgtcttctctcactatgcagcgaattccggggcccagctttacgaaaccgttaaagaacttgcagaccgcggtgatccgggcatgatggagacgtttgaacgctttggctttcatatcggcatcgggcttctcaacatcttgaaaacgttgaatcccgacaccattatcttgcggaataccatagtggaatcctatccgagcatcgtcgatgcgatcaaaaaaacgattgcctcaagaagcgcagcagaagccttgtctaattatcatttaaaaatctccacgctcggccgcaccgcctcagcgcttgggatgtcctcccttgtaaccgaacgttttctggaacggtttatgaacgagagatt

SEQ ID NO: 1334 - DNA, 999 bp, Bacillus licheniformis
atgtcagtaacgattaaagatatcgccaggctggcgaatgtatcgcacaccacagtatccagagcgctgaacaacagtccgctgataaaagagaacacgaaaaagaaaatactcgacatcgcagccgaaatgaattataaaccgaattttaatgcgaaaagccttgtcacgcaaaagtcttttacgatcggcctgtttttaacaagcctgacagacgggacgtcttcaagtttctttgcagacatcctgcgcggcgtcaacaaggtgatcgatgaaaactataatatggttgtcaggggaatcgacgattatcatgatttgtcatccattcaccgcaaccgctatgacggcatgattttaatcagccaaagcgaacaggatcaggcttttattgagcatgtcctcaaacagaatattccggtcgtcgtgctgaacagaaaaatcgaagggcactccgttgtcaatatactggcgaatgaacacgagggcgctttcctcgctgcttcatacttgatcaaaaacggccacaaacagatcgccatggtgcaggggaaagaaggctttaaatcgtctcaagaaaggaaaggaggctttcttcgcgcgcttcgcgactcaaaccttgatatgcccggcgaatacctcgttcaaggcgattatacgatgcaaagcggctttcgcgcggctgaaacgctgctaaagctgaagaatcctccgacagccctgttttgcgccaatgatgatatggcgatcggcgcgatgaacgccctctatgcaaacgggaaacgctgtcctgacaatatgtcgattatcggctttgacgatagcggattttcggcgtatacgacaccgtcattgacgacggtaaaaaaaccgactgaaaaaatcagcatgcttggtgcggaaagcctgctgtcattgatcgaaaacccgcaggcagaaggcgggcagacgctcatcagcacggagctgatcattcgcaattcagttaagcatctatag

SEQ ID NO: 1335 - DNA, 705 bp, Bacillus licheniformis
gtgtttttgcagcgctcggttatgtcatcaaggaactcgtttttttagtatcatatgtgaaaaacaatgcctttccacaaccgctgtcaagcagtgacgaaaaaaagtacttggagctgatggcccagggggatgaacacgcgagaaacatgctgatcgaacataacctccggctggtcgcccacatcgtcaaaaaattcgaaaacacaggcgaggatgcagaagacctgatttccatcggaacgatcgggctgatcaaagcaatcgaaagctattcagccggaaaaggaactaagctcgccacttatgcggcgcgttgtatagaaaacgagatcctcatgcatttgcgcgcattgaaaaaaacgaaaaaagacgtctcactccatgacccgatcggccaggacaaagaaggcaacgaaatcagcctcattgatgtcctcaaatcggaaaacgaagacgtcatcgacaccatccagctcaacatggagcttgaaaaagtgaaaaaatacatcgacatcctggacggcagagaaaaagaagtcatcgtcggccgcttcggccttgatttgaagaaagagaaaacacagcgcgaaattgcgaaggagcttgggatttcgcggagctatgtgtcgcggattgagaaacgggcgctgatgaagatgtttcatgagttttatcgggcggagaaggagaaaaggaagaagg

SEQ ID NO: 1336 - DNA, 816 bp, Bacillus licheniformis
gtttccggccaacgaaaagaaaaggacgaaaataaatcaaaaaggtgaaaaaaacgcaagagcagtccgaacacgcgcaagacaatcagctgtacgaagagctgtgacagcgaacctgtaccagctgaaaaaaggggacaaagaggcgaaggtcatcaactactatgatgaaaacggcggagaaatcacgattccgctcaatcctaataaaacgccttctgaaaatgcacaaagctattttacaaaatatcaaaaagcgaaaaattcggtagaagtcgtgaaggagcagatcaaattggcagaagaggaaatcgcttatttcgaccagctgattcagcagctttcatctgcctcaccgaaagatataaccgaaattcgcgaagagctcgccgaaggaaaatacttgcgggccaagcagcaagggggccagaagaaacagaaaaaacaggcgccgacgctcgaagcatatgagtccagctcaggagaaacgattctcgtcggcaaaaacaacaagcagaacgaatatttaacgatgaagcttgccgcccgcgaccacatctggcttcacacaaaagatattccggggtcgcacgtcgtcattcaatcgaccgatccggacgagcaaaccattctggaagcggcgcagatcgctgcatattacagcaaagcgaaaaactccgcttcggttcccgtcgactatacaaaaatacgccacgtcaaaaaaccgaatggcgcaaaaccggggtttgtcacctacgacagccagcaaaccgtttttgtaacacctgatgaagacttgatcatcaagctgaaaaa

SEQ ID NO: 1337 - DNA, 873 bp, Bacillus licheniformis
atggatattcgccagttaaaatacttcgttacaatcgcccgggaaggaaaaattacaacggcggcgaagcggctccatattgcacagccgccgctctccaggcagttgaagcagatggaagaggagctcggagtcgttttatttgaccggaacaaaaagaaaaacctgacgttgacctacgaaggagaagtttttttgaaaagagcaaaagaaatcctgcacaagcttgaggattccatcttggaggtgcgggagctgcgtgaagaagtcaacggaacccttgccgtcggctcgacgatttactgcgcggccctgctgctctcaaaagtctcgaagatcagagatatgtatccgaatttaatgtttaacatttgggaaggtgagccttcacggctaagcgagctcctggaaagccggcagatcgatgcagccgtcacgacaacgcctatccacagcaaaaacaccgaatcaaaaagcctgccggaggttccatgcaagcttgttcttccagggaatcagtcgtatggcttaaaaggagaagccggaatgaaagaaattgccggcctgccgctgattctgctcaggccgtcgcacggaaaagggatttacgacgaggtcgtccatcactttcaatcatctggcctcgaaccgagggtcgtttgtgagtgccatgattctacaacgcttctcagcctcgtcacttcgggattcggagcgacgattctgccgctgtccatgctgccggcgcattttgcacggcatgttcagacattggaaattcaaaacaatccgttcattctgcagccgtctgtcgtttggagggccggcagttttctgccgaagcctgtgagagaatttttggctttattttga

SEQ ID NO: 1338 - DNA, 868 bp, Bacillus licheniformis
atggagctgcgccatcttcgttattttatggttgttgccgaagaactgcatttcggaaaagcagctcttcggctgaacatgactcagcctccgctcagccagcagattaaacagctagaaagtgaaataggcgtcaccttgctgaagaggtcaaaaagagccgtcaggctaacggcggcaggcggggtctttttaaaacaaatcaaggaaggactttcccagattgatcaggccgtcgacatggctcagcggacggcccgcggggagctgggaagactcgtgatcggctttgtccgctccgcaacatacgagatcatgcctcccatcatcagggaataccgaaaccggttcccgtccgtgcagatcgatcttcgggagctttcaacccccaatcagatcgatgcactgctaaacgggcatattgacatcggggtgctgcatcccccgttgggaaacgacgaactgaagtcatacacggtaaaaaaaagccattgtgtccttgcacttccaaaacaccacccgttgacagaaaaagcccgggtacatttgaaggatcttgaagaagaatcgctgatcgtcattgccaaagaagcgtggccctctttatacacggaattcaatttcttgtgtgaaaaagccggatttatccccaacatcgcccaggaagctacagaataccaaatggtgatcggcctcgtatcggccggaatgggaatcgccgtcgtgcctacggcggctaaacgattatttaaccttgatgttgtatacaaagaaatcgaagactttccccttcgcgccgaatggattaccgcacatcgaaaggacaaccgcaatccggcacttaagcatttcatcgaaatctcagatc

SEQ ID NO: 1339 - DNA, 631 bp, Bacillus licheniformis
gtgtcgaggaataaagttgaaatctgcggggttgatacatcaaaactgcccgtactgaagaacgaagagatgagaaagttattcaagcaaatgcaggatgaaggagacacaacagcgagagaaaagcttgttaacggcaatttgcgccttgtcttaagcgtcattcaaaggtttaacaacagaggagaatatgttgatgacttattccaagtcggctgcatcggactaatgaaatcaattgataattttgacctgagccacaatgttaagttttcaacatatgctgtaccaatgatcatcggagaaatccgcagatatttgcgcgataacaacccgatccgcgtctcacggtcactcagggatatcgcgtacaaggcgctgcaagtgagagaacggctgatcagtgagacaagcagggagccgactgctcaggagatcgctaaagagcttgaagtgtcccatgaagaaatcgtttttgcgcttgacgccattcaagatcctgtatctttgtttgagccgatttacaatgacggaggagatccgatttatgtcatggatcaaatcagcgatgagcgcaacaaggattcgcaatggatcgaagagctcgcttaaaagaaggcatagaggaaga

SEQ ID NO: 1340 - DNA, 990 bp, Bacillus licheniformis
atgcctacgattgacgaaattgcaaaattaagtaatgtgtcaaaaacaactgtttcaagagtactgaacgatcatccctatgtatctgaagaaaaaaggaagcgggttttggaagtcatcgaaaaattggactacatcccgaacacgtctgcacgaaagctcagatccaacaaaacgatgtttctcgcagtgtctgtcccacacgcggaccaccccttcttcgctcagcttatgaagcatatgtccgctgaagcgctgaaacaccaatacaaagtcattgtgtttcagacgttttatcaaaagcagaatgaactgaaagtactggagctgctcaagaggaaagaagtcgacggcgttatgctatgcagccttgaaaatgaatgggaagacatcaaaaaatacgtcaaatacggtcccgtggttatggcaaatgaattccacgccgaagcggacgtgccggtgatctgctatgacgaattcgaagccggatataaaggaacggagctttttattcaaaaagggcatcatttaatggccttttgctgtgacacgatacacagcaaggcccagattatgagaaaagaagggtttatgaaagcattgtctgatgcaggtttgcgtttccaggagaagtggatgttcagccacgcatttaccattcatgacggcttccgcattatggaccagatccacaacatgtccgaaaagccgaccgccatttttacgggaaacgaccaagtggccgcaggaattattaaaagggcccgatattatcaatatgaagtgccaaagcagcttgcagtgcttggatatgacaatcaatcgatctgtgaggtgaccgatccggaaatcacgacaatcgatatacctgttgaagagctggctcaaaaagccgtatgtgcaatggtaaaccttctgaatggggaaagcggcttacagagggatgtcgtgacactgtcccctgcattaaaaataagacaatctgtttag

SEQ ID NO: 1341 - DNA, 837 bp, Bacillus licheniformis
caggggctgaagggtgaaaaaaagcaaagttatcggatttttggtcgccgatattacaaacccgttttcagtagccaccttgagaggggtggaagaggtttgcgatcagtacggatacagcatcatggtctgcaacacggacaacagtcctgagaaagaaagggagatgctgcacaagctgaacgcgcattacattgaagggctgattattaatacgacgggaaggaacaacgatgtgctcttggatttaatcagccaggatgtatcgattgtgctcgttgaccggaaagtgcccgggctcaagatcgatgcagtcacaacgaacaaccgcgaagtgacaagtcaaatcgtcaatctcatgtatgacaaaggctatgcccaggtcggtctgtttaccgaaccgattaagggaatcagtccaagggaggaaagggcctccgcctatacagaaatcgcgctggaacgaaacgccggcggtacccctctcgtatatgaggctgacgtcaaagacaaagaatctctattacagtccgtcaaaagctttttggaaatgaaagaagggaaaaaagccattcttggaaacaacgggcttctgatgctgaaaatcatcagctgcctttatgagcttggcatttcaattccggaagatgtcggaattgccggatttgatgatacagaatggtataaattgatcggtccgggcattacgaccatcgcccagccgtcgcatgaaatgggcagggtcgccatggagcggatcatcaaacggattgaaggagacgaaagcgccccgcagacgattcagcttgaggcggagcttgttctcagacagtcgct

SEQ ID NO: 1342 - DNA, 677 bp, Bacillus licheniformis
atgaagttttcagaagaatgccgaaacagcgctgcaacttggtgggaagggagttttgtccatccgtttattcaaggaattggagacggcacacttccggttgaccgatttaaatactatgtcatgcaggattcctactatttgacccactttgccaaagtccaatcctttggagcggcatatgctcacgatctatatacgacaagccggatggccgaacacgcgaaagggacatatgaagccgagatgtcgctccacaggaaattcaccgatctattgggcatcacaaaggaagagctggagtcgtttcagccgtcgccgacagcgtatgcgtacacatcgcatttgtaccgttctgtcgtcagcggcagttttgcggaaatactcgctgctttgcttccttgctattggctctattatgacgtcggcgaaacgctgaaaacgtgcaggcctgacaacgcgatttatcaggaatggatcgcgacatacggaggagactggtttaaaaaatctgtaacggaacagatcaaccgcttcgatgagctggctgaaaacgccgatgagaaaacgcgcgcgaagatgaaggagaatttcgtcatctccagcttctacgaataccggttctgggatatggcctatcaaaaagaaagctggtcaaaaagcggggtggatcagct

SEQ ID NO: 1343 - DNA, 696 bp, Bacillus licheniformis
aagatatggaaacattgcaggtcgaatcagtcaatcgcaagactttggcaaaacaggttgttgaacgaatcgtccatttattatcaagcggccagttgaaaccgggggacaaactgccgacggagattgagctcatggaaaagctgaatgtcagcagacccgttctccgcgaagctttaatatcgctcgaaacgctcggaattatcaaaagaaaaacccgggacggcacatattttaatgataaaatcggcattcagccgttttctgtcatgctggctttggcagtcgataatttgccggccattattgaagcgaggatggcgctggagctcgggcttgtcacgatcgccgcagaaaagatcaatgacagtcagctcgaaaggcttcaggaaacgatcgatattatagcaaacagcacggataatcattatggagaagcggataaggaatttcaccggattatcgctttgagcgcgaacaacccggtgcttgaagggatgattcaatcgctcttgatcacacacgccaaaatcgacagccagattccatatagggaaagggaccggactgtcgaatatcatacgaatattttgaaagcccttcaacaaagggacccatatcaagcctatcaccatatgtatgagcatttaaaatttgtacgtgacaaaatactgaatggtcttcgtgatgaaaaaa

SEQ ID NO: 1344 - DNA, 726 bp, Bacillus licheniformis
atgtcgataaaagctgacaatcaacggttatgtttaaaggtgattgatcggataaaagatgatattcaaaatggggtcttttgcgaaaatgaacggctcccgagtgaatttgagctgtcaaagatgcttggtgtgagcagaacggctttgcgtgaggcgcttagaatactggaagaagaaaacgtcatcatcagaaggcatggagtcggacattttgtaaatgccagaccgttatttctatcaggtattgagcagctgaacagcgtcacaaaaatgatcgagcaggcaagcatgacgccgggaaccatttttatgtcctcacaggttaccgctcccactgaagaagatatgctccggtttcaatatgcggaagaaaccgagatctttttgcttgagcgggtgagaacggcaaatggaatgccggttgtctactgtcttgataaaatacctgtggacattctcccggaaggcttttcacacgagcaggagtcgatgtttgaatggcttgagaacaaatccggcgccgtgatcagctacgctgttgccgatattgtgccaatcggatatcatgacaccatttcccaaattcttgaatgcgatcctgaaacgtctttgctgctgctcaaacagactcattatgaccaaaacgataagcccgttttatattctttaaactattttagggccgataaattcagatttcatgtcgtcagaaaacgtttttga

SEQ ID NO: 1345 - DNA, 1021 bp, Bacillus licheniformis
atggcgacgattaaagagattgcgcttcaggctaaagtatcaagcacaacggtttcaagggttctgaaccatgaccagtcattatcagtagcgcctgaaacaaggcagcggattttggatatagcagcccggctcggctataaaagcacgcgcaggcgccgcgaggtatatgcctcaggaagcggggaaagcccgcgcatcggcattgttgtctgccaatcacaggaagaagagctgaacgatccgtacttttattccatcaggcagggaattgaaagtgagtgttttgaaagaggagcgtttattacgaaatttattcagctgagcagcatccgctcgaatcagcctgtaggcgatgtcgacggcttaatcgtcatcggaaggatcaactttgccggtttgcagcagtgcatgggcgcgctcaacaacgtcgtgtacatcaaccatacagacaatgaagagctgcgcgactcggttgtcgtagattttgagaaggctacggggagggcgctgaaccatttgaaatcgctcggctatacaaggatcggttatatcggcggaagagaaaaagagcactttcgaatcagcgatcaggagacaagcgccattgaaatcgaagacaaacgtctgactgcgtttctggagatggccggttcggataacgcaaagcacatttatatcggcgagtattcgatgcagcaaggctatgaactgatgaaaaaagcgcttttagagaaaaacgttcccgaagctttttttatcgccagcgattcaatggccatcggcgcgctccgggcgcttcgagaatcgggactcaaggttcccgaagatgttgcaatcgtcagcttcaacggcattgaagcgtccgaatttgctaatccgccattgacaaccgtaaaggttcatacagaagagatgggccggacgggtgtgaagctgctgctcgacagactgaaaggaagggaactgccgctgaaagtgaccgtaccttcagagctgattattcgggaaagctgcggat

SEQ ID NO: 1346 - DNA, 563 bp, Bacillus licheniformis
gtgaacttacaaaacaaccagggaaaattcagcaaagaacagttcagcaaagaacgtttttgccagttggaagacgagcaggtcattgaaatggttcatgtcggagacagtgatgcgttagattacttgattacaaagtaccgtaattttgtaagggcaaaagcaagatcctacttcttaatcggggctgatcgggaagatatcgttcaggaaggcatgattggactctacaaatctatccgtgattttagagaggacaagctgacttcattcaaagcttttgcagaattatgcattacccgccaaattattaccgctatcaaaacagctactcgccagaaacatattccgctcaattcttatgtgtcgctggacaagcccatttatgacgaggaatcagaccggacgcttctcgacgtgatttcaggggccaaggtcatgaatcctgaagagctgatcatcaatcaggaagaattcgatgatatcgagctgaaaatgggagaattgcttagtgatttagaaagaaaagttcttgcgctctatctcgacggaagatcctatca

SEQ ID NO: 1347 - DNA, 669 bp, Bacillus licheniformis
gtacgatgctaggaaagcaagttgacggtatcgtctttatgagcggaaatgtgactgaagagcatgtggaggaatttaagcgatcgccagttccgatcgtgcttgcggcatctgttgaagaaaaaggggaaacgccgtcggttgcgatcgattatgaacaggcgatttatgatgcggcaaccatgctgattgagaaaggccataagcgccttgcgttcgtctcaggacctatggctgaaccggttaatcaagcgaaaaaactgcaaggctttaaaagagcgcttggggataaggggctgcaatttaaggaagagtatgttgtagaaggcgattatacgtacgattcaggaatggaagcgctggaggctttaatgaagctggatgaaaaaccgacagccgtcctgtcagcgacagacgaaatggcgctcggcgttattcacgcagcacaggataaaggactggctgttccggatgaccttgaagtgatcggttttgacaatacaaggctttcattaatggttcggccgcagctgtcgactgtcgtccagcctacgtatgatatcggtgccgtggcgatgaggcttctgacaaagctgatgaacaaagaggaagtcgaagagcatattgtccagctgccgcatcgcattgaactcagacaatcaacaaaat

SEQ ID NO: 1348 - DNA, 858 bp, Bacillus licheniformis
aggaagaaacaatggctgcaggaggattggaaatcattcagaatatgcttcacaaattgccgcaatctgaacgaaagcttgccgaatacattttgaaaaacccccacgagatcgtaaacggcaccattcaggaggtgagctcttcggcaaagacaagcggggcggcggcgatacggctctgcaaatctttggggctgaaaggctttcaagatttaaaaatgagagtcgccggtgatttaatgaagccgtctgatcagggataccgggatatcgaaccgcaggagccgctccattcaatcgttcaaaaaacaaccagcaattcgattcaggcgattcgcgatacctttgaaaacattgaccacgaagaacttcaaaaagcgattcaaatattgatcaacgcagaaacggttcatttttgcgggatcggggcttcaggaatcgtcgcacaagacgcccagcagaaatttttgcgcatcaataaaaaggccaccgcttttagtgatatgcatcttgttgcgacattaatcgccaatgccggcgagaatgacgttctgtttgctatatcccattcaggagaaacacaggaaatcgccaatgcagtcaggctcgccaaaaaacatggtattaaaaccattgggctgacgcggttgggacagtctgctgtcgcttcattaagcgatatcgccctgtatacgtcatgctcaaatgaagcgccgtttcgcagcgccgccacctcctctcgtttaactcagctttacatgattgacttactgtttttaggcatggccgcagagcgctacgaggacatcattcagtatattgatcaaacaaaagcggccatccgcatgatgggaattt

SEQ ID NO: 1349 - DNA, 835 bp, Bacillus licheniformis
gtgcaatagaagcaggaggcacaaagtttgtttgtgcagtcggaacagaaaagggagaaatcatagacaggctgacgatcccgacggagacgcctgaagagaccattggaaagctgaccgatttcttcagcaagtatcagctcacatcaatgggagtgggctcttttggacctatatccgttgcaaaaaataaagaggattacggatacataaccaataccccgaaattagcctggaaggggtacccgtttattcccgaattggaaaaaaggcttggcattccggtttcgtttacgactgatgtaaacgctgccgcgcttggagagctgacgaaaggagaggcgcaaggcctggagagctgcttgtatatcacagtcggcacaggaatcggagcaggagcgattgtcggcggccggctcgtacagagcacgctccatcctgaaatgggtcacctactcattagacggcatccgcaggatacgtttgaaggaatctgtccgtatcacaaggactgccttgaagggatggcatcgggcccggcgcttgaaaagcgatgggggaaaaagggcaaggatttggctgaaaacgaggaagtttgggagcttgaagccgactatttagcacaggccctcatgcaatatatcttgattctgtgccctgaaaaaatcatcatgggcggcggtgtcatgaagcagcagcagctgttcccgctgattcgcaaaaagctggccgaatatttgaacggatatgtcgacctgcctgatcttgaagaatacatcgtgccgccgggccttggcgacgatcagggaatcaccggagcgcttgctttggctca

SEQ ID NO: 1350 - DNA, 584 bp, Bacillus licheniformis
atgcaatccttgaactatgaagatcagatgctttggtcgcggtggaaagaatggaaagatcctcaggcaggcgatgatttaatccgccgctatatgccgcttgtgacatatcatgtcggccggatagccgtcggcttgcccaagtccgttcataaagacgatttggtcagccttggcatgctgggtttgtatgatgcccttgaaaaatttgatccgggaagggatttgaagtttgatacatacgcttccttcagaatcagaggcgctatcatcgacggtcttcgcaaagaagactggcttccgagaacgtcccgtgaaaaaacgaagaaagtggaagcagcgatcgaaaagctcgaacagcgttacttaagaaatgtttcgccgagcgaaatcgcagctgagctgggaatgagcgaacaagacgtcgtgaccacaatcaatgaaggtttctttgcgaacctcctttcaattgatgagaagcttcacgaccatgaagacggggagaacgtccaggtgatgataagggacgacaaaacgagcacgcctgaagaaaaaatgctcaaagacgaactggcacagagtct

SEQ ID NO: 1351 - DNA, 717 bp, Bacillus licheniformis
atgaagatcaacaagtatatgatgatttacaaacaaatcgcggaacaaatcgatcaaagcatactgaatgccggagatatcctgccgtctgaaaacgaccttgccgaacagcacgacacctcgagggaaaccgttcggaaagcgctgaacgtgcttgctcagaacggatatattcagaagattaaagggaaggggtcagtcgtgctgcacagggagaaaatgcagttcccggtttccggtttggtcagctttaaggagctttcagaaacgctcggaaaagagacaagcacgacggtccatgagttcggcttgacgcatccggacgcatatattcaaaagcagctccgcacttccggagatgaagaggtatggcgggttgtcaggtcgcggaacatcaacggagagcgtatcatcctggataaagactattttatccgcaaacacgtgccgcttttaacgaaagaaatatgcgaggactcgatctatcaataccttgaagatgaatgcgggctcgtcatcagctatgctcataaggaaattgtagtcgagccatgtacggcagaggatcaagagtatttggatctgaacggatacgagcacattgtggtcgtgaaaaatttcgtttttcttgatgatacgaccttgtttcaatatacggaaagcagacaccgccttgataaattccggtttgtcgattttgcaagaagagaaaagtag

SEQ ID NO: 1352 - DNA, 750 bp, Bacillus licheniformis
atggaacataaaaacaaaacagtcgtcaaagccatgaccctgctcaatctgttcctgacgagagaaaggctctcgctgggcgacatgattgagctgacaggcatgccgaaaacatctgtctaccgcatggtttgttctctcgaagaaatgggttttctcgaccgcgacgagaacgggatgtatagcttaggactgctgtttttgcaatacggccaccttgtttcagaaaggcttgatattcgaaaaatcgctctgcccatcatggaagaactccgcgatgacgtggatgaagccgtccatttaattgtaaggcagggaaatgaagcaatgtatatagaaaaaattgagggcacgcagaccgttcgcctctatacagcgatcgggaggcggtcccctttatatgccggagcctgtgcgagaagcattctgacgtttttgcctgaagaggagcgggatgcctatatcgagcaaacagagctggtgccgatcgcttccggcacgatccgggacaaggctgagctgatccgcattgtggacgagtcgtaccggagcggctgcacggtcagtcattcggagctcgaagactacacctccgcgattgccgcgccgattttcaatcataagcgcgaagtcgcagctgggatcagcatcgccgggtttgaagcccgctttcagaaagaccgtcttccttatttgaccgaaagagtgaaaaaggcggcgcttgacatctcgagaaaattaggtttttag

SEQ ID NO: 1353 - DNA, 761 bp, Bacillus licheniformis
atgcagttggaagaattaatgaacaagcattataaaaaattgaacgaaaacgattttcatgttttgaaatatattttgaaccatcaagacacttgctacaagctgggcatcaacgaattagcaaagaagtgcaatgtatcccgcacatcgattttaagactttctcaaaaactggatttcagcgggtacagcgagttcagggtgtttctgaagtgggaggccgagaagcgggaagaagagcgggaagattgccgttcctttgaaagcctcatgagggatatggaagcgagcatgaaatatttgaaaaatacggatttgcgaaagatgtgccagctcattgacgaagcggaccggatttttgtctatggttcaggcacggctcagacgacgtgcgcttatgagctgcagcgaatgtttgtttctcagcaccgttatttgacggtgatcaaagatcaaatcgatttcgacctcatgtttcttgattttagcacggccgatctgatcatcatcatttcgctgtcaggagaaaccccgtcgctgattccgcaggcacagtctttgtcggctaaaggcattccttttatctctttgacgaatttgaaaaataatctgctcgcccagctcactccttacaatctctatgcgccgagccagacggtgacggtttatccaaaaacagagctgaccgcttttgcacccttttttctcgttggggaagcgctgtttcgcagatatgtggactatgctgaagaaaagaaaaa

SEQ ID NO: 1354 - DNA, 564 bp, Bacillus licheniformis
atggaaacaatgattaaaaaaagaatcaaacaggtgaaaaaaggcgatcgtaacgcatttgcagacatcgtggatatttacaaagacaaaatttatcagctttgctaccgtatgctcggcaatgcgcatgaggcggaagatattgcgcaggaagcgtttatcagagcatacgtgaatatcgacagttttgatatcaaccggaaattttccacatggctttatcgaatcgcaaccaatttgaccatcgatcgtatccgtaaaaaaaagccggactattacttggatgcagaggtggcagggactgaaggactgacaatgtattcccaggttgcggcggatgttgcgcttccagaggatgaagtggtttctttggagctgcacagcaccatccaggaaaaaatcttaaggcttcccgataaatacaggacggtcatcgtattaaagtacattgatgagctttcactcattgagatcagtgaaatcctccatattcccgtaggtacggtgaaaacgaggatacacaggggcagagaggctctcagaaaacaattaagggatctttaa

SEQ ID NO: 1355 - DNA, 886 bp, Bacillus licheniformis
  misc_feature (1)...(886): n = A,T,C or G
gtgtgcattatgatgcgctgaagacatcgttacctntgcagaagtcaaanattcacgaaaacggccgagttcttctcatgtcgcagccgagcgtaagcatgcacattaaaaatcttgaaaaagaattccagacgaaattatttgaacgctctccgaaatatttaaaaatcacgccgaccggtgaaattttatacgaccgcgccaaacaaatgatcaccatctatgaacaaacgaggcaggacattctcgatcaccacaactcgatcaaaggcgagctgaaaatcggcgcaagcttcacaatcggtgaatatattttgccttcgctcctcttcgaccttcaaaaggaatatcctgaactcgagctcaaggccgtcattggaaacacggaagaaatcgtgcaatccgtccgcctgtacaaagtggacatcggcttgatcgaaggacagacaaatgaaaaagagctttctgtacacgcctttatgcaggacgaattattcatcgctgcttcaagcgatcatccgcttgcggccaaacaggacgtgacaatctccgatctgcaaaatcaaacgtgggtaacgcgcgaagtcggctcaggcacacgcgaatacttaaaccatgtcatccgttcaaacggtttaaaagtgaaatcgtttctgacgatcagcagcaaccaggggatcaaagaaacgctcatgacgggcatcggactgtctctcctgtctggaagcgtcattgaaagagatgtacagcacggaaacctttccgttatccggctgaaaaatcaaacctttaacaggacgctttcctatatatattcacctgtcatgcaggacaagaaaaatgtgaaaacctttattaacgctttgaacaaaagaacatcttcgaa

SEQ ID NO: 1356 - DNA, 751 bp, Bacillus licheniformis
atgaaaatgaaagtaaaggaagtggccgatttagtcggcatcagtgtgcgcacactgcatcattatgatgaaatcgggttattagctccgtcggagacaaccgaagccggatatccgctggtttcccatgacgatctggaaaagctgcacccattcttatttttcacagagcttgacttccctttaaaaaagattaaaagcattcttgagaacccttcatttgacaagaatgaggcgcttcagctccaccgcaaagcgctgctggagaaaaggagccggcttgaccaaatgattgcgacaatcgataaaacgatccaatttgcgaaaggagaaatcaacatgacaaacgaggaaaaattcgcgggttttgatttcagtcaaaacccgtatgaggaagaagcgcgggaacgctggggagatgaagccgtcgacagatcgaaggcctatatcgaatcgatgtccgaaggtgaacgaaaaaaaatggaacagcaatatgacgccatttacagaaaaatcgccgctctcagagaaggcgcccccgactcagaggaagcacaggcggctataaaggaatggtacgactttctgaacaataacaccggccacagctattcgctggaagctttcaaaggtctaggacaaatgtatgtggctgacaagcgctttacgaaaaacatcgatcaatacggcgccggcttggcgaagttcatgtgcgacgccatgacggtgtttgctgacagaaatcaggaat

SEQ ID NO: 1357 - DNA, 567 bp, Bacillus licheniformis
tttttccgaaagtgataggggatttcagagataagtatccgaacgtcacctttcagcttgttgaacacgggtctgtgaaagtgcaggagggagtagaggacggatcgcttgatatcggcgttgtcgtcctgcctgcaaaagaggagatttttcactcctttacaattgttaaagaagacttaatgctaatcgtccacctgtcccatcgttttgccgatgcggaagagatcgagcttcggcagttaagcgaagaaccgtttattttcttccgggaagactttgttcttcacgaacggatcattacggcctgcttgaaggcgggatttcagccgaatgtcatttatgaaacctcacaatgggatttcatcagcgaaatggtttccgcgaaccttgggataggtcttttgcccgaaaggatctgccgggatcttgaccctgaaagggtgaggatcattccgctggtgaggccggccattccttggcatgtcgccgtcatttggagaaaagaccgctatctgtcgttcgcggcgagggcgtggattgatcatacaaaatcgtatatatgga

SEQ ID NO: 1358 - DNA, 862 bp, Bacillus licheniformis
atgaaacaaaaagagaaagtcattattgaaacagccatcaaacttttcgctaaaaaaggatacagttctacttcagttcaagagattgcaaaagagtgccaaatgtcaaaaggcgctttctacatttattttaaatcaaaagaagcgctcctcctttcagtccttcactactactatgaaagaatctttacccgaatccagaaaatcaaaacggagcatgacaatccgcgcgatgtgtaccggatgcagctcgtcgtttttttcgaaaacattttggagcataaagagtttatcacgatgcagtttaatgagcggtcgatgccgatcaatgaagaaattgaggcgtttgcgaaaaaaatgcggagaaccacgctcaggctgcacatcgaaaacatccagaacatttacggcaaagacattgaaccgtacagcgccgaactgtgctttatgatcaacggaatgagcgatgtctaccttgagctgatgattttgctgcaccattcgttcgacctgcagtctctcgccgaccacatgctgaaccgcctcgacgatttggcgaaggggatgatcaagcgcaatgaccagccgctgatcccattcgaaaaagcagacgagtggttcggcccattttacacatttgatccgctgaaggacgccctgctcaatgaaatgcgcgtcaaagcgaacaagcagtacaacggcgctcctcctgcagaccttgccgaaagcctggatattctggagaaagagctgagaaaagaaaaacgcaaaaacgccattatcaaaggcatgatagccaacttgaaggaatatcccgcgattcgaaaagaaacggacaaactcgccgaattgctcaaaaaag

SEQ ID NO: 1359 - DNA, 621 bp, Bacillus licheniformis
atgaatcgagcggaagagccctatacggtgaaagaagcccttttattcagtcaaagaatggcacagcttagcaaggcgctttggaagtcgatagaaaaggattggcagcagtggattaaaccttatgatctgaacattaacgagcaccatattttgtggatcgcctaccagctgaacggagcatccatttcagaaatcgccaagttcggcgtcatgcacgtatccacagcgtttaatttttcaaaaaagcttgaggaaagaggttacctggagttttccaaaaaattgaatgacaaacgcaacacttacattcagctgactccgaaaggtgaagaagttttccttaaaatcctcgagtcttacgatccgacccggaacgccgtcttaaaaggcgctcagccccttcatcagctgtacgggaagtttccagaaatcgtcgagatgatgtcgatcatccgccatatttacggcgatgatttcatggaaattttcgaaaaatcgttttcaaacatcgaaaatgaatttacgagcgaagagggcaaaatgaagaaaaaacaagaagcaaaagaagccggggaatcgatagaggtggacaaaccgcttgagcctcttaaaaactaa

SEQ ID NO: 1360 - DNA, 1065 bp, Bacillus licheniformis
aagaaacaaagatcacccctcccacggtctcaagcatcgtcaaagagctcatcggacaaggactcgttaaagaaagcacgctcggtcgttcgagcggcggaagaaagccgaccatgctccacatcaacacgggtgcctattatgtcattggcattgatgccgggcctgagacggtggagtgcgtcttaaccgatttagccggagggattttgcagcggacgtccagcctgctgaaaaaaccgctgacaaacgagaggttcatggaagttttaaaagaaagtgtctatgccattttgggacgtgccgatgtcgagcaagaaaagatcatcgggatcggcattgcaatgcacggtgtggtcgatgctgaaacgggaatgtcgcgcatcgcaccgattttaaacttaaccaatatccccatcaaagatgtgctggaacaagaattcaacttaaccgtaagagttgaaaacgatgcccgggcgatggcgcttggcgaatcgtggttcggcggccgcgatgacgcagggagcatggctgccgtgaatatcggccgcggcgtcggtgcggggatcgtcatcaacggaaaactgtaccatggagctgaagggatcgcgggtgaactgggccatatgatcattgatatcaatggagaaaagtgcgagtgcggcaaccgcggctgcctgcagacgattgtgagcggaaaagcaattgccgaacgggggaaaaagcggttgaaagaaagcactgacagcctgacagccaaagatttgtttgaaatggccgagaacggctgccaaacatgtatcgaactttttcaggaaaccggtgtgatcatcggaatcgggctgaccaatttcattcatcttgtcaatccgggcaaaatcgtgctgggaggaggagtgatgaagggcgggaggttcatattgccggcgatacgagaaacgatacagcagaaagctttaacagccgaagcgaggcagacagaagtgacgataacgaagctcggcgatgaagcgacgctttacggagccgtttcattgctgctggcggagctgtttgatccggtgc

SEQ ID NO: 1361 - DNA, 537 bp, Bacillus licheniformis
atgaaagcaactggtatcgtacgtcgaattgatgatttaggccgggtcgtgatcccgaaggaaatccgcagaactttgcgcattcgtgaaggagaccctttggaaatatttgtggaccgggatggggaggttattttaaaaaagtattctccgatcagcgagctcggcgactttgcaaaagagtatgcagatgcgctttatgacagcatgggccattccgtgctgatttgcgaccgggatgtgtatatcgcagtatccggggggtctaaaaaagactatttaaacaaatcgatcagcgacatggtcgaaaaggcgatggatcagcgcacttctgttttggacggagacgcgaagacgattcagcttattgatggtattgacgaagaggttgcttcttataccgtcggcccgattgttgcaaacggcgacccgatcggagcggttgtcattttttcaaaagaccagtcaatcggcgaagtggaacataaagcggttgaaactgccgccggctttttggcccggcaaatggaacaatag

SEQ ID NO: 1362 - DNA, 654 bp, Bacillus licheniformis
gattaaaagcggagagcttgagcccggcgacaagcttgactccgtccaagcgctcgccgacagctttcaggtcagccgttcggccgtaagggaagcgctgtccgcgttaaaagcgatggggatggtcgaaatgaagcagggggaagggacgtatgtgaaaaggtttgagcctgagcaaatttccatccccctttcggctgcacttttgatgaaaaagaaagatgtcgctgaactgctcgaagtccgtaaaatacttgaaatcggggcagtttccagtgcggctcaaaaacgcacggaggatgatctcggacgcatgcaggaagcacttgaggatatgaagctggcggacgggaacggcgaacttggcgaaaaagccgacctcgcgtttcaccttgcgcttgccggcgcttcgcagaacgatctgctgaaaggcttgatgaatcatgtgtcatctctcttaattgagacgatgagggagacgcgcaaaatttggctgttctcgaagaatacaactgttaagcgcctttatgaggaacacgaagccatctatcaggctgtgaaggaaaaagacggccaaaaagcggagcaagcgatgcacaatcatctgacaaatgtggaaaatgtgctggcctcatattttgaagaaacgaaaca

SEQ ID NO: 1363 - DNA, 723 bp, Bacillus licheniformis
gtggttaaaacatgagaaaatacgaatatatttcaaacgaaatgaggaggcggattcaggaggaatactatccgattgatcagcccatacctgatgagctttctctcgccaaggaattttcctgcagcagaatgacgatgaaaagagccctcgatattcttgtgtcagaaggcatgctgtaccgcaagcgcggacacggcaccttcattgtaaaatcatcgattcagcagcttcccgtcagtgtaacagaccgcgaaaaccttgggctgaccaagcttcttgccaacaaacaaatcgaaagccgcatcattcaatttgacgtcgaattcccttcagatgaagtggcaaagcaattgtcaatcgaaaagaccgttccggtgtatcatatcatcaggctcagaaaggttgaaggcgaaccgtatgtcattgaagaaacgtatatgccttcgaacgtcatctctgaattaaatgaagacgtccttcacggctccgtttaccggcacatcaccgagacgctgaaactgacaatcgccggatcgcaccggaagatcagggcggataagtcgagtgcactcgaccgagagtacttggaatgcgcccctgacgatccggttcttgaagtcgaacaggtcgcttttttaaatacgggggaaccgtttgaatatttttttgcaaggcatcgctatgataagtttgtgttttcgagcgtccatattcggaaat

SEQ ID NO: 1364 - DNA, 535 bp, Bacillus licheniformis
  misc_feature (1)...(535): n = A,T,C or G
atgacgatgtatattccaaaatattttaaagtcgaaaatgctgatgaaattttggattttgtccaaaaaaactcttttggcacgattgttacgacagaacaagggaagccaatcgcgactcatttgcctttagggctcaataaaaaaggcgatgattactatatcactggccatatcgcttatggaaacccgcaggtgggaactttggaaacctgtaaagatgtgcttgtcatgtttcaggggccgcacgcatatatttcttcttcctggtatgggcatgaggatgttccaacatggaattatcaagccgtccatatatacggtaaagcaagcattctagagagagatgaattaatagaagaattaacaatcatgatggaaaaatacgagaagcatcgggaaaatccaattttatgggataacctttctcctcaacttttggagagacaactgaaagcgattgtcgggtttaagattaaggtggaagacattcaggctgcatataaattaagtcagaaccgaaatgatacagacn

SEQ ID NO: 1365 - DNA, 577 bp, Bacillus licheniformis
gtggaagaaacctttcagaaaatatatgatcagtatcatcaggatttatttcagtttttattttatatggtaaaagacaaaaatcaggcggaagacttagttcaggaagtatacatccgcgtcctgcattcttacgaaacatttgaaggcaggagcagcgaaaaaacctggcttctttcgattgcgcggcacgttgcgatcgactggttcagaaagcagcagacgatccgccagcggattttggggacgtttgactgggagaaacaagatgtaaaagaccgcaagcctctgcctgaggacatcgtgatgcaaaatgaaaacctaaaggaaattttcgaggccctagacaagtgtacgcttgaccaaagatcagttatcgtcttgcgttttattcaaggatattcgatcagtgaaacagcaaaagccttgaatttttccgaaagcaaggtaaaaaccactcagcaccgcggtctgaaagtgcttcgtaaacagatggagcttttgaaggaggatccaaagaatgaagaagtcagaatggaacgaagaacggctgaaggcgttactaagccaacttcca

SEQ ID NO: 1366 - DNA, 501 bp, Bacillus licheniformis
atgaagctaacagaaaaagaaacagaaatattggaaatattagaggaaaacagccgcctcgaacctgaaacgattgctaaaatggcgaacatttcacaggaagaaacaaaagcgattattgaaaagcttgaaaaagaaaaggtcatcatcgattattctgcaatgatcgactggcgaaaagtcgacggccatgaaggcgtgacagcgatgatcgatgtgaaagtaacgccgaagcgcggcgtcggatttgacgaagtggccgagcggatttatcgttttcaggaagttgaatccgtttacttgatgtcaggcgtatatgacctgtctgttgtcatccgcggcagaacgatgtcggatatttcgcatttcgtgtccgaaaaattatcgacgcttgaatcggtcgtgtcgacaaccacccactttattttaaagaaatacaagcatgacggtaaagtttttgactccggtgatgatgacaaaagaatcgtggtgtctccttaa

SEQ ID NO: 1367 - DNA, 566 bp, Bacillus licheniformis
gtgagcaaagatcgaaaagcactgattttagaagcggcgacaaaatcgtttacacaattcggctacaaagcgacgacgatggatctggtggcgaagcttgccaatgtcggcaagggtacgatctatacctttttcaagaataaagaggaactgttcgatgacattttttcttcgcttctgattgaaatgaagcaaacggctgatcaagcgattgaccctgatctgccttttcacgaaaatgcccatcgcgcgatgatggcgatattggagtacagaaagaggcaccagctgaccattaagatctttcaggaaggcgcggagctcggcacaccggcggcccgcgaggtgattgaaaagctggaacgcatggtcatcggctatattaagagaaaaattaaagaagcaattaaaaatgacgatattagaccgtgtgacccagagctgaacgcgtttgtcatcttcaagctttacatcgcgctcatctttgactgggaaaaaaaccatgaaccgctgaaagatgaagagttggcagagatgctgaaaatgtatattttaaaaggattatc

SEQ ID NO: 1368 - DNA, 657 bp, Bacillus licheniformis
tagaaccgtgaagcggataattcttgactgttttttctagaaagtgtatccttcaaataaaggaggtgataggggcttgggaaggagcaaagaatttgataccgctctcgtccttcataaagcgatggaggttttcggccaattcggctatgagggggcgtcgatgcaggagctgctcagccgcctgggaattgccaggcaaagtctgtacaatgcattcgggactaaaaggggtctgtttatcgccgcccttacaagatatctagatgataaaaatgcgcaagtgatcgccatgcttgaaagccccggatcagtgaagcaatcggttcggcagatcttccaggaaagcttaaacgttctgaaagaccccgaacgttcaaaggcatgctatatcatcaacagcgcaattgaacaaattccccgcgatccggaggttgccgaatacttcgataagcagacaaagcagttggaaaccgccttttacaaagcgcttgtccgagcacagtcacagggggaactaaagaagggcctccatgatctttcagcagttgcccgttttttgaatcaaacccggctgtcgctcacgtttcaggcgaagttaacgggggattttgatgcccttcaggatctgatcgatgtcagcctgtctattcttga

SEQ ID NO: 1369 - DNA, 965 bp, Bacillus licheniformis
atgagaggggatcgactgatatctattcttttaatgcttcaggcacaagggcaaatgacggcgaaagaattagcggaaaggctggaagtctccgagcgcacgatttacagggatatggaagctttaagcggagcggggattcccgttgtggccgaacgcggcataaacggaggctggtcattgcttgatgattaccaaaccactctaaccggcttaaaagaatctgaaatacgcgcactatttgttccgctttctgaacaattgcttgacgatctcggattaacccgcatatccgaagaagcccgaaataaactgattgcctcgctgccttcggaatatcgccaaaacgcaaaggatgtatggaaccgcatatatattgatacctgttcatggcgccataagaaagaaaaagcagaatcctttgaagtgctgaaagatgccatatggaaagatcaaaaattaaaaattgtctatcagcgggcagatggacaaacggctgatcgtgttgttgcaccgcttgggctggtggctaaaggggcgaactggtatctgattgcatctaaagaaaatggggagattcggaattacagggcttcacggattaaatctgccgtttttgtccgcgaaacgtttgataggcccgaaaattttgatattgctcacgtgtggcggtcttcaacaaaggaatttattgaaaggctgccgacgtatgaagtgcgggtgaaggcggcgcaggccatcttgccgaggctgtcgtttaccaatcattttgtgcggatcatcgaaacaaatgagatcgatcaggagggctggatccccgttacgctatcctttgatacggaagaagaagcaaaaaggtatatactcggattcgcagagcacatgaggatcattgaacctaaagaactgcacggaaagatacttaaaatggctgaatccatagttgcgcattataaaacctgaaa

SEQ ID NO: 1370 - DNA, 475 bp, Bacillus licheniformis
gtgagcctcgactaccatatgccaaatttaattctcgatgaaacggataaaaaaatcctttcgatcttgcatgaggaaggaagaatctcttatacggatttaggaaagcgtgtgggactctcaagagttgccgtacagacgcggatcaacaacttgattgaagaaggcatcattgaaaaattcacagccgtcatcaatccagtcaaggtcgggattcacgtatcggtgtttttcaacgttgaagtcgaaccccaatatttagaggctgttgccgttgctttggaaaaggagcccgccgtgacaagcctctatcatatgacagggccgagcaagctgcatatgcacggcattttcgcaaatgatcaggagatggaggaatttttgacgaagcgcctgtaccccctgaaaggcgtggtgagcgtcgactgccagatgctgattaaacgttataagagccgaatgggaatgaagcttt

SEQ ID NO: 1371 - DNA, 477 bp, Bacillus licheniformis
atggcacaagagaaagtatttcctatgacagaaacgggaaagaaaaaactggaagaagaacttgagtatttgaaaacggttaaacgtaaagaagttgttgaacgtattaaagtggcaagaagcttcggagacctttccgaaaactccgaatacgattcagcaaaagaagaacaagcttttgtagaagggcgcatcacaacccttgacaatatgatccgcaacgcaaagatcatcgaagatgacggtgcaaactcagacatcgtcagccttggaaaaaccgttacatttacggagcttcctgacggtgaagaagaatcttatacgattgtgggcagcgcggaagccgatccgtttgaaggaaaaatctcgaacgattccccaatcgcgaaaagccttctcggcaagcaggttggagacgaagtaaccgttcaaacacctggcggcgaaatgcttgtaaaaattgtgaaaatttcataa

SEQ ID NO: 1372 - DNA, 891 bp, Bacillus licheniformis
gaaaaggaaaactaaagatgaaaaatgtgatattgtttgtcctcgcgctagtgataacgatcggcagtgtggtgtcatacgggatttaccgtacagtcgccaaatcaataaatggaatgtacgaacctcttcatcgggatgccgagcagaaggatactgctccgcacgatcctatatccattcttttattggggatagatgagcgccccggtgataaaggacgcccggattctatgattgtaatgactgttaacccgaagacaaagaaaacgacaatgaccagtattccgcgtgatacaagggtgtttatcaaatcaaaaaataaattttcgaaaatgaattcggcttatacgtatggcggaattgaaggaaccgttgaaactgtagaacaatttttgaacattccaatcaattattatatcaaaatcaatatggatgggtttaaagatatagtagatgcgattggcggcgtaacggtggataatcggattgatttcacccttgaaggcgtgcatctgtcaaaagggaagcagcatcttgacggcaaaacagcattgacatatgcccggatgagaaaagacgatccccgcggtgattttgggcgtcaagagcgtcagcgtgagattatcaacgaaattattcatgaaggtgcacaattaaaatcattaacaaactatcaggagattttggcagcattagaaaaaaacatcaaaacaaacttaacactggacaagatgatcgatattcaaagttcttataaagaagctgctaaagatattaagcaggtagaaattgaaggtgaagacaaaaaagttgacagcttatggtatcacctagtgactgacgaaaagagaatggagatttccaaaaagcttcgccaacaattggact

SEQ ID NO: 1373 - DNA, 513 bp, Bacillus licheniformis
gatcgcacaggcaaaagatcttgtcattgattcaatcgcagaaacaatggatctgtacggcattacccggagtgcgggcattttgtacggaacgatgtacctttcggatgaaatgacgctggacgaaatgcgggaagaactgcaaatgagcaagcccagcatgagcacaagcgtaaaaaagctccaagacttaaacgtcgtcaaaaagacattccacagaggaagaagaaaacacagctttgttgctgaaaaggatttcttcaaatttttcacaagctttttccctaaaaaatgggaaagggaagtcaaagtgaatctcatggctattcaagacgctcaaaaagcattggaggacatcatcgaaagcgaagggcttgacgaaagcataaaagaggaagcgagaactctttatgaccagcttgaacattcaaaaccgtattatgactggctgctgagactcgctaaatctgtccaatcgggagagatttttgagtttataccgattgataacaa

SEQ ID NO: 1374 - DNA, 456 bp, Bacillus licheniformis
atgatgaaggatattctgcgtgaaattggaatgattgcccgagcattggattctataagcaatatcgaatttaaagaacatgacctgacaaaagggcaatatttgtaccttgtccgaatatgcgaaaacccgggaatcattcaggagaagctggctgagatgattaaagtagacaggaccaccgcagcccgtgcaataaaaaaacttgaaatgaagggctttattgaacggagagatgatgaacataacaaaaaaataaaaaaactttttccgacggaaaagggaaatgaggtatttccttttataaaaagagaaaatgaccattcgaatcgtgtggcattagagggattttccgagggggaagcggagatcatcttcaatcttcttcaaagagtaagaaaaaatgtagaaaaggactgggaattcgtgaaaaaggggaacaagagaaattattga

SEQ ID NO: 1375 - DNA, 921 bp, Bacillus licheniformis
aagagtaagaaaaccgaaaagaaaaaggcgaaaaatcataaagcgcctgtttacattaactttgctggttatcatagcagcagcgggttatacctactttgaatacaaaaaaggcttatctgaatctgacggagattttaaagaagacggacagtttgaatttaacggggaaggctctgatcttgatgaagtgaacatcctcgttcttgggatcgattcaagaggggaagaccattcaaggtctgactccatgatggtcatccactataataaaaagcagaaacagcctaaattgatttcgattatgagggacagctatgtcgacattccgggatatgacaagcaaaaagtcaatgcggcttatgcatacggaggcccggaactcgtcagaaaaacattaaaagaatcctttgatttggacattaactattacgctgtcatcgattttaaaggttttgccaaaatcgttgatgcggtggcgcctgacggcatcgaagtcgatgttccgaaaaaaatgtcatacggaatcggcatgacactgcagccgggaaaacaagttcttcacggtgaaaggctgctgggctatgtccggttcaggcatgacagagaaagcgattttggacgggtcagaaggcagcaggaagtcttttcaaagcttcaaaaagaagcggtgagcatcggaaatatcgcacagcttccgaagctgtgggggctcgtcgatccgtatattgaaacaaacattccgaacggcgtcatactctccgtcggcaaagactttttgcttggaagcgtaaaagaaaccaaaagcttcaggctgccggttgacggatcatttacgaacaaagacgatccaaaatacggggcagtccttgatttagaccttgaacaaaacaaggaagagctgaaacgctttttaaatga

SEQ ID NO: 1376 - DNA, 678 bp, Bacillus licheniformis
atatcgccgaggtcgccaagcttgtcaccgatccgtcgcgggcggcgattttaaccgcattgcttgatgaccggtattatacggctaccgagctggccggatatgcgggaatcaagcagcagacagcaagctttcacctttccaagctgcttgacgccgagatgctgacatgcaggaagcaaggacgccaccgctattacaggctcaaaaacggaaagattgcacaatcgctggagaccctgcttaacatagcgccccctgcggaaattcgctctttccggcagtcagctgaagatcgggcggtcagaaaagcgcgcacatgctatgatcacctggctggatcgctcggcgtcacacttgcggatcggctcgtggagatgggcgtattgaaagaagaagagacggcttttacagtgactgaagaaggggaagcatttttgaaagagcttggcatcgatgtcagggaagtcaaaaagaaacggcgctctttttgccataaatgcctggattggagtgaaagacggcatcacattgccggcgccttaggctccgcattgctcgatgccttcatccgcatgggctggatcgagcggcgcccgcatacacgggccgttgcagtcacgcccgccggcgcaaaggaactttaccgcctatttcatatttccattgaaaagaact

SEQ ID NO: 1377 - DNA, 474 bp, Bacillus licheniformis
tggaggaaaacgctttaaaagtgattgaacaagcggaagaacatttcatagaaaaaatcgccgaaaatatgaatacatacggtctatcatcaactgtcggccgcgtgctcgggatcatctatatgaacagaaagccgatgaccttaaatgaactgtcagaagaaacgggcatgagcaaaacgagaatgagccaggtcgtccgcgaaatgatcgatttaaatatagctgaaaaagtttttgaaaaaggcgtccgcaaagatctgtacgatgtcgaacaagactattatcaaacgtttatttcattgtttacggccaactggagcaaagtcgccaaaaagaacaggatgattgggaaaaaaatcagaaaagagctgttggaggcgctcgaggaagaaggccttacgcctgaaaccgaagctaaaatcaacgagctgctggctgaaacaaaacaatggatcgattactgcgagtggg

SEQ ID NO: 1378 - DNA, 378 bp, Bacillus licheniformis
atgatggaaatgaaaaaaatacctcaaatctctgatgcggaattagaagtgatgaaagtcatctggaagcattcttcgatcaataccaatgaggtgattaaagagttgtccaaaaccagtacatggagccctaaaaccatccaaaccatgctgctgcgcctcattaaaaaaggagcattaaaccaccataaagaaggccgggttttcgtttatacgccaaatatagacgaaaatgattatatagaagtgaaaagtcacagttttttaaaccggttttacaatggcactcttaattcgatggtattaaactttttggagaatgatcagctgtcaggtgaagaaattaatgagttgtatcaaatactagaaagaacataa

SEQ ID NO: 1379 - DNA, 567 bp, Bacillus licheniformis
cacaaattgggtattgaatctcaagttgaagcaaggggtacttttgaaacgccgaccatggtatcatttaaagattccgagaaaggaaaagattgaccaaaaagggtttatgaacaggcagtttaggcgtttgattgacgattccgcccaaaattccgacttgcggtttcgcaggcagctcttgttcgaagagctggtgattcacttgcagaaggaggcgttccatattccttcggcgagtgagcgtgtagcatccgaagcacagcattacatcgaccgccattataaggagaagctcagcatggagcagctctcggctgcccttcattatcaccaggactacattacccgctgcatgcaaaaggtgtttggcatcacaccgggccaatatgccaataaggcgaaagtttttgaagcgaagcggctcctctcttctacaaacgacaaaatgtcatcgattgccgaacaagtcggaatcgatgatccgacctatttctcaaagctgtttaaacaaatagaagggatttcgcccgttgaatacagaaagatgatgaagcgaaatattga

SEQ ID NO: 1380 - DNA, 526 bp, Bacillus licheniformis
gtggatcaagcagatgaaaaagaactgatcatacgggcaaaagacggtgaagatgcggcttttacgaaactgtttcagcttcattacccctttgtatatcaatatgttctgaaattaacgctgaacccagatctcacagaggacttggtccaggaaacgatgctgaaagcgtatgtcagccttcatcagtttcagggcaatgcaaaattttcaacatggctgatctcaattgcttcccggctgtttatcgaccatcagcgccggaaaaaacgcgaaaaccgcaaaacgcaagcagcaggagaggaagccttgcgaaaaatgaaatggaattctgcccttcacggccacgaatggagcgaatacttggagatgtttgctgcgcttgagcctgagttcagaatgccaatcttgttaagacactattacgggtttacttaccctgaagtggcaaacatgctgaaaataaaagaaggtaccgtcaaatcgcgcgtgcatcatggattaaagaaaattcgaaaggagtggg

SEQ ID NO: 1381 - DNA, 419 bp, Bacillus licheniformis
atgaaaattgatgatctcgattttaaaatcatagccgaattaaagaaagacagccgtttatcgatgcgggagctgggcaggaagatcagcctttcggcaccgtctgtgaccgaaagagtcaggcggctcgaatcgttcggcgtcataaaaaaatatacgctggacatcgattaccaaaaggtcggtcttcccgtttcctgcatcattgaagcaacggtgaaaaacggggaatacgagaggtttaaagcgtatatcgaacgcctcccgaacattgaattctgctaccggatcgcgggagctgcctgctatatgctgaaaatcaatgcagagagcctggcgaagatcgaagcgtttatcaatgaaacgtctccatatgcccaaaccgtgacacacgtgattttttcggaaattgaaacaaa

SEQ ID NO: 1382 - DNA, 930 bp, Bacillus licheniformis
aaagagaaggctgattaaacggtttatagtccttatgctgctcgcacttctcgcagtcggcggagtgggcatatataaaattataaacacgatttccgcggctgacggcacttatgatgagcttgaacgcggagagaagtcgaagctcagggacgatgttgttgatattcaaaaaaagccgttctcgattctttttatgggggttgaagattattcgacaaacggcgagcacggccggacggattccctgattgtcgtgacgctcgatcctaaaaagaagtcgatgaaaatgctgagcattccgcgggacacaagggttcatttggccagcgacacaaccggcacaaaaacaaaaattaatgcggcctatgcaaaaggcggcaaggatgaaacaattgagacggttgaggatttcctcggaatcccgatcgactactatgcaacggtcgattttgacgggtttaaagatgtcatcgatgaaatcggcggaatcgatgtcgatgtgccgtttgactttagcgaaaaaagcgatgtctccaaatcgaagagaatctattttaaaaaaggaaatatgcatctaaatggtgaggaagctcttgcctacgcaaggatgagaaaacaggataagcgtggagacttcgggagaaacgacagacagaagcaaattttaaaagccgctcttgatcaaatctcaaaaccgcaaaacctcgctaaaattgatacaattgcccaaaaagcaagcaaaaacattcagacgaattttagaatcacgcaggcgctggcgcttcaacaaatttacagcggctttgccggcgatgatatcaaaacattaaacatcacaggacaggatcttacgattgcaaatgtttactactttgagcctgaccagcaaaacctggaaaacgtgcaaaatgaattgacccatcattt

SEQ ID NO: 1383 - DNA, 386 bp, Bacillus licheniformis
atgaagtattcgaaagcaacgaactatgcccttcacactatgctctttcttgcagcaggcgccccaaatacatttgtcggtgtacagcagttggcagaacggcaagaggtatcgcccacgtatttatcgaaaattttaacgaagctggccaaggcgggaatgattgaatccgcttcaggcgccaatggcggatataggctaaagcggaattgggaagacatttcgtttcttgatattattcacgcaattgaaggtacagcctccttgttcgattgcaacttgaaccatggatcagaatgtgtgattcagaaggtgatggtatctgcagaagatgaaatggagaattatttgagacaacaaaaaatatctgaccttgccaaaaaaat

SEQ ID NO: 1384 - DNA, 423 bp, Bacillus licheniformis
ggaacagtccttgaagttatttattgtattatctcgagcgtacagatccattaatgatcatatgaataaacatattcatcatcatggtctgaatccaaccgagtttgccgttttagaactcctctatcataaaggggatcagccccttcagcaaataggggataagattcttctggcgagcgggagtattacatatgtggttgacaagcttgagcaaaagcagctgatcacgagaagagcctgtacgacagaccgcagggtgacctatgcgcaaattacagataaaggcaccgagctcctcgagaagatttttccgggtcatgcagaagagctgcacaacatgatcagcgtattaagcgatgaggagaaagaagcctgcatcgaaatgctgaaaaaagtcggactgaatgcaagaaatattta

SEQ ID NO: 1385 - DNA, 868 bp, Bacillus licheniformis
atggagatccgacacttgaaaacatttaaaacaatcgtggatatcggcggttttacccgtgctgccgattatttaggatatgcacagtccactgtgacttcgcacgttcaagcaatcgaacaagaattaagaaagccgctgttctaccggctcgggaaaaaaatgatgctgacagaagcgggaaagcaccttctcccttatgccgcagaaatggtcgagctgtatgaaaaagcgaggcacattccggaaaacgaccaggagccgtcgggaaacttgatcatcggcgcctcggaatctttaacggtatacaggctgcccgccattcttcacgaatttacaagcaaatatccgcaggtcacggtcactttaaagtcttccacgtgctggcagctgagagacgaattgaaacagggaaaaatcgatgtcgcttttcttttggacaacgaccggaaagaaaacgaccttcatgttgaaaagctggtcaatgagccgatggtgttcatctttcccaaagaacacccggcaggacaaaaagctcttgatgatttgacttttaacgcaaatgaaacgtttttatataccgagcacggctgcagctaccgtgatttttttgaggaatatttacgtcaaaggggagtcattgccgaccatacgatggagttttggagtgtcgaagcgattaaacaatgcgtaatgtgcggtttgggcgtctcccttcttcctttgatcacaacgcgcactgatatcgaagaaggaaagcttcagggcacgctggtccgcgacgccctgttttccactcaaatggtttatcataaaaacaaatggctttctcctgctatggcggcttttacggatatcgtccgcagga

SEQ ID NO: 1386 - DNA, 498 bp, Bacillus licheniformis
ataaacagacgattgaagaactgtacagggaatattatcatgacatcatgtactatttgtacaggcgaacccatcagcttgagacggcgaaagacctggcgcaggatacgtttctaaaagcttttgcgggcctggagtctttcaggggccattcctcgatcaaaacatggctgtatacgatcgcacatcatacgtttatcaactggtacagaaaagataaaaaaatccaattttccgacgtggcggcctgcggcgatatggaacagcacacatttgaaatgcctgagcgccatttggcaaacgccataatgcaggaagagctgaaacatcacattgaccggctgaaagaagattaccagactgtcctcattttaagagagtttcaagagctgtcatacgaggaaatagcggaagtgctgaattggaaactgtcaaaggtaaaaaccaatcttcaccgggcccgcctggagctgaaaaaaagcttggaaggcagggagg

SEQ ID NO: 1387 - DNA, 429 bp, Bacillus licheniformis
atggacgtggagtggatgaagattgatcaaatggccaagcgaagcggcctgacgaaaagaacgatccgcttttacgaagaaatcggtctgctttcttcaccgaagcggacggaaggcggagtccgtctttactctgaagacgatcttgaggaacttgaaagagtgatcagcgcgaaggaagtgctgggattctcgctgcaggagctccagcagttcatggaaacgggcaagcacctggagatgaataaagaaggatacctattgtcgctggataaacgggaacgaaaagaaaagcttgaagacattcagaggatgctgaatgaacagatgagaatgattgatgaaaagattgaaaaatttcaatcattcaagaagcgcttggaaggtatgcaggcaaaagccgagaatgccctacaatcaattgattaa

SEQ ID NO: 1388 - DNA, 666 bp, Bacillus licheniformis
atatccggagaagtggctttctagagcttcaactggtgttcgcgtcgcatgcgagctgagaatgcgcattatttccggtttgattgaaagcggtaccattttatctgaaaataaattggctgcggaattctcggtgagccggtctcccatccgcgaggctttaaaaatactggcatcggaaaaaatcatccgtttggaacggatgggggccgttgtcatcggtttaaccgaaaaagaaataggagaaatttatgatgtgcgcctggtgatggaaacattcgtattcgaacggcttggacaggccaatgtcgacgaactggtaacagacctcagcaaaatattggagatgatgaaagtctccatcaaatacaaagatgccgacgagttctcatttcaagacgtcttatttcacgaaacgattgtccgctccatcaatcattcttacattttgatgatatggaacaatctcaaacctgtgatggaaagctttattcttttatccatgcgggcccgcttaaaagaaaaatacgaagactttgaacgaattctcgataaccatgaactttatattcaagcgatcaaaacgaaagacagggatctgatgcttaaatccctacatcaaaatttcgatgacgtacaaggtaaagttgaagatctatggctgtc

SEQ ID NO: 1389 - DNA, 425 bp, Bacillus licheniformis
atgaaattaacaaattatacggattactcattgagggtactgatttttctagcaaccaaaaactcaaacgagcttgtcaatattaaagacatcgccgattcttattccatttcaaaaaaccaccttatgaaggtgatttacgagcttggcaagcttggctacgttgaaacgatccgcggccgcaacggcgggattcgtctcggaaaagcgcctgaactgattaatatcggtgaagtcataagacatacagaagatgattttaaccttgtcgagtgttttaacggagaaaaaaaccattgtatactttctccgatctgcggattaaagcatgttttaaacaaagccctttccgcctatttggacgtattggaccaatacactctgcaagatattatcatgaatcaggaccatatacgtaaattatt

SEQ ID NO: 1390 - DNA, 555 bp, Bacillus licheniformis
catcaaaactgatcgcgtattagatgcaaaagggcttgcttgtccaatgcccgtcgtaaaaacgaaaaaagccatgaatgagttaaaaccggggcaggtaattgaagtgcatgctactgataaagggtctcttgctgatatacgggcatgggcaaagggaagcggtcaccagtatctcggtacaacagaagacggagatatattaaagcattatcttcgaaaagcgggtcactctgaaataaagaaagtaaaaacgtttccttatacgattcaaaatgaagagcttcaaaaaaaggtagaggcgggcgagcggctaacagtagttgatgttcgggaacctgcagaataccgtttcggccatattcccggagcgatttcaattccattaggtgaacttgaaaaaagagcgcacgaactgaatagagacgggaaaatttatgttgtttgccgtacgggtaatagaagcgatctggcagctaaacagcttgcggataatggctttaaagatgttgaaaatgttgtccaaggtatggcggagtggtcaggccctgttga

SEQ ID NO: 1391 - DNA, 328 bp, Bacillus licheniformis
ttggccagcgtattaaacaatatcgaaaagaaaaaggctactcactatctgaactagctgaaaaggctggggtagcgaagtcttatttaagttcaatagaaagaaacttgcaaacaaacccctccattcaatttctagaaaaagtctccgctgttctggacgtctcggttcataccctgctcgatgagaaagatgaaaccgaatacgatggtcaattagatagtgaatgggaaaatctagttcgtgacgctatggcatcaggggtttctaaaaaacaatttcgagaatttttagattatcaaaagtggaagaaaagacaggaaaagga

SEQ ID NO: 1392 - DNA, 378 bp, Bacillus licheniformis
atgaagccgaaaaagtataatatatctgtcgaagctacacttgaagtgatcggcgggaaatggaaatgcgtgattttgtgtcacttgacgcacggcaaaaaacgcacgagcgagctcaagcggctgatgccgaacattacgcagaaaatgctgacccagcagctgcgcgaactggaggaggacggcgtcatcaaccggatcgtgtaccagcaggtgccgccgaaggtcgaatacgaactcagcgaatacggatggacgcttaaagacattttggattcgctgtgctcctggggcgaaaaacacattacaaaagtgtatggagacaaatttgctgttttggaggacagcgtgctgaatgaacaattacaggaaacatga

SEQ ID NO: 1393 - DNA, 642 bp, Bacillus licheniformis
ttctgtcagagatcaaatctatcaggtgctgaaggaagaaatcatgaagtttcggcttgttccgggtgagcagatatcggaaaaagagatttcagaacggtatgaagtcagccgcactccggtcagagaggcttttttgcagctgtcgaaggaagggcttctcgaagtctatccgcagaaaggaacccgcgtgtcgctgatcgatcttgacctggtggaggaagcgaggtttatgcgggaaaaactggaaaaggctgtagctgaactggcgtgtgaggacttcccgcaggaagctatgtttaagctggagcagaatgtgaagatgcaggaattatcgatcgcacagaaaaattatgaaagtttgtttgaattagatgaagcgtttcatcagacgatttttgaaggctgcggaaaagcgaatgtctgggctgcgattcagcagatgaacgttcccttccaaagaatccgctttttaaggcttgccgccgattttaactggaacaccatccatcagcagcacgcggcattaacagaagcgattcgaacaaaacagaaggcaaaagccaaggaaatcgccgaagagcatttgcagctggtcatcgtcgataaacagatgctcattgatgagtttcccggttattt

SEQ ID NO: 1394 - DNA, 843 bp, Bacillus licheniformis
gtctatggaatattatcgacaatatcattcattgcttttttcgattgcttaccgtatgctcgggtcttttcaagatgcagaggacatcatccaagaattgttcgcagaccttcaggaaaaagatatcggtcaaattgaccatattcaagcatatttaacgaaatcaatcacaaaccgctgcataaatgaactgcagtctgcccgcaagaagcgggaggtatatatcggggaatggcttccggaaccgcaggtggcgctttcagctcaaatcccggctgagtacgttgaagagaaagaaaaggtatcctatgcttttctggtagttatgagccgattaaatcctgtagaaagagccgttttgatgtttagagaagtatttggatatcattacaaggaaatttcgtccattatcgggaagtcggaagcgaactgtcgtcaaatccacagccggctgaaacagaaattaaacgaggatatttcggtattttcacagccggttgaagaacagcaattggcccagctgtttatcgaatcagcgaaaacaggtaattttgaggagttttccaagaaattgattgaagatgccgtattgtatacagatggcggcggaaaagtgcgcagcgctttgagaccgatctatggaaagagccgcatttatgcgttttttacgggagttgtttcaaagggaagcttttccggccgctttatgccagtcgatatcaacgaccaaaagggcgttttgatcatgaaaaacaaccgcccggcttacgcggtttgctttgcttggaatccggaaggcgattccgtcaaaaatgtgtttatcgtgtcaaatcccgataaact

SEQ ID NO: 1395 - DNA, 414 bp, Bacillus licheniformis
gaagaattttacggcgtcatcagactccgtcacgaacttcggcatgttcgtcgagctgccgaacacgatcgaagggcttgtccacgtcagctttatgacggatgatttctaccgttatgatgaacagcactacgcgatgatcggcgagcgcacgggcaacgtgtaccggatcggcgatgagattacggtccgcgtcgttgacgtcaataaagacgagcggaacatcgattttgaaatcgtcggcatgaaaggctcccgccgccggcagaagccggagccaaagcagaaaaaggcttcaaaaagagaggctccatcggctgacaaaggggaatggttcaccaagccgaaaaagaaaaaagtaaagaaaaaacgcggttttcaaaacgcgccgaaacaaaaacgcaagaaaaagaa

SEQ ID NO: 1396 - DNA, 1056 bp, Bacillus licheniformis
atgacgaccaaacgagcgaaggtgcagaaagttaaaggagtgctcaagatgtctcatactcgaattaaattcccggcaggattttgggcaggattgcgtcaattaggaattaacgcccctgatgtgcttcgaaaagcccggctgccgctcaccgtgatgactgaaccagttgtcaccgccgcccaatacttcgcgatctggcaggcgtattccgaccttgttgatgacgtttccaaaggaatcatcaagcttgcgaccggctttgagccggcacattaccctccggccgtattagcggcttaccatgcccgtgactaccgcggcgcgctaaaacgaatggcccgctacaaacaattatgccctcctgaaagcctgcgtatcaccgaagaagatgagcactgcgcaatcgaactggaatggttggatgataagctacccggtccgccgctcttgattggcattacactggcatttcttctggaactcgggcgccggggcacaggtcagccgttgacagcgaagtcggtcgagtttgcacacccaatgggcgacatgcaggcgcttgaagcatacttcggctgccgcatccggagcggtgcagctcggaaccggctgacgctgaatcgaggagatcttgaccgcccttttgtctcgtataacgcggagttgctggagattttgactcccgtgctggatcaatcgttgaatgatcagcaaaatagcctttcaatcagcggagcggtcaagtggatcatgaaacgcacgcttccaggagggcaccccgacattcagactgttgcgagcgagttgggaatgagcggccgcaccttgcagcgccggcttactgacgaaggcactagcttcaaacagctgttgatccaagtcagacatgagcaggcgcgggagtacttggcagacccttcgctcgatattaaagaagtggccattctgatcggatatgaagatcagaactcgttctaccgggccttccgcctttgggaaggcgagactccttctaattggcgtaagaagacccggctgaatggatttaactag

SEQ ID NO: 1397 - DNA, 483 bp, Bacillus licheniformis
tgatcaagaggaacgcgaaacggattacgctgattaaaggaccggctcaccttcagactgcaagagaccgtttcaacggagcgctggacgtgctaagcggagccgatatcgattttcacgtcatgaaaaccgagacattttcatttccggaagcccaaaaacgggcggcggagctgtttggcacatatccggaaacagacggcgtgatcgcaagcaatgacattgtggcgacagccgttttgcatgaagccttaaaacggaagatcaaagttcccgatgaactgcagattatcggctttgatgacataccgcaaagcgaattgcttttcccctctttatcaacgatcaggcagcccgcctatgaaatgggaaaagaagctgcaaaactgctgcttagattaatgaaaaatgaatatattgaacaatcggcagttcagatgccggttgcctttattgaaagacaaacgacaagaaaggcggaat

SEQ ID NO: 1398 - DNA, 385 bp, Bacillus licheniformis
atgaaaagaagaacagcaagagaaaaggctttgcagtcactattccagattgatgtcagtgatatagaaccgaatgaagcgatgcagcatgccttggacgggcaggaaagcgatgcttttttcgaacagctcgtttacggggtcttagagaacaaagagaaaatcgatgagatgatcaagcggcatctcgtcaattggaagcttgacaggctggcgaatgtcgaccgcgcgattttgcgtttgtccgcctacgaaatgatctttttagatgacatacctgtcaacgtctctatgaatgaagcgattgaactggcaaagcaatttggtgatgacaagtcggcgaagtttgtaaacggtgttctttctaacattaaatccgatcttg

SEQ ID NO: 1399 - DNA, 1047 bp, Bacillus licheniformis
atgtcctgcaaaccccttttgagatttaagtataatcgacctcttaccataaaactattcaatcgttattataaaaacaataggttaaacctatcattggaattcggctgtttttcagatggagaggaggaaagagcattggagctaaagcaattggaatactttatggcattgtgccgggagcttcattttacccgcgccgccgaaaaactgaatatcgctcagccctcgctgagccagcaaatccgtttgcttgaacacgaaatcggaatgcctttgtttaaccgttcaggcaaacgcaccgtgatgacggaagcgggaaatattctgctccagcactgttacaatatctttcatgaactgtcacaggcgcgagacgcgatcagcgagcttcaaggtttaaaacggggaacgcttaaaatcggggcgcttttgaccgtggttaattatttgcttccccggaccgtggtcgaatttcaccgcagctaccccaatattgaattgtctgttttagggctgagaaccggggatatttacgaccggctgctgcaaaatgagctcgacttgggcattgtagcccagcgggtggaacatcgtgacttagaagccgtcccattccttacccagcatctcgccctcgcggcgcctgttgacaatccggttgcaaagcggcagtttgtcacgcttgacgtgttaagggagattccatccattttgctgcctgagacgtattttttgcggcagctgatcaacgaaaagtgccgcacgcttggattcgagccccggccggtcatggaaatgacaacgatggaatcgatcatgaacatggtcggtaaaggcatcggcgccaccattttgccgaaaggctatcttaatgctattggaaataaatccattcagacgattccgatacaaaagccggatttgacgacggagatcagcatcgtttaccgtaaaaacaagcatatgtgcgctgcaagccgggtgtttatgaaactgctgatttcctcggtcaaaagcgaaaccgctgatgcgccgccgcgttaa

SEQ ID NO: 1400 - DNA, 451 bp, Bacillus licheniformis
atgatcggaagagtcatccgaatgtacagaaagagaaaaggctactccattaaccagcttgctgatatagcaggcgtatcaaaatcatatttaagcaaaattgaacgcggcgttcacagaaatccgtcagtcgaattcctgaaaaaaatctcccgggcgctgaaagtcgaattaaaggaattgtttgataccgaagtgatcctttatcgccggactgagcaggaagatgagtggagaacccatcttgtacaggccgtgcaggccgggatgaaccaggaagaactgtttcaattcacacatcgcctcaagcagaaaaagaaagaacgggcgctttatcgaaacagagagctgacccgggcgaatatcgacgaatggagagcccttatgctggaggccaaagaaatgggactgaccgtcaaagaagtagaagcgtttttgatgaggacaaaaa

SEQ ID NO: 1401 - DNA, 354 bp, Bacillus licheniformis
tcattgtgaccattattgcatacggcgacattgaagcggatttcgccaatgtctatctacatgacaacagcaggcaaattacagaagagtatgacggacgctggctcgtattcagcgtcgacgattcaaaagttgtggccggcattgtctcgcatgggaaagacagccgcgcagcctggacgatgcatgtaggcttggtgatgccgattaccgaagtgatgattcatgatttgtacctgatggaaatcatggagaagcacagagaggtattggaggaaagtttcggcgaaaacctgatccatttgcgccgcaaattttcgatacatccggattttaaaaagcattatatgaaat

SEQ ID NO: 1402 - DNA, 333 bp, Bacillus licheniformis
atgacagtcgaagatctttcttataaagataaaaaagtgatttcaattggcattgtcagcgagctgacgggtctgtcggtcaggcagatccgctattacgaagaacgcaagctgatctatccgcagcgctctacaagaggcacgcgcaaatattcctttgctgacgtcgaacggctgatggaaatcgcaaacaagcgggaagacggtgttcagaccgcagaaatcctcaaagatatgcgcaaaaaagaacaaaggctaaaaaacgaccagcagctcagaaagaaaatgctcgaaggccagcttaacgctcattttaaatacaaaaaccgttaa

SEQ ID NO: 1403 - DNA, 550 bp, Bacillus licheniformis
atgacaaaaagaaatcacacgacttacgcgctgcttggattgattacggccggctaccgaacgggttacgaaatgaaacgaatgatcgaccaaagtttgaatcatttttggaaaatcagctacgggcaaatttatcccgcactgcgtcaattaacggaagcaggctgggccgcggcttctccggcgctctcggacaaaaagcaggacagaaaagagtacatgattaccgctgaaggtcaaaaagcgctgcagagctggcttgaagaaccgatcaatgacatcgcttcagaaaaaaacgagtttttgctgaagctgtttttcagcaaggaagaatcgcgggagaaaaccgctttgaaagtgaaggagtaccaacaaaagcttgaagaacggcttgaagcatataaagcaatcgagcagtcaattctttcgtgcagctcccattcaaaggacagagagtactggcttttcacgttggattatggaaaacgcaccacctcggccggaattgaatggtgtgaggccacaatcaatcggctgaatggaaaggaag

SEQ ID NO: 1404 - DNA, 342 bp, Bacillus licheniformis
tgtttgaagcttttatcggtgcgctctatctggatcaggggctcgaagccgtcgtgacttttctgaaagcgtacgttttccctaaaatcgacgatggtgctttttctcatgtgatggattttaaaagccagctgcaggaatttgtacagcgcgacgggcgaggcatactggagtataaaatccttcaggaaaaaggaccggcgcacaaccgcgaatttgaagcaaatgtatcgctaaaaggagaagtacttggggtgggaagcggccgttccaaaaaagaagctgaacagcatgccgctcaagaagcgctcgcgaagctgcaaaaacaccatatgaaacaat

SEQ ID NO: 1405 - DNA, 407 bp, Bacillus licheniformis
atgctggatcatacagacaagcaaatcatagaggaattatcaaaaaacagccggatgaccatgaaggaattaggagagaaagttcatttgacaggccaggcggcttcagcaagggttgctaaattagaggatcaaggagtgattgaaggttataccatacaagtgaatcaagtgaaactcgggtgttttattcacgcttttatcaatatctatacaaaaagcacttatcataagccttatctttcatttattaaagcacagcagaaatacatcattcataactataaaatcagcggagacggctgttatcttcttgaatgcaagtttccgtcaaatcaacagttggaccaatttttaatagacttaaaccatcatgcaaattataaactgtcgatcgttatcaataa

SEQ ID NO: 1406 - DNA, 402 bp, Bacillus licheniformis
atggtgaacacccgtctttcagtggccattcatatattgtctttaatcgccgcaaacccgcgggaatcttcggaaatgatcgccgggagcgttaatacgaacccggttgtaatcaggcgcatgatcagccagctcaaaaaagccggtattctgacgtcgcggccgggagtggccggggcaagcctgaaaagagatcccgaagatatatctctgcttgatatttaccgcgcggttcagccgcatgaggaattatttgcgattcatgacaagccgaatccaaactgtccggttggaagacaaattcaaacaacgcttgatcaaacgtttcacagcgttcagcaggcgatggagaacgaattggccagcaagtctcttaaagacgtcttaactcatctcttttaa

SEQ ID NO: 1407 - DNA, 805 bp, Bacillus licheniformis
atggatttcaaaacgttaaagacgtttcataaaatcgtggcttgcggaagctttaaccgcgcggctgaagaactgaattatgcgcagtccacggtcacaatgcatatcaaaaagctcgaggaagacctcggcattcgtttgctcgagagggggaaaacattccgtctgactgaagccggcaggcttttttttgaataaagcagacatattgtcaaggatatagatcaccttcaacatcatatggacgacttattgcttggcgaagggggaaatatccgccttggagcggtcgaaccgatcgcgagctgtgaattgccccagattttggggagatttttagcggattatccgaagatccgggtttccgttgatatcgccaactcgtcggcattgggggaacggctggttcaaggaagcctggatcttgccgtctgttcgactccggcaatgggaacagatctttattttgaaccgctttatgctgaagaactcgtagtgctgctccctgagggacaccccgccggaaacaatgaacgcattcatctgaaagatattagggagcaccgcctgctgattacggccaacaattgcacctaccggaagaaagtcgaaatcgcgtttcaagagctgccggggagccaaatgaacacgatggagatcggaagcatgacagctttgaaaaactatgttgccgcaggactcggcgttgccctgattccgaaaagcatcgtttcccctcctcctcccggaacgattgtccggtttatcgacgatgacccgatcagcgtaaccttcggcatccttt

SEQ ID NO: 1408 - DNA, 345 bp, Bacillus licheniformis
aaagcttccggcagaagtgcaagaagcgatcttgaaaaaagaaatttcagagcgccacgcaagagcgctcataccgttgaaacagcccgaccttcaggtcaagctgctgcatgaagtcattgaaaagagtttaaatgtaaaacaaaccgaagaccgtgtcgtcaaaatgcttgagcaggataaacgcaagcctaaaccaaagagaaaagcgtacagcagggacgcgagaatcgcgatgaatacgattcgccagtccttatcaatggtggaagacagcggcgtcaaactgaatacggaagaagaggaatttgaagaatatattcagtttacgattcgaataccgaa

SEQ ID NO: 1409 - DNA, 420 bp, Bacillus licheniformis
atgaatcaccatcggattgaagcgaatctattggaccatgctttcacgaaatatttgcggtcttcaaagaaattagacgaagaaacgattccgaaaagtatcacgagcggcaaagggtttattttgcgtatcatttacagacacggaacatgtacgataaaggaaattttacaggaggtcgcgctgtctccatcagcaacgacaacagctctgaaccatttggagaaagagggtcttgtgatcagatcgagaaataacgatgaccggcgcaccgtctggatcgaactgtcgcaagaaggaacgaggatcgccgcacaaatggtggaaaaccgccaggccttgatcgacaagctcttcggcaaattgtcagaggaagaaaaaaaggctttttttgctgtgattgaaaaagtgatgatgtaa

SEQ ID NO: 1410 - DNA, 457 bp, Bacillus licheniformis
atgagactttcgttaaatgaggaagaagttcaccgtgctatgtcgctgtacaagtttttgccagggctttaaaagcgtttcagaacatagtattcgggacagcaaggaacacgggtttaatcctacagattttctttaatggggccttggtatacgaggggagcccaaaagctgcagcaaatcggctcgaggctgctccttgtaagcgggaacgtaacctatgtgatcgacaaactggaaaaaaacggtttcatcaaacgagagcaggacccgaaagataaacggtctgtctatgcgaatttgacggagaagggaaaggcatatctcgatgagatttatccgatccactccctgagaattgcgagggctttttcaggcttgacaaaggaggaacaggagcagctgatggtccttctgaaaaaagccggaatccacagccagcacctattgtttcgct

SEQ ID NO: 1411 - DNA, 439 bp, Bacillus licheniformis
atggcaaacgaatttgaacatatgaggcttgacagacagctttgctttctcctttatgcaagctcgcgtgaaatgacgaagctttacaagcctctgcttgatgaactcaatattacgtatccgcagtacctcgcgctccttttattatgggaacacggggaattaagcgtcaaaacaatgggcaagctcctttatctcgattccggcacactgacgccgatgctgaagagaatggagcagcacgggcttttaacaagagagcggtcacctgaagatgaacggtctgtaattgtcagactgacagcaggcggccaggcactccaagaaaaagcaagcagcattccgcagcacatgatcgcccagaccgatctgtcggctggcgaactgaaaaacttgaagcaaacgcttgaatcccttcttgcttcattgacgaaaaaaa

SEQ ID NO: 1412 - DNA, 519 bp, Bacillus licheniformis
tcgcggacagaggctttgacgccgcaaccattcccatgatcgccgataaggcaaacgtcggtgcaggcaccatctaccgctactttgacagcaaggaagcacttgtaaacgtcttgttccaagacagtgtgaagagatttaaagaaaagatagaggagggctatcctgaagattcagcaggcataaaaaaacaatttcagcacattttccgctgccttttcgagttttctcaggaaaatatccatgcgctgtattttttggaaattgacaagacctctcattacttgactgagaaaagccgcgaggtcttgaacgaactgctggatttcatctatttattttttgaaaaagggaaagcggccggcatgattcgccctttgccttcccacattttgtcggctgttgtattcggagcgttcgttcatattcagaagttggtaagagcaggggaattcgaggaccctaccgaactgatggaggagattgaagaatgttcctgggatgctgttaaacatcatg

SEQ ID NO: 1413 - DNA, 320 bp, Bacillus licheniformis
atgagtttgaaacaatactcagaggaacagctaaaggaaatggctttagttgaaatcgcatacgaaattttctcggaacacaaaaaaccgattacattccaggagctaacagatcaagtggcttccttgcttggaatggggaaagaagagctggaagaccgcatcgcccagttctacacagatttaaatatcgacggacgctttttggcgctgtcagaccaaacgtggggcctgcgcagctggtatccgtatgatcagcttgatgaagaaacccagccgactgtaaaagcgaaaaagaaaaaagcgaaaaaagcggttga

SEQ ID NO: 1414 - DNA, 549 bp, Bacillus licheniformis
gaaagccattgtcgaagcgcttttgtatgccgccggcgacgagggcctgacaaaaaaacagctattatccgttttggaggtcgatgaagccgagctgctggatattatgcttgatgtcaaagaaacctatgaaaaagaagacaggggcatcgagcttgtcgagtatgcggatacgtacatgctttcgaccaaaaaagaattcgccgtctatttgaaaaagctgatcgaagccccttcaaaagggctttctcaggctgcgctcgaggttttggccatcgtctcttataagcagccgatcacgagagcggaagttgaggagatcagaggggtcaaatctgaacggattcttcagagcctggtcgcaaaagcgctgttatgcgaagtcggacgggcggatggaccgggcagggcgatcttgtacggtacaacagaaacatttctggaacaattcggcttaaaaacgcttgaagagcttccgccgctgcccgaaaatgtagaagaagacggggttcaggaagaagccgatctgttcttcgaaaactttaacca

SEQ ID NO: 1415 - DNA, 305 bp, Bacillus licheniformis
ttggaagataaggtattgcgaaagctatttctaggatttattcaaattcatattctgcaccacgccagcgaacacccgattttcggattgtggatgcttgaggaattgaaagagcacggatataacatcagtgcgggaacgctgtatccgatccttcattctatggaagctgacggacttcttcgaaaagaagaacagaatgtggacggaaagatcagaaaatactattcaaccacggaaaaaggagcaagcgtactgaaggaagccagattgaaagcatatgaactgtttaaagaaattaaaga

SEQ ID NO: 1416 - DNA, 726 bp, Bacillus licheniformis
ttacacaatcggaggcggcggctatgtttttcgcgtatcaatctttgcagttcttcggatcgctcccctttgatgcggaaacgcggatggttttaaaaaagttctaccgccaccttcccccggaaacacaggagcggattgatgcgatgaaagacagaatcgtgttctggaatccgcatcgcccaaaagccgccgaacatttagagacgcttcttgacgcagccgtcactcaatccgttttgacggtcgtttatgacggaactgacgagtgcacggagagatccatccagcctatcggcttatacagctggaacggcttctggtactgtccggcctattgctttaaaaggcaggcgttcagactgttccgcgccgaccgcatcctccgtgcggaaaaagcggacagcgggcaggcccgccagcttccctatccatcagttctcagctggatcaaacattcggagagcgagtgccctgaaccggtgcggctgcaagcggaactgacacgtagaggagccaggcgggctgcggctgatgtggatttattcaagatcctcaccatgcgggatgacggaacgggggcgatcgatgccagtatccccaggtctgaacttgagtatttcggagaacttttgtggaatctcggcgctgaggtaactgtaacagaacccgcggaaatcaagcttcatctgaaacggaaggctgctgacattttagcgaggtacg

SEQ ID NO: 1417 - DNA, 732 bp, Bacillus licheniformis
taaaatccgcggtacgtgttgtacgtatatttgaattgctgtcaaatcatccggatggattaaccgtaaaggaaatcagcaaagaactttcgctgcctcagagcagtacattcaatttggccgctacacttttggatgaaggttaccttcagcaggatgctgtcaagcgttacaggctgggggcaaaattgattcaagttggaaccgctgccatggagtcgatagacatttcatcgcagggcgttccttttttaaaacagctgatggacggcgttcaggaaacggtgtttatggccgttctatccgatgatcagctcgtctacatcgcaaaaatcgataacaacaggtcaatcagaacaaccgcacagcccggctcgcgcaaaccgctttattgcaccgggcttggcaaggcatttttggcattcatgccggaggacaaaagggaagggctgctcgaccgcatggagtttatccggtttaccgggcataccatcactgccagagaagagctggaaaagcagctgcagacatttttggaacagggatatgccgttgacaatgaagaaaatgaagaaggtttgttttgtctggcggcgcctgtctatggtccggatggcgtgatgaaggcggcgatcagcaccgccgggccaaaggagcgcatgctcgcaagaaaggccgttatcgttgagcagctgcttcacacagccggaaaaattacagaaagcattggcg

SEQ ID NO: 1418 - DNA, 882 bp, Bacillus licheniformis
atggaaatcagacatttaatcacgtttcagaccatcgttgaaatgggaagttatacgggggcggcttcgaaattaggctatactcaatccacgatcaccactcatatccaggctcttgagcatgagatcggcggggctttatttacgtatgaaaaaaggaatttaaaactgactcagttaggaagggagttaatgcctttagccgaagaattgctgtcaacccataatcagatcaagaatttgcagagcgctcacgaagtgaagggggtattgaaagtggctgcgcccgagtctttaaccatttctaggctggggccaataataagggagtattcgttgaaatatcctcatgtcaaattgaaactgagcaacggtacatgcggacaaaaccaagtcgacttattaagcgggaatgtggatgtcgctttaatggtttatcccgaaatcgagctggacaaatgcattcgctacacgttggctgaggagaagatcgtccttgtcggcagcagtgaagggcctgaggatttagaagaatatcaaaaacatttttttataacgaatgaagaagactgcagctatcgaaccatgtttgaaaaatatctcttgaaaaacgatattcattactttccaacgatggagttgtggagcatcgaagcaataaaacaaacggtcatgagcggactcggattttctgttttgccttacattacggtgaaagacgaagtggaaagcggtaaactgaaaatccttcctcattctcaatacctcgacccgctttattcccagatgcttatcaaaaagaaaaagtggcagctgcctgctgtggatgcttttgcggatctggtattgcattcgtttcgtgaacctcgattaataggataa

SEQ ID NO: 1419 - DNA, 333 bp, Bacillus licheniformis
atgagtgagcacaatcaagaaacaacagaaaaacaggtgcgggccgagttagatgaagaaactttatttctcgtttcacagacgtttaaagcgctctctgacccaacgagaatcaaaattcttcacctgctctcacaaggcgagcattcggttaatgaaatagcagagaagctgagtctcctgcagtcaaccgtttctcaccagctcaggtttttaaaaaaccttcgtctcgtcaaatcaagaagggcagggacttccattttttattctccggaagaccagcatgtcctcgatgtacttcagcagatgatcgatcatacacaacatgactaa

SEQ ID NO: 1420 - DNA, 879 bp, Bacillus licheniformis
atgaatatgaatgattacgaaagaattcaaaacgcggttcagtttatcgaagaacaccttcaaaacgatttaaacatcacggatattgcggctaaatcgtgtttctccccatttcattttcaaaggctttttcaggcgatctccggtttttccgtttatcaatacattcgcaaccggcgtctgtctgaagctgcgcttctgcttgagaaaacagaccgttccattctcgacattgcaatcaatttcggctatggctcacaagaagctttcagcagggctttctcacagtacttcggcatcactccggccaagtatcgcaaagcgaaggtcaagcttgattttcaatctaaaattaatttcctcgaatataaagaaaggatgactggagatatgaacatcccaaagccgcacatcactcatttaaacgacatacatatgatcggatatgagtaccggacaaatttaaacgatgaaaagtatttcgaagatatcccgaaattctacaacgatttcggcagaaatggatactttatgcaaattcctcaaaaaacggatccgaatatgtgttacgggctgtcatgccgcttccaggatgacggaggtttctcatttattatcggggaagccgttcgcgaaacagcagccggggaagtgccggagccgcttatttatacgaaaattcccggcggcaaatacgccgtatttcatgtaaacggatcgactgaatcagtgcagaacacaagaagatacatctatggatcatggctgatgaataccaattacgagagaacagaaggaccggactttgaagtgactgatgtgtgccgttccgtaccgccgaacgagatgaagatgaccatctatatcccgcttctgtaa

SEQ ID NO: 1421 - DNA, 308 bp, Bacillus licheniformis
ttggggtttacaatgtgtcctagaatggaagccgccttttctttactcggcaaacgatggaatggactgatcatccatgtattattggatggacctaaacgatttaaagacttgactgaaatgataccgatgatcagccagaaaatgctggctgaacgtttaaaagagctcgaacactgcaaaatagtcgagcgtcaagtgctcccggaaacgccggtaaaagtgatctatcaattgacagacaagggaacggcgctggagcctgtcctcaaggagatacaaacctgggccgaaagccattgtgatcc

SEQ ID NO: 1422 - DNA, 858 bp, Bacillus licheniformis
atgttcgaagtctctgtcagaacgatttatcgggatattgaggcgatcaaccaggcgggcattccgattgtcacctcacagggagcaggaggcgggatcagcatcatggagcggtttcggctcgaaaataagctgctgtcagcagacgaactggcggccattacgacggctttggaaagcgtttcctcgacgtacgaagtgctccatcacgggtctgcacttgaaaaaatccggtttctcgtttcggaagaagaaatgccggaattccgcaagaaaacggaaaaatggtttgttgacatctcttcctggggagaaagtcctgtcatcaaagaaaagatccgcttgctggatgaagcgtcagacagcacgcgggcggtctcctttaattatgtggacagagaggggcagaccggaaaaaggaaagcggagccgcataccctcgtcctaaagggaaggcactggtatttgtatgctttctgcctgaagagacaggcgtttcgcttctttaaactgttgcggatgaaagacgtgcggatgcttgaagaaaagtttgaaagaaaggaagtcgatctgtcttcacttccttgggagacatcgtggtacaaaccggacaatatgaccgaggtgacccttctcattaagccgtcgggagagtctttggcaagagaatggttcggctcagaagctctcacttatgaaaacggacaatgcgtggcaaccatttcttatccggaagatcaatggctgtacggatttctgctccaatttggaacccatatcgaagttctcgatcctcctcgcatccgtcaaaaaataaaagacttggcaaaacaaattgtacatttatacgaaacctga

SEQ ID NO: 1423 - DNA, 579 bp, Bacillus licheniformis
atggcagaaaaaatgagcagccgcgacaaaattttgcggacggcttcacgattgttccgcaaacaaggctaccatgccacaggcttaagccaaatcacagccgaaagcggagcgccgcggggatcgctttattattatttccccggcggcaaagaggaactggcgcaagaggcgattcaattaaccggagaaagaatcaaagcgtatatatcgtcagcgatcagcggtgaagctgatcctgtcaaggcgtttcaatcttatatccagatgatggctgacggaatcgaggaatacatcatcgaagaaaacgacgatattccgatcgtatccgtcgccgcagaaacgtggtcgttcagtgaaaggctccgccaaacgtgtgaacaggtttatcaagactggcagcttgtctatcaggaaaaactgctccagtcaggctatgcgccggaaacggccgagacgctgagcgtcgcgatacaagcgatgattgagggtgcgtatgtgctctcagtgacgaaaaaaaacggccggcctctcagtgcagccgccgaacaaattccttttttgctaaaacgttcataa

SEQ ID NO: 1424 - DNA, 855 bp, Bacillus licheniformis
atgggattcatgaaggaatatttttcaatcggggaaacagcccgtctaaataacatttccattcaaacattgcgctattatgataagatcggaattttcaagcctcaatgtacagaccgggataacggctatcgatattaccatgttaaacagttcttttatttggatattataaaatatctcaaatccattaaaacgcctttggaagaaattaagcgcattatctcacatacatctgcccctgaactgatgcaaacctttcttgaggagcaagaaaacgttattgagcgtgaaatggaaaaactcgaacgtgccaggcaattgcttcaaagaagaaaggaccagcttcatgaacaattggagatacgcgctaaaaaagaagaaggtctggtgtatgttcggcatatagaaggccaaaccattttaaaagcagcgacacctcaagtgaatcctcatgaccaatcagatttgtattaccgaaaactggctgaggtcctggaagaaagaggagatatggtcgataactattatggactgatttatgatttaaagccttataaaaattcaggtgacatttattgcaacagtgtttatacgacgatttacgatggagcaaagatagatacagaagaacaaaatattgggatggatacgatcccatccggtgaatatgtgtgtatttcatttgattgctcttcaacaaattatttttcatactatcaaaaactgtaccattttattgaaactcatggcattcaaacggatggaaaagtatatcaagtttcttttccaaacagctataactcattaaaagaagaagacttcctcacagaattcagagtgctgaaaaaataa

SEQ ID NO: 1425 - DNA, 269 bp, Bacillus licheniformis
ttgaaagcaataggagttgtgagaaaagtagacgaactcggcaggatcgtgatgccgattgaattgagaagagctttggatatctcgatcaaggacagcatcgaattctttgtcgaccaagataaaatcgtcctgaaaaaatataaaccgcacggtgtgtgtctgatgaccggtgaaatcacttctgaaaaccgcgagtatggaaacgggaaaattacgctcagtcctgaaggggccgaattgcttttggaagaaatcaaagctgcctt

SEQ ID NO: 1426 - DNA, 837 bp, Bacillus licheniformis
atgatgaacaatcgattccgtgtaggagaagtagcaagacttttcaagctgcctgcatcgactctgcgttactatgatgaaatcgggctgttcaggccaaagtataccgatcctgaaacatcttatcgatattatggtgttgaacaatttcagatcctggatacgattatttttttaaggaaaaatggattttcgttaaaagatattcagcatcagttagatcaaaggactccggaaacaacgatggaaattttgaagaaaaagcttgaggaagtcagagcggaaatttttcgtctccaacgcaacgcggcgagaatcgagaacaaaatttccacaatcgaagaaggaataaaacttgccgaacatcctgctttaacatttcagtatttcccaaaacgggctatttcctacctgtattttgacaagcctgtcgacctgatggaggaaggcgacgacatttatttaaaggataaagaaacgctttcaagccagtcgattgagaataacggcttcttcaccggagacattggaacaatcgttgatatggagagcttgaagcaagaaggaccggtaaaatatatcggcgtatttgaattgctgcacgaggaagacagtgaagactatttaaacgaagggttgtatgcgagttacccccatattggtccctacgaggacatcaggaaaagttatcagctcgttttaagccagctgaaagagaaggaatacgagctggcgggaatccctgttgaaatctcatttcttgatgatgctgtgatcaaggagtcagctcgttatgtcactttaatccaaattccggtaacaaagagttttgattga

SEQ ID NO: 1427 - DNA, 319 bp, Bacillus licheniformis
gtggcgacgataaaagatgttgcagaaaaggcggggtattccatctcaacggtttcccgcgtattgaataacgacgaaagcctttccgtacccgatgagacgcgggagaaaatatttgaagtggcggaaagcctgaactaccgcaagaaaacgatcaggacactggtaaaaaacatcgcgtttctgtactggctgacggataaggaagagctcgaagacgtgtattctaaaacgatgaggctggaaatccagaaactcgcagagcaattaaacgtagaactgacaacgtgtaaaatttagggaggcattgacgcccttt

SEQ ID NO: 1428 - DNA, 813 bp, Bacillus licheniformis
atgatggatatgaatcgtcagttggaggtgactcttatgaaaaaagatgagtattattcaatcggtgttttctcagaaatgacagggacatccattcggacgctccattattacgatgaaatcggcctgttgaaacctgaaaaagagacgggaaccggccgccgtctctacacagacagagatgcgaaagatttgcagaagatcatatgttttaagtttctggggtacagccttgaacaaattcgcgctttcatgaaggatgcatgcttcgatgctggtctgattgaggcgctgcaggagcagaaaagggtgctggaggagaggaaggagcatattgaaacagggctgaaagcgatcgacaggacgatcggtcttctggaagaggaagaggaaatcgacagttctgttttcatgagcctgctgaacagcatccagacggagaaggagcagcgcgaatggcttgaacagcaggtgtctaaaagttttgccgatgatgtattcggcaaatcagaggaagagatggccaaattggatcaagagtatgttcgtttatctaaggaagccaagcggctcatgggaaaaccggttgatgaccccgaggtgcaggacatggcagaccggtatatgaagacgagtttggagtttgtcggagagggcgtgctgtcggctttaggacagatggagacaatagaatcgcggcagctggcagagaaatttccttcaccatttacaaaagaagaagaagagtggctgcagcgggtgttcgaatattatatgattcacaacgatttctgtcccgaaagcggcggatga

SEQ ID NO: 1429 - DNA, 804 bp, Bacillus licheniformis
atgactataaaagggggttttatcatgaaagacagcgtgtttcaaatgacttctgacacatatcaatctctcagcgattcagaacggcatttgctcgagtacatttatcagcacttagacgtcatcgccactttatcgattgtaaaattaagcgaggatgcaaatgtttcaacagccacgattgtcaggttaatgaaaaaactcggatatgacggctacacttcttttaagtatgcattaaaagaaaaacaccacctcggacacgctccgctgatggatgatatcgacagccaaattaaacaggccgtgctaaagaatgaaagagaagttctggatacgattaagatgcttgatatcgggttgatcgaagatgccattcaaaaaatcagcaatgccgaaaaagtttacatcttcgcaagaggattgtctgaaatgattggaaccgagatgacgatcaagcttcagctgctcggcaaaaactgcgagatgcacagcgacccgaatattatcagaggaaagtcaaaaacactggccaaaaaagacctcggcctttttgtttccttgaacggcgagacagaagagcttgttgaagccgctcaaaatttcaaattgcaagccatttccaccattacattaacgacaaggatcgattcgcgtcttgcgaaattatcagagatcgtactggtcgggtttaaaggggaacaatcattttttcccgattatgaagtccgctctcgcctccctctgcaagtcctctcccgcatcatgctggactcatatgtcatccgcaccgctcatagctga

SEQ ID NO: 1430 - DNA, 478 bp, Bacillus licheniformis
atggcaaggccaaatgtgacatcaaaagaaacgttgattgaggcggctaagcgccgcattgccgaacatggcctggacaaactgacgctaaaggcggtcgctgaagaagcaaaggtcacacagggaactgtttactatcattttcggacaaaagagcagcttgtttttgaagtggtccgcgacctatgccgcgcgtcgtgggagcgattgaaagcaaatgaaaagcccgctgccgaaaggataaaagacggattgtcttccgcgaaatcaagaacactgaaggatgcgtattatcatcagctttttttagaattggccgttttagggtttcgaaatgaaaagataaaagaacagctcggcgaacttctcgaagaggaaaatgcggtgttggcagaacagctttccgacctgtggaagcgttctcctgttgacggggtttctttcagcacgtggggcattcttttaaacgcactaatcg

SEQ ID NO: 1431 - DNA, 401 bp, Bacillus licheniformis
aagaatttatggataagcttctctcctttatgaaagaagaagcatataaacctcttacagttcaggaactggaagagatgctggaaatcaccgattcggacgaatacaaagagctcgtcaaagctcttgtaacccttgaagaaaaagggcttgtcgtcagaacgagaagcaaccgctacggtttgcccgaaaaaatgaatctgatcaaagggaaggtgtcggcgcacgcgaaaggcttcgcgtttgtccttcccgaagactcctcgcttgacgatgtcttcattccgccgtctgagctgaacacagcaatgaacggagataccgtgctcgtccgcctgagcacagaatccggcggtacaaaaaaagaaggggccatcatccgcatcatcgagcgcaacatt

SEQ ID NO: 1432 - DNA, 483 bp, Bacillus licheniformis
atgatgacagtggaaaacaagacgtatgagcaggcatttcaagccgttcaggattttattctcaaaagagaaaagcgggctcagcatgaacagcaggcgttcgcagaggaagcctttcaagaagaagaaagcatgcgtaagcattggaccctgacccagcttcacattatctcgcttatcagcgaaagcgaagcagacgtcaacaacgctttcctggcagcaaaactccaaatttcaaaagcggcagtgacaaaagcggtcaatgtgctcacaaagcacggaatgatcgaatcgcacaaaaaaccgaacaacaacaaagaattgtattacacattaaccgatgaggggaaaaaactggccgacattcatgacaggatgcatgaaattgcaaaacagcgctacatcgagctgtttgatcggttttccgaatccgagctgcaaaccgtcatccgctttttaaacgaatggtcaaaacacatttaa

SEQ ID NO: 1433 - DNA, 552 bp, Bacillus licheniformis
ttgaaaaacaagtggcagaaaacattaagaggctgcgaaaaatccgcaattacagccttgatcaattgtcatcgatgaccggcgtcagcaaaggcatgctcgcgcaaattgaaaaaggctcttcaagtccgacaatcacaaccttgtggaagatcgcaaacgggctgcaagtatcatttacttctttggcagaaaggcctgccggggagccgacggtcgtcagaaagcacgagaaaacgcctgttatggccggagaagaaaaatacgcggcatttccgcattttccgttcgaccagaaaaagaagtttgaaatcttttatattgaacttgcgcccggctgtgtgcacgaatcagagcctcaccacggagggattgaagagtacgtgctcgtctctaaaggcgcgcttgcggtgacggcgggtgattacacctgcgacttgaacgagggtgatgcaatgcatttcaccgcaaacaccgttcatacgtacaaaaacaacacggaacaaacggcatcatgctatacactcatttattatccgtaaagaggtgtca

SEQ ID NO: 1434 - DNA, 741 bp, Bacillus licheniformis
atggtgaaagaggaactgacaaccgggcgggtggcgaagatgatggggatatccgtaaggacgctccgctactacgatcaaatcggtttattaaaaccgggctctacactgccgaatgggcgaaggcaatattcgaaggaagatttgttagagctcgaaaaaattatgatcttgaaatctgctcaattttcattggagcatatcaagacgttaatgaatcaattggatacaattagtatcatcgaaatgcataaaaggcgccttaattcggagatcgaacagctgacgaagagcctggagcatacaaatactttgctgaacatgtatcaaatcgaaggaagcttgagctgggaagaccttctcaagctcgtcagacagccccggcataaaccatggaaggaatcattctctgaagaggaggctgagattttagcagaaaggcttccgaaggcggagagtgacgatttcatcacaaagcaatggctctctatcatcaagcggattaagctgtgtttaaaacaagaggtgccgcctgaatctgaatggggaaagcaaattgcggaggatatcatatgcctgtctgatcattcgtttaagggacatgaggatttagccgatcgattctgggaggttcgcaagtctgaggagccaaacgggctttatccgcttgacagcgggattatggaatttgcggagagagcgattgaatctgcatttcatgattcaggaggatcagggtga

SEQ ID NO: 1435 - DNA, 381 bp, Bacillus licheniformis
ttaaagaccatgaagtgaaagaactgattaaaaacagccagaacggcgatcaaaaagcaagggacctcctcatagaaaaaaacatgcgtcttgtttggtctgtcgttcagcgttttttgaacagaggctatgagcctgacgacctctttcaaatcggctgcatcggcctcttgaagtcggtggacaaattcgatctttcctatgacgttcggttttccacctacgccgttccgatgattatcggcgagattcagcggtttatcagagatgacggaaccgtcaaagtgagccgctcgctgaaagaactcggcaacaaaatccggcgggcgaaagacgagctttccaagtcaaacggccggattccgaccgttcaggaaatcg

SEQ ID NO: 1436 - DNA, 561 bp, Bacillus licheniformis
atgaatactgctgatgcggcaaatgaactgggggtttcaaccaaaacggtgcagcgttgggtcaagcagctgcaactgcccgcttcccgaaatgagcttggccactactttttcacggaagacgatatcgccattttaaaagaagtaaaagagcagttgaaaaacggtacgcctatgcaggatgtcacggtcaaacgcccgaaaaaaaccttcttcatcaagaaaaacgaaatgattcaaacgaaagagcctgcactgcaattgaatgagcggctcgaagaaaggctgcagcgttttttagagcatgaacagcttgaacgcgagctgctccaaaagaaaatcgccgagctggaaagaaagctggagcaaaaagcggacgaggtcgtctcctaccagcttctgcagcaaaggcgcgaacttgaagaagaacggcagcagatcaagcatctcgagcagaaaatcagccaattggaaagcatgaaccgccgggaaaaagatacagccgtcagaagagaagaaaaaaaaccgaagagcaaattgaaatcgatcttctctttttaa

SEQ ID NO: 1437 - DNA, 729 bp, Bacillus licheniformis
atgctctatacggtaaaagaagtggctcgcttggcgaatatcacgatcaaaacgctgtaccactatcataaaatcggacttttatgccccgcggaggtgacggatgccggctatcgcctttacggggtaaaagagctggaacggctgcagcacatcttgttttatcgggagctcgaatttccgctcaaggcaattaagcaaatactggacggcaaagctgatcgactgacgattttgtctgagcagaaacgtcttttcactgcccgtttggacagaattaaacagcttatttctacgatcgatctctcgattcagcaggccgggaaaggagaagcaatggatcaatcaagcatgttcaaagggttttcaagcagcagggaatgggaggatgcgctcgctgaacaaaaccgctatttgaaggaggcgtatgatgtcgatttgctgaaaggagaaccagtcatagcggaagaaatgaatgaaaaagctgaagaggcggcccgttttatgaatggaatggccgaagcgctcagagacggagtcaaacacgaccatgaacaagtgaagactgcaattaaacggcacctcaagtttttgggaattacgcccgacgattttcagtcccagacacgcttctttatcgaagacgattttcatcgcggaatgcttgaaaatcagcaaacaggcctctcgtattatttggctgctgctgcagaagcatttgcttcataa

SEQ ID NO: 1438 - DNA, 699 bp, Bacillus licheniformis
gatcaaaaaagattcccacattccgatttactatcagattgagaccgaaattaaaaagcttgccgaaacaaaagatttgaaacccggcgacctcattccttctgaaagagagttcgcagaaaaatatgaggtgagcaggatgaccgttcgacaggcggttaacaatctcgtcaatgaaggcattctcgtccggcagcggggaaaagggacatttattgccgagccaaaaattgagcagcctctcaaaggattgacaagcttttccgaggacatgaaatcaaggggcatgaggcccggcacgaaaatgctcggcttcggcgtcatcccgtgcgaccagagcacagcgcgcaaactggagatacgtgaaggggcttccgtctatgaagtcaaacggatccgcctcgccgatgacatcccgatggcttatgaaatctcctatttgcccgccgacttcattaacggcctgaccgaagacattatgagcgcatctttgtacgactatgtcgaaaatacgctctcccttacgatcgaccgggccgcgcaaacactagaaccggcgattgcctctcaggcagagagcgagcctctcgacatagaggaaggcgcaccagtcctgctcattgaacgcttgagctatttggacgacggcagaccgtttgaagtggtcaaatccgtttacagaggcgaccgctataaatt

SEQ ID NO: 1439 - DNA, 726 bp, Bacillus licheniformis
agcaacagcggcaggcgaggtaagggcgcagagaaggaaacgctacgcaggagaaaaagagggtaaacaccagcagacactcggcggaaagagccggggcagcaatagaaccaccagccgcccaacctggggacacggtaggattaggcacgggggacgcaggaggcgggaagaacgcgcagttccccggcgccaaaaaacggagcgcctcaatagcgccgctggccgccggtccgggcgccaaggacacgaaacatcacgtgcacagcatcgtccacagcactgcgggtgactttggaggcacgcctgacttcacagatgcggcagccgtcgtcgaaaaaaaagaaacgaaggaggaaatcgtcaagtcccactatttcaaaaaaagagaaaggctgtggaacggccttactgtggcagccgtcggaatcggggcgccgcttagttcttcaaagatgatcgggaccggattctacggcgatcaggatatcgagcgccttgaagaaaaacatgcagtcggagatatatgctcgcgtttctttgatcgttcgggagctttagtagaaacagagattcatgacagaaccatcgcgatagacatcaacaggttaaaggatttggaatattccataggtcttgccgaatcccatgaaaaagttccttcgattatcggggctgcaaaaggccgctatattaatgttttagtgacaactgccgaaacagcca

SEQ ID NO: 1440 - DNA, 651 bp, Bacillus licheniformis
gttttcgatccaacgtgcagtctcttatcatgatcaagtccatcattatttaaaagatatgattattaaaggaggatatcagcccggcgaacggatctatgaatccaaaatcgccaaggagctgcaagtgagccgcagccccgtcagagaggcgattcggacacttgaacaagaaggcctgttattgatagatgataaatcaaaaattacagtttatgaaccgacaatcaaagatcttgaagaaatataccaatgccgtcaggcgctcgaatccctggccgtttctttggcgactcgccttgcctctaatgaaacactggagctcatttccgaaacgctctctgaggcgcataagcaccagaaaagccaaggtccggagtcggctaatgctctgcttcgcctaaatacgcaatttcatgatgccatcatcgaagcgagcgaaaacgaacgcctgcaaaaacagctgcttgatttacggtcgctgacctttttctaccggagcaaaaaccttgaaaaaccggagcgcactcttgaaatcatcaatcagcacgaggagattctgcgtcacatgcaggacagaaatgacgcaaaagcagccgaatcaatgaggaagcatatagaggcagacctttgctacttaaaagaggtgtt

SEQ ID NO: 1441 - DNA, 486 bp, Bacillus licheniformis
aaagcagatcttaagctccagcagcctccgctatgcagaacaattgaaggctcaaggctttaaaccgaaaatcaaggttgttgatttgcaaaaaataaagccgtccgaaaaactccaaacccgtctcggaatcgacgctgaacaaatggtctatcaagtaaaaagaatccgctatgcagacgatgaagaaatccagtttgaaacagcctatatcagaacggatctcgtacccgaagtaacggaagaaatggcgaatatctcactttaccagtgcatcagcaggcagggaaacaacattaaaagaacagaggagcaaatcaagattgtgatttctgatgaggagattgcacaccatttaaatattacacaaggcacgccttgcttccagatatcgacgcaaacatttttggcgtctgaagaggttgtcgagtattctatggcctattttcgcggtgaccgcgttgagttcttcattgaacgcgatta

SEQ ID NO: 1442 - DNA, 345 bp, Bacillus licheniformis
  misc_feature (1)...(345): n = A,T,C or G
tttttgccggaggttnntcgttgaaacgctacatttgatgaacaagcagtgaaacatnggagaaagctgcgagcgcctttttaacagcgcgaatccgattgccgtagctgccatcagccccttaagtgaaaaaggattcgccatcccgggcagagtcagcatcatcagcatcaacaacatcagtgtagcgaaatacgtatctcccccgctgacgacattccatatcgatattaaagagctntgcacaaacgctattgaattgcttntggaacaaatacttcaaaanagacaagctgtaaaaacgctatatatcggtgccgaactggtgctcaggaaaagcaccaa

SEQ ID NO: 1443 - DNA, 429 bp, Bacillus licheniformis
cgtgctgaaagcgatggaagaactgaattaccacccgaatgaagtagccaggtctctctataaaagggagtccagactgatcggactgctgctgccggatatcacaaacccgttctttcctcagcttgcccgcggcgttgaagatgagatccaccgcctcggctttcggctcatatttggaaacagcgatgaaaatctggaaaaagagcttgattatatgcagacgtttaaacaaaatcatgtggtcggagtcatttcagcgaccaattatccggatgcgccaaattatcaagacttgtccatgccgatcgtctttcttgaccggacgggcgagaatgcgccggctgtatttgcggacagccgcgaaggaggcagaatcgcagcggctgagatgatcaagaggaacgcgaaacggattacgctgattaa

SEQ ID NO: 1444 - DNA, 228 bp, Bacillus licheniformis
tttaggaaaagaaggtacgaaaagattcggagaattaaaagccctgatgcccggcattacgcaaagaatgctggtgaatcagctgcgtgaattggaagaagatcatattgtacatagggaagtatatccggttgttcccccaaaagttgaatattcccttacaaaacagggagaaagtttaatgcctatattagaggcgatgtatgagtggggtaaaaattatataga

SEQ ID NO: 1445 - DNA, 228 bp, Bacillus licheniformis
atgaaatcagataaagtaatagatgctaaaggatttgcgtgcccgatgccaattgtgaaaacaaaaaaagcgatggatgaattgcaatccggagaagtgttagaagtacatgccactgataaaggggcaaaaagcgatctaacagcatgggcgaagtcaggcggtcatgagttgcttaaagatacagaggaagatggtatattaaagttttggcttaaaaaaggttaa

SEQ ID NO: 1446 - DNA, 567 bp, Bacillus licheniformis
atgcttattatgaagaattagatgttccttttctttgtctcgatgacgtgcagtcaagctatctcgcaacaaaagaattaatatcaaaaggacatacacaaattggtctcatttcaaaaatggatgatttacaaggaaagtatcgaatgaaggggtatataaaagcgcttggtgaagccaaattacgattttacccggagcatgtgctttcgtacaatatagagacgaagctggacctatacacagacctgaagaagtttctaaatgaaaaaagagacgtgttgactgcaatcgtctgctacaacgacgaagtagggctggaagtagcaaatgtatgcagacaacttaatatttctatcccggacaaattgtcaattattggtcaggacaattcgtatatcgccaaaaatgcgaatatcaaactaacaacattgacccatcctcaagaacaaatgggacacgatgcagctgattgggtcattaaaaaattacaaggaaagaaggatttaccaaacgaaacctactatcaacctgtgttagttgaaggcgaaaccgtaaaagagttag

SEQ ID NO: 1447 - DNA, 624 bp, Bacillus licheniformis
  misc_feature (1)...(624): n = A,T,C or G
atggggaatacagacacaagagaggaattgctacatatcgcgcttgagctttttgctacgaaaggataccacgcggcaaaaatttcagatatcgtaaaacaggctggcgttgcacagggaaccttttactggcacttcaaaagcaaagaagaaatcgccaaggaaatcataggcagagggaaagataaccttctcgcagccattcatcaaggctacaggcaaacgtttgctcttgccgatgatatgatccaatccacgacagcgcttatgaaaagaatttttacgtttgcacaggagaatagaaacttaatgacatttttattagtcaagggacaaggcgccgatccggaaatcagggaggcaatcgaagaggcgctgatcagtgttgaacaggcatttaanaagaacattcaaagggctacagaacttggaatgctaaattcctcccataacactgatctgcaggccaccatgttaacaagtcttgtgttgggcacactatcaaaatggctttttgggccaaagcatgatctgaattatgttcctaagttttcagttgatgaaatgactgaagaattggttcattttgaatttttcggactgattggccaaagggggaattaa

SEQ ID NO: 1448 - DNA, 375 bp, Bacillus licheniformis
atgaatatgaaattcggcgatcgacttagcgaactcaggaaaatgaggccgaatctttctcaaaaaaaattaggggaacatttaggtcttgcagaaagcacaattagtatgtatgagcaaaatagaagagaaccggaatatgaaattctaattaaaatagctgattatttcgatgtttcaattgactacttacttcgaggcactgatccgaaggttcaagataaaatctttgaagacgaagcaaagaggattctaaatgaccctaaaaccttcatcgcggctcgtgatggagaaattacacaggagattttagatgctgcccttgaaatcattacggagcaactgaaagaaggcgggaaaaagaaatctgactaa

SEQ ID NO: 1449 - DNA, 615 bp, Bacillus licheniformis
atgcctttacagctttatgaaaaagagcaaatactcgatgcctgtttggaggtttttgcccggcatggctatgcaaagacttcgaccggaatgctggcggaagcggccggcatttcaaaggcgctgatttttcatcattttaaaagcaaaaaagatctgtacttaactgtgctcgattattgtattgagaaggtaaagtcgcgcctttcccttgatgacctggcgtcttatgatgatttctttgaagcgaaagaaaaaataagcatggctaagcttgagtttttcgcggattattcaaatgtatacaagctcacgaaagatgccttttattcaccgccttccgaattaaaaaaagaaatcgctgcaaagtatggggagcaatttgccgttagaaatcgtattctaaaacagctttttgcgaaagttccgttgagggaaggagtggatcgtgaagaggcgttcgaacttatcatggtcatgatggggcattttgaacaaaagtttctagcggaagtaacggctgaggacgattttgatccagcctggagcagacgtcttcttgaagaacgaaaacggtttttggatatgattcgtttcggcattgaaggcgaataa

SEQ ID NO: 1450 - DNA, 232 bp, Bacillus licheniformis
ttgaaagttagagaacaaatgatgtatgatatggaagcactgcttcgcacagtatttaaacagatacgtgatgagataaatgagctgctcgaaaaagagatgtcccgcaatgaattcatgattctccgcctgctgagcgagcaaggtccaaagaaagtcacggagtttgcaacgattttaggcgtttcagcaagccatatcacagctgtaaccgatgcatggttgaaaaagg

SEQ ID NO: 1451 - DNA, 606 bp, Bacillus licheniformis
atgactgagcagaaaaaagaccgcagggtaaaacgcacgaaaaaaatgattagagacgcactctctgaactgatgaaaaataaagcgtttgaagagatatccgttacggacattacgaagaaagccgatattaaccgcggcacgttttacttgcactacgaagataaatacgatttgctggaccaaagcgaggaggaaatcatccaagagatcaataaaattgctaaacgctcgattcactcaatggatgtattaaatcaggatgtgattgaccatccgctgacattcgtcgtcgacatttttcaatatataaaagaaaacgaagtttttatgaaggcagttttaggccctaaaggcccgggttctttccgtttaaaattcaaatcggttttgatcagcaatttaaaacggctgaaaacagcgatcagaacggatccgattgtaccggaagactacttgatttcctacataaccggcgctcatatcagcgttatgcagcaatggcttgagaacgggatgaaagagacgccgcatgatatggcgctgattttatcaaaaataaccggaatgggccctgcatatgcggcagggctgagaaaaaaatga

SEQ ID NO: 1452 - DNA, 368 bp, Bacillus licheniformis
ttgaatatcatcatttcaaattcatctgatgaaccgatttatttgcagatcgtcaaccaattaaaagatcaaatcgtcaagggagaactctcagagtcagaggcgctcccgtcgatcagaaacctggccaaagagcttaaaatcagcgtaattacaacaaaaagagcctatgacgagctggagagagaagggtttatcgtcacagtcgcgggaaagggctcgtatgtcgcagccattaacaaggacatgctgcgggaaacaaaagtcaaattaatcgaagaacacatagcagaagccgttactgaagcgaaacaaatcggctttacatacgaagaactccaagagatgctcaaactggtttatgagga

SEQ ID NO: 1453 - DNA, 600 bp, Bacillus licheniformis
atgaacaacatacgtaaatttgtttataaacggaggtcaccgatggaggacagaaggtcaattaaaacaaaaagagcgataaaagaggcttttttaaagctgctccatgagaaagaaatcaataaaattaccgtttccgatttatcgaggcgcgctgatttagggcgcgggactttttatcttcattatcgggatgtttttgatttgtatgaacaaatcgagaatgagttgtttgatcagctggggaaattttacgatgattattttccaagcgaagatccgcaccatctgctcaccttcatcgaaaaaacgactgaatatatttatcaaaacgctgcaatcttcactttattgacgaaaccgaaaggaaacattttgaccatcaataaatttaaagattttttcaagcagaagattttcgaagaattgagcatgatgcagcaatcaggtaatgagatggcatgcgatgaaatggaaattacatttctagtatccggagcggtcggcatttttgaagagtggatcaacggcggcatggttcagacgccggcacatattgcaggcgtcgtccaccgcatcctgttgaaaatcgcgatgtaa

SEQ ID NO: 1454 - DNA, 597 bp, Bacillus licheniformis
atgtcagcacaatctacaagggatcgattaatccaagcggcgcttgcccttttcaaagaaaaaggatatcaagccgcatccaccagagaaattgcccaaaaagcaggcgtcaatcatttgaccctttttagacacttcggaaataaacagaatttatttcgggaaagtgttattcaacatgtgtcatcgggagattttattggagaacttgaaggaatactgagcggcgatttacgacaagacctctcattcattgcgaaagcatatctaaaagaaaacctggaaaaaggtactgtttttttactttactttaatgatgcagtacaggataaggaagtttgcgaattaatcatggatattccccgccgtctcaaccgctttttagaggcttattttgcaaagctctacgccgaaaaaaaaatttcagacggcaactttcaaatgttaagccaaatgtttttcggtttactgaatcaatatattatgtttcaacatttgcccggattcaaggagtcgttcaatgatcggattgatgactatgttgaagagtgcgtcgatttattttacacaaaacttgaaaaggaagtgccgtcttga

SEQ ID NO: 1455 - DNA, 585 bp, Bacillus licheniformis
atgtcaaagcaaacgtccgggaaatatgaaaagattttgcaggcggccattgaagtcatttctgaaaaagggcttgataaggcgtcgatttcagatatcgtgaaaaaggcgggtactgcgcaaggcactttttatctttatttctcatccaaaaatgcgctgattccagcgatcgcggaaaatcttctgacacattctttggaccatattaagagcaaggtcgacggaaccatgtctttctggaccgccttggatatcatgatcgatgagacgttcaacatgacggaacttcatcaggatattatcgttctttgctactcaggtcttgcctttgaccattcgatggaaaaatgggaggcaatctatcagccttattattcctggcttgaaggacttattgaaaaagcagttgagaaaaacgaggtcattccggccattaatgtgcgctggacggcccgaacgattatcaactttgtcgaaaacacagcggaacgttattacatcggggcggaaaacgacgaagagctcagtgtgttcaaaaaagaaatatttacttttctgaagagaagcataggaaccaagtaa

SEQ ID NO: 1456 - DNA, 288 bp, Bacillus licheniformis
attgagcgattctacccgactcttaattctgaaactgcttcaggagaaaccatattgcgtctgccagcttgtcgatatgtttgaaacaagccagcccgcaatcagccagcatttgcgaaagctgaaaagcgcaaatatgatcaaggaacagagaagggaacaatggcgtttttattcgcttcatgacgactttccggaacgcgaattggtccttgccgttctcaatcagatcgatgcacacgacgaggttcttcaaaccgttaaaagaaaagaaagacccgtttcgtg

SEQ ID NO: 1457 - DNA, 268 bp, Bacillus licheniformis
atgaatcaaacctttaaagctctagctgatccgacgagaagaaagattttgaacctgctgaaggaccgggatatgaccgccggtgaaatttccgaccagtttcaaatgtctaaaccaagtatttctcagcatttaaaaattttaaaacaggctgaattaattcaggatgaaaaaaaaggccaatacatcatctactcgctaaacactacaatgtttcaagaaatcatcggctgggctttcagttttactgaacaagccggcaaagata

SEQ ID NO: 1458 - DNA, 573 bp, Bacillus licheniformis
  misc_feature (1)...(573): n = A,T,C or G
atgcaaaaatacggattcaagtcggtgacaataaaggatatcgcgcttcattcaggcgtcagcgagatgacggtctaccgccacttcaaaactaagcttggacttttggaagcggccgttcaacaattttcttatataccagcctttcagcgcgtatttgaaaacgatatcacttggaacctggagaaagacttaacattgattgcagaatcgtatttgcttcatatggaaaaaaacaagccgctctaccttatcgctgttcaagacggcggaaggatgactgatcttttcggttctctgttaaagcatatggaggagctcctttgttatttaacagactactttcggacgatgcangacanaaacctgatgaanaagggagatgcagattcacaggccttcgcttttctgtcatctttatacggatacttctcgtctggcgcattggctggcggncgttttcaaaaagtcgctaaagacacttatattaaacaggataccgccgccttctgcnngcggctngcatgtatgatatcatcccttcaacctgaagatgaatcgttaatcatttaa

SEQ ID NO: 1459 - DNA, 475 bp, Bacillus licheniformis
atgagtttttccgcagaacttcgccgcgaggcagaccctatttttgaagccatttttgagcatccgtttgtactggggctggcgtccgggaggctggaaaaggagcagcttattcattatgtaaagcaagattacgagtatttgaatgcctttattcaaatctacggaattgcgatttccaagtgtcaaaatcgaaaagatatggaaatgtttcatgagcagatttcatttgtgctagacagcgaagtgcacccgcacaaaaacctgtgccgggccgctggggtggagtacgaaactctgcagggctatccgcttgcgccttccgcccatcattatgtccgccatatgctgacggcggcgcacgaaggtacgctgggagagatattagccgtcttgctgccttgtccatggacatattgggagatcggaacaaaactgatgaaggacgttcagcctgatccatcgcatccatttt

SEQ ID NO: 1460 - DNA, 519 bp, Bacillus licheniformis
agtattggaagctgctgcagctctggctgatgaggaaggcattcatgaagtgacgcttgcttcactttccaaaaggctgaatgtcaaatctccgtctctgtacaatcatataaaaggattgaacgacttacggaaggaactcgcactttacggcttgacgattctttatgaaaacatggcttcggctatccagagagccgaagaggatcaggctgtcagccaaatggctcatgcctatctcgcttttgccaaaaacagaccggggctttatgaagcaacttttattgcaatgcccgatgaagatggacggcttgacgaggctggagacagagtcctcgccttggtgctttccgttctgaaagactatcatttagatgatgaagccgcgattcatgcggtcagaggcttgagaagcatcctgcatggatttgccgcactcaggcaacacgatgcgttcggtcttccttatgatgtagaagaaagtcttgatctgacaatccgcgtcttcttaaaaggcat

SEQ ID NO: 1461 - DNA, 201 bp, Bacillus licheniformis
atgctagatccgtcaattgactctttaatgaacaaactggattcaaaatacacgctcgttaccgtatccgcacggcgcgcccgcgaaatgcagatgaacaaagacgcgcagatcgaaaatccgaagtcgcataaatttgtaggcaaagcattggaagaaattgatgccggactgcttacattcgaaaaggaaaatcgctaa

SEQ ID NO: 1462 - DNA, 306 bp, Bacillus licheniformis
cgcaaatgctgaaagggattttagaaggatgtctgcttgccgttatatcagaaggggagatatacggctatgaaatgacaaaggtgcttgcgggatacggtttttcggatatcagcgaaggaagcatctatccgattctcctccgcatgcaaaaggaaaaatgggtggagaccgaactaaaacggtcggcgagcggcccgaagagaaaatattacagacttacaccccttggagaagcggagcttcaatcgttcatcgaccgttggaaagcattatccgggaacgtcaatgcactgctcgaaaaaa

SEQ ID NO: 1463 - DNA, 238 bp, Bacillus licheniformis
atgaaacaagtcactttaaaaggagaaaagatcagaagtgtatcagatcttcacaaagaattaaaagaacagctggagcttcctgactactatggcgaaaatcttgatgcgctgtgggattgtctgaccggctgggtcggcatgcctttgctgatagagtggaagaatgtcgagaaaagccggatttacttgggcgatcaagccgaggcatatttgcagctttttcgcgaagccgaag

SEQ ID NO: 1464 - DNA, 282 bp, Bacillus licheniformis
atttttgttctgattccggcgcaacaactgaaatatagattcgcttgccagaagctttagtatcagaaatggatgttttcgtcatgcaagataacgggagcagaaatgaattgatttaccaagccacaaaaatgtatttacgcgaacgcaaaattcgacaaattcgggaatcgatgagacgcggttatatggagatggccaagatcaatttgaacatctcttctgaggctcaatttgcagagtatgaggctgaaaacacagtagagcgcttagtaagcggag

SEQ ID NO: 1465 - DNA, 519 bp, Bacillus licheniformis
atgattatcagctggcataaagactctatcattcaagcgtacggcgaagaggtcgagccgtttatatgggatatcgtcatcattttccacgggctgatgagggaattcctgtttttagtcggcactggaaaagcgcagcctgacgttaaaacgattccgccattcattatgtcagttctggacctcttcatagagaaaaagctgaacgaagatcagaaaagttcattaaatgaagacattattgcctcctattcgaatttctcatcatgctgggcaccgcccaaaaaagaggaattgcttgaagaccttttgcaaaaactgaaaaccaagatttcttcgctgccacaagacgatgtttccgtgacagaattgctgtctgccgcagatttgctgagcgaggagcttttcgccaatgagccacgcacgtatttaattaaggctctccttgattaccttggaaaaatcgaggccatccaatacgatgtttcacaaatacaaacgattagtataaaagaataa

SEQ ID NO: 1466 - DNA, 168 bp, Bacillus licheniformis
ccttaaaagaagcatgagacggctgaatgaacgggaaaaaatgatcctcagaaaacgcttcttccaaggcaagacgcaaatggaagtcgctgatgagatcggaatctcccaagcccaggtctcaaggctggaaaaagccgccattaaacaaatgaataagaacattca

SEQ ID NO: 1467 - DNA, 174 bp, Bacillus licheniformis
agcgctcgattccgtcgattccgttcgcaatccggatacgatcaaaagctggttttataaaattttggtgcggacggcaatcgattttttgcgcaaacagaaaaaactaaaggttatggatgatcaaacgatcgagtttttaagccagggcaaggaagatacctaccgggatac

SEQ ID NO: 1468 - DNA, 285 bp, Bacillus licheniformis
ttgaaaccggacagccgctgccttctatgcgccaattggcaaaggacatgaatgtcagtcttattacgtcaaagcgcgcttatgaagaactggagaagaatgggttcatttattccgtagtcgggaaaggctcttttgtatcagatcagaatgacgaaataatgaaagaaggaaaaatgaaagccatcgaagagcaattgtcggcagtgataaaaaacagcaaagacataggcgttacccttacagaattaaaagacttgcttaccattttatatcaggaggaag

SEQ ID NO: 1469 - DNA, 384 bp, Bacillus licheniformis
ctataaaagaagttgctgaaaaagtaggtttgcctacacatacactccgatattatgaaaaagaaggtcttctgccttttattaaaagagacgcaaatggaaaccgcatttttgaagaaaaagacttgtcatggttggagcttgtgatatgcttgcggaaaactgacattgcgctttcggaattacgggaaatcgtcaatttaacaaaagaaggagattggaccatctcgaagcgcaaacaaatacttgaaaaacataaagaaaaaatgcttgaaaagcaaagagtcctggaacgcgcctttttaaaaatcgatgagaaaatcatgtactatgatggattagaaaaaaagaatcaggcaatgtccttgaaagcggatgaaaagt

SEQ ID NO: 1470 - DNA, 207 bp, Bacillus licheniformis
ggtagccggagacgatattacacaaggtttgccgcgtatccaggaattgtttgaagcgcgaaaccctaaaggtcaagcgacgatctctgaaattgacggtgtcgtggccgaaatcaatgaggttcgcgataaacagcaggaaatcgtcgttcagggcgaagtcgaaagccgttcatatacggcgccttacaacgcgcgcttgaaagt

SEQ ID NO: 1471 - DNA, 819 bp, Bacillus licheniformis
tcctaaatatttcatagccgagcattctttttcgattcaatatatgcagagaaaaggatttaccgagatgaacgcgccgcatgttcatgaaggctatgaactgtattatctgctgagcggagaacgcacgtattttattaaccaaagcgtctataccgcggaaaaaggcacgatgatcatcatcaatccccacgacctccaccgaacgtcaagcacggaagttcaagagttcgaacgcatcctgattaatttctcgcacgatttcatagaaccattgctgaagtgcagccattatcggcttcttccgtttccggaaaatcaaaacttcatcgcattttccctgcgtgaacaggccgcagtcgaacatatgctgatggagatgaaaaaggagtgcaagctgaaaaaagaaggacacgaggatgtcgtcagggcgctgctgtttcagctgcttttcaccatttaccggagccttgcgggcggcggccgcaatcaaacacggccgcttcacccgatggatgaaaaaatctcggaaatcgcttcatatatcaattgcagctttcaagaaacgatgacgttagacggattggccggacaattttatatcagcccatcctatttaagcagagtgtttaaaaaagtgaccggctttcatcttcaggagtatatccggcacatcaggatccgcgaagcgaaaaaacggcttcgtgatacagacgagaaaatattggacatcgctgcggataccggttttaagcatatcagccatttcaataaagtgtttaaagagatcgtcggcatcccgccgcttcaatacaggaa

SEQ ID NO: 1472 - DNA, 477 bp, Bacillus licheniformis
atgtcaagaacaaatcatattgaaggaaaagggctggtcaacgagctgatacagcagttgaggtttcacagcacagcaaccgtttttctgcaccaggcgatcggcgagaaaatcggactgaacggaacggatcataaatgccttgagatcatctcgcgggaaggtcaagtaacagcgggggagctcgccgcaaaaagcggactgacaacgggagcgatcacaggagtgatcgaccgtcttgagaaagcgggctatgtcagacgcatcagggattcgtccgacagaaggcgtcttttagtcgaactgatcccggaaaatctggagacgatatcacatatatttcatgacttggcgcaagagtctgccgaatttctaagccgatattcagaggaagaactgcaaaccattatcaagtttttgaaaaacagcacggcgtttgccgccgattatgccaaaaccttaaaaaagacgaagtga

SEQ ID NO: 1473 - DNA, 414 bp, Bacillus licheniformis
atattgtccggcagattaaaaaggatacgaaaggcaaagtcaaccttcaaacaggcgagcagacgctgggcggagaagaagccctcgcttatgtaagaacgagaaaagccgatacggacttgaagcgcggcgagcgccagatggaagtcatcaaatcgattatcaacaaatccaaatcgcttacttccattccggcttacgacgatatccttgatacagtcggaaagaacgtatcgatgaacttgtcgctgaatgatgcaatcggactgatcccgtttatgacgtccattcaaacggtcgatacccttcaattgaaagggagcgattatcaaccgggcaaagtctactatttccagcttgatcaggaaaacctcaacgaaattaagcaggaattaaaacagcagttagatgtat

SEQ ID NO: 1474 - DNA, 669 bp, Bacillus licheniformis
agcggctgttttcacttgaaaaagaaattgaatcgtacgtggagcagttaagggaagggtcaattggaaaactgcgtattgcctccaccttcctccccgccaattatttgctgccaagatggctcagccgatttaaacagcaatttccgaaaacggaagttgaaatcacgacaacgaattttcaaaaagcttgtgaacagctgatcaactacgaagcggacattggcctgatcggcgggacaacggaattcggccccttcttaaaaggaacgctgcttttggaagatgacatgttattcgtagtcaatcaaaaacataaattcgcctcaaaacacgtggcattagaggagattgtaaaagaacctttcgtctttcgcgaggaaggaagtttttcgcgggaaaaattgatttcgctgtgcaacctgcataacgcgggaaaaccaaatatgggtgtacaaataaacggattaaacgaaacaatcagaacggttatggaaggatacggtgtaacattcgtatccgctcttgaagtaaacgaatatatcgcccgcggagacatcgcaaaggttcatgttgataaagccgtaataaagaacccgatttcgctatgtgtaaggacggaagaccatctatctccatctgcccttaactttattcaaatgatcgatt

SEQ ID NO: 1475 - DNA, 783 bp, Bacillus licheniformis
atgtatatatgcaaattccaaaccactttccttgcgggaaagtggtttttttatgttcagaatcgaaggaggagccttgaaatgaagttttcagaagaatgccgaaacagcgctgcaacttggtgggaagggagttttgtccatccgtttattcaaggaattggagacggcacacttccggttgaccgatttaaatactatgtcatgcaggattcctactatttgacccactttgccaaagtccaatcctttggagcggcatatgctcacgatctatatacgacaagccggatggccgaacacgcgaaagggacatatgaagccgagatgtcgctccacaggaaattcaccgatctattgggcatcacaaaggaagagctggagtcgtttcagccgtcgccgacagcgtatgcgtacacatcgcatttgtaccgttctgtcgtcagcggcagttttgcggaaatactcgctgctttgcttccttgctattggctctattatgacgtcggcgaaacgctgaaaacgtgcaggcctgacaacgcgatttatcaggaatggatcgcgacatacggaggagactggtttaaaaaatctgtaacggaacagatcaaccgcttcgatgagctggctgaaaacgccgatgagaaaacgcgcgcgaagatgaaggagaatttcgtcatctccagcttctacgaataccggttctgggatatggcctatcaaaaagaaagctggtcaaaaagcggggtggatcagcttgcatctgcacgcgatcaccgatga

SEQ ID NO: 1476 - DNA, 551 bp, Bacillus licheniformis
tcatcaggctgcagccctactgctatgaagaccgccgcctgacgcttcaagcagacaccgaccctgacgctttttccgaccttcagatgatgaatgtccatcctgtcggaaatctggcctcccgtcttcaggaactttccgccttatggccggcatcttcagcgctccaggagctgaaatgccaagcagatctgcagcagcttctgtacgatatctattcggccaaactgactcatcccgaaaacaccgcatcagccataggaaaaacaaaggagtatattgaggagcattcagatgcacacctgacgcttgatcaactcgcgcaaatggccggaatcagcgcgaagcactacagcgaaaggttcaaaaagctgtacggtcaaagcgtgacagagtttatcactgagacgcggatgacgaaagcgaagcagctgatggcaaaagcgagctacaagctgagggaaatttcaagccaaatcggatatcaggatgaattttatttcagcaggacgtttaagaagcatacaggcttatccccgaccgtttataga

SEQ ID NO: 1477 - DNA, 396 bp, Bacillus licheniformis
atgactgttgagacgaaggaccaccagctgctcggttcagtaaaaaatgcgcttcggctgcttcaatcgtttaccttagacacaccggaaaagaaactaaccgaactcgcctcgtcgcttggcctcggaaaaagcacggtctcgcgccttttgtctacattggaaagcgaagggtttgtcatgaaggacccggaatccagaagatacaagctcggcttatcggtcctgcagttaaacaccattgtcaactccactcttgaaatcaaccgcgaatccctgccggtcctcaaacggctgaccgatgagaccggcgaaacgtcgcatatcgcgatgcgccgcggtctcagcgtcgtttatctcaatcggacggaatgcccccgccaggtcgaactctag

SEQ ID NO: 1478 - DNA, 387 bp, Bacillus licheniformis
atgacatcatttccctttccccttctccgcctggtaaaactcatgaaacatcttgaacaatgcgcgcttttcaatccgggacacatcgcagcgcgaaatcccgagctccttcgcgatctcgcgctgcgtttttttcttcaaatcaaggctgaggcgccggcgatgacttctttttctctgccgtcgaggatgtcgttgtattttttgactttttcaggcctgtgcctgagctggatggtgtcgatgacgtcttcgttttctgatcccgaggacatcgatgagactggtttcgtggcggcccataggttactgtttggaattcaggtgaaaagttcagataaaaagagttttacaatagcatgttacataccaaaagcgatttattga

SEQ ID NO: 1479 - DNA, 258 bp, Bacillus licheniformis
tttgcgtcctcatggaagaaaatccaaagactctcctggtttcagttgtaaattttgatgaggctgaggaaaaagcgctcaacctggctttaaataagatcagcggtgactgggatgattacaaacttgaacaggttttggaagacctgcagcacaataattttgatctatcccttacaggcttctcagaaagtgaaatagatgaaatcttgggagagctggctgagcatgaaggcaacgaaggaaaaatcaatgaca

SEQ ID NO: 1480 - DNA, 333 bp, Bacillus licheniformis
gctttttaggcaatggaggaattgctatgaattcagctgtcgatcataaagaatgctcttctttaattcaggatgtattgaaaattttctctggtaaatggtcatttttagttctcgccgaactcattcaaggcaagcggcgattcaacgagctcaaaaggaacttgggaaacgtcaacacaaaaggattaactgacacattaagacatcttgaagaaagcggcatgatttcccggaaggtgttcccaacggttcctgttactgtataatataaattaacacaaaaaggtaaagagttccacatcatttttaaagagatggccgcatgggggg

SEQ ID NO: 1481 - DNA, 315 bp, Bacillus licheniformis
agcagatgaaagagctgtgcttaaaagggataatcaagcctggagataaacttccttctgtcagagagcttgcaaccattatcattgcaaacccgaatacggtcagcaaagcctataaagaacttgaacgggaagggattattgaaacgttgaggggaagaggaacgtatatttcagaaaacgcgaaagttacgcttgatgaagggaagattgcgatgattaaagagcagttaaagcagctgatcatcgatgcgcattacgcggggatcgacaccaaaaagctgcaggagtggatggcggaaatcgacgaagaag

SEQ ID NO: 1482 - DNA, 243 bp, Bacillus licheniformis
gtcctgaaggcatgatttattataggttagaggtgtttattttgaaaatatcaactaaaggcagatacgggctgacgattatgattgagcttgcgaaaaagcatggggaatgcccgacttctttgaaaagtattgctcagacaaacgatttatcggaacattatttggaacagcttgtttcacctttgcggaacgccgggcttgtgaaaagcattcgcggggcctacggcggctacattcttg

SEQ ID NO: 1483 - DNA, 390 bp, Bacillus licheniformis
cccccgcccggtcgaacttctctcatatatcgggcggcaaaacccgatgcactgcacaagctcaggtaaggtgcttctcgcctttgatgaagagggcatattggacgagtatgtgaaggaaggcttgaaaagctgtacgaaagaaaccattacagacggggacaaattgagggatgtgctgaaaaccgttaaagaaaacggatttgacgtcagttgcggggaattcatagatggtgtcacatcaatctcagctcccgtcagaaaccacgcaggtcgagtgttgtacgccgtcagtgtcgtaggccctgcaaaacgcatcaaggcccggcaggcgaaaatcatttaccaagtgaaacaagcggcccgggatatttccgaaaggatcgggta

SEQ ID NO: 1484 - DNA, 271 bp, Bacillus licheniformis
gtgttccaagccgtttccgatccctcccggcgaaaaatgctggagctcctcgccggcaaagaattgcctgtcacagatatcagcagccatttcccgatgagccggacggctgtttcaaagcatctcagagttttgtccgaagcaggcctagtcagcgggagaaaagcgggcagagaaaaactgtacaggcttcatcccgaacctctcgccgagctgcagcagtggctcgcctacttcgacatgtattgggacaataagctttccttgctaa

SEQ ID NO: 1485 - DNA, 124 bp, Bacillus licheniformis
atggcaattataatcaatatcgatgtgatgctggctaaaaggaaaatgagtgtaacagaactttctgagaagggtggaatcacaatggcgaatctttctatattgaaaaatggaaagggcaaag

SEQ ID NO: 1486 - DNA, 188 bp, Bacillus licheniformis
atggttaaccgggtcaaactcgcccggatcgaaaagtctttgacacaagcccagctcgccgagcgggtcaatgtgacaaggcagacgatcgggctgatcgaaaaaaataaatacaatccgacattgcagctctgcatcgcgatcgcaaaggcattagacaaaacgcttgacgatttgttttgggaaga

SEQ ID NO: 1487 - DNA, 186 bp, Bacillus licheniformis
tatcaaataaggtttatgaatatcgtgtacttgccagaatgtctcagcaagaattagcggagaaagtcggggtttccaaacaaaccattttcgtaatggaaaaaggaaattatgttccgactctgctgttggcttttcgaattgctgaattttttaatgttgatgtaaacgaaatttttacttatg

SEQ ID NO: 1488 - DNA, 342 bp, Bacillus licheniformis
atgagggctacggccaggcgctgtgcgtatacacgtctgacacagcaagtggagggcctgtccagttggtatctgtatgatcagtatgaagaaataacccatccttttgttaaagtgataaagtttaaagcgaatatagcgggtgaagaagatgttgatcctgtcgaattcgaagaaatcgacgagcacgatattcttctccacgatgtcgaagaagatttggacattgacgccgatgaattcgatgaaatcgatgaagccgacgatgatgagctggatgatcttgaagacgagatcctggatgatgatgaagattttgatgaagaggaagacgaagagtaa

SEQ ID NO: 1489 - DNA, 266 bp, Bacillus licheniformis
  misc_feature (1)...(266): n = A,T,C or G
ttgcaaaagcaacagggatatacagaacaaccgtcggacgtatgctgaaaaaagcgcgtgaggcaggaatcgttaaaatcacgatcgatgaccatgtcgggacacactatgatttggaacgggagctcgaacagctgctcgggcttaaagaagtgtacatatgngatgcataaccggaacaaacagctgaagacaagaagaaactcgtcggcaaagccggagccgaaatcttaaaacgagtcgtgaaagacggggatacggtaggc

SEQ ID NO: 1490 - DNA, 315 bp, Bacillus licheniformis
atgcaaaagcatttcactgaaagggagttttctttaatacagatggcggatgcgcttcaagtctcgtccgtctatttgagcagaatgatgaagaaggagctcggcgtgacatttgttcagcttttgacggagatgcgcatggatcaagcggttcacctgttagagacaacccctctttcaattcatgacattgccgaacaaacgggctatgatacacagcactatttcagcactgtatttaaaaagacgatgggtgtatcccccaatcagtaccgccgcatgtcgggaattgaaagaacaggaggaaaattgtaa

SEQ ID NO: 1491 - DNA, 312 bp, Bacillus licheniformis
tcaaacaaatggacatacgccacttaacctatttcttggaggtagcccgtctgaaaagcttcacaaaagccgctcagtcattatacatatctcagccgacgatttccaaaatgattaaaaaccttgaagaagagctgggcatcgagctgttttaccggcgcggccggcagatcgagctgactgatgcggggcaaagcatgtatgtgcaggcccaggaaatcaccaagtcatttcaaaatttaacttctgagctgaacgacttgatggacgtcaaaaaagggcatgtgaggatcggtctgccgccgatgatcg

SEQ ID NO: 1492 - DNA, 228 bp, Bacillus licheniformis
accccaaaggagaaaatgtatggcgaaacaaccacagctccacagtcaaattaaacaagatattgtagataagattgaaagcggttattatccgccgggcagcctgttgccgacggagtccgagttttgcaaaatttatgatgtcagccggacgacgctgcggaccgcgctgaatcatttgcttatggaaggggctatttaccgaaagcagggaaaagggacatttgt

SEQ ID NO: 1493 - DNA, 111 bp, Bacillus licheniformis
tgcgaaaatcgacgaagtcgcatatgctccgatttgcttcagtataccgccaatttaaagatattaacgtatttatcgacgagctgaaagatttaataaagaaagaacggt

SEQ ID NO: 1494 - DNA, 306 bp, Bacillus licheniformis
tctttttagttcagtccctcaacctattaaaacctgtgagtggcattaaatcagcctcattgatgccctcaggatcggaaaacgaagacgtcatcgacaccattcagttcaagcacagagcttgaaaagtcaaaaattcattgacatcctggacggcagagaaaaagaagtttattgccggccgctttagccttgatttgaagaaagaaaaaacgcagcgggaaattgcgaaggagctcgggatttcacggagctatgtgtcgcggatagagaagcgggcgctgatgaaggtgtttcacgagtttt

SEQ ID NO: 1495 - DNA, 255 bp, Bacillus licheniformis
atgtccttctcaaataacgcggcaatgcgaaaccccattaacagggatggtttgtatttattcttttcaatggaaatcacagtttgtcttgttacacccaatagatcggcaagctgcttttgcgtccaccctttctctgctcgcagcacaggaatccggttggttaacaccccgctttgcttttcaatctcaatcaccctctttatttgcaaatcatttacatatatagagtacaatgttttttacacattgtaa

SEQ ID NO: 1496 - DNA, 225 bp, Bacillus licheniformis
atgaagcctaaaaaagagctcatccgcgtcgtccgttcgaaggaaggcgaagtttccgttgacccgaccggcaagaagaacggccggggagcctaccttacacttgataaagacgtcattttaactgcaaaaaagagaaacagcttagcaaatcagcttcaagcacagattgatgatcagatttttgatgaactgctggaactggcggaaaaggagaatagataa

SEQ ID NO: 1497 - DNA, 796 bp, Bacillus licheniformis; identical to SEQ ID NO: 1322

SEQ ID NO: 1498 - DNA, 1321 bp, Bacillus licheniformis
atgcacaaatatgtcgcactgatgaacgaattggaggatatgatcgaagacaaatcctttcaggaaggggacaggctgccttccatccgcgcgctggccatacgtttcaaggtaagcaaaagcacggtcatcagggcgttgaacgagctggaaagacggcacctcatctattcagtgccgaaaagcggctattacgtcgtgaaaaaaacgaatcagcggcccaactccggaaaggctgtaatcgatttcgcagcatccgctcctgatccggatgtttttccatacatcgattttcagcattgcatcaataaagccatcgatacatacaaaaacgatctgtttatttatgggacgccgaaaggtctgccgtcgttaatccaagccgttcagaaagagctcgcaaacagccaggtgtttgcaaaagaggaacacatatttattacatcaggcgtccagcaggccctcgccttgctcgcttcaatgccttttccaaaccggaagcggaaagttctgatcgaacagccgagctatcatttattgattaaataccttgaagttcacggcatccccgcggtcggcatcgagagaaccgccgaaggcatcgatatggacgagctggagcgcatctttcaaaccgaagatatcaaatttttttatacgatgccgagattccacaatccgctcgggacatcctacacggaacgggaaaaaacggccatcgtcaagctggcggagaaatatgacgtctatattgccgaggatgattttttaggagatttggagaatgataaaaaggcggatccgttacattactatgacatttcttcccacgttatttatttgaaaagtttctcaaagattatttttccgggtctgcgggtcggagccgccgtgctgcccgattctctgacaattgtgttcaaccggtacaaacagctgctcgacattgacagttccatgctgtctcaggccgctttggagatctatttgaagagcgggatgtttgaaaagcataagcaaaagatccgttcttcctatcaaaaaagatcatgccttctgcatgatctgctaaaagaatgttccgcgtctctaggggatgtgtttgaatttcatcctcccgcacagccggctatccacacccatattgaattggaccggacgatcccggcatcccgtctgattaaaagcctacaaaaacgggacgtcctgctcgaaccggtcaacgctcattatatgccggcttttccaaaaagaaatctattgaaaatcaatacgtccaatgtgaaggaagaggacatccgcagcggcatcgagcggttgc

SEQ ID NO: 1499 - DNA, 1385 bp, Bacillus licheniformis
atggatataaccccttttttaaaccgcagcggcagcgagccgctttatcagcagctgtacacgtttttcaaacgcagcattcattcgggacacataaagcctggaacaaagcttccctccaaacgaatgctttccaaacacttaaatgtcagcctgacaactgtagaacacgcgtatgaacagctggctgcagaaggatatttgctcagcaagcctagaaaaggctggtttgcggctgaagcggaaggagactttgcacagactgcgcctcctccccctgccgaaaaagaactggaagaacatgagacggcggctaacatgatcgattttcaccacggccacgtagacctcgcgtcatttcctgtttcccaatggaaaaaaacgctcgccaaaaccgttggtgaatcagggtacgacctttttcaaagcggcccgccggccggagacattccgctgcggaaaatgattgcggtttacctcagagaatcgcgcggcgtggtctgttcccccgagcaaatcatcatcggagccggcacaccggttttgctgcagttgctgtgccatctgtttcctaaaggcacaaccgtcggatttgaaaatcccggatttcatcgctcaaaaacagtcctgaaaaccggcggcttcaatgtggttccaataccggttgacgaaagcgggatttccgtgcaggatcttgaacaatatcagccgcagctcgcatacaccactccgtcccaccagtttccgctcggaatgatcatgccggtcggccgcaggctgcagttgcttgactgggcagcagcgaccggagcttatatcattgaagacgattatgacggggaattccgctatgcgggacagccgattccttccctgcaagggcttgaccggaacgaccgggtcatctatttagggactttttcaaaatcgctgattccctccctcaggatcagctatatggttctcccctttccgctcgtcaaagaagggcttaacatggcatccttatttaaacaaacggtttcccgccatgtacagcatgccattgctctttttatgaaaaacggggattatcaaaggcacttgaatcgaatgagaacactctaccgaaaaaagcgaaaaacgctccttgatgccatcaagcgtgaatttggcggtcatgccgcagtcagaggagagaacgccggtcttcacatcatccttgaggtgaaaagcgccccgagtgaagagtggctgacccaaaaagcgctggaaaaaggggttaaagtatatccagcctcagtctcgtatatgcccccccctgatacacacgcggtcctcctcgggtttggcggactttctgaaaaaagcatcgcagacggcatcaaaaagctgaagactgcatg

SEQ ID NO: 1500 - DNA, 845 bp, Bacillus licheniformis
atgatcacaataccgattgaccgctccaagggcgcggaatatatttatcaccaaatctatcaacggattaaagaagaaattttcagccgcaaccttttgccggggaaaaagctcccatccaagcgagagctcgccgaaacattgaacgtcagcatcaattcggtcaacgccgcctaccagcagcttctggcagaaggttatctttattcgcgtgaaagaaaaggcttttttgtagagcagatcgaaacgttccacgccagccgtcaccccggtccccttcaattggaaaaagaactggttgaagagcctgaaagcaaagacggctggatctcgttttcccatatgagcgtcgatacggcgcattttccgtttaaaacatggcttcgctgcgaacagaaagcggtttcttcacatgttgacgaactcggagaaatgacgcacccgcaaggcgtctacgaagtgcgccaaacgatcgcacgctttatcgctttaacgagaggcgtcaaatgtctccccgaacaaatcgtgatcagcgcagggacgcagtccttaattcacacgctccaggaccttctccccgcctcagccgtctatgcgatggaggagccgggatacagccgcatttatcgactgctgaaaaatgaaggaaaagaagtcgccacgattcagctcgaccataaaggaatgcggatcagcgagattcaccgtctgaatccggacgttttatttgtcacgccttcacaccagtttccaacaggaatcattatgccggtatcgaggaggattcagcttttaaactgggtttccgacggggcaaaccgctatattgtgtaagacgattatga

SEQ ID NO: 1501 - DNA, 708 bp, Bacillus licheniformis
tgaacaaagaggtgtccgctgtgcacctgagcaaattgtgatctgttccggtacgcagtatgcagtcggacttctttgccagctgctctcaatgaacggccgattggttgcgttggaaaatccgggatatgatggtgtgcgttctgttttccttaaccatggatgtgatattcagccaattggtctggagacggatgggatcaatttgacacagcttgctgcaacacgggcgaaactcgtttatattacgccatcgcatcagtttccgtatggaatggttctgccgatacagaagaggctgaaattgcttgaatgggcaagccgtgagaaggcctatattatcgaagacgactatgacagcgaattccgctatcagggcaggcctattccatctttaaaagcgcttgataaaaaagaaaatgtcatttatttagggactttttcaaagtcatttcttccgggagcgagattgagttatatcgttctgccttcaaaactggcggatgaatttcaagagaagcttggccgctacagccagtctgcttcacccatcattcaaaaagcgatgtttttatttaggaaagaagggtttttcgaaaggcacatccgtaaaatgaaaaaagtatatcaagaaaagcacaaaacattaatatcggccattaaaacgcatttcggaaatgacgtggaatcatcggcgaaaaagcgggg

SEQ ID NO: 1502 - DNA, 741 bp, Bacillus licheniformis
aattttgcgggcttcccatggatgccggaggattagacccgtccgtcattccggcggtaaaaaaacggcatggcgccgatttgttgtacacgattccgtcatttcacaatccgacgggcaaactgatgtccgaagaccggaagcgcgagctgattcaaatcagcaagcagctgtcgctcccggttattgaagatgacgcatatggcgatttgcagcttgacggcccgccgtcgtcgccgctgaaggccatggacagagaaggcagcattctttatgtcggcacattatcgaaaaccgtcagtcccggcctccgcatcggctgggtcgcaggtccggagcccgtcatcgagaggctggccgatattaaaatgcagactgactacggatcaagttcattgtcgcaatgggcggctgcaaagtggctttcaagcgggctctatgatgaaaatctcagccggattaaagtcgaactgagacaaaggcgggatgaagcgctccggtgtcttgagacctattgcagaggaatcgcccgctgggaaaagccctcaggcggattttacatttgggtcacattcctaaaaccgctctcgctcagcgctttgttcgaacaagcattacagaaaaacatcctcatcaatcccggcaccctctacgataaggaagccaaatacagcatcagattgtcctattcgtacgcctctttgacagagcttcgctacggcattcaaacaatcgcagaac

SEQ ID NO: 1503 - DNA, 752 bp, Bacillus licheniformis
atgaagttaatgcggattaaagaaatggaagattatattttgaccaatggcaccgtttcgcttgatgaactatgccaggtctttaatgtttcaaaaaacacggtcagacgcgacattaacaagctgaccgagaaaggagttataaaaaaagtctacggcggcgtaacagcgatcgaaaaaacggccttgatcccttttgaaaacagaaccattcaaaacaaggatgccaagacaaaaatcgcgcgctatgcttcacgctttattgaagaccatgacctgatttttattgattccggcacaacgacccgatccatattggaaactcttgatccaaataaaaatgtaaccgttttaacgaacagcctcgacattatcaacgctgctgcagcgatgcaaaatataaacttgatcatcatcggcagcaactacaaacggaaaacgcagtccttcgtcggcatggatgatccgggaacgctggataaatataatattaataaagctttcatgtcggcaaccggcgcaacacttacccatggactgacaaactccgatctgcttgaatatgaaattaaaaagaaaatatccgaaaaagcaaaacaagtatatttgctggccgaccattccaaattcgggaagtcgaccctgctgacgtacgcgccgtttgacagattgcacgcgatcgtcacatctcaggcgcttgatgaggaatatcacgtgtactgtaaagatcgcaaaattgaaatccatttggc

SEQ ID NO: 1504 - DNA, 767 bp, Bacillus licheniformis
gtgtaccaagaggaaaggctaatttccatcatcgactatttaaaagagcataaacggatttcccgttgaacaaatttgttctttattcggagtttcaagagatacggcaagggcgggatctggttaaactgcaagagcaaggcgccattatcaggacaaggggccggggcgattctgcccaccgttcatgatgaggtcaaagactattcgggcaggctgggcatggtttccgaagaaaaaagcatgatcggaaaagcagccgcttctttaatcagagaaggcgaccgcattattttggacgcttccacgacagtccaatcatgcgcagagcatttgccggatgtcaattgcacgatcatcaccaattcgattaaccttgcggacgttctttcctcaagaaaaggggctgacatccgcctgcttggaggaaagcttcaaaaagagcaccggtttttgtacggcgcctctgtcattgaaaagctgtcatgctatcatgttgataaagcgctgatcggcgtggtgggggtttctgaacatgggcttacaatcgcccatgaggaggacggaatggtgaagcggaaaatgatttcccaagcgaagcaagtcatagcgcttgccgaccattcgaaaatcgggagaacggatttttaccgatacgctgaactcagtgacattgaccttctcattacagaccggctgccgtcgaaaccgtttcagaagctgcttgatgaacacgatgtggagctgcttgtggctgaacatcacga

SEQ ID NO: 1505 - DNA, 573 bp, Bacillus licheniformis
atgctaccgattaaaagaagggagcagattttggcttggatcaaagaagaagaatctctgcgcatttcggaaatttcgaaaaggctgaacgtctctgaaatgaccgtttaccgcgacattaaaccgctcgttgaaaacgggcaggtcatcaagaccgcaggcggaattacgctaaacaagccgaagcagcagcttgggcagctttgcgtcgtttgcggaaaaggggcaggttcgaggcttgccgtgcaaattgtcaaaaacgacagccaaattgaacagttttgctgcgtgcattgcgcaatgctccgctatgagaaagtgaaagatgatgtatcacagattatctgcagggattttttgctggatacgacgatcagcgccaaagctgccgtctttttgctggatacagatcttcatttgaactgctgcgagccgcatgcgctccctttcgcttctgaagcagaagcgcggaaattcaaaaaaggctttggcggacagctgttatcgtttgacgatgccgcgcttctggtccagaaaacgatgaagaacagctgctgcagcctgaagacatga

SEQ ID NO: 1506 - DNA, 220 bp, Bacillus licheniformis
ttgaaaccttcaacaaaccgaatgctaaccaggatcaaatcagtctacatgttcattcaagaaaagggactcgttacaacccaggaactggttgatgaatttggcactacaccgagaacaatccagcgtgatctgaatgtgttggcatacaacgatctagtacacagccccagcagaggcaaatgggagactacaagaaaaaaagtgaaaatctcctcat

SEQ ID NO: 1507 - DNA, 297 bp, Bacillus licheniformis
cctagtaggcggttcggcttttacgcctcagccataccggtttgacaaaagcttcatcggcgtcaacggcattcataaggaagcggggttcacgactccggatcctgaagaagcgcttttgaaaacaaaagctgtcaaccaggcgaaaaaagcatttattttagctgacgtttccaagtttggggaaatttcattttctgcctttgccggtttagacgaagcaactatcattacagcaggatctgcaaaacattcatttgataactatcaagaaaaaactgtcgtaaaggtagtgaa

SEQ ID NO: 1508 - DNA, 2753 bp, Bacillus licheniformis
atggcgagtcttaaggaaatcgtaatacatgtcgaacagtcagaagactatacatttattttatcttgtcatgacggggatcatcagtttcttacgcgaaatgaaatggaaaggcatttgtttcagtggcacgaatcgtctttttacggaacatttctcgaggaagccggtttagatacccctgcggttctgctgtccccgtggatggcggtcgaatttctcggcaaaaactcatttaattcattcagcgacatcatccttactgaggaaactgaacctttgatgaaaacggcttccaccatttatgagtttatcgcagatgaagactttcttcccgactatgaagcatggaagcaggaaatgctgcgctggaaagataaagaagggattttggaaggctatacagccgaatggttttcacacgctgtcgaagactacatcaactacaatgacgaattaaaagcaaaatgggaatcgattgtcgcacattcccccgcagtcaccacatttcagggacattttcttgatgaagacgattttcttgaaacgattggctggcatgaaaaccctgtgccgtttaccgtcggactccgcttaaatgaacctgactttgacggagacgattggaaaatcgaactgtttttgcgcgacaaaaaaagcggagccattcagttctttgaaggcttgaacaggctgaaaaaatcgtggcaggcatacgctgataaaatcgaccgagaacaagacaggttccgccaaatcgtgccctggctgacgatcgaatcggggacgtcgcttttaacggaagaggaagcatggatcttcctgtccgaagctagcgaaacacttgtcagcatggggattgaaattctgctgccgtcatggtggcaaatcgtgagagacagcaatatgctgctgaaagcaaaagtgtcatcggctccccgcggcgagtcttttgtcggaatgaatgcattgatggacttcaactggcgttttgccaccaatggaattgaactcacagaggaagaattcgagcagcttgtcgccaataaaagacggcttgtcaatatacgcgggcagtggatcaaaatcgacccgaattttatcaaacaaatgaaaaagctgatggagcgggcagaaacagaggggcttcatatgtctgacatcctggcgcgcgagctgacagagcggagcgaaacccgcgaggatgatgatctgttcgatgcttccgcattcagcgatgtacggtttgaactgtcctatcagctgaaaaacatgatcagaaagctgagccagcgcgatgatctcccgtcatacccggtcagcaaatattttcacgggacgctcagagcttatcaggaagacggtttgaactggctgatctttctcagaaactgcggcttcggcgcctgcctggcagatgatatggggctcggaaagaccattcagatgatcgcctatttcgcctatttaaaagaacagggacaacaaacgccgtctcttatcattgcgccgacttccgtcctcgggaactggcagcgcgaactcgagaccttcgcgcccggcctgacggcagcgctccactacgggccaaaacgccctaaaggtgaagcgtttcagacatcttacaaagatgcggatatcgtcttgacgtcatacggcctcgcccaatccgactttgacgatctcagcagcgtcgcctggaactgcatctgccttgacgaggcccaaaacattaaaaatgcgcacacgaaacaatcccgttcaatcagaaagctgaaaggactgcatcatatcgcgctcagcgggactccgatggaaaaccgcctgacggagctgtggtcaatctacgatttcatgaacaaaggctatctcggaagccttggcagcttccataagcgttttgtcctgccaatcgaaaaagaccgcgacgaaaaacggatcgaacagcttcagcagctgatcaaaccgtttttattaagacggacaaagcaggacaaagaagtcgcgctcaatctgcctgagaaacaggaggaaaaagagttcgttccgctctccgcagaacaggcttcactatatgaacagcttgtcaaagatacgtttgaacatatgtcaagcctcgccggaatgcagcgcaaagctctaatcttaagcatgctcggcaagctcaaacaaatctgcggccaccctgccctttacttaaaagagaccgggagcgagctccttaacggaaggtcagtcaagctcgaaaaactgctggagctgacgaagacgattcgcgaaagcgatgaaagctgcttgattttcacccaatatctcgggatgggagatatgatgaagcgcctgctcgagaagtcattcggcgaaccggtcaagtttctgaacggcagcttatccaagcttgaacgggacaaaatggtggagcagtttcaaaacaaggaatttccgattttgatcttatcattaaaagccgggggcacaggcctcaatttgacggccgccaatcacgtcatccattatgacagatggtggaatcccgcggttgaaaatcaagcgacagaccgcgcctacagaattggacagaaacggttcgtccacgttcataaactgatcaccaccggcacaattgaagaaaaaatcgaccaaatgctcgaatcgaagcaatcgctgaacgatcaaatcatccaaagcgaaaattggatcaccgagctttctgagcatgaacttgaggagttatttaccctgaacgcttcggc

SEQ ID NO: 1509 - DNA, 1639 bp, Bacillus licheniformis
atgagaccagacattcatttcgacaacgaatggccggaacagttcaaaaagcatcttgatgaagacggcccgtgggcgaattgggagctttaccagctttcctgtgaagtgcagaaaaggcttgcgattccgacgtttgaaggcttgcaggccccataccacctccccggcttcacaccgcttccccaccagctcgaagtcgcccggaaggtggtcgaacagatgaacggaaaagccatcttggcggatgaagtgggcctcggcaaaacagtcgaggcggggctgatattaaaagaatacatgattcgcgggctggccaagaaaatattaatccttgtccccgcctcgctcgtctcgcaatgggtaaaggaacttcgggaaaagtttttaattccggccgttgaacagaaaaaaagctatgtatgggagcaatgcgatgttgtcgtctcctcccttgacacggcaaagcggtcgccgcacagagagacggttttgtcgatccagtacgatgtggtgattattgatgaagctcacaaactgaaaaacaataaaacaaaaaattacgagtttgtccgcagcttaaagaaaaaatactgtctgatgctgacggcgacgccgatccaaaacaagatcgacgaaatatttaatctcgtctccctgctaaaacccggacacttgggaaatgaaagcaacttcaacaaagattatacaaaacagatcaattcagctgaagcacacgagcgcttgaagtcccttatcaataaagtcatgatcagaaacaggcggcatgataccggcatcacctggacaaagcgtcatgtcgaaaccgtgcctattttcttttcgcctacagaacaggctttgtgtgacgagattaaaaagctgaagacaaatcatcagcattcatcaagcatgttctcaatcatgacattggagcgcgaatgctgttcaagcagggaggctgtctatatgacgctgaaaaacatgcttgaccgaaaggaccgcgaagcgccggtaatctctgaacctgtcatccaccatttgatcgaaaaggtcaacgaggtcgcacaaaattcaaaagcgctgaaagtcggtgaactcattcaagaactcgatgacaaagtcattatctttaccgaatacagggcgacgcaaatttatctgcaatggttcctccagcagaacggcatcagttccgtaccgttcagaggcggatttaaaagaggaaagaaagactggatgaaagatttgttcaggggcaaagtgcaagttctgatcgcgactgaagcaggcggcgaaggaatcaaccttcaattttgcaataaaatcatcaactatgaccttccgtggaacccgatgcgcctcgaacaaagaatcggcaggattcaccggctcggccaggaacgcgatgtctacatttacaatatggcaacaaagcataccgtagaagaacatattttaaagcttctttatgaaaagattcatttgttcgaaaaagtcgtcggagacttggatgatattttaacaaaaatcgaggtcggcaattttgaagagcacctccacgatattcttttttactctgcgacagacgaggaaatgaaaatcaaaatggaaaacttaacctctttcatctcttacg

SEQ ID NO: 1510 - DNA, 405 bp, Bacillus licheniformis
tctgcgcgaccatataggcggagccatgcagatcatcgaaggtgcgaacgggcagaaatcctcgcggcaggcagatgatgttcacatcgccgtagagcatgacaggtcctgccaaatcgtgcgagtccgcacgatagtattggggcagtcgcttttgtcggaagaggtagcagggatcttcctgtcagaagctggggtagcacttgtcgccatggggatggtcattgtgctgccgtcaggggggcagcttgagggagacggcggtatgatggcgaaggcaaatgagtcatcggctcccggcggggagtccatggtggggattaatgcattcatggacttcatcagggatttgctcgccaaagtagttggctcttccgaggaggagttcgagcagctcgtcgtctc

SEQ ID NO: 1511 - DNA, 265 bp, Bacillus licheniformis
atgaagatcaaccaatatggaacacaacctgttaatccttatcataaatcatttgaaaaacaaacagcttcttcacagggagcagcccagccggaagacaaagttgagatttccgcgaaagcaaaggagctgcaaaaaggccctgatttaatgaaggagcgtcaggagaaaattgcccagctgaaagcagccgtggagaatggaacgtacaaagttgacggcaaaggcatagctgaaaaaatggtcaatttttataaacagcaat

SEQ ID NO: 1512 - DNA, 894 bp, Bacillus licheniformis
ctacaacattaaaattcagaaagttcaatcgattctatacaaatgtgctcggttttctgaatgaacatatttatgacagccctttttcattgacggaaacccggatattatttgaaattcacaatacggccgattgtacagccaaactgattcaagatacgctcggcctggaccggggctatgtcagccggatcctgaagcggtttgaaaaagaaaatatggtctataaaaagagaagcgaggaggacagccgcaaccactatatctacttaaccagcttcggtgaatccatttataaaaagctggaggccaaagccaatcaacaaatcgaaaacatgctgaagcatatcgacggccgccatcaggaaaagctgacggaggcaatgaatacaattgaatgcatattgtcggaacacctgcctcccgaaaaatcggccgtttctataagagattactatatatcggacgatatcaaactgatgatcgaaaaacagcgtgccttctacgcggagacacacggctgggacgattcatttttggattaccttcacgaaacattcgacgccgagatcgaaaaaatctggatcgcagagagcgccggaagattcgcgggatgtgtcgggctcgtcaaacaccccggcaggaccgtgcagctcagatggtttctggtcgacgccgcttttcggcaccagggagtcggcacacgcctcttggagcatctcatcgattattgcaaagaaaatcagtatgagcggatttttttatggacggtaagcacgatggccgaagcacggcctttgtatgaaaaattcggattcagactgacggaagtgaaagacgagactttattatgggggcagcggctccgggaagaacgctgggatgccgagttag

SEQ ID NO: 1513 - DNA, 519 bp, Bacillus licheniformis
atgacagtaaatataaaaaggtgtacccttgaagacttacacaagcttcaggaaattggttatgaaacatttaatgagacatttaagcatcagaattcgccagaaaatatgaaagcctacttggacaaggcatttaacttaaaacaattagaaaaagaattatccaatagctcttcgcaattcttttttgtttattttaacaacgaaatcgctggatatttaaaggtcaacaccgatgaggcccagtctgaaaaaatgggtgatgaatcacttgaaatcgagagaatttatatcaagaacaactttcaaaaacacggcctgggcaaatatctgttcaataaagctgtggaaattgcaaaggaactgaataaaaagaaaatctggctgggcgtatgggaaaaaaacgaaaatgcgattgctttttataagaaaatggggtttgtacaaaccggcgcccactctttttatatgggagatgaagagcaaacggactttatcatggccaaaacaatcctataa

SEQ ID NO: 1514 - DNA, 747 bp, Bacillus licheniformis
ttcaaacacagaagaccgttatttaatgctgacatgcagcaaaaaaattgaatcccattatcatatatacacagatgaggagatcccgcagatgttttcctctcattttctgcagctgcaggacgattttccgctgacagagctgtactccctgctcgttcggacacccgaaattttaaaacgaaattatgttcatgtgaaaagctcttataagcgggatctgccttttacgatgaaaaagtcgctctttgatcttggctatattcttgatgaagaattgttttattccatcaggcttgcagattggaaaggagattcccctggtgtacgggcagagtgggggacggagaaatcgctcattgacggctgccgcatgatgcaggcttatgatacattgtctatcaatgaagcgtttgcgaaggaaaagctgctgcgcaagtatcctttttatgaggaaggcatcattcagctgtgtgtctgctactcggaagaaggcgaaccgattggatgtgctgagctttatctcgatcacgacgaaaacgttgctaaaatcgaagaagtcgccattttggagccataccagcggaaaggctatggatcgggccttatcaagcagatgctcaccgccgccaaacaatcgggcatggaatcgtgctatcttgtaacttcgggaagcgatcaggtgaaaacgttttatgaaaagctgggctttcagcagaaggaaaagctcacgacaatatttaaata

SEQ ID NO: 1515 - DNA, 415 bp, Bacillus licheniformis
gtggaagccgtcattgtgaagaatcaacaacagcttgaagacgccttctttgttagaaaggaagtctttatcaaggagcagcacgtatcaccggaagaagaaatggatcatcttgatcaggaatcttcacatctcgtcatctatgacgaaaaagagccgatcggcgctggccggctccggcttgtcgacggctacggcaaacttgaacgaatctgtgtgctgaaaagccaccgctccctcggcgtcggcaacctgatcattcaggcgcttgaagaggaagccgccaagcaaggcgcgtctcaatttatgctgaacgcgcagacacaggctgttcccttttacgaaaaacacggctataaagtcgtgtctgaagaattttcagatgcgaatattccccatgtcaaaatggtcaaaa

SEQ ID NO: 1516 - DNA, 506 bp, Bacillus licheniformis
atgattttaataagaaaagccaaagtgtcagacgctaattcaattgccaaagttcatgtggaaagttggaaaaccacatatcaaggagtattgcctgatgacacgttatctaagctttctgtcgaaaatcaggcaaagctttggagaacttcattaagtgatcctaaaaatcaagatattgtctatgttgcagaagaaaccgacggtaaaattataggctttgcttccggaggtccaaaccgcgatcatcttagcaaatataagggtgaagtttccgcgatttatctgttgttacagtatcagaaaaaaggaatcggatctcgactaatgaaggcgattgtagaggagcttgtaaagaaaaacataaaatcattattggtatgggttttagccggtaatccatcgataaatttttatgaaaagctaggtggaaggcagagcacaacaaaacaaatacaattcggtgaagattatttcaaagctattgctatcggctggacggatat

SEQ ID NO: 1517 - DNA, 480 bp, Bacillus licheniformis
aatgaaaaaaacgcctttcatctcgatgcttcatcgtgatgaaaaggcgttttattatggtctgggggaaaaagaaatgaaactcgtatcaacgcacgccttgtcaaaagcggacgttaccgcgttttttcatacacattggggaagtccggaaatggtcaattcacacggaacattccgctgcgatgaattggaaggattcgctgtaacagatgaaaaaagcgacattaaaggcttgattacgtacttcatcgctggaaacgaatgtgaagtcgtctctttggacagtgttgtcgaaaacaaagggatcggctcactccttttacaagaagtggagcgtgtttcaaagcgaaaacagtgtaaatcgattaaactgatcacgacgaacgataatatgcgggcgcttatgttttatcaaaagaggggctatactttggccgagttgtatgtaaacgcagttgacaaagcaagaaaagtaaa

SEQ ID NO: 1518 - DNA, 351 bp, Bacillus licheniformis
ccatttggatgaaacgtcttttttggagctcgtcaaagaagctcgggaggctgaaagctacacgttatttgcgctgtacgacggtgatattccggtggctttggccggctttttgccgagggtttctttgaaccaaggccgtcatgtttgggtagcggacctggtgacgtgtgaaaaacaccgttcaaaaggctatggaaagaagcttttaggcgctgttgaagagtgggccaaagggaacggattggcttcaatcgctttatcatcaggcttgcagcgggcagacgctcaccgtttttacgaagagaaaatggggtatgaaaaagcgagctacctatttcgcaaggctct

SEQ ID NO: 1519 - DNA, 552 bp, Bacillus licheniformis
atggaaactgtgaatgagcttgtcgaacgaatcaggacgaaagacggcggtgaagctgtcatccgtcccgtcaaaatggcggatgcccctgacatcatcgaggcggtgaaagatgtgattcaaacgggcgtttacatccaaaaagaacggccgcgcacacttgaggaagagcgtgcatttatcagcgatatgatgaaaaaagacaacatgtatgcggcggttgaaatcgatggtacggtgtacggaattgcccgggtcatacgcggcgaactcaaaatgaagcggcacacgggtctgttcagaacttggctccacagcaaggcgcaggggcttgggatcggcagggaaatcatgtcctacaccctgaaatggtgcaggctgcatcgcctgcataagctctgcttgaccgttttttccgaaaatgaagcagcgctgtcgctctataagaaaagcggctttatcgttgaaggggttcaaaaggaacaggttttgtcggacgggaaatatgaagatgaagtgctgatggcctattttttcaacgggtccacataa

SEQ ID NO: 1520 - DNA, 483 bp, Bacillus licheniformis
actggcaaggcttgaaacgaagggattgatcagaagggatccgacgaagccgagagcgatcgaaattctcgatacagaggaggaaattcatattccgaaaaaccaggttgtcaatgtcccggtcatcggaaaggtgaccgccggtacaccgattaccgcagtcgaaaacatcgaggaatactttccgcttcccgaacgcctggcgccgccggatgagcacgtcttcatgctggagatcatgggagaaagcatgatcgatgccggaattcttgatcaagattatgtgattgtcaagcagcagaacaccgcaaacaacggggatatcgtcgttgcgatgaccgaagacgacgaagcgactgttaagcggtttttcaaggaggaaacccatatccgccttcagccggaaaacccgacgatggagccgatcatccttcagaatgtgacgattctcggaaaagtcatcggcgtttttcgcactgttca

SEQ ID NO: 1521 - DNA, 191 bp, Bacillus licheniformis
atgaaaaggctatttcgatccgaaacagacagaaagattgccggggtcgtcggaggtcttgctgaatatttaaatatggatgcgtcattgctgagaatcattacggttctattatttatattttcgaccggagttcccgtcctgctgatttatattgtctgggtattccttgtgccgaatgaaggagacgt

SEQ ID NO: 1522 - DNA, 4308 bp, Bacillus licheniformis
agaccagctttctgtcaacagaagacagtttcaaattcttctgcagcagctgaatgtaacggaagatacgatgatccgccaccttgaaggcggacaaatcataaagctgaccgttcataaaaacaagaagacatggcactttcactttaaattgagaaatgtgctgccttatcaaatcttcgaacggtttcacagccagctgacccgcaccttttcccatatcgcccaggtcacctgttccatcgaggcggaaaacccttcgattgacgagcagcttgttcaggattactggacgcgctgcattcaggaactcgatggtatttctccgccgatcttggcgcttttgaacgaccaaaagcccaagcttacgggaaacaaaatcctgcttaaaacgaaaacagatacagaagcgtccgctttaaaaaagaaatacagctcgctcatccagtcaagctaccgcacattcggctttcctgagctccagctggacacagaaatttttgtatcagatcaagagattcagaaattcagagagcaaaaaatggccgaagatcaagagagggcccttcaggctttaatcgaaatggagaagcaggataaggaagcacaagacgatgaagcgccggcaggccctcttcagatcggctaccagattaaagactctgaagaaatcagaacgcttgacagcatcatggatgaagagcggagaattacggtgcaaggctatgtattcgacgctgaaacaagagagctgaaaagcggcagaacgctttgcatctttaaaataaccgactatacaaacagcattcttgtcaaaatgttcgcccgcgaaaaagaagacgctgtattgatgaagtccctgaaaaaagggatgtgggtcaaggcgagaggaagcatacaaaacgatacattcgtccgcgatttggtgatgatcgccaacgatgtcaatgaaatcaaagcgaaaacccgtgaggatacagcgccagaggacgaaaaacgagtcgagctccacctccattcaccaatgagccagatggatgccgtatcaagcatcggcaagcttgtcgaacaggcgaaaaaatgggggcacccggctatcgcgctcactgaccatgccgtagtccaatcgtttccggatgcattcgcggcaagcaaaaagcatggcgtgaaaatgatctacggacttgaagccaacctcgtcgacgacggcgtgccgattgcctacaatcccgtgcaccgtctgcttgaagaggaaacatatgtcgtgttcgacgtcgagacgacggggctgtctgccgtctatgatacaatcatcgagctggccgccgttaaagtaaaaggcggggaaatcatcgaacgctttgaaaggtttgccaacccgcatcgacctttatcggctacgatcatcgagctgacggggattaccgatgatatgctgaaagatgcgcccgaagtcgaagaggtcatccgcgattttaaagaatgggtcggtgatcacacgcttgtcgctcacaatgcaagctttgacatcggcttcatcaatgtcgcctataagcgcctgctgaattcggagaaagtgcagaacccggtcattgacacgcttgagctgggccgttttctttatccggaattcaaaaaccacaggctgaatacgctttgtaaaaagtttgacatcgagctcacccagcatcacagggcgatttatgataccgaagcgacgggttatctccttgtgaaaatgctgaaagatgcggccgaaaaaaatatcctgtaccacgatcagctgaatgaaaatatggggcagtccaatgcctatcagcgttcaaggccatatcacgcgacacttttggcggttaatgagacaggcttgaaaaaccttttcaaacttgtttcgctgtcgcatatccattatttttacagggtgccgaggatcccaaggtcacagcttgaaaagtacagagaagggcttttaatcggttcggcgtgcgacaaaggcgaagtatttgaaggcatgatgcagaaatcgccggaagaagttgaagacatcgcttcattttatgactaccttgaagtcatgccgcctgaagtctaccggcacctgcttcagctcgaactcgtcagggatgaaaaagcgttaaaagaaatcatcgccaacatcacaaagctcggcgagaagctgaatatcccagtagtagcaactggaaatgtccattatctgaaccctgaggacaaaatttaccggaagattctagtttcctcgcaaggcggcgcaaatccgctcaacaggcacgagctgccgaacgttcatttccgttcgacggatgaaatgcttgaggccttttcatttttgggtgaggaaaaagcgaaagaaatcgttgtcaagaacacccgcatgatcagcgagcgaatcgaagaaatcaagccgatcaaagacgatctttacacaccgaagatcgaaggcgcagatgacgaaatccgccgcatgagctatgagaaagcaagaagcatttacggcgaggacctgcccgaaatcgtcgaaaaacggatcgaaaaagagctgaaaagcataatcggccacggattcgccgtcatctatctgatctctcataagcttgtaaaacgctcccttgatgacggctatctcgtcggttcgaggggatcggtcggttcttcccttgtcgcaacattgacggaaattaccgaggtcaacccgctgccaccgcattacgtctgtccggattgccgccattccgagtttttcaacgacggatcggtcggttcgggatttgatttgcctgacaaagactgtccgaagtgcggagcggcctacagaaaagacggccacgacattccgtttgagacgttcctggggtttaaaggggacaaggttcctgatatcgacttgaacttctcgggcgaataccagccgcatgcccacaactatacgaaagtcctgttcggagaggataacgtctaccgtgcgggaacgatcggaacagtcgccgaaaaaacggcttacgggtatgtcaaagggtatgcaaacgacaacaatttgcatatgcgcggggcggaaatcgaccgacttgtccaaggctgtacaggcgtcaagcggacgacagggcagcacccgggcggaattatcgttgtgccggattatatggatatttacgacttttcaccaatccagtttccggcggatgccacagattccgaatggaagacgacgcattttgacttccattccatccatgacaaccttctgaagcttgatattctcggacacgatgatccgacggtcatccgtatgctccaggatcttagcgggattgatccgaaaacgattccgaccgatgatcctgaagtgatgaaaattttccaagggacagagtctttaggggtaaccgaggaacagatcggctgtaaaaccggtacactcggcatccctgaattcggaacccgctttgtcagacagatgcttgaggacaccaagccgacgacattttccgagctcgtacagatttccggcctgtcacacggtacggacgtatggctcggcaacgcgcaggagctgattcacaacaatatttgtgaactgagcgaagtgatcggctgccgtgatgacattatggtgtacttaatctaccaggggcttgagccatccctcgcctttaagattatggagtttgtccgtaaaggaaagggactgacgcctgagtgggaagaagaaatgaagaataataatgttccggactggtatatcgattcctgcaaaaaaatcaaatacatgttcccgaaagcccacgctgcggcatatgttttgatggcggtcaggatcgcttattttaaagtccatcatccgctgctctactacgcagcatacttcaccgtgcgggccgacgactttgacatcgaaacgatgatcaaaggatcgacagcgatcagagccgtcatggatgatatcaactctaaaggccttgacgcttctccaaaagagaaaagtttgctcacggtgcttgagctggcgcttgaaatgtgcgaaaggggcttctctttccaaaaagtcgatttatacagatcgagcgcttcagaattcatcattgatggaaacagcttgattccgccgtttaattcaataccggggcttggaacaaacgccgccttgaatattgtcaaagcgagggaagaaggcgaatttctttccaaagaagatttgcaaaaaagaggaaaggtgtcaaaaacgatcatggaatacttggagcgccacggctgtctcgagtcgcttccagatcagaaccagctgtcattatt

SEQ ID NO: 1523 - DNA, 2771 bp, Bacillus licheniformis
atggcaacgaaacgaattgaggtgaaaggtgcaagggcccataacctgaaaaatatcgatgtctctattccgagggatcagcttgtcgttttgacaggtctttcgggatcagggaaatcatcccttgcgttcgatacgatatatgcagaggggcagcggcgctatgtcgagtctctctccgcatatgcccgccagtttttaggacagatggacaaacccgacgtcgatgcgattgaaggcctgtcgccggcgatcagcatcgatcagaaaacaacgagccggaacccccggtcgacagtcggaacggtgacggaaatctacgattatctccggctgctgtttgccagaatcggaaagccggtttgccctgttcacggcattgaaattacctcgcaaacgatcgaacagatgacggacagaattttggattatcccgagcggacgaagatccaggtgcttgcgccgatcgtctcgggaagaaaaggatcgcacgtgaaagtgctcgaacaaatcagaaaacaaggctatgtgagagtccggatcgacggcgaaatgaacgacctctcagaggacatcgagctcgaaaagaataaaaagcattcgatcgaagtcgtcgtcgaccgcatcgtcataaaagaaggcgtaaccgcccgtctcacagactcgctcgaaacggcgctccgcctcggcgaaggccgtgtgatcatcgacgtgatcgggcaggaagagctgctgttcagcgagcaccatgcctgtccgcactgcggtttttcaattggggaactggagccgaggatgttttctttcaacagcccgttcggcgcatgtccgagctgcgacggcctcgggtccaagctggaagtcgatgtagagctcgtcattccaaacgatgagctgtctctaaaggagaatgcgattgcaccttgggaaccgcagagctcccaatattatccgaagctgcttgaagcggtatgcagccactatggaatcgatatggatattccggtcagagacctgccgaagcaccaccttgagaaaatcctctacggcagcggaggcgagcagatttatttcagatatgaaaacgacttcggacaagtccgggaaaactacattgagttcgaaggcgtcatccgcaatatcgaaaggcgctataaagaaaccagctcggattatgttcgtgaactgatggaaaaatatatggctaatcagccgtgcccttcatgcaaaggctaccgtctgaaaaaggaatccctcgccgtgctgattaacggccttcacatcggtaagataaccgaaatgtcggtagctaacgcccttcaatttttccgtgaacttgatctttcagaaaaagacatgaagatcgccaacctcattttgcgggagattgaagaaaggctcggattcttgaacaatgtcgggcttgactatttgacgctcagccgcgcagccggcactctgtcggggggagaagcgcagcggatcaggcttgcaacgcaaatcggctcaaggctgaccggtgtcctttacatccttgatgagccgtcaatcggtcttcatcaacgcgataacgaccgcctgattgagacgctcaaaaacatgagggatatcggaaacacattgatcgtcgtcgagcatgacgaggatacaatgcttgccgccgattatttaatcgatatcgggcccggcgcgggtgtacacgggggagaagtaatctccgccggaacgccggaagaagtgatgaacgatgatcaatctctgacagggcaatatctttcagggaaaaaattcattcctcttcctgccgagagaagaaagcctgacaaccgctttatcgaggtaaaaggggcaaaggaaaacaacttgaaaaatgtttccgtgaaatttccgctcggcgtgttcacagctgttaccggggtatcgggatcagggaaaagcacgctcgttaatgaaattctccacaaaacgctggctcagaagctgcatcgggctaagacgaaaccgggagaatacaaagaaataaaaggaatcgagcacctcgataaagtgatcgatattgaccagtctccgatcggccggacgccgaggtcaaatccggccacatataccggcgtgttcgatgacatccgcgacgtgtttgcccagacgaatgaagcgaaagtcagaggatacaagaaagggcgcttcagctttaacgtcaaaggcggacgctgtgaggcctgcaaaggcgacggaatcattaaaatcgagatgcacttcctgcccgatgtatacgttccttgtgaggtttgccacggaaagagatacaaccgtgaaacgcttcaggttacgtacaaaggcaaaaatatctctgacgtgcttgagatgacggtcgagaatgccgttcaattttttgagaacatcccgaaaatcaagcgcaagctgcagaccctctatgatgtcggtcttggctatattacgctcggacagccggctacaacgctttccgggggagaagcgcagcgggtcaaattggcatctgaacttcaccgccgttcaacgggaagatccctttatattttggacgagccgacgacaggactgcacgtcgatgatatcgcaaggcttttggccgttctgcagcgcctggtcgacaatggagatacagtgcttgtaatcgaacacaatctagatattataaaagcggctgattatttgatcgacttgggtcctgaaggcggagacggcgggggaatgattcgtggctgccggaactcccgaagaattcgtga

SEQ ID NO: 1524 - DNA, 2545 bp, Bacillus licheniformis
atgactgaaagaaaaaaattagtattggttgacggaaacagcctggcttaccgtgcgtttttcgccctgcctcttctcagcaatgaaaaagggatacatacaaacgcggtgtacggttttaccacgatcttaatgaagatgcttgaagaggaaaaaccgacccacatgctcgtcgcttttgatgcggggaaaacgacattcagacataaaacgtttaaagaatataaaggcggcagacaaaaaacgccgccggagctgtcagagcaattgccgtttatccgcgagctgctcgacgcatatagaatctcaaggtatgagcttgaaaactacgaggccgatgatattatcggcacccttgccaaatcagcggaaaaagacggatttgaagtgaagattttttccggcgacaaggacctgacacagctggctacagaaggaacgacggtcgccatcacaaaaaagggcattacagatgtcgaatactatacgcctgaacatgtccgggaaaagtacggacttacccctgaacagatcattgatatgaaagggctgatgggagactcgtcagacaatattccaggcgtgccgggagtcggcgaaaagacggcgatcaagcttttgaaacagttccatacagtagaggagctgctgtcgtcaatagacgaagtcagcggaaaaaaactgaaagaaaagcttgaagaatttaaagaacaggctttgatgagcaaagagcttgcgacgattacgacagaagcgccgcttgaagtcagcctcgattccctcggatatgaaggttttgacagggaagcggtcgtcaagatttttaaagatctcggctttcattctttgctcgaaaggattggcgaagaggcgggagagaaagaagaagaacagttggaagagatcgatgtcatgatcaaaacagacatcacggatgacttgtttgcgtcaccggcttcactcgtagtcgaacagctcggcgacaattatcacgaggcgccgatcctcggtttttcgatcgtcaacgaacacggcgctttcttcattccggaagagacggccgttcagtcggactgttttaaagaatgggccgaagatgagtcgaaaaagaaatgggtgtttgatgcaaaacgtgcggcggtcgctttgcgctggcggggcattgaactgaaaggcgctgagtttgacgttcttcttgcggcctatatcatcaacccggggcactcctacgatgatgtggcaagcgttgcgaaagaacatcaattacacatcgtttcagcagatgaagcggtctacggaaaaggagcgaaacaggcggttccggatgagaaggagcttgccgaccatttagccagaaaggcgaaggcgatatcgctgctgcgcgaaaagctccttgatgaactggaagaaaacgagcagctcgaactgtttgaagcgctcgaaatgcccctcgcccacattctcggtgagatggaatcgatcggtgtccaagtcgatgtcgacagactgaaaaaaatgggtgaagaactgtccgctaaattagcggaatacgagaaaaaaatccacgagtcagcaggtgaaaccttcaacattaattcaccaaagcagctcggtgtgattttgtttgataaactcgggctgcctgtcgtcaaaaaaacaaaaacgggctattcaacttcagccgatgtgcttgaaaagctgcgcgataaacatgtcattatcgaagatatcctgcactacaggcagattggcaagctccagtccacatacgtagaagggcttttgaaagtgatcaaaaaagacagccataaagtgcatacccgctttaatcaagctttaacacagacgggaaggctcagctcaaccgatccgaatctgcaaaatataccgatccgccttgaggagggccgcaaaatccggcaggcgtttgtcccttcgcaaaaaggctggctcatatttgcggcggattactcacagatcgagctgagggttctcgcccacatttcaaaggataaaaatttgattgaagcgttcacgaacgatatggacgttcacacaaaaacggcgatggacgtttttcatgtatcagaagaagaagtcacccctgcgatgagaaggcaggcgaaagcagtcaatttcggaatcgtctacggaatcagcgactacggcttgtcgcaaaacctgggaattacaagaaaggaagcggcagcgtttattgagcgctatttccacagcttccagggagtcaaagaatacatggaagagaccgttcaggaagcgaagcagcgaggctatgtaacgactcttttaagccggaggcggtatataccggaattgacgagccggaatttcaatctgcgcagctttgccgaacggacggcgatgaacacaccgatccagggaagcgccgcagatattattaaaaaagcgatgatcgacatggcggacaagctgaaagaaaaaaatctccaggccaaactgctgctgcaggttcatgacgaattgatttttgaagcgcctgaagatgaaatcaaagtgcttgaaa

SEQ ID NO: 1525 - DNA, 2215 bp, Bacillus licheniformis
  misc_feature (1)...(2215): n = A,T,C or G
ttgaattacattagcgaccaattattaagcggattgaacaagatgcagcaggaagcggtcaaaacgacggacggtccgcttttgatcatggcaggagcaggaagcggaaagacgcgggtattgacgcaccgcattgcgtatttaatggcggagaagcgcgttgccccgtggaacatactggcgattacatttacgaacaaagcggccagagaaatgaaagaacgtgtggaaagcattctcggaccgggagcggatgacatctggatttcgacgttccacagcatgtgcgtcagaattttgcggagagacatcgacagaatcggcatcaaccggaatttctcgattcttgatacgtctgaccagctttccgtcattaaaggaatcctgaaagaaagaaacatcgatccgaaaaaattcgatccgagaagcatactaggatcgatcagcagtgcgaaaaacgagttgatcgccccggaagaatacgagaaaacagccggcggtttttttgaacaagtcgtcagcgatgtctacaaagattatcagaagaaactgcggaaaaaccagtcgctcgattttgacgatttgattatgacgacgattgtcctgtttgaccgggtgccggaagtgcttgaatactaccagcggaaattccaatacattcatgtcgatgagtatcaggatacgaacagggcgcagtatttgctcgtcaaaaaaatggcgcagcgcttccaaaacatctgcgttgtcggggactccgaccagtcgatctacagatggcgcggagcggatatcgccaacatcctgtcgtttgaaaaagactatccgaatgcgagcgtcattctgctcgaacaaaactacagatcgacaaagcggatattgaacgcggccaatgaagtgattcagaacaactcaaacagaaagccgaaaaacctctggaccgaaaatgacgaaggggcgaaaatctcctacttcagaggcgacaacgaatttggcgaaggccaatttgtcgcgggcaaaatcagggagctcgtcggctctggaaaacgatccttctcagatatcgcgattttgtaccggacgaacgcccagtcgcgggtcattgaggaaacgctgatgaaggcgaacatcaactacaacatcgtcggcggcacgaagttctatgacagaaaagaaatcaaggacatcctcgcgtatttgcgcctcgtcgcaaaccctgacgacgatatcagctttgcgcggatcgtgaacgtcccgaagcgcggcgtcggtgcgacttcagtcgataaaatcgcggcctatgccgacatgaacggtatgtctttatttgaagcgctcggccaggttgactttatcggcctcagtgctagagcggccaacgcgcttgatgagttcagacagacgatcgaaaacctgacgaatatgcaggaatacttatccgtcacagagcttacggaagaaatccttgaaaaaaccgaataccgcgaaatgctgaaagcggaaaaatccttggaggcgcagagccgccttgagaatatcgacgaatttctctccgtaacgaaaaactttgagcagcaaagcgaagacaaatcgctcgtcgcttttttgaccgatttggcgctcatcgccgatatcgatcagcttgatcagaaggaagaagagaccggaaatcaagacgcggtcatcttaatgacgcttcatgctgcaaaaggactcgaattcccggtcgtgttcctgatggggcttgaagaaggagtgttcccgcacagccgctccctgatggaggaagcggagatggaagaagagcggagactcgcgtacgtcggcatcacgagggctgaggaagaactttatttaacgaacgcgcggatgcggacgttgttcggaagaacgaatatgaacccggaatcaaggttcattgcggaaataccggaggaattattggacaatctaaacgagaagaaaaaagatctgaaaacgccgtttggaagaaagcccgagcggagaggccccgttacccgtccggctgcatcgtacagcaaaaccggcggcgacggcgtcaattgggcagtcggcgacaaagcctcccataaaaaatggggcgtcggaaccgttgtcagcgtncaaggatccggcgaatcgacagagcttgacatcgcctttccgagcccgaccggagtgaagcgtcttctcgcggcctttgcgccaattgaaaagn

SEQ ID NO: 1526 - DNA, 2356 bp, Bacillus licheniformis
ttgcagcaaaaagcgctatcagcacttgaatttcataaagtaaaagaacagctcacagagcatgcggcatcttctttggggaaggaaatgcttttggaactcaaaccttcccgttcgctcgaagaagttaaaaagctgcaggaagaagtcgatgaagcaggaaccgtcctgcgtttaaaaggaagcgcccctttcggcggccttacggacattagaaaagcgttaagaagggcagaaatcggcagcattttaagcccggcggaattgactgaaatatcgggtctgctatacgcagcaaaacagatgaagcactttcttgaaggcctgttcgaagacggggttgagattccttatcttcatcaatatgcagaaaagctcataccgctttccgaattggaaagggacatcaattcgtgcatcgatgatcatggggaagtgcttgatcatgcatcagagacgttaaggggaatcaggacccagctgcggacgcttgaatcaagaatcagggaccggctggaatcgatgctgcgttcttcatctgcgcaaaaaatgctgtcggatacgatcatcacgattcgcaacgaccgcttcgtcatccctgtcaaacaggagtacagatcaagctacggaggaatcgtgcacgatcagtcttcttccggtgcgacattgtttatcgagcctcaggcgattgtcgatatgaacaatgcgcttcgccaggcaaaagtaaacgaaaaacaggagattgaacggattttgcgcgtcctgacagaaaagacggcagagcacacaaatgagctctttcacgatgtcaaagtgcttcagacgctggactttatttttgcaaaagcaaaatatgcaaaagcgacaaaagcggttaaaccggctgtcaacgctgacggctatgtccgcctgattcaagcccgccacccgcttttgcccctggatgaggtcgttccgaatgatattgagctcggcggagagtatacgacaattgtcatcacgggcccgaacacgggggggaaaacggtgacgctcaaaacgctcgggcttttgaccatgatggcgcagtcgggattgcacgtaccggcggaagaaggatcagagaccgccgtatttgatcaagtatttgccgatatcggcgatgaacagtcaatcgaacaaagcttaagtacgttctcgtcgcatatggtcaacatcgtcgatattttgaaagacatgacggaaaacagccttgtgctttttgacgagctcggtgccggaacagacccgcaggaaggcgcggcccttgcgatcagcatccttgatgaggtgtgccagacaggcgcacgcgtcattgccacgacccattacccggagctgaaggcatacggctacaatcgcgaaaatgtcattaatgcaagcgtcgaatttgatatcgatacactatcaccgacatacaagcttttaattggagtgcccggccgaagcaatgcgttcgaaatctcgaagcgcctcgggctgcctgattacctgatcggccgcgcaaaagcggagatgacggccgaacataatgaagttgatacgatgatcgcatcgctggaagacagcaaaaagcgcgcagaagcggagctcaaggagaccgaagccatccgcgcggaagctgaagcccttcaccgcgacctgcagcagcagatcagcgaatggcaggagaaaaaagacaagctctacgaagaagcggagcaaaaagcggctgaaaaagtcaaagcagcgatgaaagaagcagacgacatcatccagtcgctccgcatgatcaaagaagaccataaagcatttaaagaccatgagctgatcgaggcgaaaaagcgccttgaagaagccgtgccttcgtttgaaaaagcgaaaaagccggctcagaaaaaaacggacaagcgcgaattaaaaccgggcgatgaagtcaaagttttaacctttggccaaaaagggacgctgctcgaaaaaacgggtgcggccgaatggaatgtgcaaatcggcatcctgaaaatgaaggtcaaggaaaaggatctggaattcctgaaatcggcacccgaacccgagaaacaaaaaacgatcgccgccgtcaaagggaaagattatcacgtctcgctcgaactcgaccttaggggggagcggtttgaaaatgcgcttcaccgggttgaaaaatacttggatgatgcggtgcttgcgggctatccgagagtctcgatcattcacggaaaaggaaccggcgccctccgaaaaggcgtccaggacctattgaaatcccaccgcaatgtgaaaaactcccggttcggcgaagcgggagagggaggatcaggagtcaccattgtcgaattaaaat

SEQ ID NO: 1527 - DNA, 1984 bp, Bacillus licheniformis
atgtgaaagaccgctttgaattagtctcgaattatcagccccagggggatcagccgaaagcgattgatcagcttgtcaaaggaatcaatgaaggcagaaagcatcagacgcttttgggggcaaccggtactggaaagacgtttacgatgtcgaacgtgattaaagaggtcaacaaaccgactctcgtcatcgcccacaacaaaacgttagccgggcagctttacagcgagtttaaagaatttttccccaacaacgcagtcgaatattttgtcagctattatgactattaccagcctgaggcctacgtgccccagactgatacatttatcgaaaaagatgccagcattaacgatgagattgataaattaaggcactctgccacgtctgctctttttgaacgcaaagatgtcatcattgtggcgagtgtctcttgtatttacggcttgggttctcctgaggaatacagggaaatggtgctctcgctcagaacggaaatggaaatcgagcggaatgagctgctcagaaagctcgttgacatccaatatgcgcggaatgacatcgattttcagcgcggaacattcagggtgcgcggcgatgtcgtcgagatctttccggcttcaagggatgagcactgcgtccgagttgaatttttcggggacgaaatcgaacggatcagggaagtggatgccctgactggcgaaattttaggggagagggaacacgtcgcgatcttcccggcttcccacttcgtcacccgggaagaaaagatgaagaaagcgatcataaacattgaagaggagctggaagagcgcctcaaagcgcttcgtgaagaaggcaagctccttgaagcgcagcgtctggaacagcggacgagatacgatttggaaatgatgcgcgaaatgggcttttgctcgggcatcgaaaactattcaagacatttgacgcttcgtccggcaggttcgactccatatacgctgctcgattactttccggatgatttcctgatggtcatagatgagtcgcatgtcaccataccgcagatcagaggaatgtacaacggagaccaggcgagaaaacaggttctcgtcgatcatggattcaggctgccttccgctttggataaccgtccgctcaggtttgaagagtttgaaaagcacattcacaacatcgtgtatgtgtcggctacgccggggccttatgaacttgagcatacgcctgaaatggtagagcagatcatccggccgacagggctgctcgatccgattattgaggtaaggccgattgaagggcagatcgatgatctgatcggtgaaatccagcagagaatcgagcggaatgaacgcgtcctcgtcacgacgctgacgaaaaaaatgtccgaggatttgacggattatctgaaggaaatcggtatcaaggtcacgtacctgcattcagagattaaaacgctggagcggatcgagatcatacgcgaccttcgcctcggcaagcatgacgttctcgtcggcatcaacctgctgagggaaggactcgatattcctgaggtttcactcgtcgccattcttgacgcagacaaagaaggctttttgcggtccgaacgctcgctcatccaaacgatcggccgcgccgccagaaatgccgaaggccgcgtaatcatgtatgccgacaaaatcaccaactcgatggaaatcgcaatcaatgaaacgaagcgccgccgcgaacagcaggaggcttataatgagaaacacggcattacgccgaaaacgatcaacaaaaagatcagggacgtcatccgggcaactcatgctgctgaagaccaggaagaatatcaagtgaaagaggagccgaagctttcgaagatgacgaagaaagagcgggaaaaagtgatcgctcaaatggaaagcgacatgaaggaagcggcaaaagcgcttgactttgaacgcgccgccgagcttcgcgacttgctcctagagttaaaatcggaagg

SEQ ID NO: 1528 - DNA, 1908 bp, Bacillus licheniformis
aacagcaaaataattacgatgaaaatcagatacaggttctagagggattggaagccgttcggaaaagacccggaatgtacatcgggtcgacaagcggcaaaggtctgcaccatttagtatgggaaattgtcgataacagcatcgatgaagcattggccggttactgcactgaaatcaatgtcgcaattgaaaaagacaacagcatcacagtaaaagacaacggacggggtatcccggtcggtattcatgagaagatgggtcgtcccgctgtggaagtcatcatgactgtcctgcacgccggaggaaagtttgacggaagcggatataaagtttcgggcggtttgcacggcgtcggtgcttctgttgttaacgccctttcaaccgagctggatgtaacggtttacagagatggaaaaatccattatcaggaatttgaacgtggcgttccgaaagctgatttgaaagtcattggagatacggaagtgacgggaacgaccacacacttcaagcctgatccggaaatattcacggaaacgactgaatacgactatgatacgctcgccactcgtgtccgcgaactcgctttcttgacaaaaggcgtcaaaatcacgatcgaagacaagcgagaaggaaaagaacgcaagaatgaatactgctatgaaggcggtattaaaagctatgttgaacacttgaaccgttcgcgggaagttattcatgaagagccggtctatattgaaggatccaaagacggcattacagtcgaggtggctcttcaatacaatgacagctatacaagcaacatttattcatttgctaacaacattcatacgtatgaaggcggaacccatgaagccggctttaagaccggtttgacgagggtcatcaatgattacgcgagaagaaacggcgtattcaaagaaagcgatccgaacttaagcggagaagacgtccgggaaggtttgacagcgattatttcaatcaagcacccggatcctcaatttgaagggcagacgaaaacaaagctcggcaactcagaagcgcgtacgataacagatgcgctattttcagaagcgcttgaaaagtttctgctagaaaacccggattcagcgaaaaaaatcgttgaaaaaggggttatggccgccagagcacggatggctgcaaagaaagcacgcgaattgacgcgcagaaaaagcgcccttgaagtgtccaatctgccggggaaacttgctgactgttcttctaaagacccgacgatttccgaactttacatcgttgagggtgactctgcgggcggatcggcaaaacagggccgcgaccgtcatttccaagcaattttgcctttgagagggaaaattttgaacgtcgaaaaagcccgcctggacaaaatattgtccaacaatgaggttcgttctatgatcaccgcccttggcaccggaatcggggaagatttcaaccttgaaaaagcccgctaccacaaagtcgtgattatgacggatgccgacgtcgatggtgcacacatcagaacattgctgctgacctttttctaccgctacatgagacagattatcgaacaaggatatgtctacatcgctcagccgcctctttacaaagtacagcaggggaaacgcgttgagtatgcgtacaatgaccagcagctcgaagaaattttaaaagagcttccgcaaaatcctaagccaggcctgcagcgctacaaaggtttgggcgagatgaatgcgacacagctttgggaaacgacgatggatccagaaacgcggacattgcttcaagtaacgctcaaagatgcgattgatgcggatgaaacctttgaaatgctgatgggcgacaaggttgaaccgcgccgcaacttcatcgaagagaatgcccgatatgtaaagaatttggatattt

SEQ ID NO: 1529 - DNA, 2406 bp, Bacillus licheniformis
agcatgaggggaacctgtttatggtgggcgatgtcaagcagtcgatttaccggttccgcctggctgagccgcttttgttcctctcgaaatataaacgctttacagacgatggctcgggttccggccagaaaatcgatttaaataaaaacttcagaagccgttcagatattttggacagcacgaactttttattcaaacagctcatgggagaaaaagtcggggaagtcgagtatgacgaacaagccgaattgaagctcggcgcctcttatccgccgaacgaagcgacaaaaacggagcttctgctcatcgaaaccccgagcggcgcgccgggtgaagaggctgaagagcttgaggcggtccagcttgaagcaagagcgatggccgggcagatccgcaggctgattacagaaaaatttcaagtatatgatgccaaagcgaaagcgtcgcgaaacatccagtaccgtgatatcgtggtgcttttgcggtcgatgccttgggcgcctcaaattatggacgagtttaaacagcagggaatacccgtatacgcgaacctctcaactggttattttgaggcgacagaagtatcggtcacactgtctttattaaaaatcatcgataatgcctatcaggacatcccgcttgcgtccgttctcagatcgcctgttgtgggtcttgatgagaatgagctttccttgatcagaatcaaagataaaaaagcgccgttttacgaagccatgaaagcgtaccttgctgcagcagacggcgatgagaggctcagcgaaaagcttcgccgctttgacggtctgctcaagaagtggagagcttatgcgaaaaaccactctgtagcagagctgatctgggaaatctaccgggatacgaagtatttggattatgtcggcggaatgccgggcggaaaacagcggcaggccaatttgcgcgcgctttacgacagggcgagatcctatgaagcgacatcattccgcggcttgttccgctttttaagatttattgagcggatgcaggagcggggcgatgacctcggaacggcaagggctctaagcgaacaggaagacgttgttcggctgatgacgatccactcaagcaaagggcttgaatttcctgtcgtatttaccgccggtctcggacggaattttaatatgatggacttgaacaaatcttatctgctggataaagagctcggttttggaacgaagtttatccatccgaagtggcggatcagctatccgacgctgccgcttatcgcgatgaagaaaaaactccgccgcgagcttttatcagaggagctgcgcgtcttgtatgtcgcccttacccgggccaaggaaaagctgtacctggtcgggacggcgaaggataaagaaaagctgcttgccgactggcggacacaagcggccgggtccgagtggctgctcccggattatgaacggtttcaggcaaaatcatatctggatttcatcggacctgctttgatgaggcacagagatatggatgaatccggggcgccgcctgtgattgatgagatccgcgaacatccggcgcgctttcaggtcagctggctgtccgccgcggatctacaagctgaggctgtcgatcaggccggtgaagaaagacacgaccggctcgtccaaattcaaatgggccatgcgattgaaggcgcctttgaatatgagcagcaagtcagagaacgactggcatggtcatatccatacaaggacgccgccaaagtcagaacaaaacaatctgtctcagaaatgaaacggcagaaggaatacgaggatgaatacggcgaccgctcgcttattcgtccatcacaggaggctctcctgtttaaacggccgtcctttatgatggcaaaaggcctgaccgcagccgaacgggggacggcgatgcacaccgtcatgcagcatattccgctgacccgtacgcctgaaaagaatgagctcagccgccttctagacaggcttgttgagaaagagctgttaacagaagaccagcgggcagcgattgaagaagacgacattcttgcattctttgatacggaaatcggacaaaagcttttcggcgcccgccgcgtcgaacgggaggttccctttaacatgacgctgtccgctaaagaggtttatccggatcttgagtcagccgatgaacctgttttgatacagggaattatcgactgcctattcgagacggaggacggtttttaccttctagattacaaaaccgaccggatacacggaaagtaccggaacggcttcgaaggggccgagccgattttaagaaaacgttacgaaacacaaattcagctttacgcacgagccgttgaaacgatgattaaaatgccgctcaaagggcgcgcgctgtacttttttgacggaggacacgtgctct

SEQ ID NO: 1530 - DNA, 2250 bp, Bacillus licheniformis
taagcttagcgaacatccggaaattcgaatcccccaccgggcgatgtcgtacatcgaaaaggagaacgcgccagcttccacgtgtttaaagcgattaaagcggcgagaaagctgaacgaagacatgaaggccgaaggagatctgcatcttgagctcaacgcgccccgctgaaatgctggacatttacagagatcgtccggacgcgttggagaatacagtcaaaatcgcggaccgatgccaggtggacctgagccttggccagacgcgcctgccgaaatatccggcgccttccggcaagaatgccgacgattatttggccgagctttgctttctcggactgaaaaaacggttcgaagccgctccgaaggagtatgtcgagcggcttaagtatgagctgaaagtgattcgcgacatggctttcagcgactattttttgatcgtctgggatttcatgaagttcgcccacgataacggcattatcacagggccggggcgcggatcggcggccggttctctcgtcgcttatacgctgtttatcacagatgtcgatccgcttaagcacaaattgctgtttgaacggtttttaaatccggagcgcatcagcatgcccgatatcgatatcgattttcccgatacgagaagggatgaagttattcagtacgtgaaaaataagtacggggcactgcacgtagcacaaataaccacgttcggtacattggccgcaaaagcggcgctccgagacgtcggcagggtgatgggcatcagtccgaaagaagccgaccagctggcgaagctgattccctccaaacccggagtgacgctgaaagaggcgagagcactttcacctgaacttgacaagcgcctaaacggctcaaaaaagcttcaggacatatttaaaacggcgcagaaaatcgaagggcttccccggcatacgtccattcatgcggctggcgtcgtattgagcgaggagccgctgacgaatatcataccggtacaggaaggtcatggcggcgtatatttaacgcaatattcgatgggctatctcgaagacttgggacttttgaaaatggattttctcggcttgcgcaatttaacgctcattgaatcgatcaaaacgctgatcgaaaaaagcgagcgggtcactatcgatttctcggcgattccctatgatgatgaacagacgtttaagctgctggctgaaggagatacgacaggtattttccagctcgaatcagccggcatgagaaacgttttaaaaaggctcaagccatcgagccttgaagatattgtcgccgtcaatgccttgtaccgcccgggcccgatggaaaacatcccgctgtatatcgaaaggaagcacggacgggttcctgtgtcttatccgcacgaggatttggccgatatcctgaaagatacgtacggcgtgatcgtttatcaggaacaaatcatgatgatcgcatcccggatggcgggtttcaggcttggagaagccgaccttttgcgaagggcggtcggcaaaaaaaacaaggaaattctcgatacagagagaaatcattttattagtggatgtttgaaaaaaggatattccgtacaggcggctaatgaagtatacgatctgattgtgaaattcgccaattacggttttaaccggagccatgccgttgcatacagcatgatcggctaccagctcgcttatttaaaagcgcattatcccctctactttatgtgcggcctcttgacgagtgcgatcggaaatgaggaaaagcttgctcagtacatctatgaagcaaaagggaaagggctgaatgttctaggtccttccatcaataagagcggctatccgtttgtcgtggaaaacggggcgctgcgctacagtttaagagctgttaaaggcgtcgggatagcggctgtaaaagagatctacagagccagaaaagaaaagccgttcgcagatttgtttgatttttgtgtgaggacttctgtgaaaagcgtaaatcggaaaacgattgaagccttaatttttgccggagcaatggatgaattcggtgaaaaccgggctactttgctcgcttctgtcgatgtcgcgctggagcatgccgaattgtttgcaggagacaatgatcagctaggcttctttctcgatgaaggcttgacaatcaagccgaagtacgccgagacggaggaaatgccgctcgtcgacctgctggcacacgagaaggaacgcttggcattaactttctgacatcagctgag

SEQ ID NO: 1531 - DNA, 2194 bp, Bacillus licheniformis
  misc_feature (1)...(2194): n = A,T,C or G
atggcacagccagagatttatcatgatttaccattggaagacgtgatcggcgaccgtttcggccgatacagcaaatatattattcaggaccgggcgctccctgatgcgcgcgacggcctgaagcctgttcaaagaagaatcttatacgccatgcatgcggaagggaacacatacgataagaatttccgcaaggccgcaaaaacggtcggtaatgtaatcggaaactatcatcctcacggagacagctcggtctacgaagcgatggtgcggatgagccaggactggaaggttcgcaacgtgctgattgaaatgcacggaaacaacggaagcatcgacggtgatccgccggctgcgatgcgttatacagaagcaaggctcgcggcgatcgcgtcagagctattgcgggatattgacaaagaaacggtcgagtttgtaccaaactttgatgatacgagcaaagagcctgtcgtccttccggcaatgttcccgaacctgcttgtcaacggatcgacagggatttccgccgggtatgcgactgacattccgccgcatcatctcggggaagtgatcgatgccgtgattaagcggatcgactcgccgaactgcagcgtggatgacctcatggagttcgtaaaaggtccggactttccgaccggaggaatcatccaggggaaagaaggcataaaaaaagcctatgaaaccggaaaaggaaaaatcatcatcaggggcaaagccgagatcgaaacaatcagaggcggccgccagcaaattgtcattactgaaattccgtttgaagtcaacaaagcgaatttagtgaaaaaaatggacgaattcaggattgaacggaaggtcgaagggatttcagaagtccgtgacgagaccgaccggacaggcctcagaatcgtgattgagctgaaaaaagaagcggatgcacaaggcattttaaatttcttatacaaaaacacggatttgcagattccttacaactttaacatggtcgccatccataacagaagaccgatgctgatgaatctcacatcgattttggacgcttatatcggccaccaaaaagaagtcatcaccaaccgttctcagtatgagctgaaaaaagcgaaggaaaggcatcatatcgtagaaggcttaatgaaggcactgtccattttggatgaggtcattgcgacgatccgctcctccaatgacaagcgcgatgccaaaaacaatctgatcgaaaagttcgcatttactgagccgcaggctgaagcgatcgtttccttgcagctgtacaggctgacaaacacagatattacggccctccaggaagaagcaaaagaactggaccagaagatcaaagagctggaagagatcctttccaatgataagaaacttttgaaagtgatcaaagacagcttgaaaaaggttaaaaaaacctatgccagtcaaaggcgctctgtcatcgaagaaaaaatcgaagaaattaaaatcaaccttgaagtgatggtggcgtcggaagacgtttatgtgaccgtaacgaaagacggttatattaaacgaacgagccagcggtctttcgccgcatcaaacggccaggacttcggcatgaaagataccgaccgtctgctctgtcagctggaaatgaatacgacagacgttctgctcttgttcacaaataaagggagctatgtctattgtccagttcaccagctccctgatatcagatggaaagatttaggtcagcatataacgaatatcatatcgattgacagcgatgagtccatcgtcaaggcgattcctgtcagagagtttaccgaatctgaatacctgctgttctttacgaaaaacggaatggcgaaaagaactcagctgatgcagtataaagcacagcgctattcaaaagcactggttgcccttaatttaaaaggcgacgatgaagtggtcgatgttcatgtaacggacggaacgaaagatttgtttattgcgacacattccggctacggtctgtggttcacagaagatgaagtcagcgtcgtcggcgcaagggcggccggtgtcaagggcgtcaatttgaaagacggcgactttgtcgccagcggacaggttttagaggaaaaagacgtgcttgtgctcgtgacccagcgcggatctattaagcggatgaaccgcagcgaatntgaaanaacgtcaagggcgaaacgan

SEQ ID NO: 1532 - DNA, 1772 bp, Bacillus licheniformis
gtgtctaaaacagttgttttagcagaaaaaccttcagtcggccgtgacttggcccgcgtgctgaagtgtcataaaaaaggaaacggatatcttgaaggcgaccgctatatcgtgacatgggcgctcggccatctggtcacattggcggaccctgaaggatacggaaaggaataccagtcttggcggcttgaagacctgccgatcatccctgagcctttaaagctcgtcgtgatcaaaaagaccggaaaacagtttcaggcggtaaaatcgcagctgatcagaaaagatgtcaaagacatcgtcattgcaaccgatgccggccgggaaggcgagctcgtcgcccgctggatcatcgaaaaagcaaaggtcacgaagccattgaagcgtctgtggatttcatctgttactgacaaagcgatcaaagacggatttaaaaacttaaagaacggcaaagactttgaaaacctttaccattcagctgtggctcgagctgaagccgattggatcgtcggcatcaacgcgacgagggcgctgacaacgaaattcaacgcccagctttcctgcgggcgcgtacagacgccgacgctggcaatgatcgccaaaagagaggaagatattaagaactttaaacccgtcccttatttcggcttgcgcgcagcggtcgacggcatgacgctgacatggcaggacaaaaagacgtcacagacacgcacgttcaacgcatctgtgacgtcgcagcttgcaggagcgctgcaaggcaaaccggccgtcatcgtcgacttgaaaaaaacggcgaaaaaaagctttgctcccggactttatgatctgactgagctgcagagggacgcccataaacgcttcggcttttccgcaaaagaaacgctgtccgttttgcagaagctctatgagcagcacaagctcgtcacctatccgcggacggactcaaggtttctttccaatgacatcgtcccgacgctgaaagaccgtttggaaggcatgcaggtgaagccttatgcccagcatgtggcccggatcctgaagcggggggttaaagccaataaaagctttgtcaacgatgcgaaagtatccgatcaccacgcgattattccgacggaagagccgcttgcgctcggcgcgttaagcgaaaaggaaagaaagctttacgatttgatcgcgaagcgcttcctcgctgttttaatgccgccgtttgaatatgaagaaacaaaagtgtttgccgaaatcggcggagaaacctttacggcaaaagggaaaacagttcagtcgcaaggctggaaagcggtgtacgatttcgcagacgaagatgatgacgaggaagaaaaggatcaaacccttccaaaactcgcaaaaggcgacacgctttccgtccggtctttgacagagacgaagggtgaaacaaaaccgccggcgcggtttaatgaaggaacattgctgtctgcgatggagaatccagccgcatttatgcagggagaagaaaaaaaccttgtgaaaaccctcggagagacgggcggacttgggacggtcgcgacacgcgccgatattatcgaaaagctgttcaacacgttcctgattgagaaaaaaggaaaagatatttacattacttcaaaaggaaaacagctccttgagcttgttccgtcagatttaaaatctccggccctcaccgccgaatgggagcagaagctgtcaggcattgcgaaaggaaagctgaaatcttcagccttcattaaagaaagaaggaagtacgcaaagcagac

SEQ ID NO: 1533 - DNA, 2964 bp, Bacillus licheniformis
ttttacaagggcagtcgtcctgccgcaaggaaaattcgccgaatttctttccttgaaaggagcggagcgaaggcagatgcttcagcgcctgttcaaccttgaacaatacggggacaggctcgtcaaaaaactaaagaaacaggcgcaaacagctcagtccagaaaaaacgagatgcttgccgagcaggctggattgggcgatgcgggggaagaggcgctgaagctggcggaacagcatctcgaagaagccgaaacccttttgcaaagcaagaggcgcgaacgagatgcggaagcgcagcgctttgcggagtaccaggaaatttggaatctgcagcaagaaaaagaaagctatctaaaaaaagaggcggagcttttaaagaaaaaggaacagatccgggaaaaagaaagccgcctgcatctcgctgaaacggcaaatacgctcaagccttatgcagacgcctttctggcagcgcgggaagatgccgagcgcgcacttcgggaagaaaaacaagcgcgggaacaattagaacaatacgaagagcttcataaaaaaacagagtgcgagtacgagaatttcaggcgtcataaaaatgaaaaagaaccggagcttctcaagcaagaagaacagctcaccgctttgaaggaaattgaaaacaagcggcttgccgcacaggcagaagctgagaaaaagcagcgggaacagcgcttgaaagaagaggaaatcaagcatgcggcagacgaactggccaaggtgaaaagcctgcttgaacgcgggacagccaagcaaaatcagctgaaagcggagctgaaatctgtccaggtatccagcgaagagcgcaaaaactgccggaaggccaatcagcttgcttttcacattcagcagcttaacagcgatgccgctttagaaaaaaaacggctcgatcagcaggaggcgctgatcaaagagctccggcaagaacagcaagcggtggatcagaaggtgaaggatgaaaccgaacgcatccaggcattgtttgccgctgtcgaacgagcgtatgcgctcgtttgcgaaacggacagatcgctctctgagaccgtccgtctcgcgactcaaaagaaagaagagattgtcgcaaaacggaaacaggcaaaccgtgatcagctggcaatcgaactggcaaagcagctcaaagagggtgagccttgtccggtctgcgggtctgtacatcatgaaatgcccgcgggtgtcggtacggaaagcccgtcctttaaagagacggaatccgaactggagaaaacggaagccatcatcgcagaagccggcgcgctggctcaggagtttctctcagccaaagtggcgctcgaacagcagtccggccacctgatgagcgaatgcccgtttttagtcaaaagcaaacacgaactgcctgaaactgctgcatcgctagaagaaggcaccattcccgaacggttcagccgcatcagctttgaatggaaaggaatcagacaggatctcgccgagacaaaaagccggatgtcaaagctccttcacacatataaagagctctgcaaaaaacgcgaccaaatcagcgaacgcctcagccatgaagaaaaagagcaaaacaggcttcaaaaccgcgtccgcgaattgaatgacgagttaaatgaacgccaaaaaagcttcggcgaacaattcggcggcctctcttatgaacaggctgaaaaatggcaaaaaacgattgaagaaaaagatctggccgcagaggaattcgaaaagcgaatcgaaacgagcgtcgaatttctcacggaacatgaacagcaaaaagagaagctcaccgagcgcttgtttgcgcttgataaagaaaagcttgaccttcattatgcggtcgaaagcctcaaaaaagacataaacgattatcaaaaagagctgacgggctatcccgatacagctgcgatcgacgaaaagcttcaagacgtgaaaacgcagttggccaagctgcatgagcaggaacagacgctttacggacggctcaaggagaccgaatccgaagtcagccgtttaagaggacagactaaagggtgtgagctcgctttgcgcgaagcggaagcaaggcttgcgaaagcggcggacatctggcaggaaaaagccggaggcacaccgttcgaaaaggcctctgaagtgaaagcgagcattttggaccgcgatgagctttcccggctgaaagaagacattcaactgtattgggatcacacaaagcagtgcgagtccaatatcaagcgaattacggaaaagcttgacggcagatctgtttctgaagagaattgggaaaaagccgcagtcacgaaggaccaggcggaggaggcattcagcaaagctctagaggaaaggggagcggccggcaaagctctcgccgtcatccgcgagaaccataaaaggtttaaggagcttgaaacatcgttggctgaatggcagacatacatcgaccgccttgataagctccaagccgtctttaaaggaaacagctttgttgaatacttggcagaagagcagcttgaaagcgtcacaagagacgcatctgcaagactcggagaactgacaaggcagcggtatgcaattgaagtcgactcagaaggcggctttgtgatgagggacgatgccaacggcggagtcaagcgccctgttacgagtctgtcaggcggggagacatttctgacttcgcttgcgctggcgcttgcactctcggcgcagattcagcttcgcggagagtatccgctccaattcttctttttggacgaaggatttggcacgctggatcaggatttgctggatacggtcgtgactgcgttggagaagcttcagtctgacaatctgtcggtcggtgtgatcagccatgttcaggaacttcgggcaaggctgccgaaaaagctgattgtgcatccggctgaaccaagcggcaaaggtacagccgtatcgcttgaaatgat

SEQ ID NO: 1534 - DNA, 1689 bp, Bacillus licheniformis
aaaaaccctatatcacgcttccggaattgatggagatcattcctggacccgacttccctacagcagggctgatcttgggaagaagcggtatccgaaaggcctatgaaacaggccggggatcaattacgcttcgagccaaagctcaaatcgaagaaacatcttccggcaaaccggtaatcattattacggaaataccgtaccaagtgaataaagcaaggctgatcgaaaaaatcgccgatctagtgcgcgataagaaaatcgacggcattacggatctccgcgatgaatcagaccgaaacggaatgcgcatcgtcattgaactgagaagggatgcaaatgccaatgtactgttaaataacttgtacaagcagaccgctcttcaaacatcattcggcattaatcttttggcgcttgttgacggccagccgaaagtattgagcttgaagcagtgtctggagcattatctcgaccatcaaaaagtcgtgatcagaaggcgtactgcattcgagcttcgcaaagcggaagcgcgggcccatattcttgagggcttgagagtggcgcttgatcaccttgatgaagttatttccctaattagaaattcgcaaacggctgaaatcgcaaaaaacggattgattgagaagttttctttgactgaaaaacaggcccaggcgattttggacatgcgtctccagcgtttaacagggctggaacgcgaaaaaatcgaagaggaatatcaaagccttgttgagctgattgcagagctaaaagcaatcttagcagacgaagagaaagttcttgaaatcattcgggaagagctcacagaagttaaagagcgctttaatgatgagcgccgtactgaaatcgtgacatcgggccttgagacgattgaggatgaagatctcatcacgcgcgagaatatcgttgtgactttaactcataacggatatatcaaacgtctgccttcttccacttaccgcagccaaaaacggggcgggaaaggcattcagggcatgggtacaaatgaagacgacttcgttgaacacctgatttcaacatccacccatgacaccattctcttcttctcgaataaagggaaggtgtaccgtgcgaaaggatatgagatccctgaattcggacggacagcgaagggaattccgattattaacctgcttgaagtggaaaaaggagaatggatcaacgcgattattccggtaggcgaatttgatgacgagtcttatttgttcttcacgacaaaacacggaatatcaaaacgcacaccgctttctcaattcgcgaatatccgcaataatggattgatcgccttaagcctccgcgatgaggatgaattgatcgctgtccgcctgacggatggaaataaacaaattattatcggcacgaagaacggtctgctcatccgtttccctgaaacagatgtaaggcaaatgggaagaacagcagccggcgttaagggcatcaatctgacagatgacgatgttgttgtcggcatggagattttggaagaggattcacacgtgctaatcgtaactgaaaagggctacggaaaactgacgcccgcttcagaatacagggtgcaaagccgcggaggaaaagggctgaaaacctgcaaaatcacagaaaataacggatctcttgtgacagtgaaagcaacgacaggagaagaagatttaa

SEQ ID NO: 1535 - DNA, 2400 bp, Bacillus licheniformis
agtgatcgtcgatgttccaccgaaaaatatcgacagaccgttttattaccgcatccccgtcaaattcaaaggtatgattaaaaaaggtatgcgcgtgatcgttccgttcggcgcccgcaaaatccagggatttgtcaccagcgtgaaagaatcgtcggagcttgccggccgttcggttaaggatatcgaggatatccttgatctggcgcccgttttgacggaggagctgcttgagctgtcagactggctgacagaaaaaacactttcttttaaaattacggctttgcaggcgatgctccccgcggctatgaaagcaaaatacggcaaagaaatcaaggtgatcggcgataaaccgcttcccgaaccgctaaaaaccttgttctcgcaaaaagagacgctttcttattccgatataaatgaccacggaacattaaagctgattcagcgccaggttcaagaaggcaatcttgaagtggcgtataaagtaaagcagaaaacaaacaaaaaaatgcggagaatgatcgcccccctttgcgcgaaagaacatttaaaagaagcgcttgccggcctctctccgcaagctgtcaaacaaaaagcgatccttcagtttttcatcgaccgcaaagagggcggcgctgttccggcaaaggatctgatcgacaaaacggggggctcttccgcgtccttgaaagcgctcatcgacaaggggctgttaaaggaaagcgaagaggaggtttacagggatccttatcaggacagaatgttcaaaaaaaccgaaccgcttccgctgactgaagagcaggcgcaggcctacgaggcgatagcggatgcaatcgaagaaaagcggcacgatgtgtttcttcttcacggagtgaccggaagcggaaaaacggaagtctatctgcaatcgatcgaaaaggtgctggaagccggcaaagaagcgatcgttctcgttccggaaatttccctgacgccgcagatggtcaaccgctttaaagggcgctttggctcgcaggtagccgtactgcacagcgggctttcaacaggagaaaaatatgatgaatggcggaaaatccaccgcaaagaagtccggcttgtcgtcggggcgcgctcggcgattttcgcgccgtttgaaaatctcggcatgattataattgatgaagagcacgaaacatcgtacaagcaggaggagatgccgagataccatgcgaaagaagcggcgattcaaagggccaaataccaccggtgtccggtcgtgctcggcagtgcgacgccgacgctcgaatcgttcgcgagggcgaaaaaaggcgtgtacaagcttctttctctcaagcaccgcgtcaatcaccaagtcatgcccgacgtgtctctcgtcgatatgagagaggaactgcgcagcggaaaccgctcgatgttttccaaagacttaatggccgggcttgaggaaactcttgaaaaaggagagcaggccgttctgtttttaaacaaaagaggctattcctcatttgtcatgtgcagggactgcggatatgtcatccagtgtcctcattgtgaaatttcattgacgtaccacaggtatggacagcgtctgaagtgccattactgcggctatgaaaccggcatgccgtcaagctgccccgaatgcggaagcgagcatatccgctactttggtacaggcacacagcgggtcgaagaagaattgacgaaggttctgccggctgcaagggtgatccgcatggatgtcgatacaacctcaagaaagggagcgcatgaaaagctgctcacatcctttggcagaggcgaagccgatatcctgcttggaacgcagatgatcgccaaagggctcgatttcgaaaacgtcacgctcgtcggtgtcttgagcgcggatacgatgcttcacatccccgatttcagagccgctgaaaaaacgttccagctgatgacgcaggtgagcggaagagcggggcgccacgaaaagccgggcaaggtgatcattcagacgtacacaccgtcccattacagcattcagctcacaaaaacgcatgattatgaaacattcttccggcaggagatgctgcacagaagggaacaggcctatcctccatattattatttggcgctggtcagcgtatcgcacgaggaagtgacgaaggcggcactcgtgactgaaaaaatcgccacctatttaaaaaagaacatttcaagcgaggcgaagattctcggccctgtcgcatctccgatcgccaggatcaaagatagatatcgctatcaatgcgtgataaaatacaaacaggaaaaccagcttacatcgttgcttaaaaacattatggatcattacaaacgagacattgaacaaaagcaattggcgatttcgatcgacatgaatccatatatgatgat

SEQ ID NO: 1536 - DNA, 1909 bp, Bacillus licheniformis
ttggcaaaaattgttcagctgcctgacgatttatcgaataaaatcgcggcgggtgaagtagtggaaaggccggcgtcggtcgtcaaagagcttgtcgaaaatgcaatcgatgcgaacagctccgtgattgaaatcgatgttgaagaagcgggtctcgcctcgattaaagtgcttgacgacggcgaagggatggacgcagaagactgcagaacggcttttttgcgtcatgccacaagcaaaatcaaagacgaaaacgacctgtttcgcgtcagaacgctcggatttcgcggagaagctttgccaagtatcgcgtctgtctcacacttaagcattaaaacgagcaccggagaaggggcaggcacccatttgacgctgcaggggggaagaatcatttccgagcaaaaagcgccaagccgcagaggaaccgaaattacggttaccaacctgtttttcaatacgccggcaaggctgaaatacatgaaaacgattcataccgagcttggcaacatcacagatgtggtcaacagaatcgcccttgcccatccggaagtttcgatcaggctgcgtcatcaagggaaaacgcttctgcagacaaacggaaacggcgatgtccgccacgtgcttgcggcgatttacggcacggcggttgccaaaaaaatgctcccgcttgaagcgagatctcttgactttgaagtgaagggctatatcgctcttcctgaaattacgcgcgcctcgcgaaattacatgtcatctgtcgtcaacggcagatacattaaaaacttcccgctcgtaaaagcgatccacgagggctaccatacgcttcttccgatcggccgccatccgatcacgttcattgaaatcaacatggacccgctccttgtggacgtcaacgtgcacccgtcaaagctggaggtcaggctgagcaaagagacggagcttcacgagctgattcgcgacgccatcaaagacgtctttaaacagcagcagctcattccaagcgtgcaggtcccgaaaaaaaccgcacctctgatcaataaaccagagcagcaaaagcttgatttcgaccaggtacgagaaccggcacctctttctgattctgatgttgaaagagagtataagccggagccttcgttttcggcgatgaaattaagctcgcttgtcaaagacccgccgccttccgctcccgtagagcgcgaagaaaacgtaatgcaggacaccgagcctgaatggcccggagctgaagagtatacgcctgaagccgcgccggccgtacaagcagaaccggaacaggcaggagagaacgtccaggacgaagagacgccaaaagaaagggtgccgatcatgtatccgatcggccaaatgcacggcacctacatacttgcccaaaatgaaaacgggctgtacatcatcgatcagcacgccgcacaggagcggatcaaatacgaatatttccgtgaaaaagtcggggaagtcgaatcggaagtccaggacctgcttgtgccgctgacattccattattcaaaaaatgaagcgctgacgatcgaccagcacttggacgatttagccaaagtcggcgtctttctcgaatcgttcggcgccggcagctatatcgtccgatgccacccgacatggtttccgaaaggggaagaaacgacgatcattgaagacatcattcagcaggtccttgatgaccgcacgatcgacatcaaaaaactgcgcgaagaagccgcaatcatgatgagctgcaaaggctccatcaaagccaatcatcacctgcgggacgacgaaatcaccgccctgctcgatgagctgcgcagaacatccgaccctttcacatgcccgcacggccggccgatcatcatccactactccacctatgagatggagaagatgtttaagcgggtaatgt

SEQ ID NO: 1537 - DNA, 1782 bp, Bacillus licheniformis
cgggaagcggaaaaacgcgggtattaaccgcgcgagcgcttatatgatatcccggctcgatatcccgccttctgccatattgctcgtcacattcacgacaaaagctgtgaaagaaatgaaagagcggatggcctcgctatacggtttgccgatgcagactgtgaaccgcctcgtgacaggcaccttccacagctttttttacaaaattctttatcatcatgatccggccaaatggaatggcgagcacctgctgaaatgggaatggcaaaaagaacagtacatcaaaatggcccttgccgaagaagggcttgatgaaaaagactttccggttgaccaggcgatccagcagatcggctactggaagaacgcttatcttccgggtgaacagattccgcttgaagacgaatgggaaaagcgggttcaccggctgtaccgtcattatgaagaacaaaaagcagcgcggcgccaattcgatttcgacgatatggcatctgcgtgctggcagctgtttcaagaacagccggacattttaaagcgatatcagacgcgctttcacgcgattttgattgacgaatttcaggacattaaccctgttcaatacgccatcatcaagctcttggcaagccccgaaaacaacctgacctgtgtcggggatgatgatcagtcaatctacgcgttcagagggagcagtccttcttttatactcgattttgaaaaagattatccgaaggcgaaaacggtccgcctcacgacgaattacagatcgagccatccgattgtggcaagcgccgatatggtcgtaaggaaaaacaaaaagcgttttccgaaaacattaagcgccgcgagagacgaccgccaaaaaccgctcttattttatccttatgatgaagaggaagaagcgattatgatcgtctctgatatccaagaaaaaattgaaatgggcgcaaagcctgatgacttcgccatcctataccggacaaacagcagcggccgcgccatttttgaacgtctgcaccagtcagccattccgtacacggctgaacaaggcgtccggtcgttttacagcaggaggatcgtccggcagatgctggcctatctctacttaagccaaaatcaagatgacgcggaagccgtaaagcagattttacccgccctctttctcaagcagtccgctttaaacacgcttaaagcgctctcgattacagaagattgcacaatggttcaggcgcttgaaaaattgactgacattaaaccgtttcagcttgataaaataaaaaaaatcgttccttttttcccaggcttaaaaacgatgaagccggttgaagccatctctttcgcagaagaaaagatgggcttttccgattacctgaaaaagcgcggaaacgaagggaacaagctcgaaaaagggtctgacgatctgcgggatctcaaaactgcggcaaaaaaattcaaaacgatccccgaatttcttgagcatgtcgatcatatgagagccgcggaaaagcaaaaagctgacggatacggtgttcagcttttgacaattcatcgtgcgaaagggcttgaatttaaaacggtctatatactgggagtgcaggacggctcgattccgcatgactttgccctggagacagcgagaaaaggcgatgaaaccgctcttgaagaagagcggaggctgctgtatgtcgccatgacccgggccgaggaccgcctgtatatcagcgtcccttccttcagaaggggaagaacggcataccgctcaaggtttttacagcctattttacg

SEQ ID NO: 1538 - DNA, 1729 bp, Bacillus licheniformis
ttgttagctgaattatcgatcaaaaactttgcgattatcgaagaattaaccgtttcttttgaaaaagggctgacggttctaaccggtgaaacaggtgccggaaaatcgatcatcatcgacgccgtctctttgcttgtcggaggccgcggatcgtccgaatatgtcaggtatggcgaaaaaagggccgaattggaagggcttttcctccttgacggcggccatccggtttttgatttgtgcacagagctggggattgaagcctcggacgacatgatcgtcatgagaagagatattaacgcaaacggcaaaagcatctgccgcgtcaatggaaaacttgtcaccattgccgcattgcgggaagtcggcagactgctgcttgacattcacgggcagcacgacaatcagctgctgatggaggacgagcaccatcttcagcttctggacaggttcgcaggagaagaaatcgagaatgctttaaaagcgtatcaggaagtttacagccgctacatggatgtcatgaagaaggtgaaagagctttctgaaagcgagcaggaaatggctcacaggctcgatttaatacagttccagcttgacgaaatcgaatcagcaaaccttgagccgaaagaggacgagcttcttcaggaagagcgccgtcaaattgcaaatttcgaaaaaatatacgaagcgctgcaaaatgcctataatgcgcttcgcaatgagcaggccgggcttgactgggtcggcatggcttcaagcgagcttgaaaacgtctcaggcattaatgaagggctcaataaagtatctgaatcggtagccaacgcttactacattctcgaagattcaacctttcagatcagaaatatgctggatgaactcgaatacgaccccgagcgcctcgattatatcgaatcgcgtttaaacgaaatcaaacagctgaaacgcaaatacggcgctactgtcgaagacatccaagcttattcggctaagatagaggaagaaatcgaccggatcgaaaaccgggacagccacttgcaggctttaaaatcacgactcgaatcaatcggcaaggatgtggcgattgaagcagccaatgtgtccgaaatcagaaaaaaatgggcggaaaagctggccaaacagattcagcaggaattgaaagatctgtatatggaaaaatcgacatttgatacggaatttcatgtgaaaaaagcggaacgggatgatgatgcacccgtcgtcaacggaatgcctgttcagctcacaaagcacggcattgacaccgttcgtttcctgatctccacaaacacgggagaaccgcttaaatccttgtcaaaggttgcttcaggaggagagctctcaagaatcatgctggcgatgaaaagcattttctccgctcagcaggatgttacatcgatcattttcgatgaagtggacactggtgtaagcggaagagtcgcgcaggcgatcgctgaaaaaatacaccgcgtctctatcggctctcaagttttatgcattacccacttgccgcaggtggccgcgatggctgacacccaccttttgatcacgaaacagtcgaaagacgggagaacaacaacaagcgtcacacctttgtcaaaacaggaaaaaatagcggaaatcggccggatgattgccggcgttgaagtaacggatttgacgaagcgccatgcgaaagaacttttaaatcaagctaagctagtcaaaaccagcggat

SEQ ID NO: 1539 - DNA, 1691 bp, Bacillus licheniformis
atgcagcgccataacccggaccagatcgaaatggaagaagcttcatttgtaaaaggaacggtaacggctgtcatatatcataatgaaacaaacctgtataccgtactgaaagtaaaagtggaagaaacatcagagtcttttgaagacaaaaccgtttctgtcaccggttactttcctttgatccatgaagacgatatctacacattttacggaaaaaccgcctcccatccgaaatttggcctgcaatttcaagcggatcatttcaaaaaggaagtgccgacaacgaaagaaggcgtgatccaatacttggccagcgatttatttgaaggaatcggcaagaaaacggccgaggaaattgtcaataagctgggggaaggggcaatcaacaaaattttaagcgacggcgccgtcctgtatgatgtcccgaagctctccaaaaaaaaggcggataagcttgccgctgcccttcagcagcatcaggggctcgagcagattatgatctccttgagcgaattcggcttcggcccccagctgtccatgaaaatttatcaggcgtacgaagcggaaacgctcgataaaatccgcgaaaatccgtaccagcttgtcaaagatgttgaaggaatcggctttatcaaagcagacgaactgggcggcagaatggggatctcaggcaaacatgaagagcggatcaaagcggcgattttatacacggttgaagcgacatgccttcaagaagggcatacgtacatagaaacgagacagctcatcatcgagacgcaaaagctgttaaaccagtcagcaggcgatgaaaaagtaaccgagatggatgtggcggacgcgatcatttccttaggggagcaaaaagagctgttcattgaagatgaaaggtgttattatccgtccctttactacgctgaacaaagctttgccaaaagggtgcagaaaatcgccggacagaccgaatacgatgaccagtttcccgaatcggaattcctgctcgctttaggggagcttgaagaacggatgaaagtgcagtacgcgccaagccaaaaagaagccatacaaaaagcgctgatgtcgccgatgctgcttttgacgggcggaccgggaaccgggaaaacgaccgtcatcaggggaatcgtcgagttgtacagcgagctgcacggcttaagcttaaatccggctgattacaaaaaagatgaaacgtttccgtttgtgctggcagcaccgaccggccgggccgctaagcggatgagcgagtcgaccggtctgccggccgttacgattcacaggcttctcggctggaacggagccgaaggatttacgcacgatgaagacaatccgattgaaggacggctgctcattattgatgaaacgagcatgcttgatatatggcttgccaaccaattattcaaggcgatccccgatcggatacaggtgatcatggtcggagatgaagaccagcttccgtccgtcggtcccggacaggtgctaagggatctgttggcatcgaatgtgattccttctgtcagatgacccgacatttacagacagactgaaggctcttctatcgttgcactggcgcacgacatgaaacagggaaagcttccggaaaacttgcccgccccgacaaaagaccgttatattattcgctgccgccagcagcagatcaaagaagtcgtcgaaaaagt

SEQ ID NO: 1540 - DNA, 2315 bp, Bacillus licheniformis
gtgcaggaaaacggtcaggaatggctggaagaggaaaaacgaatccggcttgttttaaaggaattggatcaaaagcttcattctctaaagggaaaaaccggcggattgaaggaggatatcatcgatttacggaaacatttttggagcgatgtcaccgtaaacatagccgatgaaaatgaagcggttgaaacattttttagcattaaacagcaggctgaggttttggctgagagggaaaggagccataagcagttttacagccagctgaaaaacctgttaaaagtgaaagaatcgccttatttcggccgcgtagattttttggaggacggcgaagaaaacgctgagtccgtctacatcggactcgcctctttaatgtatgaaaaagaagagcggtttttgatctatgattggagagcgccgatttccagtctgttctataactatggacccggcgcggctcaatacgaagttccggacgagacggtcaggggaacgattgagctgaaaaggcaatttctcttcaaaaacggacagctgaaagcgatgtttaatacggatatggcgattggggatgaagtccttcaggaagtgctggggcagcaggccgatatccagatgaaaagcatcgtcgcgacgattcaaaaagaacagaatcagatcattcggaacgaaaagagccgctttttaattgttcggggagcggctggcagcggaaaaacgtcggcggcattgcagcgggccgcatatttgctgtaccgcggccgcgggcagatcgagtcgagccagatgctgctattctctccaaacctgctttttaacagctatgtcgccaatgttctgcctgagctcggagaggaaaacatccagcagacgacgttccaggaatttgtagcgcgccgccttggaaagcaggtaccatgcgagactccgttcgatcagcttgaatattgtttaaccgcttcagacggtgaggagcagcgcatccggatgaaatcgattgaattgaaatccagtctggctttcaaaggcatcatcgatgattacgtcaaatatttggcaaaagggcacctggtgtttaaacatatcacctttcgcggaaaaaggatcatcacaagcggtcagatgcggaaatttttcgcggcccttgatcattcagacacgctgtccaaccggattgaacaaacgggaaaatggctgttgcagctcctgaataaatatgaacgccaggaaagaaaaaaagactgggtcatcgaagaaagcgagctgctggataaagaggaatacttaaaggcttataaacgtcttcaggaggaacagcgctttacggagaatacgtttgacgattatgaaagggagcgaaacctccttgcctccatcgttgccgaaagggagttcaagccgctcaagcaagtggtaaaagcgttcggctttattgattttaaaggaacataccttcagcttttttccggacgctataccccgcaaacgcgccctgatgactggcagagcatttgcacattcactcagaaaagctttcgttttgagaagctgctttatgaagatgccgtcccttttttatatatgaaaaacaagctgaaaggcggggggaaaaacacggcaatccgccatttattcattgatgaagcccaggattacacgccttttcaacttgcttttttggagagcttgtttcccgcgtgcagcatcacgatgctgggagacttaaaccaggcgattcttgcccatgcctatcacgataagacgcttctgtcgggaggcgtgtttgaaggcgaaaaaacggagatcatcaccttgaagcgcagctacaggtcgacgaaagaaattgttgaattgacaaagcgcatcatcgaagggggcgaagagatcgaagcttttaataggaacggcaaaaaaccgactttgacaatatcagccgatcctcatgcacaccataaagagatggcttcccttatgaccgcccttcaaaaagaaggacttgagacgattgcagtcatctgtaaaacagtccgggaatgcagggatgcgttccagcatcttcagcagcatgcagagcttaaactgatcgataaagaaacgagaacgtttcaaaaaggcgtggtcgtcattcccgtctatttggcgaaagggatcgaatttgatgccgtcatcatttatgacgcttctgaaaagcaatacaaaaaggaaagagagcggactttattttatacggcgtgcacgagggcgatgcatgagctgcacctcttttccattggaaaagaaacgcattttttaaacggcgtcccaaatgatatgta

SEQ ID NO: 1541 - DNA, 2421 bp, Bacillus licheniformis
aaccggggaacttcgaagatgtcctttcgggttttccgggtaaaaatgccagagctgagcgaaagttccaaattcgtcatgaaaaccgccccagggtaccagcgatgcgaaagtgccgcttttatccttttacctatgatggccagacgaaaaggctgccgattcccgtttgaaatctatcagacgtctatcctggcatttgatcagcgacgcgcaggagctttttgacggcttgattgctgaaaaaggcgccgatgctgaacttgaggccggctttacgaaggtcggttcttttgtgatcaggactcctgaagtcgaggatgaagaggccggccataagagccgggttccgcagacagagccgctcatttgggaaagagacggcgggctttcttcattggacgaccggtttgacaagagagaaggtcagacaaaaatgatgcgggaggtctggaccgcttttcaaaatcatgagcatgcgttaatagaagccgctactggaatcggaaaatcgctcggatatctcgtgccggctgcaattcacgccaagcaaacaggcaaaccggtcgtgatcagcacatatacgacattgcttcagcagcaaatgataaaccgcgatatcccgcttttggaaaagatttttccatttccggtaaaagccgcggttttaaagggccgctcccattacttatccattcgcaagttcaagcatattttacaggaagatgatgacaattatgatagcgtcctagcaaaagcgcagattctcgtctggctgacagacacggaaacgggcgatttatccgaaattaatctcccgtcaggcggaaagcttttatgggacagactggcatatgattcgcattcatatgcagaaagcagcaacatgaggaaattgtgtttttatgaaagagccaaagcgagggcccagaaggctgatatgatcattaccaatcatgcgcttctgttgactgacgaaaccaatcagcgaatccataccggagatgccgatatgttcattattgatgaagcccatcattttgagcgcgcggcgggcgagcagtatggagctagagcagactatgtctttctccacaaaagattgatgaggctcggcaccctcaagcagaggggtattttgaaaaaagccgaacggctctaccggtcggcaggcatttcatcagaatcctttttccaaatggacgaatggctcgctcagcttcttgaagaaagcgatctattctttacggctgttcattcttttgtcaagaggaggaaaccaagaaacgatctaaaccgtctcttatataagatcggcgaaaccggtgaaagcagagcatggagcaggcttgaagaaggcgcacgaagactgtgttccatgctgtatgacatgcatcggctgtttatggatcaaaagaaaagcctcgctgaaaaacaggcttctttcacaagccgtcaggcgtttttgttagaggaatacgattcgtgcatgaacgaccttgaagaatatcgaaagacgctcggccgcttgatgtttgaccctgttgaagatgaggtcgtctggattgaaattgacgcgaagggcgcaaaaaacgccgctgctatttacgctcagccgcttgatacaagcgaaattctggccgaccggtttttcaccgagaaaaaaagcgttgtcctcacatcggggacgcttgtcgtcgagaactcttttgactatatgatcaaaaagcttggtttaagcgatttctatccgaggaccttgcaaatcgagtcgcctttttcttatgataaacatatgaatatcatgattccgacggatgtcagcccgattcaaaacgatccgggagactatattcaggatgtctcgcgttacgtcaaggcgcttgcaaaacagaaagatgccaaagtgctcgtcctgtttacgtctcatgatatgctgcgagacgtctaccatacattgaaaaatgaggaagactttcctcgtcagctccttgcacaggggatctccggcggaagtcccgttaaggtcatgaagttgtttaaatcgtatcctcatgcggttcttctcggaacgaaccatttttgggagggcgttgactttccgggtgatgagctgactacgctgatcatcgcaaggcttccgttcagaccgcctgaccatccggttgaatcagcaaagtgcgaccgggcaaagagaaggggagaaagtccgtttcaagcggtatctctgccggaagctgtcctggccttcaggcagggaatcggcaggctgctccgctcagagaaagacagcggaacggtcgttattcttgaccgccgcatccgaacctcttcctacggcacggtgtttatgaaggctctgccccctgcaaaagtcatggagcctactttccttgagcttgaagcctacatagccgggaa

SEQ ID NO: 1542 - DNA, 1701 bp, Bacillus licheniformis
  misc_feature (1)...(1701): n = A,T,C or G
ttgtccctttcagggtaagaacccacattcttttctgtttttgaagaaaaccagattttcattgttttgcctgcgaagcgggaggaacgttttttcatttttaagacaaatggagggctattcatttccggaggctgtctctcacctggcggacaaatatcaaatagatctgccgnagcaggtcgcagctgtatcagcatacagcacaggcagttcgaatgaacagaaaatggcggaagctcatgatctgtaaaagaaattttatcatcatttgctcgtcaatacaaaggaagagcaggcagcgctcgattatttgcttgaaagaggctttaagatggagcagatcgagcagtttgaaatcggatgcgcgcttgactcgtgggatttcatcacgaagtttttggaacggagaggttttgatcttgcgctgatggaaagagctggactcatcatcagacgcgagaacggcgacggatattttgaccgtttcagaaacaggattatgtttccgattcatgatcatcacggcacaacggtcgctttttccggaaggacgttcaccggggagcagccaaaatacatgaacagcccggaaacgccgctttttcgaaaaagcaagcttctctatcatttccatcaggcccgccttcacattcggaaagaagaaagggccgtcctttttgaaggatttgccgatgtcatttcagccgtcacctccggtgtgaaagaatcgatcgccacgatgggtacatcgctgacggaagaacatgcgaagatcatcaggcgaaatgtcggagaggtcatactgtgctatgactcggatcatgccggttatgaagccacgctgaaagcggcggagattcttcagaaaaaaggctgcaacgtcaaggtggccatgatacctgacgggctggatcccgatgactacatcaaaaaattcggcagcgagaaattcaaaaatgatgtaataggggccagcgttacgatgatgacgtttaaaatgaactatttccgcaagggcagaaacctgtctgatgaaggagaccgtttagcctatatcaacgatgtactgaaggaagtcagccttctcagcggtcctttggaacaggaaatatacatcaaacagctggcaaatgaattttcaatctcatttgaatccttgaaggatcagctttccgtatttgaaaagcaggctgcaagccgcagcagggaaagcagccgccaggactctaaagagcggcaggcggccgtatcgcgcgcccctcggagaaagacggggcttcggccggctcatgagaatgcggagcggatgctcctggcccacatgattcatgaccgggacgtcattcgaaaggttttggaacgggtgggctttgaattcaaccttgatcagcaccgagcgattgccgcttatttgtacgccatgtatgaagaaggagcggacatttccatccaggagctctttaagagagtcgaggatcaggaacttggccagcttctgacagatatcttaatgcttcaggtgaacgaagaattaagtgaagcggaattatctgattatgtaaaaaaagtgttgaattatcgaaattggtcaatgataaaagaaaaagaagctgcaagggcggaagccgagaggcaaaaagactttatcaaagcggcgactttggcgcaggaaattgttaagttgaaccgttcgctgaa

SEQ ID NO: 1543 - DNA, 1215 bp, Bacillus licheniformis
aaatatttaacgccatgcttgttcttggaaaccgcggcgagcctgtagacctggtgacggtgacatcagagcttgcgaacacggaccttttggaagaggttggcggcatttcttatttgacggatattgcaaattctgtgccgactgcggctaatatagagtattatgcaaaaatcgtggaagaaaaatcgattctccgccgcttgatccgtacagcaacgacgattgcccaagacggatatacaagggaggatgaagtcgaagacctcttaagcgaagcagaaaaaacgattatggaagtcgcccagcgcaaaaactccggggcctttcaaaatattaaagatgttctcgttcaaacctacgataatattgaacagctccacaacagaaaaggggacatcaccgggattccgacaggttttaccgagcttgacaggatgacggcgggctttcaaagaaacgatttgatcatcgtagccgcccgtccgtcagtcggcaaaaccgcttttgccttaaacatcgcccaaaacgtggcgacgaaaaccgatgaaagcgtcgcgatcttcagccttgagatgggcgccgagcagctggtcatgcggatgctctgtgcggaaggcaacatcaacgcccagaatctccggaccggaaacctgacggaagaggattggggcaagctgacaatggcgatgggaagcttatcaaacagcggaattttcatcgatgacacaccgggaatccgcgtcagcgaaatccgttccaagtgcagacgtttaaagcaggagaacggcctcggcatgattttgatcgactacctgcagctgatccaaggaagcggcagatcaagtgacaaccgccagcaggaagtatcggaaatatcccgtgcgctgaaagcgctggcgagggagcttgaagttccggtcatcgccctttcacagctttcccggggcgtcgaacagcgccaggataagcgtccgatgatgtcggacatccgggaatcgggaagtatcgagcaggacgccgatatcgttgcgttcctgtaccgtgatgattactatgacaaagaatctgagaataaaaacatcattgaaatcattattgcaaaacaaaggaacggcccggtcgggaccgtctcactcgcttttgtaaaagaatataataagttcgtcaacctggaacgccggtttgatgacgcgggtgttgcgcctggtgcat

SEQ ID NO: 1544 - DNA, 1837 bp, Bacillus licheniformis
atggcaggctacacgcctatgatacagcaatatttaaagattaaggcagagtatcaggatgcctttttattttttcgtcttggcgacttttatgagatgttttttgaagatgcaaaaaaggcgtctcaggagctcgaaatcacgctgacgagcagggacggaggatcaagcgaaagaattccgatgtgcggggttccttatcattcctgctcttcgtatatcgaacagctcattaaaaaaggctataaagtcgcgatctgtgaacaggtggaggaccctaaatcggccaaaggagtcgtcaaaagggaagtcgtgcagctgatcacacccggcaccgtgatggacggcaaagggattcatgaaaatgaaaacaactttatcgcctctgtcagtaaatttcagcatacatacgggctcgctttttctgatttgacgacaggcgagaatttagtaacggctatcgaaaggcttgatgatgtcgtttccgaaatttactctgtcggagcaagggaaatcgtcgtcagccgcaaccttgacgagaaagacgtcgcaatgctgaaagagcgctgcggcgccacgatctctttcgaggatgaacaagcggatgaagtgcctggcattgtgaacggactggggtccaaagagcttgtcgatacgtttatgaggctttacgtctacttgaagcggacgcagaaaagaagcctcgaccaccttcaaaacgttcaggcctacgagctcgaagaagcgatgaaaatcgatttgtactcgaaacgcaatcttgaactgacggaaacgatccgttcgaaaaacaaaaaaggctcgcttctttggcttttggatgaaacgaaaacggccatgggagggcggctgttaaagcaatggatcgacaggccgctgatcagaaagggacagatcgaagagcgccaggaaatcgttgaaacgctgatcgcccatctgtttgagcgggaagatttgcgcgaacggctgaaggaagtatacgacctcgagcggctcgccggaagggtcgcatacggcaacgtcaacgccagagatttgatccagctgaaggaatcgctgaaacaagtcccggccatcaaacagcttgtcggctccctcgaccatccgaaagcaaaagcgcgcgccgagaaaatcgatccgtgcggcgatcttttgaatcttttggaagacgcgctatacgagaatccgcctctttcattaaaagaggggaacttaatcaaagacggctaccacgcgaaactggatgaatacagggacgcaagcaagaacggaaaagactggatcgcaaggcttgagcagcaggaacgcgagtacacgggaatccgctctttaaaagtcggctttaacaaggtgttcggctattatattgaagtgacgaaagcgaacatccatctgcttgaagaaggccgctatgaacggaagcagacgctgaccaatgcagaacgctacatcacgccggagctgaaagaaaaagaagccctgattctcgaagcggaaaacaatatttgcgagctggagtatgagctgttttccgagcttcgcagcaaggtgaaggaatatatcccgcgcttgcagcagctggcaaaaatgatgagcgagcttgatgtgctccaatgttttgcgacgatcagcgaaaaccggcactatgttaagccggagttttccgatgatgtcgttcaggtgatcgacggacggcatccggtcgtagaaaaggtgatggacagccagtcttacgttccgaacagctgtgaaatgggcaaaggcaggcagatgcttttaatcaccgggccgaatatgtccgggaaaagcacgtatatag

SEQ ID NO: 1545 - DNA, 1835 bp, Bacillus licheniformis
atgggaattacgatgcagcctgtattgactacatcagctccctcaggcggcaattggcggtatgaagtcaaatatgacgggtatcggggtcttttaaagattgctgcgaccggcgaagtttcgctcatcagcagaaactcacagccgctcgaaaacacatttccggaaatttcggaatttgcaaaaagcatgatcgaaactctcaaagaacacttgccgatcacgattgacggggaaattgtgtcgttgacaaaccgttttcgttcccgatttgaatatgtccaaaaaaggggtttgagcaaaaaggccgagttgattgcacaagcagccgcaaagaaaccgtgccagtacttggcttttgatttactggtttttaacggagaaagtttaacctcgctcccctataccgaacgaaaacgcatgcttttcgacctgatgaaagagctcggcctgccgatggctcccgatccgatggctcacgctcgaattcaatacatccctgacacttctgatttccacgacctttggaaggctgttaaaaggtttgacggcgagggaattgtcgcgaagaaaaaagacagccgctgggctgaaaataaaaaaacggccgaatggctcaaactcaaaaactacaaaaaagctgctgtatttatgacaggctacaacatggcaaaccgttatttgacaatcgccgtctatgaccgcggccaaatcaaggaagtcggttcggtttcccacggactcggagaacaggaaagaaacgccattctttcgatcgtcaagcaatacggaaccgaaacaaaacccggtgaatataccattgatccgtcgatttgcatgacggtccattacttaacgattcattacgggacattgcgcgaggtgtcgtttgtttcatttgaatttgacatggcatgggaaaattgcacttacaaccgcctgctgcttcattcaagaaacgtccatcccgatttgcagctgacaagccttgataaagtcatctttcctaaaagcgataaaacaaaagcggattacatcggataccttaatgaaatcggcgattttctgcttccgtttctcgacaatcgggcgcttaccgttatccgttatccgcacggttccggcggagagtctttttttcaaaaaaacaagcccgactacgcacccgaatttatcacgtccattcgggatgacgagcacgagcatatcatctgcagcgattattcggttctgctgtggcttgccaatcagcttgcgttggagttccatatcccttttcaaacggtggatacggcccatccgaccgaaatcgttttcgatcttgatccgccttcaaagtcggagtttccgctggccgtcagagccgcgaaagagctgcaccgtttatttgatcagctcggcctcttatcttttccaaagctgtcgggaaataaagggatacaaatctatattccgatttcaaaaaacgcctttacttatgaagaaacccgccttttcacaagctttgcggcttcttattgcgtctcgctttttcccgatctgttcacaaccgaacgcctgatcaaaaacaggggcggaaagctctatattgactatgtgcagcatgccccgggaaaaacgatcatctgcccgtattccacaagaggcaatgagcttggcacagtggccgcaccgctgttttgggatgaagtccattcagacttgtcacccttaaattttacgatggaggctgtcgtcaaacgcacaaaggaactcggatgccctttcgaaagcttcttcagacagccccaggacaaacagatcaaagctattctcgatcacttaaaagaaaacaa

SEQ ID NO: 1546 - DNA, 1354 bp, Bacillus licheniformis
ttggttaaaaaacagcaagttgactataatgatgattccatacaggtgctcgaaggccttgaagcggtcagaaaacgccccggtatgtacatcggttcgacagacagccggggactgcaccatctcgtatatgaaatcgtcgataattccgtcgatgaagtccttgcgggccatggggatcacattatagtaaaaatacataaagataacagcatatcggtgcaagacagaggccggggaatgccaacaggaatgcataagctcggcaagccgactccagaaattattttgacagtgctgcatgccggaggaaagttcggccaaggcggctataaaacgagcggggggctgcacggcgtcggtgcatccgttgtaaacgccctgtccgagtggctgacagtcacgattgagcgggacggaaatgtttacaggcagcgttttgaaaacggcggcaaaccggtgacatcccttgataaaatcggaacgaccaaaaagaccggcaccctgattcatttcaagcctgatcctgcgatgttcagcacgacgacgtttaactttgaaacgctttcagagcgtctgagagaatcagcctttttgttaaaaggactaaaaatagaattgatcgatgaacgcgatcaaacaaaagaaacgtttttatacgaaaacggaatcgaagcttttgtcgcttatttaaatgaggagaaagacgcgctttctgaagtggtctcatttgaaggagagcacaacggcatcgaggttgacttcgcgtttcagtttaatgacggctattccgaaaacatcctgtcgttcgtcaataatgtcagaacgaaagatggaggaacccatgagtccggtgccaaaacggcgatgacgagagcattcaacgagtatgcgagaaaggtggcccttttaaaagaaaaggacaaaaaccttgaaggaacggatatcagggaaggcctgtcagccatcgtttccgtccggattcccgaagagcttcttcaatttgaaggacagacaaaaggaaagctcggcacaagtgaagcacggtcagccgttgatgcaatcgtctctgagcagctcgcctattttcttgaagaaaacagggaaacggcaacattgcttgtcaaaaaagcgattaaagcctcccaggcgagagaggctgcgagaaaagcaagagaagaggcaagaagcggaaagaaaagaaagaaatccgaagcgacgctctccgggaagctgacgcctgcacaatcaaggaatccatccaagaacgaattgtatctcgtggagggtgattctgcgtgaggatcagcaaagcagggacgagaccggaaattccaggctgtcctgccgctcc

SEQ ID NO: 1547 - DNA, 1027 bp, Bacillus licheniformis
atggtaaaaccgtttgttccccaactcgtctatattgaaccgagagccctggaatatccgcttggaaaagagctgagggataaattttcaaacatgggacttgagatcagggaaacaacttcacacaaccaggtgaggaatatcccgggggaaggccacctgcaaaaatacagaaatgcgaaatccactttggtgatcggcgtcagaaaaacattgaagttcgattcgtcaaaaccgtccgcagaatacgcgatcccgtttgcaacagggtgtatgggtcactgtcattactgctacctgcaaacgacaatgggcagcaagccgtatatcagaacgtacgtcaatgtggaggaaatacttgagcaggcggatcaatatataaaagaaagggctcccgaagatacgcggtttgaagcttcctgcacatccgatatcgtcggaattgaccatttgacacatacgttaaaacgcgccattgagcatttcggtcaaaccgaccatggtaagctgcgtttcgtgacaaaatttcatcatgtcgaccatttgctcgatgccaagcacaacggaaaaacgcgcttccgcttcagcgtgaatgccgaatatgtcattaaaagctttgaacccggcacatccccgttggataaacggatcgaagccgccgtgaaagtagcggaagcgggctatccgctcggttttatcatcgctccgatttatattcatgacggctggcaggaaggctacagagttctgctggaaaagctcgatcgtgcgctgccgcagcatgcgaggcgcgacatcacctttgaaatgatccagcatagattcacgaagccggcaaagagagtcattgaaaaaaactatccaaagacaaagctcgaactggatgaagaaaaacggcgctataaatggggcagatacgggattggcaaatacatttatcagaaggatgaagaagcagagcttcgcagcgcccttgaatcgtatatcgacaactattttcccgaagcaaaaatcgaatatttcacat

SEQ ID NO: 1548 - DNA, 1350 bp, Bacillus licheniformis
atgagtgaaatatcatttgtcacggtcacggctttgacaaaatatattaagcgcaaatttgacgtggaccctcatcttgaagatatttggatcaagggcgagctgtcaaatgttaaaatacatagcagaggccatatttatttcacactgaaagatgataacgcccgcatccaatccgtcatgttcgccagacaaaacaggaatctcgcctttacccctgaaaacgggatgaaagtattggtgagaggcggcatttcggtatatgaaccgagcggcagctatcagctttatgcaaaagaaatccagccggacggcataggtgcgcttcatctcgcgtatgaggaacttaagaaaaagctatcgcaagaaggcttatttgatgaaaaatacaagaaacccatccccgcgttcccatccgtcgtcggtgttgtcacgtctccaactggagcggctgtacgcgatgtgatcaccaccattaaaagaagatatccccttgtaaaagtgatcgtccttcctacgctcgttcaaggagtaaacgcgggcgagtccatcgtaagcagcattgaagaggctaaccgcagagacttatgcgatgtattaatcgtcggtcgaggaggaggatcgatcgaagagctgtgggcatttaacgaagaggccgtcgccagggccattttttcttctgacattccgatcatttctgccgtcgggcatgaaacggattttacaatcagcgattttgtcgccgatttgcgcgcggcaaccccgacaggagcggccgaactggccgtacctaatatgcttgatttgctggagcgtctgaaaacgctcgaagcgagaatgacaaaatcgatgcagcaggacttaaaaaagcggcaggagcgggtgaaaaaccttcagtcctcctatgccttccgatacccgaagcggctatatgcccaaaaggaacaggaattcgacctgatattcgaccgtttccaaaaacagctggcgatgaccgtcgaccgcaaaaaacaaaaactgaacgaacagacatacaagctggagatgcttcatcccgaggagcagcttaaacaagcgcgaaaaaggcatgaagagcaaacagtccggctgaagcggaatatgaaagtgcagctgaagcagattcactcgcagtttcaaacggttcttggtaaactgaatgcattaagccctctccaagtgatggaaagagggtacagtttgacatataaagaaaacgaattgattaaaagtattgaacaggttcatgaaaaagacgagatccgcgtcacattaaacgatgggacgctgacctgtgaggtactgcaaaagagaggcgaaacaaatggctga

SEQ ID NO: 1549 - DNA, 1237 bp, Bacillus licheniformis
ttgtgagttaccaggctttatatagagtgttcaggccgcagttgtttgaagatgtagtcggtcaggagcacatcacgaaaacgttgcaaaatgcccttttacaaaagaaattttcgcacgcttatctgttttccggaccgaggggaacgggaaaaacaagcgccgcaaaactgtttgccaaagctgtcaactgtgagcgcgctccggtcagtgaaccgtgtaacgaatgctccgcgtgcaaaggcattacaaacggttcgatttcagatgtgatcgaaattgacgccgcttctaacaacggtgtagatgaaatacgcgacatccgcgacaaggtgaaatttgccccgtttgccgtcacgtataaagtatatatcatagatgaagtacatatgctttctatcggcgcattcaacgcccttctaaaaacgcttgaagagccgccggagcattgtatctttattctcgcaacaacagagcctcataaaattcctttaacgattatttctagatgtcagcgatttgattttaagaggattacctcgcaggcaattgtcggacgaatgaaaaaaatcgtcgaagctgaacagttaaaggtgcaggacggagccttagacatcatcgccagtgccgcggacggcggcatgagggatgcgctgagcctgctcgatcaggccgtatcattcagcggagaagagctgacggtggatgatgcgctgctgataacaggcgccgtgtcacagcactatattggaaagctcgcctcaacccttcacgaaaaaaatgtttccggtgctttggaaacattgaacgaactccttcagcaggggaaagatccggcaaaattaatcgaggatatgattttctacttcagggatatgcttctttatcaaacggcgcccgatttagaaggcgttcttgaaaaggtgaaggtggacgaagagttccaaaccctatcccggcaaattcccgcatcagacctttacgaaatgatcgatatattaaataaaagccatcaggaaatgaaatggacgaatcatccgcgtatcttctttgaagttgcggttgtgaagctctgcctgggaccaaaagcaggggcatccgcggccgcccagccggaagtggacaatctcgtcaacaaggttcggcagcttgaacaggagattgagaggcttaaaacacaaggtgtgcaggtctcttctgctcccgcccaggctaaagaagcgtcccgtccgcaggg

SEQ ID NO: 1550 - DNA, 1425 bp, Bacillus licheniformis
atgagtaattattggaaagatttgcttcctgtcgatccgtatgttgtcaaaagcagcggattgctgcaggatttggaccggcaaattgtcacgctattgtatcagcctttaatcggctctttttcgttcagcttgtttctcacgctgtggggagagctggagcaaaacagagtctggggaaaaagctcgactcacagacagctgatggcggcgatgcagaccagcctgaagacgatccactcagaaaaggaaaagcttgaggggatcggactgttgaaaacttatataaaagaaacggaacacgaacgtttgtttatatatgaattgattccgccgctcagaccggacgagttctttcaggacggcatgctgaatgtcttcttgtacaaccgcgtcggaaaggcgaggtttcagcagctgaaagaatatttttcccacccgtctgttcctgaagaagcacgggacatcacccgttctttcaatgaagtttttgcatctgtccagccgagcgaatggaagatgtccgacgatatgatcgaagcgatggagcttcgcgaagatcatgaatggatgaaagaagggaatagccaaccggcagcagtcacagacggcgcctttgactttcaactgtttctcgccggtttatctgacacgcttatcccgagaaaagcgctgacagaccaagtgaaggaaacgattaaaaagctggcctttctctacggtatcgaaccgcttcagatgcaaaacgtcgtcatgtcagccgttgacgaacacgatatgatcacgacagaggcgctcagaaaagcggcgagcgactggtatcagatcgagcgcggcggcccgcttccggaactcgtcgacaaagtgcagccgatgaatctccgcgaacagccgaatcaacagtcgtccacaaacgccaaggaagacaatttgatcgctttgcttgagcaagtatcgccaagaaagctgctgcaggatattggcggcggagcggaaccatccaaagccgatctgaaaattatagaagaaattatgcttgaccaaaaattagagcccggcgtcatcaatgttctgatttattatgtcatgctgaaaaccgatatgaagctttcgaaaaattacacgcaaaaaatcgcttcccactgggccagaaaaaaagttcgtacggttagagaggccatgaagcttgcgaaagaagaaaaccgccaatatcttgaatgggcggaagggaagaaaaagacttcccggaacaagaaagtcatcagagaagaaaagctgcctgattggcttcgggaaagtgacgatgctgacagcaaaccgctggaaacagagcaggctggtcctgcaaccagagaaggctttgaccagcagaaacagaagctgctcgaagaagtaaaaaaactgaaaaaccattccgctctttaa

SEQ ID NO: 1551 - DNA, 1599 bp, Bacillus licheniformis
ggaacacaaccatggctgaattacactcaaaactctttagtgccgcagacaacttgcgaagtaaaatggatgcatcagaatataaaaactatttattaggtttaatcttttacaaatatttatctgataaattattagaaaaagtagtagaaatagcgggtgaatcgttagaagaatacaacacacaagacaaacaaactcaattgtatatggaatccttggcagatgaagagataaaaaatgacttgattgaaacgttagtcgacacattgggctatgatattgaaccaaagtatttattcagtgtattagccaaccaagcgaaacaaaacacgtttcatctgaatgacttgaataaggcatttatcgatttgtctacgaaatatgaccaatttaacggtctgtttgatgatgtggatttgaaatcgaaaaaactggggtcggatgatccacaacggaacattaccattactgaagtactgaagaaactaaatgatgtcaatgtgatagaacataatggtgatgttattggggatgcctatgagtacttaattagtcaatttgcctcagaggctggtaagaaagcgggggaattttacacccctcatcaagtatctgacatgatggctcgtattgccgcgattggtcaagaagacaaaaaattgtttagcgtatttgacccaacgatgggatctggttctttaatgttgaatattcgaaactatattaattatccagatagtgtgaaatatcatgggcaagaactaaacacaacaacttttaatctagcgaagatgaacttgatcttgcatggtgttaataaagaagatatgcggttacgcaatggggatacattgaataaagattggccgacagatgagccttatacttttgatgccgtccttatgaatccaccatactctgcaaaatggtctgcagatactacattcatagatgattcgcgtttcaatcgttacggaaagttagcgccgaaatcaaaagccgactttgcttttcttttacatgggttctatcatttgaaagattcgggaacaatggccatcgtcttaccgcatggggtcctgttccgtggagctgcagaaggtgtgattcgtaagaaattattagaagatgggagcattgatgctgtaatcggcatgccagcaaacttattctttgggacatcgatcccaacaacagtcatcatcttgaagaaaaaccgcagcactcgtgatgtgttatttattgatgcaagtaaggagtttattaaaggaaagaaccaaaataaactttctaaagaaaacattgataagattgtcgaaacgtataagaaacgagaagatgtcgagaaatatgcccacgttgcaactttcgaggaaatcaaggagaatgatttcaatttgaacatccctcgatacgtagatacctttgaagaagaagaacctattgatatggctgcaattggctcaaagattaaagatattcgaatagaaaaagcagaactagagtctagcctatatgacatgatttcttcgctacaatatgatgaagaaaatgctgactggatcaagggtgcgttagaggtgtttaatcgtggaa

SEQ ID NO: 1552 - DNA, 1144 bp, Bacillus licheniformis
  misc_feature (1)...(1144): n = A,T,C or G
ttggataaacaaaaaattcaaaaaaaagctggccctcctcccggatcagcctggctgctacttgatgaaagacggcaggataccgtcatctacgtcgggaaagcgaaaatcttaaaaaacagggtccgctcctatttcagcgggtcccatgatgccaaaacacagcgtcttgtcagtgaaattgaagacttcgaatacattgtcacatcctcgaacatcgaagcgctcattcttgaaatgaatttaatcaaaaagtacgacccgaaatataacgtgatgcttaaagatgataaaagctacccgttcattaaaatcacgaacgagcggcatccgaagctggttgtcacaaggaaggtcaaaaaagacaaaggccgctatttcgggccgtaccccaatgtccaggctgcgagggaaacaaaaaagctgctggaccgcctctatccgctcagaaagtgcgccaagctgcctgaccgcgtctgtttgtactatcatctcggacaatgtctggcgccatgcgtatatgatgtgtctgaggagacaaacagacagctcacagaagaaattacccgctttttaaaaggcggctacaatgaagtgaagaaagagcttgaagcaaaaatgctcgaagcctcggaaaacctgcagtttgaacgggcgaaagaattccgcgatcaaattgcccatatcgagtcaacgatggaaaaacagaaaatgatgctgaatgacatggttgaccgcgatgtatttgcctattcgtatgacaagggctggatgtgcgtccaggtcttcttcatcaggcagggcaaattgattgaaagagatgtcagcatgtttcctttatacaggnaagcagacgaggaatttctgacattcatcgggcaattttactccaaaaacaaccattttcttccgaaggaaattttggtgcctgacagcgtcgacaaggacatgattgaggagcttttggacgtgaacgtgcgccagccgaaaagaggagcgaaaaaagacctgctgctccttgcccataaaaatgcaaagctcgctttgaaggagaagttttcgctcattgaacgggatgaagagcggacgatcggcgcgattgaaaagctcggaaaagcgctggacatctacacgccatacagga

SEQ ID NO: 1553 - DNA, 1230 bp, Bacillus licheniformis
aggggagagtcatctttcatatcgatatgaacagcttttacgcgtctgttgaaatggcgtatgacccttcgctgaaaggcaggccgctagccatcgcgggaaatgcgaaggagcggaaaggaatcgtcgtcacgtgcagctatgaggcgagagcacgcggcgtcaaaccgcccatgccgctctgggaagcgaagcggctctgtcccgagctgatcgtcaagccgccgaatttcgaccgctacagaagctcttcaagagaaatgtttcaagtgctcagggagtacacggaccttgtcgagcctgtttcgatcgacgaagggtacatggacttaacggatacgccatacagaaatcgggcatgcgaaacggcaaaggaaattcaggagcgccttcaaaaggaactgctgcttccgtcaagcatcgggatcgctccgaataaattcctggccaaaatggcttcggatatgaaaaagccgctcggcattacgattttgagaaagcgtgaagtgccccggattctttggcccatggacatcagcgagatgtacggagtcggccggaaaaccgccgaaaagcttaagacgctcgagatcgaaaagatcggcgatttggctgccgcagatgagtatgctttaaagcgcctcctcggcatcaacggcccccgtttaaaaagaagggcaaacggcatcgacacaggagaagtgaatcccgacagaatatacgaattcaaaagcgtcggcaattcctcgaccctcccgcatgacagcacagatgagaaagagctgttcggactgattgacaagctttcaatctcagtaagcgacaggctgaagcgaaaagaggtcatggcagcaaaagttttcatcatgatccgctttgcggactggacgaacataacaagaagcaagacccttctgaatccgaccgattcaaaagacgaaattgcgaaggaatcgaaagcccttttcaggcagcattggcacggaagccctgtcaggcttttgggcgtgacgggaacagacctcgtcaatcgaaaggaagccgtcaaacagcttgatttgttttcctttcatgaggatgccaaagatgagccgatccaaaaagtgatggccgaactgaatgaaaaatatggaacagacctcatcaaaaaaggggtcaggattgtgaaaaaagaaagcaaaacgagcggaacaagctttaacaaagattttttccaagacgagagacaag

SEQ ID NO: 1554 - DNA, 1072 bp, Bacillus licheniformis
atgaagtttacaattcaaaaagaccgcctggtcgaaagtgtccaagatgtgttaaaagccgtttcttcaagaacgacgattccgatcttaaccggtattaaaatcgtggcctctgatgaaggggtctctctgacaggcagcgattccgatatttcgattgaatcgtttatcccgaaagaagacggcgatttagagatcgtgacaattgaacagcccggcagcattgtgcttcaagcccgttttttcagtgaaattgtcaaaaagctgccgatgtcaacagtggaaatcgaggttcaaaatcaatacttaacgatcatccgctccggcaaagcagagtttaacttaaacggtttggatgcaagcgaatatccgcttttgccgcaaattgaagagcatcacgcttttcaaattccgaccgatctgctgaaaaacctgatccgccaaaccgtttttgcagtgtccacctcagaaacacgcccaatcttgacaggtgtaaactggaatgtcactggcggtgaattaatatgcactgcaacggatagtcatcgtcttgcgctaaggaaagctaagctcgacattaacgaagacagttcatacaatgtcgtcatcccaggaaaaagcttaaccgagctcagcaaaatccttgatgaccatcaggagcttgttgatattgtgattaccgaaacacaagtgctgtttaaaacaaaaaacgttctgtttttctccaggcttcttgacggaaactatccggatacgaaccgcctgattcctcaggaaagcaaaacgaacttgattgtcaatactaaggaatttctccaggcgatcgacagggcttcgcttttggcgagagaaggacgaaacaacgtggtgaaactttccgcagccgccaatgagtcgatcgaaatttcttcaaactctccggaaatcggaaaggttgttgaaacggtgaatgccgagcaaatcgaaggggaagacttaaagatatcctttagtccgaaatatgtgcgggaaccataaaagttctggagggaaggccatattaggaaactcaaaggggtaaggaagcacttcg

SEQ ID NO: 1555 - DNA, 1188 bp, Bacillus licheniformis
tcgaaatagagaacacggtttttaccggtttttcgcgggataatttgacgtttaatattttaaaaggcgcaaacagggaccgttttatcgaatcatatgtggagaaaaaccgctcagaggcgggaattatctatacagcgacaagaaaggaagccgaaagaatatcaagccgcctctctcaaaaaggaattgcggccgggtgctatcacggcgggatggatgatgaagaaagagaccggcagcaggatctctttttaaatgatgagatcagtgtaatgacagcgacctcggcgtttggaatgggcatcgataaatccaatatccgctatgtgattcatgcccaaattccaaaaaatatggagagctactaccaggaggcgggacgagccggacgcgacggccttgacagcgagtgcatcctgctgttttcccctcaggacattcggcttcagcggtttttaatcgaacagtcgacagaagatgaagacattcgggcgcaagacgtgaaaaaactgaggcaaatggttgatttttgccatacggaaggctgtctcgaacggtttattctttcttattttggcgaagttccaaccgaagactgcggcaggtgcggcagctgtctcgacacccgaagcatcaccgatgtgacgaaggaggcacagatggtgctgtcctgcatcatccgcatgggagaaaggttcggaaaaaccatggtggcgcaagttctggcaggttcgaaaaataagaaagtgaccgaaaacggcttccagcaattatcgacttacggaattttaaagaaacggtctattgccgacataagcgattttatagagtttttaatcgcagatgagtacatcaaaatgtccgacgggacatatcctgttctctttgtcgccaacaaggggcgaaacgttttgctcggccgggaagcggtgatgcgcaaagaaaaaatgcaaacaaatcaaatcgttaaagatgacgaattgtttgaacggttaagggcgctgcgcagaaagcttgctcaggaacaaggcgtgcctccttttgttgtattctctgacgaaacgctgcgggaaatgagcgggaaagtccctctgacagacgaagagcttttgtcagtcaaaggagtgggagaacaaaaaagagtaaaatacggagctgtatttctacaggagcttcaagcctata

SEQ ID NO: 1556 - DNA, 890 bp, Bacillus licheniformis
ttgttgaaaatcggttcacacgtctcaatgagcggaaaacatatgctgcttgcggccagtcaggaggcaagctcctacggcgccaatacatttatgatctatacgggagcgccgcagaacacgcgcaggaaaaaaatcgaggatttgaatattgaagcgggaagggctcacatggaagagaacggcatctctgatatcgtcgttcatgccccgtatattatcaatattgccaatacaacgaatccggccacatttgagctcggtgtcgagttcttgcgttctgaaattgaaaggacgtcggcgatcggcgccagacaaatcgttcttcacccgggagctcatgtaggcgcaggcgcagaaacgggcattcaaaaaatcatcgaaggattgaacgaggtcatcgacccgaatcagaatgtgcagatcgctttggaaacgatggccgggaaaggttcagaatgcgggcggacgtttgaggagcttgcacagatcatcgacggcgttacacacaacgagcatttatccgtctgcttcgatacatgccatacccatgacgcgggttacgatgtagtatccgactttgacggtgtcttaaacgaattcgataaaattgtcggaatcgaccgtttaaaagtgcttcatattaatgacagcaagaatgtcagaggtgcgagaaaggaccgccacgaaaacatcggattcggagaaatcggttttgatgcgctccaatacatcgttcaccacgatcagctgaaagatattccgaaaatccttgaaacgccttatgtaggagaagataaaaagaacaaaaagccgccttaccggtttgaaattgaaatgctcaaaaataaacagtttgatgaagagctgcttgaaaaaatcaagcagca

SEQ ID NO: 1557 - DNA, 895 bp, Bacillus licheniformis
gtgacagcatctcgtctgcctttttcattaacaaaaacaaaaaacttttatgaagaactgaacaattggatcggtgatgtattttacgatattcttcctgaaaaaggctttgatttgcgcgatgagcaaatattcatggcttttcaattagagcgggcatttaaggaaaagaaggtcatgtttgcggaagccggcgtcggcaccggaaaaacgctcgtctatcttctgtttgccttgagctatgccaggtatacgggcaagccggcggtcatcgcctgcgcggatgagacgctgatcgaacagctcgtcaaaaaagaaggcgacatttataaaatttccgagcatttaggcctgacgatcgacgcaaggctcagcaagtcgcatgatcaatatttatgtttgaaaaaactggagaaaacgatgcagcgctctgatgatgaaaaatggcttgacctttacgaaagtctgccgtctttcgttcacgaatcgcagggcatgcaggctttttatccgtacggcgaccgaaaagagaattcgtctttatcaaacgatgagtggtctgaaatcggttacgactcttttcaggactgtcttacatgtgatatgaggcaccgctgcgggctcacactgtcaagagaccattatcgaaaatcaaccgatttcatcatctgttcccatgatttctatatggagcacgtttggacggaagaggcgagaaagcgggaaggccagcttccgcttttgccggagcacagcgcatgggtttttgatgaagggcaactgctcgagtttgcggcccaaaaagcgctgacatacagggtgaaacaatccacgctcgaaatggtccttgagcgcctgctcggcaatgacatctgagaagtatttgcagagcttg

SEQ ID NO: 1558 - DNA, 1026 bp, Bacillus licheniformis
ggtatttgatgtttggaaaagcttgaaaaaaggcgacattcatcccgtttattgcttgtacgggaaagagacgcatcttctgcaggagacggttcaaaggatcagacaagccgttgttgatgaagagacgaaagactttaacttctcgatatttgatctggaagaagacgcgctcgatcttgccgtggaggatgcggaaacctttccgtttatgggggaaaggcgtcttgtcgtggcgaaaaacccggcgtttttaacagctgaaaaaaagaaggataagcttgagcataatctcggtgtactggaagcttacattacgcagccggcaccttattccgtgtttgttttgcttgcgccttatgaaaagctcgatgaacggaaaaagctgaccaagctcctgaaaaagcatgcgcacatggtggaagcgaaggaattaaccgccaaagaaacggctgactttatcgcaggcctcgcgaagtcggaaggcaaacaaatcgaaccggaagcggcggaggagcttgtcctgttatgtcatgcaagtctgtcagccattgcccaggaggttaaaaagctcagtacatataccggtgaccgcggagagatcaccatagaggatgtcagaaagcttgtagcgagagggcttgaacaaaatattttcgaactgatcaataaggtcgtcaatcggaaacgtacagaagcgctgcagattttctacgatctattaaagcaaaatgaagagccgattaaaatgatggcgctgattgctaatcagttcaggctgctgatgcagaccaaatatttttctgaccagggatacggacaaaagcaaatcgcctcaaaccttaaagtgcacccgttcagggtgaagctggcgatcgagcaggcgaggcttttttcagagcaggagcttaggaacattatcgagcagctcgccgtgatggattatgaaatgaagacaggcaaaaaagacaagcagctcctgcttgaactgtttttgctgaagctgctgcagcctcatgaaaaaaa

SEQ ID NO: 1559 - DNA, 976 bp, Bacillus licheniformis
atgcgaattttacatacagcggactggcatttgggaaaaacgcttgaagggagaagccgactgaaagaacaggaggattttcttgaagagctcgcaaggatcgtaaaagatgaaaagatcgacgctgttatcatggccggagacgcttttgacacagtgaacccgcctgcactggctgaacagcttttttatgaaagcctctcagccttgtctgacaaaggaaaccgtccggtcgtcgtgattgccggcaatcatgacaatccggaccgcctttccgcggcctctccgttaacgacagaccacggcatccacttgatcgggtacccgaggactgcgccggttgacatagaagtcgcttctagtggggagatcttgtcagtcgcggcgctcgcctatccttccgagtccagactgaatgaagtgctgtcggagacatttgatgaaaagctgctgcgcgaccagtatgatgagaaaatcaagcagacctttcagcgtatgtgcagcaaggcgagaaaggacgcggtgcagattgcggcaagccatatctatgtggccggcggcagccagacggattccgagcggccgatcgaagtcggaggcgcatatacggtcgctgcggaaagcctgccggaaaacgccgcatatgtggcgctcgggcatcttcatcgcccgcagacgatcaaaagggcccgcacgcttgccagatattcaggctcaccgcttgcctacagcttttccgaagcgggatacgcaaaatcagtcaccattgtcgaagccgcacccggtcaaacggcatcatgggaagaggtccatttgacgagtggaaaaccgctcgtcaaatggaaggcggaaaaagggatgtcccaagtgtacagctggctggaggaagagcgggataaaaacgcgtggatcgatcttgaaatccatctgacagaccagctgtcgattgaagagattcaccgattgagaaaagcgc

SEQ ID NO: 1560 - DNA, 792 bp, Bacillus licheniformis
aaaaatttacaaatgagttcattaactcgatccgtgacaataaagctgtcgattttcgcaatcgctatcgaaatgttgacgttcttttaatagacgatattcaatttttagccggaaaagaacagacgcaagaggaatttttccatacgtttaatacgctgcatgaagaaacaaagcagattgtcatttccagcgaccggcctccaaaagagatcccaacgcttgaagaccgtttgcgctcccgttttgaatggggattgatcactgacatcacgcctcctgatctggaaacaagaattgcgattttaagaaagaaagcaaaagcagaaggacttgatatcccgaatgaagtcatgctttatattgccaatcagatcgacagcaatatcagggagctggaaggggcattaatcagggttgtcgcatattcttccttgatcaataaagacattaacgccgatctggctgctgaagctttgaaagatatcattccttcttcaaagccgaaagtcattacgatcaaagacatccaaagaatcgtcggccagcagtttaatatcaagctggaggatttcaaggcgaagaaacggacaaaatcggtggcttttccgcggcagatcgctatgtatctatcaagagaaatgacagattcttctcttccgaagatcggcgaagaatttggcggacgcgaccacacgacggtcatccatgcccatgagaaaatatcaaaactgctgagcgatgatgaacagcttcagcagcagattaaagaaattaaagagcagctgagat

SEQ ID NO: 1561 - DNA, 936 bp, Bacillus licheniformis
atgatggagccgattaaacgcgctttgcaaggcgtgacgacgagacccgattttaaaaaacgccttgaagatatgaaagaaaaagtgctctctgacaaggatgttcaggcgtttttaaacagccgccagtcagaagtggatcaaggaatgatcgacaggagccttaacaagctttatgaatatacacagcaaagcaaagcatgccaagactgcccgggtctgaaagaatgcaaaaacctgatacagggttatcatccaaagcttgtgctgaacggaaaaacaatcgatgttcaatacgataggtgtccggaaaaaaagaaagcggacgagagggaaagacagaggtcgctgattaaaagcatctatattcaacaggatcttctgaatgctacgtttgccgatattgacggagatgacccgagcagattgaaggtccttcagcttgtgacgggattcttgcatgactataacgaaacgggaaagggaaaaggcatttacgtctacgggaagttcggggtcggaaagacctttatgctggccgccattgcaaatgagcttgccgcaaaggatcatccgtccattctcgtctatgtccctgaatttgtcagggagctgaaaaatgcgatacatgatcagtcgcttgaggaaaagcttgatatggtcaagtctacgccgattctgatgctcgatgacatcggtgcggagtccatgtcaagctgggtgagggatgaggtgctcggcgccatccttcagcacagaatgtcccagcagctgccgacgtttttctcttcaaactttgatcctgatgaactgaaacaccatttcacctattcgcaaaggggagaaaaagaagaagtaaaagcggcaaggctgatggaaagggtgctgtatttagcgacgcctgtccggctggacgggaaaaaccggcgtcagtaa

SEQ ID NO: 1562 - DNA, 864 bp, Bacillus licheniformis
tacaaatagaaaagaattattcaaaatatacaattgtgggttacatttcttccattgaagactttgaacgctttttacacgttcagggcataaagggttttgaagacgtgacttatccggatgtgagaattttcttgacggaagcgcatgaaaaagggctcactcgcaggacgatcagcaagaaaatttcggctctgcgtagcttctataaatttttattaagggaaaagctggtaaaagaaaacccgtttctgcttgtcagtctcccgaaacaggataagcggattccgaagtttttatatgaaaaggaacttgaagaactgtttgaggtttcggatttgagtacaccgctcggccaaagaaatcaggcgctcctggaatttctctacgcgacaggcatgcgggtaagcgaactttgcagcctgaaggaatctgatttggatctgtttttagatacggttttggtccacgggaaaggcaggaagcaaaggtatattccatttggttcattcgcccgggaggctttggatctgtatttgcaaaatggaagacgcatccttctgttaaaagcgaaagagccctgcccttttatttttttgaatcaaaggggcgggcccttaaccccgaggggggttcgttacattttgggagaactggtcaagaagacttcgggtacattacatatacatccgcatatgctccgccatacatttgccacccatttgttaaatgagggtgcggatctgaggagcgttcaggaactgcttgggcattcaaatctttcttcaacccaggtgtatacgcatgtatctaaagatatgctcagaaagacatatatgtctcatcaccctcgggcacataaag

SEQ ID NO: 1563 - DNA, 768 bp, Bacillus licheniformis
atgttatttgatacacatgctcatttaaacgccgagcaatttaacgaggatttggaagaagtcattgctcgggcaaaggaagaaaaagtggagcacattgtcgtggtaggattcgatcgtccgacgatcaagcgtgcgatggaattgattgaagaatacgattttatttatgcagccatcgggtggcatccggttgacgcaattgatatgaccgatgaagatttggcttggatcaaagacctgtccgcccatgagaaagttgtggcgatcggagaaatgggacttgattatcattgggataagtcgccgaaggacgttcaaaaagaggtgttcagaaaacagatcgctttggcaaaagaagtcggcttgccaatcgtgattcacaaccgtgatgcaacggaggatgtcgtttctattttgcgggaagaaggggccgaggaagtcggcgggatcatgcactgttatacaggaagcgctgaaattgcacaagagtgcatcgatatgaatttctacctatctttcggcggacccgtcacatttaaaaacgccaaaaaaccgaaggaagtggtcaaacaaataccaaatgaccggcttttaattgagacggactgcccgtatttaacgccgcatccatacagaggaaagcggaatgaacctagctatgtcaaacttgtcgccgaacagattgccgaattaaaaggaatgacttatgaagaaatagcggccgtcaccacagaaaatgcaaaaaaacttttcggcatcagctga

SEQ ID NO: 1564 - DNA, 881 bp, Bacillus licheniformis
atgaacaagaagctgctgcttgtagacgggatggctttattattccggtctttttttgcgactgcggtgcaccgcaattttatgctgaatgacaaaggcgtgccgacaaacggggttcacggttttttaaagcatctgttaaccgctgcgtctgcgtttgaaccgagccatgtcatctgctgctgggacatgggaagcaaaacgtaccgaaacgatttatttaaggactataaagcgaaccggagcgagccgcctctagaattgattccgcaatttgacatggcgaaggaagcggcggaagagctcgggattttaaatatcggccttgcgggctatgaagccgatgactgcatcggcaccctgacagcgatgttcagcgaagaagcggacatcacgatcgtcaccggtgataaagatttacttcagcttttaacagtcaatgttaaagttgccctgcttcaaaaaggaatcggcaattataaggtatacacagaagaatcattcagtgaagagacaggtatcgaaccgaaagctttgattgacattaaagcgctgatgggcgatacaagcgataattatccgggtgtaaaaggcatcggcgaaaaaacggcctacaagctgatcaaggaatattcgactgttgaccggctgctggaaaacatcggtcagctgacgaagggccagcagacgaaaataaccgaatgtctagaagatctgaagatgtccagaattcttgcagaaattaaatgcgatgtaccgctttcctgctcattggacgatgcggacttcaccttgatgcatgacagggcaaaggagatgctgagacttcatcaaatacggggaatcgagccgctgctgatgaaattcgaaaaaagagagat

SEQ ID NO: 1565 - DNA, 864 bp, Bacillus licheniformis
atgtggaaggaaactgtaagcgtaacaccgccttatcattttgaccgcgtgttggacaggctttcgcttgatccgctcaatgcggtcaacctcgacaaaagggaggtcaagctgccgctccgcaatcaaaacaaagagcctcgggttgtcgctgtgcaggcgacgggaactgctgaagccccggcgtttgccgtcagcggaatagacgatcgagatgacatgataaaagaagtgaaacggatcttcagatgggaagaaagtcttcagcctgtactggatcacttttcacaatcaagcctatcatcgatttttgaggagcatgccggaacgccgctggtgctcgattttcatttgtatcattgcctgatgaaatgcattatccaccagcagctgaacctgtcttttgcttatacgctcacggagcggttcgttcacacttttggagagcaaaaggacggggtctggttttatccgcttcccgaaacgattgcacagcttgactacaacgatctgcgcgaacttcaattcagcatgcgaaaggctgaatatgtcatcgatacatcaaggatgatcgcagacggccgtttagatcttgatgagcttgatcaattatcagatgaagatattatggaaaagctggtgaaaatcagaggaatcggcccgtggaccgtccaaaacgttctgctgttcggactcggccgtcccaatctgtttccggcagccgatatcggcatccaaaatgccatcaaacgccattttggcttaaacgataaaccgacaaaagaacaaatgcttgaaatgagcaaagaatggcacccttatttaagctatgcttccttgtatttatggaggagcatcgagtag

SEQ ID NO: 1566 - DNA, 1217 bp, Bacillus licheniformis
ttgacaaacatcactttcattcatgcggcagatctgcatctggacagtccgtttcacggcatcagccagcttcccgaggagatttatcagcggatcaaaaacagcacatttaaaagcgctgaaaatgtgtttaagcttgccattgatgaacaggccgacttcattttgcttgccggggacctgttcgacgaagcaaaccgcagtttaaaagcacagatgtttttgagaaaacaatttttaaagcttaaagagaacaacatccaagtctatgtgatttttggcaatcacgatcatctgggcggcgattggacgccgattgaatggccggacaacgtccacatcttttcagcggaagacattgaagaaaaatcgttttacaaagacggccggctcgccgcaagcatctacggctacagctatcccgagcgctcagtttatgccaataaagccgctgaaatcaaaaaacgaccgacgcgcccttgcatatcggcatgattcatggaacggctttccggggagagcgggcatgacccgtactgtcctttctcccttcaagatttaaaaaacggacagatggattttggggggcttggacatatacataaaagacaggtcttttcagtcacccatccgtcggtgatttatttgggaaacacacaatcccgccatatgaaggaaacgggggagaaaggctgctatctcgtcaatgtttgcggcggagaactgtccttcgaatttaaagccgtatcggatgtcctgtgggaaacggccagcatcgatatctccgggacaaagcagatgacagagctgatcagcctcatgcacgatgcctttcaatctttcagaaaaagaggcaagcccgcatgcgtcaagatggtatggacaggagaaacaccctcttatttggcggaaggacaggccggcatcgcggacgagatccttgacatcttccatgaagaagaacgggaggaagacgcgttcatctggcttaccgcgatcgaagatcaaaccgatgccgccttgtcgggaatcgaacgggacgcttttttccaggagcttttgcaagaaatccatgagtttcaagatttcagcctgattcttgacgatttggagcggcatccggtctttagaagacacggagagctgtttaatgaggaagacttccgggacattcgcacgcaggctgaaaaactgctgcttcatgaactgaagacatt

SEQ ID NO: 1567 - DNA, 2277 bp, Bacillus licheniformis
atgcgatggttcagaaaaacgttgacaagttttgttctacgaaagttattagctcgcaaagcaggagtagatcgtaccattatgctgattgaccgaaaagacttagccaatcaaacaccgacagaattcaccaagtttgcttccgagtttaataccggtatttcttctggtgatgcaatatcgaatagcttgattgtcggaactggaagtgcgaaggagttaagtgatactctacagtctgatgccaattccaatacagtgattattaccactcgtcaaaaattagaagctgccttgcgctatgcccaaaggcaagaggagcaaaaaggtactcagcgctttaagaaactgctagggcaacatattgtctttgtcgtggatgaatgccatcgtgcgttaagtgcagaagggatgcaagtcattaagggattcttcccaaattcaacttggtttggatttacaggtacaccgatatttaacgagaataaaaaacaggctaaaggtcaattagctcgtaccactcgggatcaatatggagaagttttacacacctataccattaaaaatgcattggatgatggtgctgttttagggtttcaagtagagcacgaagatacaattgatccaacatcattaaataattatatttttaatcaactgcgtcaaaatgaaaaatacgccaatttgactgcagatgaaataaataacatcattgatcaaatggatggaacagaaaaggaagcatatcttgaaccttcttcgtttgaaagtgatgatcatattcaaaaagttattcataagattttcaggccggataatgcctatactaaatttgatttccaaaacggccgcccgcaaaagtctgccattttaacaactagttccattgatatggcgaagcgctactatcgggcaatcaaggaaatgatgaaagattcagattggttgacgaaagaatttgctggacatccgatccgaacgggacgaacgattgaagatccggattttccacgaattgcaatcacctattcgattcaagaaaacgaagacaattctaaacaaattcaagatgaaatgaaagagattattaaggaatataatgattattatcacactgcttggtcgatagaagatattgaacgatataatggtgatattaacaatcggttagctcgtaagaaagcagagttcaaagaatttggtaaacaaattgaccttgtcattgttgtcgatcggttgttgactggtttcgatgcaccaacgattcaaacgttatttgtggatcgaaatttaagttatgcgaatttgattcaagctttctctagaaccaatcgtacttatccaggaaagacaaaaggattagttgtgacatttaggaaaccttcaacaatggagcaaaatgtaaagaatgcgacgaagttatactcgcaagcacaagaggaatctagtcttgtttatccgacttatgatgaatcgaagaagcgctttaaaaaggctcacaaagcgctaactacattagttccaaatccaaccgatattgatgagaacacatctcttgaaacccgaattgagttcgtgaaagcatttcaagagctaaacaattcatatgaagctttagttacatataatgactacaacgatgatatgaagaaatcaccagcacttcaagaacaggtgaaaaccttagaagaatacattggtatatataacacggttaagggttcactcgaagatgaaggaaaccaagatggaccgggaccagatttctcagacattgaattttatggggaaaatgcagttaagatctatgatattgactcaacttatattgaccgactattagaaacatactcggccaataatcagaacatccgcgacgagatcgaaaatgcccttcaaaaactgaagaaatcagaaattgttaaaggcgtataccgcaagatgttaaatgctattgatgccaatgaaatagatgcagaggaagatattcttgcagtgaaacgaagctttttcactaaagcacgtgacaaagcgattcatgaatttgcgaatacgtggtttgtagaagaagatgagctgcatttatctgcaattcaatatgtgataggaataaattctattcctaatataagtaaaatcaacaatagtgggcaatttgataagtataaagccgtacatccagatgcaaaaccattgaaatatagaccagaaatcaaacgtcaatggaaaaagacattagatgaagtcattgtacctttggatgatgagttgagataa

SEQ ID NO: 1568 - DNA, 826 bp, Bacillus licheniformis
gtgccggaattaccagaagtcgaaacggtccggcgcactcttgccgggcttgtaagagggaaaacgatcgatgcggttgatgtcagatggacaaaaatcataaaacgtccggaggagcctgaggaattcgcaaggctcctggccggccagacgattcagtcgatcggaagaaggggaaaattcctgttgtttcatcttgatgattgtgtcatggtttcccatttgagaatggaaggaaagtacgggcttcatcaaaacgatgaaccccttgataaacatgtgcacgtcattttcaggttcacggacggaagcgagctgcgctaccgggatgtcagaaagttcggcaccatgcatttgtttaagccgggagaggaactgacagagctgcctctcaggcagctcggccccgagcccttcagcagcgaatttacagccgattacttaagagagcgcctgaagaaaacaaaccgctcggtgaaaaccgcgctgctcgatcagcggacagtcgtcggactgggcaatatttatgtcgacgaggctttgttcagagccggtatccatcccgaggcaacagcgaacaagctcacaaaaaaacagacggttcttctccataaagagatcattcaaacgttaaaggaagctgttgaagcagggggaagcacagtcagatcttacatcaattcacaaggtgagatcggcatgttccagctcaaacttttcgtttacggcaggaaagatgaaccttgtaaaaaatgcggatctccaattgaaaaaacagtcgttggcggaaggggcacgcatttttgcataaagtgccagaaaaaat

SEQ ID NO: 1569 - DNA, 653 bp, Bacillus licheniformis
gtgttaaatctaaaacaaattgaattctgtttagacaagataggtgaaatgtttccggatgcggagtgtgaattagtccattccaatccgtttgaattagtggtggctgttgctttatcggcccagtgcacagacgcgcttgtaaacagagtgaccaaaacgcttttccaaaaatataaaaaacctgaagattatcttgcagttccgcttgaagagctgcagcaggatattaaatcgatcggtttatatcgtaataaagcgaaaaatattcaaaagctgagtaaaatgattattgaagattacggcggagaagtgccgagagaccgcgatgagctggtgaaacttccgggtgtcgggagaaagaccgctaatgtcgtcgtttccgtggcattcggcgttcctgccattgccgtagatacccatgtggagagagtttcaaaacgattgggcatttgtagatggaaggattcggttctggaagttgaaaagacgctgatgaaaaaagtgcctgaatcagattggtccgtcactcatcaccgcttgatttttttcggccgctatcactgtaaggcgcaaagaccgaaatgcgaagaatgcccgttgttttctctgtgcagggaagggcaaaaacgatataaaaaagggctggtgaa

SEQ ID NO: 1570 - DNA, 888 bp, Bacillus licheniformis
attggcggaagccggagaggcattctttacaggttctgcggaccgcgggctttccgaagaagccgaacaaaaggtgaaggatctgatcggccgtgcgcgcttttcagagtgcagtcatgagtcgatacggaaagccttccagcttgccatactgaaaggccagaaagatattcctcatccgaacaggcagatgacgcccgatacgatcggattatttatcggatatcttgtgaacaaatttatggagcggaaaaaaggattgacgctgtttgatccggcggtcggcactggaaacctgctgcttgccgttttgaaccagctggctgaggaagcgggaaaagcgttcggctcagagattgatgacgtcctgatcaagctggcctatgtccaggcaaacctgcaggaaaaggaaatcgagctttttaaccaggacagcctgcagccgatttttatggaacatgccgatgcggtcatctgcgatcttcctgtcggatattatcctgatgacgaaagtgcgcgcgctttcgaattaaaggcagatgaaggccactctttttcacaccatttgtttattgaacaaagcttgacctatacgaaaccgggcggctatttattttttatgattccgaaccatttgtttgaaagcggtcaaagcgaaaagctgcgtacctttttaaagaacaatgcgcatattaatgcagtgcttcagcttccgctgtccattttcaaagatgaagcacacgcgaagagcattttggttttacaaaagcatggggaacaggcgaaagcgcctaaacaggttctgctcgcgcaagtcccgtcattcgccaatcaggatgcgatgctgaacatgacagccaaactcgacagctggttccaggctgaaaa

SEQ ID NO: 1571 - DNA, 877 bp, Bacillus licheniformis
atggataaacttcatcaggcgctccgcaggtattttggttatcatgcttttaaaaaaggccaggaaacgatcatcaaaagcgtgctggagggacgggacacggtggcgatgcttccgacaggaggcgggaaatcgctgtgctatcagctcccagggcttttgttagacggcaccgtcctgatcgtctcgccgcttttgtctttaatggaagaccaggtgcagcaattgaagatgcgcggagagaagagagctgccgccttgaacagcgctttgacacaccaagaaaaaaatgacgtattaaaccggcttcaccgcctcaaatatctgtacatttcaccagaagcgcttcagtccggccaaatgctgaaaaagcttcaattgctcaatgtcagcctttttgtcgttgatgaagcccactgcatctcacaatgggggcatgatttcaggcctgattattcgaagcttggagacatcaaggcgctcctcggtcatcccgtcactctggcgcttacagcaacggcaaccgaagcgacattaaaggacatttcggaaatcctggggcttaaagccgccaattatttgattcattcggtcgaccgtccgaacattgcgcttcatattgaaaagctgagggatactgctgagaagacggagcggctgacagggctggttcaaaagctgcaaggtcctggccttgtttattgcccgacgagaaaatgggctgaagaactggctgacaagctccgtaaagaagcaaacttgagaacgggattttatcatggcgggatggaggcaagcgacaggatgctgatccagcagcagtttatccgcaatcagcttgatgtggtctgctgtacaaacgccttcggtatgggaa

SEQ ID NO: 1572 - DNA, 704 bp, Bacillus licheniformis
atggatgagcggcttgtatcaagtgaactagacaaccatgaatcagcgattgagcaaagtctgcgtccgcaaagacttgctcagtatatcggccaggaaaaagtgaaagataacctcaaggttttcatcgaagctgcgaaaatgcgggaggaaacccttgaccatgtcttattgtacgggccgccgggattgggaaaaacgacgctcgccgcgatcatcgccaacgaaatgggagtcaatctcagaacgacgtcaggtccggcgatcgagcgccccggtgatttggcggcgatattaacggctctggagccaggtgacgttttatttatagacgagatccaccgcctgcaccgttcgatcgaagaggtgctgtatcctgcgatggaagatttctgccttgatatcgtgatcggcaaaggaccgtcggcacgttctgtgaggctcgatcttcctccttttaccctcgtcggcgcgaccacaagggttgggcttttaaccgcgcctctcagggacaggttcggcgttctgtcgaggcttgagtattacacgcgtgatgagctttcagagatcgtgatcagaacggcagagctgtttgaagtcgacatcgattcgctctcggctctcgaaatcgcgagacggtcaagaggcaccgccgcggattgccacaggcttttaaggagggtcagggattttgcccggtgctt

SEQ ID NO: 1573 - DNA, 690 bp, Bacillus licheniformis
tatcataagcgatctgccattgaaattaaaagattttcctgatgaagaaaggccaagggagcgccttctcaacacaggcgccgaaagtttgtcaaaccatgaactgcttgcgatactgctcagaaccggtacgaaaaaagaatcggttcttcagctttcaagccggctgcttcaaacgtttgacggcctccgtttgttaaaagaagcatccgccgaggagctttcaagcatttccgggatcggccgcgcaaaagccgtgcagattttggcggcccttgagcttggccggcgcattcacagtctggcttgcaaagaccgttatgtgattcgttttcccgaagatgcggccaattttttaatgggggatatgcgctttctctctcaggagcacttcgtatgtgtgtatctgaacacgaaaaaccaggtgatccacaagcgcacggtttttatagggagcctgaactcttcaatcgtccatccgagggaagtgtttaaagaagctttaaagcgctccgcagcttcattcatctgcgtccacaatcatccgtccggagatccggctccaagccgcgaagacatagaagttacacagcgccttcacgagtccggacagctgctcggaatcgaattgctcgatcatatcatcatcggtgatcaaaaatttgtgagcttaaaagaaaaaggatattt

SEQ ID NO: 1574 - DNA, 735 bp, Bacillus licheniformis
tcgagcccgaacagcacttcacacagccgcctccgcgctatacggaagcaaggctggtcaaaacgcttgaagaactgggaatcggacgtccatccacatacgcgccgacgcttgacacgatccaaaagcgcgggtatgtcgcccttgataataaacgctttattccgactgagctcggtgaaattgtgcttgacttgatcatggagtttttccctgagattattaacgttgagttcaccgccaaaatggaaaaagagcttgatgacgttgaagacggaaacattcaatgggtgcagatcatcgattccttttacaaggactttgaaaagcgtgttgaaaaagcggaagccgagatgcaggaagtggagatcgaaccggagtatgcaggtgttgactgtgaagcgtgcggacatccgatggtctataaaatgggccggtacggcaaatttatggcctgctccaattttccggactgccgcaacaccaagccgatcgtaaaagagatcggcgtcaaatgcccatcatgcaaaaccggcaacatcgtcgagcgcaaatcgaaaaaacgccgcattttttacggctgtgaccgctatcctgaatgtgaattcgtatcatgggataaaccgcttgaacggaaatgtccgaaatgcgaggacatgcttgtggagaaaaagctcaaaaaaggcgttcaagtgcagtgcgttaattgcgattataagggaagaacaacaaagt

SEQ ID NO: 1575 - DNA, 675 bp, Bacillus licheniformis
aaacaaagcgatcagtataaacacggcatttcaaaaggtgatgcaaagccttcgggaaaaatcagcccacttttcggccccggacgcatccggagaaaaggctgagtacgaatgtgaaacctgtaaagatcatggcattgtgttttatcgggttcataaagatacgaaatggaattatgacgaacggttaaagcaacttgtgccagaggaaatggtgccggaagatgattttctttctggaaaggtttgtccgccggaaaaggcaggggaatggaaggatacctattccaaacaatgcgactgtgtacggcgaaagagaatagcccgacttatggcagccagtggcattacagaagaatttgaaaagcttatattcggcaattttaaaacggaggggaaaccaaaattgataaaggatgcatatgattgcgctgttgaatacttcaaggattttgaaaaaatcaggggggatcgttcaaacagtatcgctttgcttggtcaacccggcagcggcaaaactcatctgcttacagccattatgaataatctcatcaagaagaagtccgtccactgtttgtatttcccgtatgtagaaggcatgggggatctgaaaaaggactttgatcaattggaaaccaagcttgatgcgatgcggaaagtcgaagtgcttttcat

SEQ ID NO: 1576 - DNA, 693 bp, Bacillus licheniformis
gagagaacacgggaaaatcggtgtgctggcaagggggcgccaaaaagccgaacagccgcttgtcagcgatttcccagccgttcctttatgcatcttttttattccgcaaatcatccggcctcggcacattggagcagggcgagatgatcgaaagcatgaggaatatccgcgaggatctgtttttaacagcttacgcggcctacatcgctgaattaatcgacaagggaacggaggaaaagaaaccgaatccgtttttatttgagctgctgcttcagtcaatgaggaggctgaatgacggtacagatcccgacattatcgccaacctcatcgaagtcaaaatgctcagcgtgatggggctgtatccggagctggatgaatgtgtgcactgcaaaagcaaagacggcacatttcatttttcgatccgcgacaacggctttatctgccaccgctgttttgcgaaagatccatacaggataccgctgtctcccgcatccgccaggctgttgagactgtttttttattttgacctgtcaaggctcggaaatgtctcggtcaaacaggagacgaaggatgagctgaaaagggttattcagacgtactatgacgagtactcagggatctacctgaaatcgcggcgcttcatggaacaaatggacaatatgaaaaagatgctgggcgatgaaaacaaaagtt

SEQ ID NO: 1577 - DNA, 794 bp, Bacillus licheniformis
atgcccaaaagaacaatcgaagaggtcatggacgaactgagaaacaggagccgtcaatcacaggggggcaaaccggaagaatccgccgcaaaacggtatgactgtccgaagtgcaaagatgaactcggatttatcgaacggcgcggaacgatggaagtatgggtatcatgcgtctgccgcgaatggcgcaaagcgcaaaagctgttgaagacgagcgaaatcaccgaacaatttaaaaacttaaactttgctcaattcaagacggaaggaaagcatcaatctgtaaaagaggcgtatgaatgcgccgttgaatatgtacaagcttaccgggacattcaggaaagccgcagaaacagcatcgcgctcttgggacgacccggttcagggaagactcatttgctgacggctgccgccaatgagctgatgaggaagctttttgtacccgtcctgtattttccgtttgtcgaaggattcaatgatttaaaacaggacttttcgttgcttgagaataagctgaaccggatgaagcaagtcgaggtgctgtttcttgatgacctgtttaagccggtggcaggcaggccgcgggcaacggaatggcagatcgaacagacatatgccgtcgtcaattacaggtatttgaaccataagccgatcatgctgtccagcgagctaagcgttgaagaaattgtcagcatagacgaagcgctcggaacgaggctggtcgaaatgtgcggggactttctcgtcgtcctgaacgggagctctttcggcatcaatcatagactggaggggat

SEQ ID NO: 1578 - DNA, 806 bp, Bacillus licheniformis
ttgtttatttggcccatgctgcttgagtccgcaaaggagccgtttaactcggacgactatatcacggaaaccaaattcgacggcatccgtctgatcgcgtccaggaataacggtttaatccgcctctacacacgccacaacaacgaagtcaccgctaaatttccggaactattaacgctcgacataccggatgaaactattttagacggcgagcttatcgtacctggatcgacaggcgccggcgattttgaggccgtcatggaacgattccagtcgcggaaaagtttttatccgatagtattttgcgtttttgatgtcctgcggatagaaggcgtttcagttacgtctaagccgctaagtgaacgaaaagaattgctggccggtctaaaactcgatcatcctaacgttaaaatagtcgagggcgtgcgcggccatgctacggattatttcgaattagtccgcgaaaataagatcgagggcatcgttatgaagcaggcaaacgctccgtatgcggaaaataagcggtcagatcgctggctgaagatcgttaactacgaatatactgacgttctgatatcaggactccgcaaggaagacaatgcgctgcttctttcgtacctggacggccagtatgccggcattatggagtttatgccgtatgatgcgcggcggaagtttcatgcggagcggctaatcgtagaagaaacggagaaatacgcctacatcgagccaattgggtgccgcgtcaagcaccggttcaagacgaaaaacggtttgttgcggattccttcgttccatgaatggcg

SEQ ID NO: 1579 - DNA, 810 bp, Bacillus licheniformis
ttttaaaataattgatattcttggagtattaggcatacctaagtcaacatattaccgttggaaaaagaagtataaaaaagttgagctaacttcattagaagagctagtaatcaagctgtgtaagaaaaacttctatcactatggtcatcgtaaaattaaatccatcttaaacagaaagtatgggataaatgtaaaccgcaaaactgtacaaaaaattatgcaaaagtttgagattcagtgtcaagttaagaagaagcgacaaaagtacatttgtggtgagagtaatattattgtgccgaacactctcaatcgtaattttaaagcaagccgattaaatgaaaaatgggtaaccgacattacctacttaccttatggctcgactatgttatatttatcaacgattatggacttatataacaacgaaatagtggcttacaaaataggtacgagccaagatattaacctagtattagacacattgagggaagctgtagaattacgtaaaccagtagggttacttcttcatagcgaccagggatctgtctatacttcacatgcatatcagaatttggccaaagaaaaaggcattaccacaagcatgtctcgaaaaggaaactgccatgataatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacaggcagc

SEQ ID NO: 1580 - DNA, 696 bp, Bacillus licheniformis
cgcggtgccggaagagtatttacaacagatggcttactccctttcgccccacaggaaaaatgcgatcagctggcttgaacaaaaagagccagagtcgacatttgtcgtcatgccgagaaccgtctctgaagttctcggagaaaaggtgttctccaagcagattccgtttattttctcatcggcgacattatcggaaaacggatcgttcgattatttggcgaccagcctcgggatccgcgattacttatcatttaccgtcgattcgccgtacgattatgaagagcagatgaaagtgtacatccatcaaatcgaggaaaaagaagcgaaagaagaagcggcaatccgtgcaatcaaagaatctggagggaagacgctgatcctgtttccgtcttttgaagagcttctgtccttcaagcgccggactgcacaggaatcattttcgtttcccgtttactttgaaggggacccccccctcagtacaatcgttgaaaagtttcaaacggtagaagaatccgtcttgtgctctgtccatctatgggaagggctcgatattcccggagacccgcttcaaaatgtcatcatctggtcgctcccatttccgccgcatgatcccgtgtttgaagcgaagcggagcggcgtggaaaacgccttcgcgcaagtagaccttccttacatgctgctaagaggtcgccaagg

SEQ ID NO: 1581 - DNA, 648 bp, Bacillus licheniformis
  misc_feature (1)...(648): n = A,T,C or G
gcttgaacaaggagcgccaaaaattcgtcaatcagatgacagaggaagccgttcagatgatcgaggaggaaggccttgaccagcctgtgatcgtcgtagcgcggccgggctggaatcctggcgtcgtgggaatcgtggcttcaaagcttgtcgagcggttttacaggcccgccatcgtccttggcgtcgatgaagaaaaaggaattgccaaaggatctgcgcgcagcatcaaaggatttgatttatttcaaaacctttccgagtgccgggatattctcccgcacttcggcggccacccgatggcagccggaatgacgctcaacctggaagacgtttcggctctgagggagagaatcaaccgtcaggctgaagcggttctgaccgaggcagattttatccccgtccaagacgtcgatttgtgctgccggctcgaagatatatcggttgacagcattgccgaaatgaacttgctggcgccgttcggcacgggaaacccgaagccgttcgttcttgtcagcgacgtaaaaattgatgacgccagaaaaatcggcgccaacaagaatcatttgaagcttgtgcttgcagacgacgggaacaagctcgattgcatcggattttataaaggcgatatcgaagaaggaatagtnc

SEQ ID NO: 1582 - DNA, 1107 bp, Bacillus licheniformis
aaaacgtgtcgcaatttactgtagagtttctaccgaagagcaggcaacggaaggatacagcatatctgcccaattacaaactttacgtcaatatactcagttatatggttgggagattgcagaggaatatgtagatgagggaataagtggaaagaacattagcggtcgccctgcaatgcaaaaacttatttcagatgttgaaaaggataaatttcaagctgttcttgtttggaagatctcacgcctatcacgaaatatgttagatactctcactctattagacaaattcgaagattatggagtaaagttcatctcttactctgaaaactttgatacaggcagtccaattggtcgtttagttgttcaactaatggcttccattgcagaaatggagcgtaatacgttatctgagaacgttaagctcggaatgaaacagagagcattagaaggttcatggaatggaggcgttgtatttggctacgatacaattgaaaaagagcttgtgatcaacaaaaaggaagctgagattgtacaacaaatctatcaactatatgccaatggtaaaggcttaaagtcaatcgcaaactacttaaataaagcaggttacagaactaaacggaattgttatttttcgataaacggtgtagctcaaatcttagacaatgttatctataacgggaagatcagttggttaaaagttgaaaattgggatacaaaacggaggagagggaaaaatccaaatcctatccttgtagaaggacagcatgaagccattatttccgatgaattatggagtatggtacaagcaaggcggaaaagtaaatcatttaaacaaaggcaatctaatgaaccatttttacttagcagtcttttacgttgccccgattgtggtcaaggtatggttcctgccattacaacaaataaacgaaaggatggaacaaagaagaaatatcgttattatgtttgctctaactttcataacaaaggttcatctgcatgtagagcaaattcaataaaagcatatgatgcagaatacgaagtaattaataagattgacaagatcctttgcaaccagaatcagctattctctaaacttaaatctataaa

SEQ ID NO: 1583 - DNA, 528 bp, Bacillus licheniformis
  misc_feature (1)...(528): n = A,T,C or G
tgcaaaagaaattagagcaaaaaaacatcaaacaatttcaagaagatttaatttcttggtatgagcaagaaaaacgggatctgccttggcgctcagacagcgacccttataaggtgtgggtgtcggaagtaatgcttcagcagacgagagtggacacggtgattccttacttcaacaactttatcgaaaagtttccgaccgtggaagcgctcgctgaagccgacgaagaaaaagtgcttaaagcctgggaaggactgggatactattcaagggttcggaacttgcagagcgctgtcagggaagttcacgaacgatacggnggtgtggtccctccttcaaaagaggaattcggcagcttaaaaggcgtcggcccttatacaagaggcgcggtgctgagcatcgcctacaatcagccggtccccgcggtagacggaaatgtcatgcgggtcatgtcacggattctttccgtatgggatgatattgcaaagcctaaaaccaaaaccctgtttaaaaaattgtcgaaagcgt

SEQ ID NO: 1584 - DNA, 1809 bp, Bacillus licheniformis
atgatgatacgaaagtcgtacagaagaaaatattggagcttttataaacgaaggcctgaaaagaggtgtcatgaaagcttgttagctgaattatcgatcaaaaactttgcgattatcgaagaattaaccgtttcttttgaaaaagggctgacggttctaaccggtgaaacaggtgccggaaaatcgatcatcatcgacgccgtctctttgcttgtcggaggccgcggatcgtccgaatatgtcaggtatggcgaaaaaagggccgaattggaagggcttttcctccttgacggcggccatccggtttttgatttgtgcacagagctggggattgaagcctcggacgacatgatcgtcatgagaagagatattaacgcaaacggcaaaagcatctgccgcgtcaatggaaaacttgtcaccattgccgcattgcgggaagtcggcagactgctgcttgacattcacgggcagcacgacaatcagctgctgatggaggacgagcaccatcttcagcttctggacaggttcgcaggagaagaaatcgagaatgctttaaaagcgtatcaggaagtttacagccgctacatggatgtcatgaagaaggtgaaagagctttctgaaagcgagcaggaaatggctcacaggctcgatttaatacagttccagcttgacgaaatcgaatcagcaaaccttgagccgaaagaggacgagcttcttcaggaagagcgccgtcaaattgcaaatttcgaaaaaatatacgaagcgctgcaaaatgcctataatgcgcttcgcaatgagcaggccgggcttgactgggtcggcatggcttcaagcgagcttgaaaacgtctcaggcattaatgaagggctcaataaagtatctgaatcggtagccaacgcttactacattctcgaagattcaacctttcagatcagaaatatgctggatgaactcgaatacgaccccgagcgcctcgattatatcgaatcgcgtttaaacgaaatcaaacagctgaaacgcaaatacggcgctactgtcgaagacatccaagcttattcggctaagatagaggaagaaatcgaccggatcgaaaaccgggacagccacttgcaggctttaaaatcacgactcgaatcaatcggcaaggatgtggcgattgaagcagccaatgtgtccgaaatcagaaaaaaatgggcggaaaagctggccaaacagattcagcaggaattgaaagatctgtatatggaaaaatcgacatttgatacggaatttcatgtgaaaaaagcggaacgggatgatgatgcacccgtcgtcaacggaatgcctgttcagctcacaaagcacggcattgacaccgttcgtttcctgatctccacaaacacgggagaaccgcttaaatccttgtcaaaggttgcttcaggaggagagctctcaagaatcatgctggcgatgaaaagcattttctccgctcagcaggatgttacatcgatcattttcgatgaagtggacactggtgtaagcggaagagtcgcgcaggcgatcgctgaaaaaatacaccgcgtctctatcggctctcaagttttatgcattacccacttgccgcaggtggccgcgatggctgacacccaccttttgatcacgaaacagtcgaaagacgggagaacaacaacaagcgtcacacctttgtcaaaacaggaaaaaatagcggaaatcggccggatgattgccggcgttgaagtaacggatttgacgaagcgccatgcgaaagaacttttaaatcaagctaagctagtcaaaaccagcggataa

SEQ ID NO: 1585 - DNA, 558 bp, Bacillus licheniformis
tcaatatcagtcaggaaatgcgcacatcttttttagattacgcaatgagtgttattgtttcccgcgctcttccggacgtaagagacggtctgaagccggtgcacagaagaatattgtatgcgatgaacgaccttgggatgacaagtgataagccgtataaaaaatccgcgcgtattgtcggcgaagttatcggtaagtaccaccctcacggtgattctgctgtttacgaagccatggtcagaatggcgcaggattttaactatcggtacatgctcgttcaaggccatggaaacttcggttctgttgacggcgactcggctgcggccatgcgttacacagaagcgagaatgtctaaaatatcaatggaaattctgcgcgacatcaataaagacacaatcgattaccaggacaactatgacggttcggaaaaagagccggttgttatgcctgcgagatttccgaacttgcttgtcaacggagcggccggtattgctgtaggtatggccacaaacatcccgccgcatcagctcggtgaagtcattgacggtgttttggcgg

SEQ ID NO: 1586 - DNA, 606 bp, Bacillus licheniformis
cgcactatgatctcagtcggcttgagaaaacattcggggtgatgggaaaccagctctattatcacgcttggggcatcgatctttcagcgattggagcgccgctcatggaggggcaggtcagctatggaaaaagccagattctgcttcgcgattatccgaatccggaggaagtcaagcatgtcattcttgaaatgtgtgaggaagtggccaaaagggcgcgcgcccaccgccaggcgggccggaccgtcagtctcggcatcgaatacagccgcgatgagcttggcggcggattttaccgttcaaaaacaatggaaagcccttcaaatgtcacgcttgatctttaccatacatgtctggcactgttcgagcggttttatgccggcaaaacggttcggaaaatttccgtctctttgtccaatattcaagatgacaccaatatgcagcttgatctttttcgccccgatcaggaaaagaagcggcagctcgggtatgtgatggacggcatcagagaacggtacggctcaacagcgcttttgcgggccgtttcctacacaaacgccgggacggcccgtctgcggtcaaaattggtcggaggccatcaggcat

SEQ ID NO: 1587 - DNA, 459 bp, Bacillus licheniformis
agagtctggaagagctgacgttaaagtatcatacgtctcttcacgtatcagattcgcccgatttgtcgaaaatgatcaatagttatcaagaaacgttttctaaattaagagataaagaaatagaacggggggtatctctttcaggtccccacagggatgatgttcttttctatgtcaatggccgtgatgtgcagacttacggatcgcagggccagcagcgcacgactgcattgtcgcttaaattggctgaaatcgacttgattcaggaagagataggagaatacccgattctgcttttggatgatgttttatcagagctggacgactatcggcagtctcacttgctccacaccattcaaggccgcgttcaaacattcgtaacaacgacaagcgttgatggaattgatcataaaaccttaaacgaagcggaaatctttcgtgttgaaaatggcacgctat

SEQ ID NO: 1588 - DNA, 580 bp, Bacillus licheniformis
atgtctttaaaacgaaaacttaatcgctataagcatcacctgggaaatcaagcgaaagaagaaaaaacggaacctcccgcagataagctgacttccttgtccgtcagttttgaaaaagaatgggccgaactcggtgttaaaccatatgtgtttgaggaatgctattgcctgatcagggaagtcgtttacccgttgactcatgttcatggtcattacgcgttttctgagctgcatgagacggttaggcgatggaacaacagcgccgtttcccattcgctttcaagcaaagggtacacaccgagccagctcttcttctttgatacggaaacgaccggtctcggaggcggggccggcaatgcgatctttttgctcggccatgcaagggtgtatgacgaccgcgtagtcgtcaaacagcatctgctgccaaagccggggtacgaagccgccctctatcacagctttctgagtgaagtcgatattcagtctcttgtcacctataacggcaaagcgttcgactggccccaggtgaaaacgaggaccacgctgattcccgacagggtgccaaaactttccgattttt

SEQ ID NO: 1589 - DNA, 1320 bp, Bacillus licheniformis
atgggcgttgaaacgcaaagccagggactcgatttcctcgacgaactcggcttcaaaaccaatcatgaaagaaaaaaatgcagcacgatcgaagaagtcattgagattgtcgaagagctcaagacaaaacgcgccgacctcccgtatgaaatcgacgggatcgtcattaaagtcgattcccttgaccagcaggaagagctcggctttacggcgaaaagcccgcgctgggcgatcgcctacaagtttcctgccgaagaggttgttacgacgcttttggacattgaattaagcgtcggccggacgggcgcagtgaccccgactgcgattctcgaacctgtaaaagtggcgggaacgaccgtccaaagagcttctctccacaacgaagatttaattaaagagaaggatatcagactgctggacaaagtcgtcgtcaaaaaggcgggagacatcattccggaggtcgtcaacgtcctcgtcgaacagcggacgggcaaagaaaaagaattcaacatgccgaaggaatgcccggaatgcggaagcgagcttgtcagaatcgaaggagaagtcgcgcttcgctgcattaatccggaatgtccggctcagatcagggaaggcctgatccattttgtttcccggaatgcgatgaatatagatggtctcggcgagcgcgtcatcacccagctgttccgcgaagacctcgtccataatgtcgccgatctgtataagctgacgcgcgagcagctgatcaatctcgagcggatgggggaaaagtcgaccgacaacttattgaattcgattgaaaaatcgaagaagaactcattggaacggcttctcttcggactcggcatccgcttcatcggcgccaaagcggccaagacgctggcgatgcattttgaaacgctcgataagcttaaaaaagcgacaaaagaagaattgatcgaagtcgatgaaatcggcgacaagatggcggacgccctcgtcacctattttgaaaaagaagagattctgaagctgttggacgagcttgaagaactcggggtcaacaccgtgtataaaggcccgaaaaaagcggccgctgaagcgagcgattcgtattttgcggggaaaacgatcgtcctgaccgggaagctcagcgagatgtcgcggaatgacgcgaaagcggaaatcgaagcgctcggcggaaaaatcacaggcagtgtaagcaaaaaaaccgatctcgtcattgccggcgaagcggcaggcagcaaactggcgaaagctgaagacctaaacatcgaagtatgggatgaggcaagactgatcagtgagctaaagaaataa

SEQ ID NO: 1590 - DNA, 741 bp, Bacillus licheniformis
tgaagctcaagtagaacgtcgcctgattaaagtgttgggggaagggcacaatcagtggaattatcgtcctgatttaaaatcggaagaagacctatggcagaatttacgtcaaaagattacgcaaaataacttatcagaaattggggaacatccaattactgataaggaatttgacacaataaagacagagttattatcgaaaacacagactccctttgatgctgctagatggctcaaaggggaaaatggaattgctcggattacgattgaacgtgaagatgtctctttaggttcgatgtctttagtgctgtattctaaccaagatataggtggcggaatctctacatatgaagttgttcatcagattgcaaaacaaaaagcaaaccttgatggtcgtgatcgcagatttgacgtgacacttttaattaatggattgccaattgttcaaattgaattgaaaaaggtcagtgccaaagacggtgtatttcaagcctttaatcaaatcaagaaatactcagaagaagggatgtttagaaataatatcttttctactcttcagttatttgtcatttccaatgaacaaacgactcgctattttgctaatgcgatgccaaaagacatgcacaagaaatttgtctttagctggcgcacaaaggacaatcgaaaagtagaaaatctttatgaatttgtaaaacaagtcttaaatattccagatgcacatcgattgattgccgattatac

SEQ ID NO: 1591 - DNA, 408 bp, Bacillus licheniformis
tatcgatgggctttatccgctgcttcgggaaaggaagaaaggagcggatcgttccgctcggcgaagcggcgtcacatgcggtcggcgaatatctgtcaaaagcgaggggcaagcttttgaaaaaaaataccgaagacgccctgtttctgaatcaccacggcagacaaatgagccgccaggggttttggaaaaatttaaagaaaatcgctttggaagcgggaattaataaagagctgacgccgcacacgctgaggcactcattcgccacacacttgctcgaaaacggagccgatctccgggccgttcaggaaatgctcggacacgccgacatttcgacgacgcaaatttatacgcacgtgacgaaaacaaggctgaaagatgtgtataggcaataccatccccgtgcat

SEQ ID NO: 1592 - DNA, 945 bp, Bacillus licheniformis
atgttagcgtcaaaaatgcgttgggacgtgcaaacgcccgacaaagaaaaggtggagcagctcgccggaaggttaggcattactccccttgccgcctcattgcttgtcatgagaggttacgatacagccgacaaagcatcttcatttttatatggcaatgatgcacgttttcacgatccttatctgctgaaagatatggaaaaagctgtacggcgaatcaaacaggcaatttcagatcaagaaaagattatgatttacggcgattatgatgcggacggtgtgacaagcacgactgtccttttgcaaatgttgaaaaaatgttcagcacaagccgatttttatatacctgaccgctttaaagaagggtacggtccgaatgaagcggcctttcgcgggatcaaagaatcaggctattcattgatcattacagttgacacaggcattgccggcgttcatgaagctgaagtcgctaaagagctcggcatcgacctgatcattacggatcaccatgagccgggtcccgttttgccggatgcttatgcgatcattcatccgaaacagccggggctgcggctatccatttaaagagcttgccggcgtctgtgtggcatttaagcttgcccatgccttgaacggagagcttccggaagatttgctcgacctttgtgcgatcggtacgattgccgatcttgtgccgcttcatgatgaaaacacgcagatagccaagcgcggaatggaacacttcaagaaaacgaagcgttcacgattaaaagcgctggcgaaaattgtcggagcggagatcataacgcggatgaagagaccatccgttctgaaatcgcgccccgcttaaacacggtcggcataattgaacatgctgacccagccgtttacctactcgacacagaagacgaatgagaagcggcatagcttgctgaggacatcaac

SEQ ID NO: 1593 - DNA, 855 bp, Bacillus licheniformis
ataagaaagtagctatttatggacaagaaagaaacggagccacgcactcattagcattaatgaatatgtatttgcatggtatagacgatgcgaaaattgaatggggcgatacgttagcaaatccacttcacttagaagatggaaagctaatgaagttccaagcaattgtagcgaatccaccattctctcttgataagtgggcgatgggctttgcgggagaaggaacaaacgacagcaagtttaaaatggaagcaagtttagatccacatagacgttttgagtggggtgttccaccaagttcaaaaggagattatgctttcgttcaacacatgctttattcattagcggaaaacggtcgaatggcaacgattcttccacatggtgttcttttccgaggggcaagcgaaggcaaaattcgtcaacaaatcattgagatgaacttactggatgcggtgattggcttaccagaaggtctgttttatggaactggaatccctgcttgtatccttgtgttcaagaaaaatcgtactcgtaaagatgttctttttattgatgcatctgccgaagggaactacgaaaaagggaaaaatcaaaatcagctaagagaacaagacatcgctaaaattgttgacacatatgaaaagcgtgaaacgattgataaatactcctatgttgccactttagatgaaataaaggaaaacgactataacctaaacattcctcggtacgttgacacatttgaagaagaagagccagtggatatgcatgcggtgaaagagaatatcgcaaacatcaaacaagagctacaagaagtggaagcggagatggagaaatatttgaaggaattagggctgt

SEQ ID NO: 1594 - DNA, 1716 bp, Bacillus licheniformis
tgatgaacgttacattagtcaacagcctgcgatcgaggtgttgcaaggcttaggatatgagtacatagaggctgaacgagctgaggcgatgcgtgagaatctctatagcgttttgctgaaaacggtattggaaaataaattgaaggagttaaattcctatcagtataaaggtgttacgtacaagttcagtgaagcgaacatccaacaagcgatgcgagatttggatgagccactcacaaacggacttgtaaaggcaaatgaaagcatttatgaaacgttgatgttaggaagaacttatacggaattacttccagacggctcgaaaaagtcatttaccattcaatatattgattgggagaatgttgaaaataatgtttttcacattgtagaggaattttctgttgaacgtgtagacggcaggggtacagttcgtccagacattgtgttgtttgtaaatggcattccgtttgcggttattgagtgtaaaaaggcttcgatttccatggaacaagggattagtcaaatgattcgaaatcaaaaaaatgactatgttccccaactgtttaagtttgtacagatggtgatggcaacaaataaaaacgaaacaaaatatgcgacatgggaacaccgaagaagttctggtcagtgggaaagaagagcatgaggaatgggttagatcattggttaccatcaaaaccttgaaaaaccgattgccaacgtgcaagacaaaaacatcatttccttattccaccctgaacgactgcttgaattgacatgtttctttacactgtttgataaagatgtaaaaaaggtgacacgttatcagcaatattttgcgataaaagagatattaacaacaattcaagagcgggatgaaaatgggaatcgacagagcggggttatctggcacacgcaaggtagtgggaaatcgctcacaatggtgatgcttgcccgttacattttatcagagttaaatgactaccatccaaaaattattgttgtaacagacagggtagaactggataagcaaattcacaaaacgtttaatcacacgagattaaaagcaagtcgagcgacatctggaagccatttagtttcactgattaaagatgggaatgctgatatcgtcacgacattagtgcataaattcgatacggcatcaacaaaacaacagccaattgaatcaagagacatctttgtacttgttgatgaatcgcacagaagccaatatggagaattgcacattaaaatgagaaaagtgttcccaaatgcctgctacttaggctttacaggaacacctctcatgaaaaaagaaaaaagcacgatgatcaaatttggaaagctcattcataaatacacaattgccgatggagtaaaagatcgagcgatcgttccgctgttgtacgaagggaaaatggttgatcaaacggttaataaaacagcgattgataaccgactttcgatgatcactcgtcatttgaacgataagcaaaaagatgaagtgatgaaaaaatggagtcattttgaacgaattgcttcttctgaccaacgcattagtatggttgcatttgatattaatgatcatttttatcgcaattacaagacacaaggttctcagtttaaagccatgcttgcgactaatagcaagatggaagcgattcgttatttagaagcctttgaagaactgggtgatttaaactgtgcagtcgttatctc

SEQ ID NO: 1595 - DNA, 402 bp, Bacillus licheniformis
aaccactcgcattccgaatgcgccctacaaatatcgaagaggttctcggccaggatcacctggtcggggaaggaaagatcattcatcggatggtgcaggccaaacacctttcatcgatgattctgtacggccccccgggcatcggcaaaacgtcgatcgccacggcgattgccggcagcacgagcatcgctttccgaaagctgaacgcagtcatcaataataaaaaggatatggaagccattgccgccgaagcaaaaatgtcggggcaggttatcttaatccttgatgaggtgcaccggcttgacaaaggcaagcaggactttctccttccgtatttggaaaacggcatgattatcatgatcggggcgacgacagccaacccgtaccatgcgatcaatccgg

SEQ ID NO: 1596 - DNA, 525 bp, Bacillus licheniformis
tattattgtgccgaacactctcaatcgtaattttaaagcaagccgattaaatgaaaaatgggtaaccgacattacctacttaccttatggctcgactatgttatatttatcaacgattatggacttatataacaacgaaatagtggcttacaaaataggtacgagccaagatattaacctagtattagacacattgagggaagctgtagaattacgtaaaccagtagggttacttcttcatagcgaccagggatctgtctatacttcacatgcatatcagaatttggccaaagaaaaaggcattaccacaagcatgtctcgaaaaggaaactgccatgataatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacaggcagc

SEQ ID NO: 1597 - DNA, 1146 bp, Bacillus licheniformis
atgacagtgattaagaaagacgataaaaccggaaaatattattttgtatattctggcggggttcacccgataactggtgctagaattcaaaaaagaaggcaaggaatgtcgagtctacgagaggcgaaagaggttttaaagcaggtcataatagaggtggataaggaaaaaaattctcataaccctaataaaagcgtgtttagtaccttcgctgaaaaatggtttgaatcgaaaaaggttagacttcgatcaagtacaatcgtcaattaccgcgagcagcttgattacaacatacttccatatctaggaacgtttaaaattaaagacatcactgaggaagtcttgcagcattatattaatcgacttcacaatgaacggaaacttgctccggcaaccatccggacagctttcggtgttgtcgccgaagtcttaaagaaagcttcccgaaaaggagcgttcgacctcgccatccttgacgatgtaaaccttcctcccgaaaatcgcatttctaaagtatggaacgagtcgaatgtacaagcgtttttggatgctcgcaaccgtatcgtgtcactaactcgttactttatcggaatggtattatccgttattacaggcatgcgaatgggggaggttctcggattgcggtggtccgatatagacttcgaaaagggttatttaacaattcgacaaactctcgctaagatagacgacgaaggtaattacggattagttcccgaggtcaaaactgcggcgggcttcaggaccgtccatttaccgaaattctttatcgaatacttaatcgaacataagaaaatggtccagcgcgaaaaagaaattctcggcgaggactacatcgactatgatctcgtagtgtgtacgaagcacggtaagtgggtacatccgaataactatcgacgggcatttactcggttaattgcgcagcttgagctcccgaaaatccctccgaagaatttgcgacatactcacgcgacgtatttaatcagtatcggaatcagtccgaagattgttcaggagcgtttaggccacgcacatatcaaaacgacgctcggaacgtacagtcatgttttgccttcgatgcaggcggaattagtcggaaaattggacgatttagtcgcgaaagtgtga

SEQ ID NO: 1598 - DNA, 1143 bp, Bacillus licheniformis
atgtcattagttgctgaattagaaagagatatgattattttccgaacaaactctggcatggaaaaaagagcttctgaaggacattttaatggaggcgtaatttatggatatgcatcaaagaataagaaacttaaaattgtgcctgaagaagcaaaagtcataaattatatttttgagaagtatgcgataaatcagtggggttatagaaaaatagcgtcacacctaaatactttaggtatcactactaaaaaaaataatttatggtcaataactgccgtaaaaacgatactaagtaaccccatatatattggcaaagtaaagtggcggaatgaactgagagatggaaaacatgctcccatcatagatatagaattatgggagaaaacacagcaagtaatggatctaaacagttatgtgcaagagaagttgcatcctggaagcttccccttatcaggtttgttaaaatgtccagaatgtggttcagccatggtacaaggaaatagcagtccaaaatacaaatactaccaattctccagaaataagaacagtggtagtaaggcatgttcctcaaaccttgtaaaaaaggattatgctgagcaacatgtatttgatcaattattttgtgatttgcaaaaatacaatgttaaagagccattgattaaaatgattcactcatacgccatgagtgaaattgagccattggaaacaactatcaagacgtatgaagttgagttagaggaattaaaaacgaagagaaaagaacttataaattggaggctaaaagatattatttcagaagagattttaaaagaggaaatggaagatttacgagaggaagaaaaattaataataactcgaattgaaaaattacagcacctcattaaactcagagataaaacctttttaaccaatatcatttcaacttcactacacgatctaaagaactttttcaatattatcgaagatgatgacaaaaaggaattacttcgttctctcattgaagagattcacgtaaatccaggaaaaactactaaggatagaacgatcaaagaagtgatttataagtttgatttaaaatatttgaaatcaattgaactaagagaaggggaacatcttttctcttttttgtgtttcatattataa

SEQ ID NO: 1599 - DNA, 1071 bp, Bacillus licheniformis
aaccgaagggcagcacctggactgatgaccaatggaaggcgattgtctcatccggccgggacattttagttgcggcagcggccggttccggaaaaacggccgtgctggttgaacggatcattcggaaaataacggatcaggaacgaccggtagatgtcgacaggctgctcgtcgtcacctttacaaatgcatctgcggctgaaatgaagcacaggatcggcgaagcgctcgaaaaagagcttgccgaaaatccgggatcgcttcatttgcgccgacagcttgctttattaaacaaagcgagcatatcaacattgcattcattctgtcttcaagtcatccgcaaatattactatttgatcgatgtcgatccggctttccggatcgccgatcagacggaaggcgagctgctcggcgatgaggtgctggatgaactgtttgaagaagaatacaaaaaaggcaatcctgccttttttgaacttgtagacagatatacgacagaccgtcatgacctcgacctgcagcatcttgtcaagcgggtctacgaattttcccgttcgcatcccgatccggagggctggcttcactcattggctgaactgtatgacgcggcttcggatacgaaggttgaggctctgccgttttattcttacattaaagaagacatcgcactcgttctggaaggtatgcggcaaaagctgacgcgcgcgcttgatttgacgaagcagcccggggggcctgctccgcgcgccgaaaattttctcgatgatttagcgcagatcgacaggctgattcagcagcaggatgatttttcggccctgcatgagcttgtaccgaccgtttcgtttcaacgattgaagccatgcaaaggtgatgagtacgatcccagattggttgatgaggcggcagacctccgcaacagtgcgaaaaagcagcttgaaaagctgaaaagcgattatttttcgcgaactccggagcagcaccttgagagcctgagggaaatgaagcctgtcattcagacgcttgtccagctcgtgctggagtaggcaggcggtttgcggaagcgaaaaagga

SEQ ID NO: 1600 - DNA, 680 bp, Bacillus licheniformis
aagcttccgggatttgcgggccattttgacctgttgcaccggattccgccgcttttggaagcataaatttgacggcgtttctttagggcggtggaaaagaaagagctgggcgttgtaagacctgaagatacgccgggctatctggcgccgatgatgtattttcattttttaaaggaggaacggccggaaatcattgaaggcgttttgcgccataatgagcttgacgtgctttctttaatcactctttacatccatttatcgaagaaaatcctcactccggagcagacagcggaagcaaacgaaaagtacgcgatggcaaaatggctcctcgccaaccgggagacagagcttgcgacagcgcaattgcaagagcttgaaaaaaaaccttttgaacattctgaacgcgcatcattcgatttatccatgcagtataaaaaacaaggcatgctaaaagaagccgcagccctttggctgaagctccaaaatggagaagacggaaaaaccgcctggcgcgcaggcatcgaacttgccaaatactttgaacatcgaaagcgggatattcgggccgctcttgaggtagcggaaaacctgctggagcagcacggttcacaaaagtttgagctgaccgaaaaagaaatggccggcctcttgagaaggcgcgagcggctggaaaggaaata

SEQ ID NO: 1601 - DNA, 545 bp, Bacillus licheniformis
atgaagattaaagaaatcatcgttgtcgaaggccgtgatgacaccgctaaaatcaaatcggctgttgatgcagatacgatcgaaacgaacggatctgccataggggaagacgtcatcaaacggattcggctcgcccaggaaacgcgcggggttattattttaaccgatcccgatttcccgggggaaaaaatcagaaaaacgattgcagaaaaggtccccggctgcaagcatgcatttttgcccaagcatttggcaaagcctaaaaataaacgcggaatcggtgtcgaacacgcttcgcttgaagcgatccgcgaatgcttaatgaccgttcaggaggaaatggaagcgacggaacctgagattgaggcccgggatttaatcgaagccggcctgatcggaggcccgctggcaaaacaaaggcgggagcggctcggcgaaatattgaatatcggctatacaaatgggaaacagcttcaaaagcggctgcaaatgtttcagatcaaaaagagtgattatttaagcgcactggatgctgtgctgcggga

SEQ ID NO: 1602 - DNA, 438 bp, Bacillus licheniformis
aaacagcaaatcctgtacttgaaaactcaatgaatacgaatttgtcaaactggttcatcctttacacgaagcttcaccgttttcactggtacgtaaaagggccgcagttctttaccctacatgaaaaatttgaagagctatacaaccatgcgtcagaaacagcagatgtgatcgcggaacgcttgctggccatcggcggacagccgctcgccacaatgaaagaatacattgaccacggcacaattgaggaaaacggagccgaaaaaacggccgaagaaatggtttccgcactggtaagcgattaccgtcaaatccgcgatgaaattcagcataccatcgaacttgcggaagataaatcagatcattctaccgctgacctttatatcgccctgacagaggaaattgataagcagatttggatgctttcttcatttttgg

SEQ ID NO: 1603 - DNA, 321 bp, Bacillus licheniformis
tgtctatggagaaaatgaaggagtacaacggactgtaccatgttttgcatggagcgatttctccgatggacggcatcggtccggaagatattaaaatacccgaattgctgaagcggttgcaggatgatcaggtgactgaagtcattctcgcgacaaacccgaatatagaaggagaagcaacggccatgtacatttcaaggcttttaaagccgtctggtatcaagctgtcacgaattgcccatggacttccggtcggaggcgatttggagtatgcagatgaagtcactctttctaaagcgcttgaaggcagacgtgaaatgt

SEQ ID NO: 1604 - DNA, 380 bp, Bacillus licheniformis
atgagagtgatttctgggacgtataagggacgtgccttaaaggcggttcccggcacgtcgacaaggccgacgaccgataaagtaaaggaatccatctttaatatggtcggcccgtattttgaaggcggcaccggccttgatctgtacgcgggaagcggcggattgggcattgaagcgctgtcgcggggatttgaccgcttcatttttgtcgaccgggattttaaagcgattcaaaccgtgaaaggaaatttgaaaacgctgggcttagaaaagtgcgccgaagtgtacagaaatgacgcagaacgggctctgcatgcactggtgaaaaggggcgcaagctttgatgccgtctttttggacccgccatatcgagagcagaa

SEQ ID NO: 1605 - DNA, 618 bp, Bacillus licheniformis
ttggctaaaacaatataaatggcatgctgcgggaggcgttgcactcgtcttgatcatcagcgctgccttcatgctgttaagcggaaagcgtgaaacttcatccggcctctccattcccgaggaggcttctgcacagacgtatgacaagaaggaggaggtgaaacgggaaaaaagcgcgggaaaagaggcggttatcatcgatttgaaaggcgctgtgaaaaatccgggcgtctatcaaatgaaagagggagacagggtccacgatgtattgaaaaaagcaggcggcaccgagaaaaaagcggatcaaaagcaaattaaccttgcagccgttttgcaggacggtatggtggtttacattccatttgagggggaagaggctgctgattctttctcgaaagcgggttcaagggcagatggcgcttccgtcgatatcgtcaatatcaatacggcttcctctgaggagcttcaggcgattcccggcatcggcccttcaaaagcggaagcggttatcgaataccgcgaggagaacggaccgtttcacacggtagaagacataacaaacgtttcgggaattggagaaaagtcttttgaaagaataaaatctgcaatcacggtaaa

SEQ ID NO: 1606 - DNA, 498 bp, Bacillus licheniformis
gtgggcttttatattgaaatgacctcgccttttggacaagcctacatcgtcgaggaaaataaccatattacacatttgctatttgaaaaagaagaactaaaacagcttcaacaagacggcctggagcttcgcccggccgaaacggaattgttgaaggaggcaaagcgccagctcgaagaatatttccagggggagcggaaaacgttcacccttcctctccgccaggatggaaccccgtttcagaaaaaggtgtgggaggcgctgcagtcgatcccgtacggtgaatcacggagctatttagacatcgcatgcgccgtcgggaatccgaaagcggtgcgcgcaatcggccaagccaataaaagaaatgcgctgccgattttgatcccgtgccaccgtgtcatcggcaaaaatcgttcattgacggggtattccggaaatgaaacggataaaaaagcggtgctgctcgacatcgaaaatattgcgtataaaggaaaataa

SEQ ID NO: 1607 - DNA, 837 bp, Bacillus licheniformis
ttgtccaagttgtagaagaactctcagccacttttaaaataattgatattcttggagtattaggcatacctaagtcaacatattaccgttggaaaaagaagtataaaaaagttgagctaacttcattagaagagctagtaatcaagctgtgtaagaaaaacttctatcactatggtcatcgtaaaattaaatccatcttaaacagaaagtatgggataaatgtaaaccgcaaaactgtacaaaaaattatgcaaaagtttgagattcagtgtcaagttaagaagaagcgacaaaagtacatttgtggtgagagtaatattattgtgccgaacactctcaatcgtaattttaaagcaagccgattaaatgaaaaatgggtaaccgacattacctacttaccttatggctcgactatgttatatttatcaacgattatggacttatataacaacgaaatagtggcttacaaaataggtacgagccaagatattaacctagtattagacacattgagggaagctgtagaattacgtaaaccagtagggttacttcttcatagcgaccagggatctgtctatacttcacatgcatatcagaatttggccaaagaaaaaggcattaccacaagcatgtctcgaaaaggaaactgccatgataatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacagg

SEQ ID NO: 1608 - DNA, 619 bp, Bacillus licheniformis
atgaaaggctttcggccatgcgggaagagtggcaggcgatgacgtcttttgaacggtcgctgagagcgcggggctatcaatatatcgccggaatcgacgaggcgggcagagggcctctcgcagggccggttgtcgccgccgctgtcatcctcaaagaagattgtgaaatattagggctgacagattcgaaaaaactgtcaaagcaaaaaagagaagactattattcatacataatggaagaagccgcagcagtcggcgtcgggatcgcggacgcccatgagatcgatgagctgaatatttatgaagcctccaaagcggcgatgctgaaagcggtccaagcgctggacgtcgcaccggattatcttctgatcgacgccatgtcgcttgcggtcgatacagagcagtcatcgattattaaaggggatgccaaaagcgcctcgatagcagcaggcgcatgcatcgcaaaggtgacgagggacaggctgatggatgaatacgctgaaaagtatcctctctacgggtttgaaaagcataaaggctacggaacgaaggagcatctgaatgccctggcgaaatacggcccgtcgccgatacaccgaagatcgttcgcccctgttaa

SEQ ID NO: 1609 - DNA, 297 bp, Bacillus licheniformis
ctatgctaaaatagaaggcagggtcattaaaaaaaacggttctgttcccattcagcttgtgatttccaaaaaaggaaaaaaaggtaaagtgaatcatattgaacagcagaagctgagccagtatgtcggggctgtcaacacgattatgttcgcgccggaggatttaaatctcgtaaaaggaagtcctcaggtcagaagaaggtttctcgacatggaaatcggccaagtatcacctgtctatcttcatgacctttctctttaccaaaaaatcctttcacaacggaatcatttcttgaa

SEQ ID NO: 1610 - DNA, 406 bp, Bacillus licheniformis
atgaacatcaacaatatacacgattttaatttaaaccaagaaaatgacttcttaacgatacaaacaaaactaaaaaaacatatcaatctagaaaaccccatcagtaaagacgctctgcaaacctgtgcgggggttgatttagcttattgggagaaagatggtgaagcatttggtgtctgcagcatcatcgtgctggattttcatacgaagcgtgtcattgaaaaagtacattgtgcagggaaaatcgccgtgccttatatcgcagggtttcttgcttttagggagctgccgcttattattaaggcagctaaaaagctgacgattgaaccggatgtttttttatttgacgggaatggctatctccatattaaccatattggattgcgacacatgctgcgttttttct

SEQ ID NO: 1611 - DNA, 391 bp, Bacillus licheniformis
atgccggttgaggtgtatattgacggagcaagcgccggggatcccggaccgtccggacttggcatttttatcaaagacggccagaagaccgagtccttctcccttcccgccggctcactgagcaaccatgaagcagaattcatggcgctgatcgaaggaatgaagctgtgcgccgaacgaaactaccggatcgtttcgtttcggaccgattcgcagatcgtcgagcgcacggcggattcggagtttgtcaaaaatcaggctttcaagccttatctggatgctatcatccgcttaaaaaaggattttgatttattttttatcaagtggattccttcgaagtcaaatcaagcggctgacaagcttgcgaaaaaagcgatattgctgaaccaac

SEQ ID NO: 1612 - DNA, 597 bp, Bacillus licheniformis
tgtcttaattcgaggtatgggaagcgctgcaaagcactgcatgaagatccggtccatctaaacccctgatgctgttatattccatacactaatgctctaaacacgccaacggtgggcataccggccattggaaccgccagctcttctgggcagaatcgcacggtgatttcaggacatgcaaagtgacccaaggacaatatttgcatctcctcaaggccaccaatgtgcaaattaacgccttcctcagatacctttattttgacgaaggcggcgatctctatgcctgagctgcctgaaactactatgactgctattcctgcgatcctgacaataatcatcaaacgcgatgtaaccgcagtgattttctatatggctgtcctgtatgaaggggaccaccgtcattcggatcttgctatgaacaatacacgaacaacgggtctaaaccgtaccacggaaaaatgtcggttttattgaaatggcatcatgaagaccctgtcgatgccctcgaaagaaagcggaacgatatcatctatcagcaataccagcataaccgcaatccgttcattgatcaccctgaatgggcggaggatatttggg

SEQ ID NO: 1613 - DNA, 346 bp, Bacillus licheniformis
atgccttttgttcacctgcaagtacatagcggttacagcttattaaacagcgccgcttccgtagaggatctcacggccaaagccaaagagctgggctacagcgcaatggcgctgacggatgacgaggtcatgtacggggcggtggaattttataaatcatgcaaaaaacgcggcatcaagccgattatcgggctgacggcttctgttttaacagatgaaaaagagcagctatcatatgcgctcgttcttttggcgaaaacaaacaaaggctatcaaaacctgctgaaaatcagcagcgtgttgcagtcaaaatcaaaaaccggcatcaaggaaaaatgggctcata

SEQ ID NO: 1614 - DNA, 363 bp, Bacillus licheniformis
gtaaatctttaaaggtgatccatatgccggaaaatgaaaaagtcatgatcgtcgaagggaaatcagataagcaaaaagtgaagcatgtcatcgaagagcccgtggacatcatatgcacaaacggaacgatcagccaggcaaaactcgatgaattcgctgagacgctgttcgataaagacgtttatatcctggtggatgccgatgaatcaggcgaaaagctccgccggcagctgaagagggagcttccccaagcttcgcatctatacattgatagagtatacaaagaagtcgcttccgccccgagtcagcatgttgcagaagtattatttcgttcaaacatccgggtacatacaaaatatctat

SEQ ID NO: 1615 - DNA, 1197 bp, Bacillus licheniformis
atgatacatatcacgcctttgccgaagatgatgccgttttttcttcatatgaagaggcggaacggctttaccgtgaattatttgacgggatatgaagacattaccggtatatcacatcctctaaatgcaaaaagtaatggaaatatgcaaaggatgtgtctgtttccaatggtaaaaccgtttgttccccaactcgtctatattgaaccgagagccctggaatatccgcttggaaaagagctgagggataaattttcaaacatgggacttgagatcagggaaacaacttcacacaaccaggtgaggaatatcccgggggaaggccacctgcaaaaatacagaaatgcgaaatccactttggtgatcggcgtcagaaaaacattgaagttcgattcgtcaaaaccgtccgcagaatacgcgatcccgtttgcaacagggtgtatgggtcactgtcattactgctacctgcaaacgacaatgggcagcaagccgtatatcagaacgtacgtcaatgtggaggaaatacttgagcaggcggatcaatatataaaagaaagggctcccgaagatacgcggtttgaagcttcctgcacatccgatatcgtcggaattgaccatttgacacatacgttaaaacgcgccattgagcatttcggtcaaaccgaccatggtaagctgcgtttcgtgacaaaatttcatcatgtcgaccatttgctcgatgccaagcacaacggaaaaacgcgcttccgcttcagcgtgaatgccgaatatgtcattaaaagctttgaacccggcacatccccgttggataaacggatcgaagccgccgtgaaagtagcggaagcgggctatccgctcggttttatcatcgctccgatttatattcatgacggctggcaggaaggctacagagttctgctggaaaagctcgatcgtgcgctgccgcagcatgcgaggcgcgacatcacctttgaaatgatccagcatagattcacgaagccggcaaagagagtcattgaaaaaaactatccaaagacaaagctcgaactggatgaagaaaaacggcgctataaatggggcagatacgggattggcaaatacatttatcagaaggatgaagaagcagagcttcgcagcgcccttgaatcgtatatcgacaactattttcccgaagcaaaaatcgaatatttcacataa

SEQ ID NO: 1616 - DNA, 546 bp, Bacillus licheniformis
  misc_feature (1)...(546): n = A,T,C or G
aggtgacggcttttccagtttttcagcccagaacccgtttatttaaaagcaaacccgccaaagcaacattcttatccatcccatttaggaaagagaagccccgaatgcgctgtacggcttttcgccaagggaagaaaaaaatgcggtttacgaaaatgctgaatgttacggggatcggcccaaaaggagcgctgccgatcctcgctcccggcgatccgggagcggtgattgaagcgatcgagaatgaggacgaagcatttcttcgtcaaatttncccggcgtaggcaaaaaaacggcaaggcagatcatccttgacctgaaagggaagcttgcggatgccgttcctgaaatcgctgccgatctgtttaaccatgaagagcgggagcaaattcatgaagcggcaacggctcttgaggaagcgcttgaagcattgagggcgctcggctattccgatcgggaaattaaaaaagtccagcctcatttgaaaaaggaagaggcgctttcgacagatcaatacgttaaaaaagcattgcaaaaattgttaaa

SEQ ID NO: 1617 - DNA, 672 bp, Bacillus licheniformis
ttgttcctgcgaaaaaagcggtgctgccgatctttgatcagatctttacgagaattggcgcagcggatgatcttatatccggacagagcacgtttatggtggaaatgcttgaagccaaaaacgcgatcgtccatgcgacgaaaaacagcttgattttatttgacgaaatcggccggggtacgtccacttacgacggaatggcgcttgcacaagcgatcatcgagtacgttcacgagcacatcggcgcgaagactttattttccactcactaccacgagctgacgtcccttgaagaaaagctggacgatttgaagaatgtccacgttcgtgcggaagaatacgaaggaaaggtcgttttccttcaccagataaaagaaggagcagcagataaaagctacggtatccatgtcgcgcagctggctgaattgcccgacggtttgatcagcagggcgaaaacgatcctgaaagaacttgaatccggcgcaaaagaagccgctccatcaacggcaccgaatatggtaaaagaggcggcggaagaagccgcggcgactgttgcagatcaaccggcccagctgtcattttttgagacggacaagccaatagaaaaagagacgaagctctccaaaaaagagcaggctgttttagccgaatttaaagcgatggatctgctcg

SEQ ID NO: 1618 - DNA, 774 bp, Bacillus licheniformis
  misc_feature (1)...(774): n = A,T,C or G
atggaaaagaaagagtaccgttggaagttgggcgatttaaaaaacatcaagaaaaatggccttaaagtattcagtacattctcttggggcgggggttcctctatgggctataagctcgccggttacgatcttttggggaactgtgagatcgatccgcaaatgatgaagatttacaggaagaatcataatccgatatatccttttcttatggacatcagagactttaacaaaatggaaaatctgcctgatgaattgttcgatttagatatttttgatggttccccgccctgcaccgtgttttctattggggggggaatcgggaaacggcttggggatttttttttatcctgncgggaaggacaggcggaacagncgctggatgatctattttttcattaccttgatgctgttgaaaggctgcggccaaaaatctttgtggccgagaatgtcaaaggaatggtcagcggaaatgcaaaaggttatgtgaagctggtgattgaacggaccaaggaaattggatatgatgttcaactgttcttgttgaatgctgccacaatgggagccccgcaacgtagagagcgggtcttttttatttgccgaaggaaggacttgaatttactaccgcttaaattgtccttcaatgagccaccgattgtatataaagaattcagaagcggccatggtgcaaggcttaaagaaacatcaaagctttataaaagatgggtgaagcgacggccgtcggataataatgggagacatcacgaaaaggattga

SEQ ID NO: 1619 - DNA, 246 bp, Bacillus licheniformis
ggcagggtgaacgtgaagctgatttcatcaactgtgttgtctggagaagacaagccgaaaacgttgcaaatttccttaaaaaaggaagtcttgcgggtgtagatggacgtttgcaaacgcgcagctatgaaaatcagcagggacagcgtgtatacgtcacggaagttcaagctgaaagtgttcaatttctggagcctaaaggcggcggttctggttccggcggttacagcggaggccagggaggcc

SEQ ID NO: 1620 - DNA, 342 bp, Bacillus licheniformis
tcaaatggtttgctcggctcaaggtataccccgcattaaaatccttgagtcggtcggtgttttcggcttgatccgcctttctgaattttgtaaagtttatgtaatagccaagattgtactcggttttcccaaaaacatgatcggaaccgtcggcccgaggggggaagcgagccagaagttcgcgcaagtgcttgaagaaacgtttcaagttcccgtcgtgctttgggacgagcgcctctcgacaatggcggccgaaagaatgctgatttcagcagatgtaagcaggcaaaagagaaaggaagtaattgtaaaaaaaaaagcggttatgctagcggagccctt

SEQ ID NO: 1621 - DNA, 738 bp, Bacillus licheniformis
atggcaaaccgggcagcgggcgttcgtctgtttggcgaccgttttccgatggccgcactccctgtcctggcagacgagcattgtgccgcgtttgccgtttactttcagcatcagtttttcgtagtcagggcaatgtgtttctgtgatattgttgtgcttaaactttggattgctgcttttgattactctgatcgtgtgctatgcggactgcttgtttggttaatgaaggttgtgcatcgttccggtctcttctcgatgcctgtctttttcttgttttttttttcttgtttggttcttttctcctttttttttctccgctctcgcgcggtccgtcctctcttgttctcctccgtctctgcgtgctcctcgtctcgtctccttctttctttttctcctttctcttctgctgtgtcggcctcttgttctccctttcttcccctgttccctcccctccgcccccttttttttctcccccttccccgctcctcctttttccctgttctctcctgccgttcgcgtccttccgccgcttgtgcttctccccgctccgctctcgcccgttgttctttttctccccccccctcccctttccttccgcccctgccccccgttgctccccttctcccccctttttggtctcctctcgttctccctcctgtctttctttcttctgttcgtcttgtttctttgtcttgtctccttttttttctcgtcattttgacatacaaactaaaaaac

SEQ ID NO: 1622 - DNA, 320 bp, Bacillus licheniformis
  misc_feature (1)...(320): n = A,T,C or G
atgctagagaaagccgaagcactattgcagcactattttggctatccttcactgcgcccggggcagaagaaagccattcaatctgtcgtttctgaaaagcgagatacagcatgcattatgccgacgggcggaggcaaatcaatctgctaccaaattcccgcgctccttatggaagggacaaccattgtgatctctcctttaatttccttgatgaaggaccaggtggatgctntaaatcagcttggaattcaagctgcgtacgtgaacagttctttaggccataacgaaatcgctgagcggctctccgtatttaaggaagg

SEQ ID NO: 1623 - DNA, 240 bp, Bacillus licheniformis
tgaacccgctttagctgcagcatgctgtacgccatctcagctcagtcaaccgcccaaacatcgcactgagggttgaaaatgcggcggatacagccgaaaaaatagatagggtcattcagccggttgaaaacctgcaaggtccgggaattgtttattgtccaacacggaaatcggctaaggaattagcgggtgaaattaagagcaaaacgagcagcatagccgacttttaccatggcggtt

SEQ ID NO: 1624 - DNA, 342 bp, Bacillus licheniformis
attagacacattgaaggaagctgtagaattacgtaaaccagtagggttacttcttcatagcgaccagggatctgtctatacttcacatgcatatcagaatttggccaaagaaaaaggcattaccacaagcatgtctcgaaaaggaaactgccatgataatgccgtcattgaatcctttcactcctcgctaaagtcggaaggatttaacgctcaaagtagagcatctatatccaattctaaagtagtacaaattgtaaatcaatacatgtatcgatataatcatgtacgaattcaggcaaaattaaactacctgtccccactggaatacaggggacaggcagc

SEQ ID NO: 1625 - DNA, 256 bp, Bacillus licheniformis
atggagacgaatagccattacttttacgtgctttcgtgccgggacggcagcttgtacgcaggctatacaaacaatatcgaaaagcgcctgaaaacgcataatgacgggaagggcgccaagtatacgagggcaaggctgccggttaaactccattatgcagagtgcttttcaacgaaacgagaagcgatgcaggccgagtactatttcaaaaaattatcgagaaaaaacaaagaacgttatatagaagaaaaaagac

SEQ ID NO: 1626 - DNA, 253 bp, Bacillus licheniformis
atgtttaatgagatcatgctcgtcgggcgtttgacaaaagatcccgaactgcggtatacatctgacggtgtccctgttgcaaatgtgacgctggctgtcagcaggcctttcaagaacgcagcaggcgaagtagaagcggactttgtcaattgcactctatggcgcaaaactgccgtgaacacagacgaatattgcgaaaaaggctccatcatcgggctgagcggaagaatcccgacccgccaatacgtcaatt

SEQ ID NO: 1627 - DNA, 228 bp, Bacillus licheniformis
acggggaacgcctcggtgaaaagaaagcagtcgaagccatgtataaggatatgggcaaagcatttgccgagcttgatacatggtctgtctacatgctgacatcaaacgagcgttttgaagagtgctacgggaaaaaagcaacgaaaaaacggaagctctttaacggttttattaagacggactattaccagtattgggggaaaaggccgccaaaaccgaacaaagaaa

SEQ ID NO: 1628 - DNA, 648 bp, Bacillus licheniformis
atgtacagaggagcggccggcatcaatgagttgaacgcccttttgcagggcatactgaatccgccgaagccgaaaggcagggaaatgaagtacggagatgtcgtgtaccgtaccggagataaagtgctccagctcgtcaaccagccggagcataacgtgtttaacggtgacatgggcgagatcgtctcgattttttatgcgaaagaaaatacggaaaaagaagatatggccgttgtctctttcgacgggaatgaaatcacgtttgcaaaaaaagatttcaaccagtttacgcacgcctattgctgttcgatccacaaatcgcaaggcagcgaatttccgatcgtcatccttccggtcgtcaaaagctattaccggatgctgagaaggaacttgctttacacggctattacaagaagcaaaaaattcctgattctgtgcggcgaagaggaagcccttgaatggggcgtgaaaaataaggaatcatcagaaaggcagacatcgcttaaaagacggcttcagcaggcggcacatgaagaggatgaagagctcatggcgcttcaaaaagagctgccattcagcgtctatgacgccaatatcgggatggaaggcattacaccttttgattttatggaaaaggaagcagaataa

SEQ ID NO: 1629 - DNA, 645 bp, Bacillus licheniformis
atgaaagtcgctatccatgctaaatatcatactataaaaaaaggaagtaccatctttcccaaaagaggtgctgccattatgacaaataaggtgcggattttaggaactgatggatatatggataccaatatgatggcattagaaccaagaaatattaatggagaatttctttatacgttgattgatagaacagggctatttaaaatagcagatacttcaacaattccacaaatcaataataagcacgttgaaccatataaaatacttttacctaatttatatgagcaaaaaaatattggtaactttttcaaacaactagacgacacgatcgctcttcatcagcaagaactaaccaccctcaaacaaacaaaacagggattcttgcaaaaaatgtttccaaaagaaggggagtctgtgccggaggttcggttcccgggatttactggggaatgggaacagcgtaaggctgatgaaatattttactctgtgtctgataaaaatcattcgaatcttacggttctttctgctactcaagaaaaaggaatggtttatagggacgaaacaggacttgatattaattatgatgcaaagcctacgaaaaattacaagagggtacttactgaacaatatgtaatacatctttag

SEQ ID NO: 1630 - DNA, 531 bp, Bacillus licheniformis
tgtctataaagacaaggaaaggggaacatattattttatcatatcctatacaaacagaaatggagaatacaaacagataaaaagaagaggatttaaatcaagcggagaagcgaagagggctgaagcagaaacccttttacgactagaaactgacgacggagaaaatgaagataatccaacttttgaatttgtcgcaaaagaatacttgaaatggtacaaaaaaagaagaaaggcatcatcatatttaaaaacaagtagcattataaatactcacttgataccaaggttcgggagcaagaaaattaacaacattcgttcaagggacataatgcgttttcagaatgatttgcttgatagatatgccgttgcgcacgtcaaaaagatacatcaagttttatcggctgtatttaactttgcgattaaacaagagtacacaaaagataatccagcacgtttagcaggaaatgtggatatagaagaagataaacacatcaattattggacgttagacgagtttaaagcgtttattca

SEQ ID NO: 1631 - DNA, 447 bp, Bacillus licheniformis
ttcacattggggcgactgcccgcgggctctgttttacagggggatggaatcaaggcttcgaggatttggccgcttgggctgaaaaaagatttacacagccagttttcattcgggatgacaaaggattggcagaatacgccgagcagctgcaggcgtatttgaacggcaagcgaactcatttcagctttcctgtcgaccttgccggcacgccttttcagctggcagtgtggaaggcgctctccgaaatcccttacggcagcacttgctcctattccgatatcgccgagcatattgaaaagcaggccgctgtgcgggcagtaggcgcggcgatcggcgcaaatccgctgttaatggtggtgccttgccatcgggttatcggtaaaagcgggcagctcacgggataccggggcggattggatatgaaaaaagaactgatgatgatggagt

SEQ ID NO: 1632 - DNA, 606 bp, Bacillus licheniformis
  misc_feature (1)...(606): n = A,T,C or G
atgatcaatacggaaaaagcgaagctggccgatatntttaaaaatgaagagatcaatacgatccttcacgcgatcggcggaggggtcggcgccgattttgacattgaggacatcaattacgacaaagtcattatcatgacagatgcggatacagacggcgcgcatatccaagtgctgctcctgacttttttctaccgctatatgaagccgctgatcgagcacggaaaagtgtttatcgcactgccgccgctctataaagtgagcaaagggtcgggcaaaaaagaaatcattgaatatgcctggtctgatgaggaaatggacgacgtcctcaaaaaagtcggaaaaggatatacgatccagcgctataaaggtctcggcgaaatgaacgctgaccagctttgggaaacgacaatgaaccccgagtcaagaacacttgtcagggttaaaatcgatgacgcggcccgggtggaacggcgcgtaacgacattgatgggcgacaaagttgagccgaggagaaaatggattgagaaaaacgtcgctttcggacttgatgaagaaagcaacattttggaaaacgagaatttatcggtcgctgaggaggtttaa

SEQ ID NO: 1633 - DNA, 483 bp, Bacillus licheniformis
gctgcagcccgaatcgattgaaaaggaactggtcaaacaagaggtctcaccgaatattgcagcccttttgtcgaatatgaccaacaatttatcggaagcgctcgaattgagtcgaaatgatcagtttgcagagtcgcgagcgaaagtgataaaattgtatgaagtcttacaccagcgaaaaggacatgcttttttctatattcaagatcagtggatgccctttttcaaggagaaagaccaccaagaaatgggtcttgatatgcttttatttatatatcgcgacgtgttgtccattcagttgggacatgaagataaaatactatttcaggacttattccaatcattaaaacagcatgcgctgcaaacaacacaacaaagagtgacaaaccagatacttgctgttttagaagcaaaaaaacggctttattccaatgtgaatgctcaaggattaatggagcacttggttttaatgctgcaggaggg

SEQ ID NO: 1634 - DNA, 178 bp, Bacillus licheniformis
atgaagccgatttctctgtctattaagggcctgcacagtttcaggcaggagcaggtgatcgattttgagcgcctgtgcgatgccggtgtattcggcatcttcgggccgaccggaagcggcaagtcgtcgattcttgatgcgatgactcttgctttgtacgggaaagtggagcgggccg

SEQ ID NO: 1635 - DNA, 156 bp, Bacillus licheniformis
aaaaattcaattgatcggttttggtaactttgaggttcgtgagcgctcagctcgtaaaggacgcaatcctcaaacaggtgaagaaatcgaaatccctgcaagcaaagtacctgctttcaaaccaggtaaagcgcttaaagacgctgtagcaggaaa

SEQ ID NO: 1636 - DNA, 234 bp, Bacillus licheniformis
aaacaaaccgggatgacctgacatttgaagaggcgatgaaaggtttggaacagatcgtatcaaagcttgaagaaggggacgtgcctttggaaaaggcgatcgactatttccaggaggggatggctctttcgaaaatatgccacgaaaaactgcaaaatgtcgaaaaacagatggacttcattttgcgggaaaacggggaattagctcctttcagtgttcgggaggaggaaaaag

SEQ ID NO: 1637 - DNA, 150 bp, Bacillus licheniformis
taaaaacatatcggatctttggaatcaagctttggggcagattgaaaaaaaattgagcaagcccagctttgaaacatggatgaaattgacaaaggcccattcattgcaggtcgatacgctgatcatctccgcaccgaacgagttcgccag

SEQ ID NO: 1638 - DNA, 216 bp, Bacillus licheniformis
  misc_feature (1)...(216): n = A,T,C or G
ccagctcattatttccggggcatcgctcgtcgaatcgcttcatgcgaaaaagcagccgtccgtctatattaaagtggaggaaagccagcacncacccaatattttcaagaagatcagcagcatcctgcttgaacacaaaggggaaacgccggtctgcgtctattatgaaaaacggaagcagacgatgcagctgccggaaagctataatatcaaggc

SEQ ID NO: 1639 - DNA, 176 bp, Bacillus licheniformis
atgctgaatagaacggtacttgtcggaagattaacaagagatcctgacctaagatatgtcggggatggtaaaccggtagtcagctttaccattgcagtcaatcggacatttaaaaaccagaacggagaaacggaagcggactttatcaactgtgtcgcatggttgcagcacgctca

SEQ ID NO: 1640 - DNA, 159 bp, Bacillus licheniformis
gcaatgaaggcggcgggagagagcgaatcgaagcgcctctttcagaaatcgtcaggctcagggagaacaagctgacgtttgcggagattgcagccgtgttgagaggcttcggatacagcatatcaaaagcaaccgttcaccgccgctaccaggagtata

SEQ ID NO: 1641 - DNA, 417 bp, Bacillus licheniformis
atgttgcccaagcactcaaaagatcagcgtaaacagcttgaagtcgttgccttaagtgaacttgtccctgaagatcaactggtcaggaagatggaagaagccatggatttttcatttatttatgaaaaagttgcccctctttattcttcaaaagcacgtccaagcattgatcccgttgtattgatcaaaatggttctgattcaatacgtgtttgggcatcgctccatgcgcgaaaccatcgaacgggtttttgcggatttaaaacacaagcgtggcctgcgctggacaaccctgcggggaaagaaaaaattgtccatgcaggcgatgcttgttttcgctgccatgaatctaaaaaactggcgaattggacgtggaaaggccctaatcgccagccttttcatcgaaaaaacaaaataa

SEQ ID NO: 1642 - DNA, 300 bp, Bacillus licheniformis
tgtttgcgatatcccaagataacccgaaaacaacgcctcctgatcattgtcgatttgatgcttgtattgtgataccgcatgattatcaagtcgatgataccgtttttgaaggcgaaatttccggcggacaataccttatttacgaggttgaacatacagcagaagctattcaaaaagcatattcagatattttctcatctctgcaaaacaaataccaattggacaataggccaatcatggaaaaatacgttggtgatatggtgaacagtccgtattgcgaaatatgtgtgcccttaaaat

SEQ ID NO: 1643 - DNA, 456 bp, Bacillus licheniformis
ccatggttgtatttctcgatggaaaaccgcataaaaaagagtaccgcaaatataagatcaagacggttgaaggtcctgacgactacggatcaatgcgcgaagtcatcagaagaagatatacaagggtgctgaaagagaatctgccgctgcctgatttaattttgatcgacggcggaaaggggcaggtgtctgccgcccttgacgttctggaaaatgaactgggtctcgatgtccctgttgccggtctggtgaaagacgataagcacagaacatccaaccttttgatcggcgatccccttgagatcgtccagcttgagcggaacagccaggaattttacctgcttcagcgcattcaggacgaagtgcacaggtttgcgatcagcttccacaggcagctcaggggaaaaagcgcatttcaatcggtgctggacggcataccgggcgtcggcgaacagc

SEQ ID NO: 1644 - DNA, 324 bp, Bacillus licheniformis
cacaacaaaaagaaatgctcttgtctaatggaatcacctcagaagctaaatatgtccttatacggggcgatatgcgtcctctaaggcttgcatatccaaacgaccttttaaaccgtatgatcactaaaaataagcttcacagaatcacaattcacggttttaggcattctcacgcatcaatcctttttgaagcaggcgcatccataaaagaagtacaagcccgtttaggtcacaaagaaattcaaacgactatgaacatctatacacatgtcacgaaaaccgcaaaagcaaaaacggccgaaacatttaaaaagtacatggaat

SEQ ID NO: 1645 - DNA, 132 bp, Bacillus licheniformis
aaggagcgggcccgctcgtcgatgaagccggcgccaagctgatcaagaaacacggcgaagacgcattgcgggtattcacaaagctgcattttgccaatacgcagaaggcgaagcggattgcgtcgaaacggt

SEQ ID NO: 1646 - DNA, 315 bp, Bacillus licheniformis
atgaagcttgaaaacttgactttactgccgtttgcccgaaatgtcaacctgttgttttcaaggtcgacgctcatcgtatccagtgtcgccggagccatttggcttgcgacaaagcgctcccagatcagcttgtatagccgaagctggtctcttcccaataccgccctcagatcggaaggctttatgagcaccgaggtcggcttgatcgcttcgtgggcatcctgggcgttttcattctttttggccggctttcgcttgctacccaaaaattcttttccgtactgttcgccgatgaatgatgccgattattcttga

SEQ ID NO: 1647 - DNA, 258 bp, Bacillus licheniformis
atgcctgataataaattcggcgcttatacagatattgtgattgatggcgaagtctacggacgtgcggtgcggacaaggcaagatgtcaaaccgatatttctatcatgcggacatttgattgatttagacagcagttatgacatcgcgatgagcttaatcaatcgagaaagcaggctgccgattccggttcggctcgcggatcttgagacccatactttacgtggatattacagagagaatccaaaattgaccgagtag

SEQ ID NO: 1648 - DNA, 123 bp, Bacillus licheniformis
ctgccgccgcaaaatatcgaagccgaacaggccgtgttaggtgctgtttttttagaaccatcagctttaactttggcgtcagaagtcttgattccagatgatttttacagaatgtcgcaccaa

SEQ ID NO: 1649 - DNA, 678 bp, Bacillus licheniformis
atgcccttcctgcataggagtgagcggcggcgatcagacaaaaaacaatgctctgcgccttttaaaaggctggaaaggttgagcggaatgtctttaaaacgaaaacttaatcgctataagcatcacctgggaaatcaagcgaaagaagaaaaaacggaacctcccgcagataagctgacttccttgtccgtcagttttgaaaaagaatgggccgaactcggtgttaaaccatatgtgtttgaggaatgctattgcctgatcagggaagtcgtttacccgttgactcatgttcatggtcattacgcgttttctgagctgcatgagacggttaggcgatggaacaacagcgccgtttcccattcgctttcaagcaaagggtacacaccgagccagctcttcttctttgatacggaaacgaccggtctcggaggcggggccggcaatgcgatctttttgctcggccatgcaagggtgtatgacgaccgcgtagtcgtcaaacagcatctgctgccaaagccggggtacgaagccgccctctatcacagctttctgagtgaagtcgatattcagtctcttgtcacctataacggcaaagcgttcgactggccccaggtgaaaacgaggaccacgctgattcccgacagggtgccaaaactttccgatttttggcccctttga

SEQ ID NO: 1650 - DNA, 201 bp, Bacillus licheniformis
atgcggctcttcatgaatcgacaatttcagtctgagcggcaagccgcaatatttacacgtgatcctgtcttttcttgcttcatcaaagaggaattgcaggtgttctctcgaatatgtatgtatatgaatgtctcggttattgaatcgggcgcatttcaaaaagaggtcctccaattaatgggtagtcgtctggtgtcatga

SEQ ID NO: 1651 - DNA, 1143 bp, Bacillus licheniformis; identical to SEQ ID NO: 1598

SEQ ID NO: 1652 - DNA, 2505 bp, Bacillus licheniformis
caacgatgtcatttcctttcaccagcctccattccaaaacagtccccgcccgattttgtatacctcgctgttttaagggcatgtgcagcacaccagtccgcaaaacatcgtcaatgtttcaagcaagcaaatgcagagctttcacggacaaatgaatgtgctcaaaaatgagatcgaacggtttaaaaaatcgaaatatacgacggtttttctcggagacagcaaagagcgcgtcgaaaaactagcatctgtactgtccgactatgacatcgaagccgcacaggccgaccaggatgcagcgctcgcccaaggccagatttacattatggaaggcggtcttcaatccggttttgagcttccgatgatcaagctggccgttatcacggaggaagagctgtttaaaaagcgtgtcaaaaagcaggcgcgcaaacaaaaactgaccaatgccgaacggattaaaagctactcggagcttcagatcggcgattatgtcgttcatgtaaaccacggtatcggaaagtatttagggattgaaacgttggagatcaacggcattcataaggactacctgaatattcactaccagggaagcgacaagctttacgtaccggttgaccaaattgatcaggtgcaaaaatacgtcggttccgaaggtaaagagccgaagctttataaactcgggggaagcgaatggaaacgggttaagaaaaaggttgaaagctctgttcaggatatcgccgatgacttgatcaagctctatgccgaaagagaagcaagcaaaggctacgcgttttcacccgaccatgaaatgcagcgtgaatttgaagccgcatttccttatcaggagacagaggatcagctgagatcgatccatgagattaaaagagacatggaaaaagaaagaccgatggaccggctcctttgcggcgatgtgggctacggcaaaaccgaagtggcgatccgcgccgcttttaaggcgattgcagacggaaaacaggtcgcgatccttgtgccgactacgatcctagcacagcagcactatgaaacgatattggagcgctttcaggactacccgattaatatcggtttgctcagccggttccggacgagaaaagaagcaaatgaaacgatcaagggcttgaaaaacggaacggtagacatcgtgatcggcactcacaggctgttgtccaaggatgtcgtatacaaagatcttggtctgcttatcatcgatgaagaacaaaggttcggtgtcacacataaggaaaaaattaaacgcattaaagcgaatgtcgacgttttgacgttaacggcaactccgatacctcgaacccttcatatgtccatgcttggtgtcagagatttgtcagtcattgaaacgcctccggaaaaccgcttcccggtacagacgtacgttgtcgaatacaacggggccttggtcagggaagcgatagaacgcgagctggccagaggcggtcaggtttacttcctgtacaaccgggtggaggatattgaaagaaaagcagaagaaatctcgatgcttgtacctgacgccaaggtgacgtacgcccatggaaagatgacagaaaacgaactcgaatcggtcatgctgaacttcttagagggagaatcggatgtactagtcagcacgacgattattgagacgggcgttgatattccaaacgtcaatactttgatcgtatttgacgcagacaagatggggctttcccagctgtaccagctgaggggccgcgtcggccgctcaaaccgtgtagcttacgcttattttacgtaccggaaggacaaagtcctaacggaagtggctgaaaaaaggcttcaggcgattaaagaatttacagaactcgggtcaggatttaaaatcgcgatgcgcgatttgacgatccgcggcgccggaaaccttttaggtgcgcagcagcacgggttcatcgattctgtcggtttcgatttatattcgcaaatgctcaaggaagcaatagaggcgcgcaagggagatgcaccgcaagctgaaaagtttgagccggaaatcgatttggagcttgacgcatatattccgcagacgtatgtgacagacggcaagcaaaaaatagatatgtataaacggtttagagcgatttcaaccattgaagaaaagagcgagcttcaagacgagatgatcgaccgcttcggcgaatatccgaaagaagtagaatatttattcgccatcgctgaggcgaaggtatatgccatcaaggaacgcgtcgagctgatcaaacaggataaagacgccgtcagactgacaattgacgaaaaagctagtgccgaaattgacggtcaaaaactgtttgaactcggcagcaagtacggcagacagatcggccttggaatggaagggaagaaattgaaaatctcgattcaagtgaaaaaccgaaaaccggaggaatggctggaaacgcttctcgacatattgaagggccttcaaaacgttaaaaagcaaacgatcgcttcatc

SEQ ID NO: 1653 - DNA, 2043 bp, Bacillus licheniformis
aacacaatctgcaacttagtatatctgttataaaaggcgtcgggacggaaacggaaaaaacgttgaacgagctcggaatctatacggttctcgatcttttaaactacttcccgtaccgatatgacgattatgaattgcgcgatttggaagatgtggcacacgatgaacgagtgacggtggaagggaaggttcacagcgagccttctcttgcctattacgggaaaaagcggagccgtctcacgttccggcttttggtcgggaactatttgatcacagcggtttgctttaacaggccttatttgaaaaaaaagcttgcgatcggctcgattgttaccgtaaccggaaaatgggacaagcacagacaatccgtgatggtgcaagagctgaaaaacgggccgcaccagggtgatcagtcgattgaacccgtatactccgtcaaagaaaacatcaccgtaaagacgatgaggaaattgattcaggaagctgtccgcagccatttgccgtttgccgaagatcctcttccggaaaagcttcggaccgcctacaaacttctgtcttaccaggaggcggtaaaggcgatgcacaagcccgagtcgagggaagctttaaagcatgcgcggcgccgttttgtatatgaggaatttttgctgtttcagctgaaaatgcaggctttgcgaaagttcgagcgggaagcgtccgacggaatcagccacacctttcggctcgaagacgtcaattcgtttgtcaaaagccttccgtttcctttgacaaacgcgcaggcgaaagcgctcgacgacatattaagggacatggcttcagggtataaaatgaatcggcttttgcaaggagacgtcggttcaggcaaaacagccgtcgccgcgattgcgctatacgcctcgctgctttccggattccagggggcgatgatggtgccgaccgaaatactggcggaacagcacgccgattcgcttgtatccctctttgagcagcacgacgtcaatgtggcgcttttaacaagctctgtgaaagggaaaaggagaagagagcttttagaaagattaaaagaaggagaaattgatattttggtggggacgcacgcccttattcaggacgatgtccactttaaacagctcgggctcgtgatcaccgatgaacagcaccgcttcggcgtcgagcaaagaaaaaaactgagaagcaaagggaaagatcccgatgtcttgtttatgacggcgacgccgattccgagaacactggcgatcacggttttcggggaaatggatgtgtccgtcatcgatgaaatgccggctgggcgaaagcggatcgagacgtattgggtaaagcacgacatgctcgaacggattctcgcgtttatcgataaagaactgaaaaaaggcagacaggcgtatgtgatctgtcccttgattgaagagtcggacaagctcgacgttcaaaatgcaattgatgtgcacagcatgctgactcatgccttcaggggaagatggcagatcggtctcatgcacggaaagctgtcaaatgacgagaaagaacaggtaatgaggcagttcagcaaaaacgaatgccagattctcgtttccacaaccgtcgttgaagtcggggtaaacgttccgaatgcgacggtcatgctgatctatgatgccgaccggttcggtctttcccagctgcatcagcttcgcggccgggtcggacggggcgatcaccagtcgtattgcatcctgatggcagacccgaaatctgagacgggaaaagagcgcatgagcatcatgtctgagacgacggacggctttgagctttctgaaaaagatcttgaactcagagggcccggggactttttcggcaagaaacagagcgggatgccggagtttaaagtcgccgacatggttcacgactaccgcgcgctggaaacggcaagaagagacgctgcagaacttgtctcttcaaaagcgttctggacggatgccgaatataaaagcctgcgggaacacttgcaaaacagcggggttatggacggagagaagctgagct

SEQ ID NO: 1654 - DNA, 771 bp, Bacillus licheniformis
atcctatataacaaaaagcgatgattttaaatccatcgtcaacggcttgaacgaagggctgaaggaacagctgcttgcggggctctccggatctgcccggtcgttatttacagccgctcttacaaaagaaacgagacggccggtatttttaattacgcataacctttatcaggctcaaaaaattacagatgatttaacagggctgataaaagatcagcctgtccttttatatcctgtcaacgaattgatttcttctgaaatagcggtggcaagccctgagctgcgctcgcaaaggcttgatgtcttaaataggcttgcaagcggtgaaacgcctatcgttgttgctccggcagcagccgtcagaagaatgctgcctcctgtcgaagtatggcaaaacagtcagattcacattgagacggggcgcgacattgacacggaacagctgctccagaagctcgttcaaatggggtatgagcgtacagatatggtggcggcgccaggcgaattcagcatacgcgggggcattatcgatgtctactctttgactgaagaaaatcctgtccggattgaattgtttgatacagaagttgactcgattcgtatattcaatacggatgatcagcgctcactggaaacgcgcgatgaagtaacgatcggccctgcgaaggaactgatcgtgcgggatgaagacaggcaaagggcgcttgaacaaatcgatcaaggccttgccaacagccttaaaaagctgaagctcgattaacaaaaggaaat

SEQ ID NO: 1655 - DNA, 657 bp, Bacillus licheniformis
  misc_feature (1)...(657): n = A,T,C or G
atggatcgtccgacantnnnannnngccntttttgtcacccaatatggaaccccttccagaactccccaattaatttcggtttgcccacccggtcccggacaaaaaaaaaaccaattaaaccaaccaggggcttaaaaaacgaaccggtaaactccttaaccgccccccccgggcttttttccaaggatttcttatacaaaaacctgggcctccttaccaccaaaaaaaaacaagggtccggtttcccccttaaggaaaaatttaacccctttaaaccaaatttcaactttttaactttaacggcaaccccaatcccccaaaccctccatatttccatccttggtttcaaaaatttttcatccattaaaacccccccgaaaaacccctccccggtacaaacttattttttcaaatacaacggggccttggctcgggaaccaataaaacccaacctggccaaaggcggccaggtttactccctttacaaccgggtgaaggatattaaaaaaaaaccaaaaaaatccccaatccttttccctaaccccaaggtaactttcccccttggaaaaataacaaaaaacaatctcaattccggccatcctaaattccttaaagggagaatccgaattttctattccgccccaacaatttattaa

SEQ ID NO: 1656 - DNA, 1320 bp, Bacillus licheniformis
atgaaacaaacgaaatttgaaatgtacgatttaaagccgtttattatagaggctgttcaccacttgggattttatgagccgactgatattcaaaagcggttaatccctgcggcgctgaaaggggagagcgcgatcgggcagtcgcagacaggtacgggaaaaacgcacgcctatctgctcccgcttttaagcaggatcgatcctgaaaaggagttcgttcaagtcgtgattacggctccgacaagggagctggccaaccagattcatcaggaagttctgaaaatcaccaagtttttagggcctgatgaagcgattcgttcgaaatgtttcatcggcggtaccgataaacaaaaatcgattgacaaattaaaaacgcagccccatctggtggtaggtacgccggggcgaattgcagacctgatcagggagcaggcgctcgatgttcataaagccggttcgttcgttattgacgaggcggacttaatgcttgatatgggatttttggaagatgtcgattttatcgggtcgcatatgccggaaggcttgcagatgcttgtattttccgcaacgattcccgaaaaattaaagcctttcctgaaaaaatacatggccaatccgaggtatgcacatgttgagccgaagcacatcacggctgaaaaaatcgaacacgtgctgataccttccaggcacagggataaaaatgagctgctgctcgaggtcatgacccatttaaatccgtatttggcgattgttttcgccaatacaaaaacaacggccgacgagatcgccgcttatctgacggacaaagggatgaaagtcggacttctgcacggggggcttacgccgcgggaacgaaaaaaagtgatgaagcaaatcggcgatctggaattcacctatatcatagccactgatttggctgcaaggggaatcgatattaaaggcgtcagccatgtcattaactatgaactgcctgatgatcttgacttttacgttcaccgcgtcggccgtacagcgcgcgccggaacatccggaacagcggtgacgttttatgatacatctgatgaagatgcacttgtgaagcttgaacagatggggatcgtgtttgaaaacatgaggattgaaaaaggcgagtggaaaaagatcgatgaccgcaagcgccgtcagaaccgaaaaagaacgcctgatgaaacggatgaggtcgccaagcggcttgtgaaaaaaccgagaaaagtcaagcctggatataagaagaaaatgcagacggaaatccaaaaaataaaaagacagcaaaaaagaaagcaatttagaaaaggaaagtag

SEQ ID NO: 1657 - DNA, 1374 bp, Bacillus licheniformis
ttcacatcgaacaaccggcattctatacccgtgaattgcggtcatgtttggagcagcgccaccttctgaaaagcgaacttccttttcgtgaatccgtcgttgattggcatatccaagaaggcttgataaaaacggaggaaggtattaaaaaaacgaagaaaggctttatttgtttgaggtgcggccagcacgaacgctcatttttcgcccggtatccttgctatcggtgcagtaaatgctgcgtgtactgccgatcctgcgtcatgatgggcagggtgagcgattgtacgcctctgttgacttggcacatgcatgtcagccataaatgggcgcctgttcatacggagtggaaaggcgcgctttcagcaggtcaggagaaagcggccaaatccattatcaatgctatacgaagaaaagaagaactgttggtctgggcggtttgcgggtcggggaaaacagaacttctctttcaagggatcgaattcgcgctgaacaacggcttgacagtatgtatcgctactccgagaaccgatgtcgtactcgagcttgctccgcggtttcgccaagcctttccaggggtggaaattgccgctttgtacggaggaagctcagacgttgggaatctctcgccgcttatcatttcaactacccaccagctgctccgctataaagaagcatttgacgtgatcatcatagatgaggtggatgcttttccgtattctattgataacacgctgcaatacgctgttaaaaaatcggcaaaacggcaaagcgctcacatctatttaactgccacgccttcagcagatatgaaaaaaagggctgagagcggaaagctggacaccgtccgtattcccgcgagattccaccgcagccccttgcctgaacctacattgatttggtgcggaaattggaaaaagagtttgaaacgaagaaaagttccttttcgcctcaaaaaatggctttttaagcaccaagaactgcagcaaccggtttttttattcgttccctctgtccctgttcttaaatctgtggtcagtgtgctgaaaaaggaaacatttcgcgctgaaggagtttatgccgatgaccctgacagaaatgaaaaagtgaaccggtttagggaaagtaagcttgaggtgctcgtgacaacaacgattttggaaagaggagtgaccgtcaaaaaagcgcaggttggagtattgggggcagagtcggcggtttttaccgaaagcgccctcgtccaaatggcgggaagagccggcaggcatcccgagcacacagatggagacgtctgtttctttcattacggcaggacaaagtcgatgaatgcggcacgacgtcatattcaaaacatgaataaaatgtctaaaaagg

SEQ ID NO: 1658 - DNA, 995 bp, Bacillus licheniformis
cgtgacgtgatcgccgagtcgccgactggaacgggcaaaacgctcgcatacgtcctgccgattctggaaaagctggaggcggatcaaaagaacgtgcaagctgtgattctggctccatcccgcgagcttgtcatgcagatttttgatgtgatcgttgaatggaaaaaaggctctgatatcagagccgcttccctgatcggcggcgccaatatcaaaaagcagcaggaaaagctgaaaaaacacccgcacatcattgcaggtacgcctggacgcgtatttgagctgattaaaatgaaaaagctgaaaatgcacgaagtgaaaacgatcgtccttgacgaaaccgatcatctgcttacgccggagcaccgcgggacgatacaaagcatcatcaaatcgacgctccgcgacaggcagctcctctgtttttcggcgactttaaaagacgatgccgaacgcgagcttcgtgaaatgaccaaggatgcggaagttctcaagatcaagaggtcgaaagaagaatcggcaaaagtcaaacatcaatttctcgtatgcgaccagcgggataaggtgaaaattctgcagaaattctctcggcttccaggcatgcaggcgctcgtctttgttaaagacatcggcaatttaaacgtatatgccgaaaagctcaaatttcatcatgtagaaatcggcgtccttcacagcgaggcgaaaaaaattgagcgcgccaaaatattgcaggcatttgaggcgggagagttcacactgcttctcgcgaccgatatcgcagcgcgcgggatcgacatcgaagatctcccttatgtcatccacgccgatttgccaaacgttgaaggctatatccaccggtcgggaaggacgggaagagcggggaatgaaggaaccgtgatcagccttgtcaaccgcattgaagaagaaaggctgaaaaagctggcgaagaagcttgaaattccgcttcagcggatcgtgtatgaaagaggacggat

SEQ ID NO: 1659 - DNA, 951 bp, Bacillus licheniformis
ttttagagactatgcattaagcggcgatattacgaaagcgctcgatcacttaggatataaggagccgactgcggtgcagagcgaagtgattcccgcggtgcttaaaaagcgggatgttgtggtgaaatcgcggacggggagcgggaagacggccgcgttcggaattccgctttgcgagctgaccgaatgggaagagaacaaaccacaagccttggttttgacaccgacgcgcgagcttgccgctcaggttaaggaggatttgacgaacatcggccgctataaaagaataaaagcagcggctgtttacgggaagtcatcctttgaacggcaaaaaacggagctcaagcaaaaatgccatatcgttgtcgggccgccgggccgcgtattggatcacattgaaaaaggaacccttccattagaaaaactgaaataccttgtcatcgatgaggccgatgaaatgctgaatatgggatttatcgatcaagtgggagcaatcatccgccatttgcctgaagaacggctgacaatgctgttttcagcaacttttccggaggatgtggagcatctatcccttcaatatatgaaagaccctttgaaaatcgagattaaagcaggcggtacgacaaccgcagacatcgagcatcaactgatcattgtaaacgaaaatgatccattttcgcttttagtggatctgttcattgttgaaaacccggacagctgcatcgtcttttgccgcacacaggagcaagtgaatgagttgcagtggcgcctatccgttttgggttatccgtgcgagaaaattcacggcggcatgcctcaggaggatcgttttgccgtgatgaaccgtttcagacggggagcgttccgctatttaatcgcgacagatgtggcggcaagaggcatcgacattgagaacatcacacatgtcatcaactataagctgccattaga

SEQ ID NO: 1660 - DNA, 939 bp, Bacillus licheniformis
  misc_feature (1)...(939): n = A,T,C or G
tgcacaccgttgtgcttgatgaagcgcacgaaatgctgaacatggcattcatcgcagacatcgaatccatcctttccaatgtgcctgctgaacaccagacattgctgttttctgcaccaatgcctgctccgattaagcggattgcagaacgtttcatgaccaacccggagcacgtaaaagtgaaagcaaaagaaatgacagtatcaaacatccagcagttctacctagaagttcatgaacgcaaaaagtttgatacgctgacacgccttcttgacatccagtctccggaattggcgatcgtattcggccggacaaagcgccgtgtcgatgaactgacagaagcgcttaatctgcgcgggtatacagctgaaggaattcacggagatttgacccaggcgaagcggatggttgcactccggaaatttaagcaaggcgcgattgaagtgctcgttgcgacagacgttgcggctcgcggccttgatatttcaggtgtaacgcacgtctacaacttcgatgtgccgcaagatcctgagagctatgttcaccgcatcggaagaacgggacgcgcgggcaaaacaggaatggcgatgaccttcattacaccgcgtgaaaaggatatgctgcgcgccatcgagcagacgacaaaacgcaaaatggaccgcatgaaagcaccgactctcgatgaggccattgaaggacatcatcaggtgacggttgaccgcatccggacgatcatcgaggaaaataacctgaacttctatatgacggctgccgcggaattattggaagaacatgattctgtgacagttgttgcggctgccattnnnatgatgactaaagacccggacaacacacctgtcccttttgaccgaagatgctcccctcttaaccagcccaaaccaaaatcaccaccaccgttcatctctaaccctaatacgg

SEQ ID NO: 1661 - DNA, 623 bp, Bacillus licheniformis
  misc_feature (1)...(623): n = A,T,C or G
atgaacgacagcagcgagcttnngatattgctccgccttcgcggcacactctccctatntttgctgaccaagtggtggaagcaggacctatccttgtctcttacgggcgaaaaaaaccatcttttaacgaagctttcattaaaaagatcagacttgtgctccatacgaaaactggcggaacaagaactgtctaatgttaaacggctcatccgttcttacgaggcggccggcgtccgcatgaccgccatatcttcccctgattatccagccagcctgaaaaccattcatgacccgcctcccgtcctttttttaaaaggaaacaaaaaacttctccatgaacaaagaaagatcggaatagtcggaactcgctgcccgtcattatacggaaaaagagctgcggtccagcttgtcagggagctttgcaaaaacagctggacgatcgtcagcggtcttgcaaaaggaattgacggtctcgcccatcaggagagcatccgttcaaagggaaggacaatcggcgttatcgcgggcggattcaacagcatatatccccgtgaacatcgccagctcgccggacaaatggccgaaagccacctgctggtatcagagcaccctcctcacattaa

SEQ ID NO: 1662 - DNA, 567 bp, Bacillus licheniformis
atgatcaaactgaagcatttagaggagaaaaccatatcaaaggaaaagcttttttcaggcaaggtgatcgatctttatcttgaagatgtcgaactgccgaacggtaaaacgggaaagcgcgaaatcgtgaagcatccgggcgctgtaccggtgcttgctttaactgatgaagaaaacatcatcttagttaagcagtacagaaaagcgcttgaacggacgatcgttgaaataccggcgggcaagcttgaaaaaggggagaaacccgaatataccgcgctgcgggagcttgaggaagagacgggatacacggcggcgaagcttgagaaaatcaccgctttttacacatcgccgggctttgcggacgaactggtgcatctgtacctggctgaagagctgacgccgcttgaagaaaagcgcgaacttgatgaagacgaatttgttgaagtactggaggtgccgctttcaggcgcgctgaaactgatggaaactcaggacatctatgatgcgaaaacggcttatgccgtgcagtatctggagctgagaaaggccctgcaagcaaaaaaatga

SEQ ID NO: 1663 - DNA, 592 bp, Bacillus licheniformis
atgacaaaggagatgaagtggctggattgggcaaaggaaattcaagctatcgcccaggcggggcttgcctatacaaaagatgactttgatcgtgaacgttttgagcagcttcgcgagctgagctgcgaaatcatcgccgattatacggaaacggacttctctaaagtgaaagagctttttgccggggaatcgggctatcaaacgcctaaagtcgatgtgagagccgtaatttttaaagatcataagctcctccttgtccaggaaaaagcagacggcaaatgggcgctgccaggcggatgggcagacatcggctttacgccgaaagaaatcgcggttaaagaaacgcttgaagagacaggtttgaaagtcaaggcgcataaacttctggcggtcatggataaaaagcgccacaaccaccccccttccgccttccacatctataagctgtttatctcctgtcaaattgtcggaggcaaggcggaagcggggactgaaacacaaaaccttggttttttctcattggagaatctgcctgaattatcggcagcaaggaatacctatgaacagatcgaatatctttttgaaaagcatg

SEQ ID NO: 1664 - DNA, 455 bp, Bacillus licheniformis
ttgcaaagagtgacgaattgtgtgctgacttcaggtgataaagtcctgttgctgcaaaagcccagacgaggctggtgggtggcccccggcggcaaaatggaaagcggggaaaccgtcagggacgccgttatcagggaataccgcgaagagacgggcctgtatgtgctgaacccgcagctgaaaggaatattcacctttatcataaaggaaaatgatcaggttgtatctgaatggatgatgttcacattcgtcgccgatcattatacaggcaagcatgtagaagaatcagaagaaggcatcatcaggtggcatcaggcgggggacgtcggtagcttgccgatggcgccgggcgacgtccatattcttgattttatgctgaaaggcaaaggactgcttcacggcacctttacgtatacgcctgactttgaattgctgtcctatcgcctcgacccgca

SEQ ID NO: 1665 - DNA, 412 bp, Bacillus licheniformis
atgtacgaatttaaagatttttaccgtaatacggttcagctttcttttgagaaggaacctttttcaaaagaaccaaagcatgtatgggtgatctgccgttacgaggatcaatggctgctgacaaatcataaggacaggggccgtgaattccccggcggcaaagtcgaaccgagcgaaaacgctgaggaagcggctttgcgggaagtgaaggaagaaacgggcgctgtcgtaagaaagctgacctatctctggacaatataaagttcttggcagggagaaagtgatcgtcaaaaatatttattttgccgatatcgaaaagatagaaaaacagcagacgtactatgagacgaatggtcctgttttgctgaagagcctcccgaaggatatcgcaaaaaacaaaaattacagtttt

SEQ ID NO: 1666 - DNA, 1919 bp, Bacillus licheniformis
ttgcgcgtttccaatgtaacggtcagaaaacgtttaatattcgttctgctttttggtgtgatcatctttttgattattgatacaaggctcggatacgttcagttcgttctcggggataaactgacgactttagcaaaagattcttggagccggaaccttccttttgagccggaaaggggcgaaatattggacaggaacggcgtcaagctggcaacaaaccaaagcgcgccatcggttttggttgttccgaagcaagttgaaaatccgatcaaaacgagcagactgctggccagcgttttgaatatgtcggaagaaaaagcgtataaacatgtcacgaaaaaaacgtcgattgaaaggatcaatcccgagggccggaagatttcccacgagaaagcaaaagaagtcagagatctcaatttgaaaggcgtatacatcgcagaagactcgatccgccattatccgttcggcagctatctgtcccatgtgctcggatttgcgggcattgacaaccagggtctgctcggccttgaagccttttatgacaaagagctgaagggcgaaaagggctatgtgaaattttattccgatgcaaaaggcaagagaatgcctggggaggcggatgactataccccgccgaaagacgggcttgatatgaagctgacgatcgattcaaaggtgcagacgatcatggagcgggaatttgatatcgcagaagcgaagtataatccggacggtatggtcggtgttgcgatgaatccgaaaaacggggagatattggcgatggtcagccggccggactttgatcccgcaaactaccaatcaatcgatcccaaagtctataaccggaacctgcctgtatggagcacatatgagccgggttctacttttaaaatcatcacgcttgccgcagctttggaggaaaacaaagtcaacctccaaaaagatcaattctatgataaaggttccgttgaagtggacggcgcgaggctgaagtgctggaagcgcggcggacacggcgcacaatcgtttcttgaagtcgtccaaaattcgtgcaacccgggatttgttgagcttggtcagcggctcggcaaagaaaaactgttcacctacattaaaagtttcggcttcggacaaaaaaccgggatcgatctgcaaggcgaaggaacaggcatcctattccctcttgaccgcgtcggccccgtagagcaggcgacaacagctttcgggcagggggtatcggtgacgccgatccagcaggtcacggccgtttctgcggctgttaacggcggaacgctgtatacgccgtatattgccaaagagtggattgatcccgtgacaaaacaaacagtgaaaaaacagacgccgatcgccaaaagaaaagtgatttctgaagagacatccaaacagatccgctacgcgctggagagcgttgtcgcccaggggacggggcggaacgcttttgtcgacggctaccgggtcggcggcaaaaccggtacggcgcaaaaagtaaaagacgggaaatatttgaaaaacaaccacatcgtctcatttatcggaacggctccttcagatgatccgagcattgtcgtctacgtcgccgtcgacaacccgaaaggaacgattcaattcgggggtacggttgcagcgccgatcgtcggaaacatcatgagagacagtcttccgcagctcggcgttaagaagcggaaagatcagatcgaacgcgaatatcaatggctggacaaaaagctgatcgaggtcccgaaccttatagggctttccgtgacagagcttgaaccattgctgatcaacctcaggctgaaggcttccggagaaggcgatgtcgtcgttcagcagtcccctaagccgggcgaaaaagtaaaagaaggatcgacgattcgcatttatcttgacagcgatga

SEQ ID NO: 1667 - DNA, 1800 bp, Bacillus licheniformis
atgagcagttctttctttattccctttttggttagtcaaattctattgtctctgtttttttctctcatcatactcataaaaaaactgctgaaggctcaaatcactgtaggcacccactatcatcttagcgtgatttctcttttggcattgatcgctccttttctcccctttcattatctaaaaagcaatcattttgactggattctgaatttaggaggagctagctcaacgctatctcacacccgttccacagataagacggcggaagcaattggccaacatgcaaactgggtgcaggatttttcgatgtcgattgaacaatcgtccttcaaaatgatagattcagcctttttcgcagtctggatattgggcattgctgttatgcttatcgctactctttatagcaatcgaaaaatcggcaaaataaaaaagagcctgcaaatggttaacaacaaagagctattaaccctttttcgtacatgtaaagaggaaatacgctttcatcaaaaagtgattttaggctgttccccattgataaaatcccccataacatttggggttgtccgtccatatattatcttgccaaaggatatttcaatgttttctgccgacgagatgaaatgtgttttgcttcatgaactgtaccattgtaaacgaaaagatatgctcatcaactattttctttgcctgtccaaaatcgtctattggtttaatcctctcgtgtggtatttatcaaaggaagcaaaaacagagatggagatttcttgcgactttgccgtattaaaaacgcttgataaaaaattgcatctcaaatatggcgaggtgattttaaaattcacttcacttaagcaaagaacgtcatctttggtagccgcttctgaattcagcagctcatacaaacatatcaaaaggcggattgtcacagttgtcaacttcaaggcggcatcacctttgctaaaggtgaaaagcgccttagtgttcgcccttgttcttgggatcattctagccggcactccttctgtatctatattgactatgcaaagagatacgcactttttatctggtgcaaatgtagaatacgaagatgacagcaccttttttgatggcttctcaggaggttttgtcctgtttgattctaacaggaaaaagtatacaatatacaataggaaagaaagcaccgccagattcgcacctgcttctacatacaaggtgttcagcgcattgctcgcactggaatccgggatcatcacgaagaacaattctcaaatgacgtgggacggaactcaatatccgtataaagaatggaatcaagaccaggatttattctctgcgatgagcagctccgcaacatggtattttcaaaaactggaccggcaaattggagaggatcatttgcgtcgctatctcaaatctatccattatggaaatgaggatttctcaggtccggcgaattattggctggatggctctcttcaaatttcccctcttgaacaggttaatatgttaaaaaagttttatgataacgaatttgattttaaacagtctaatattcaaactgtgaaagattcgatacgtttagaagaatcaaatggcagaattctatccggtaaaaccgggacttcagttatcaacggagaacttcatgccggctggtttgtcggatatgtagaaactgccgaaaatacttttttctttgctgttcatattcaaggtgaaaaacgggctgccggaagcactgctgccgagattgcactttccatcttggataaaaaagggatttatccatccgcttcccgataa

SEQ ID NO: 1668 - DNA, 2127 bp, Bacillus licheniformis
gagaaagagatttttcattccaatcatcattacagcggcgatattccttttatcgttaatcggatatattacgattttgttcctgggggattatgtgattgatgaaaagaaactgattttccatgcttcttctaaaatcgtcgaccataatggagaagaagtcgcaagcctctataccgaaaacagaaggcctgtttcaattgccgaggtgccggacaatgtaaaaaatgcctttatcgcggttgaagacaagcgcttttatgagcaccacggcatcgattttaaatcggttagccgtgcggtctataaagatatattagcaggaggaaaagtggaagggggaagcacgatcacccagcagctcgcaaaaaacacttttttgacaaatgacaaaacgtttttaagaaaaacgaaagaagtcattatcgctatcaatttggagcgggattacagcaaagacaagcttttggaaatgtatttgaaccagctatatttcgggcacggcgtctatggaatccaggcggcggcaaactacttttttaacaaagatgtgaaagacttgacggtcagtgagggagcggtgctggcttccattcctaaagcgccttcaacgtattcgcccattctcaatccggaaaaaagccgggagcggcgcaatgtcattctcggcatgatgaacgagcagggatatatcagctcaaaggaaaccgtcagggcccaaggcagcacattggggctccatgtgaaagaaaaatcaaaaaatccgtggcttgacagctatattgatcttgtcatgaaagaagcggaagacaaatattcgatatcgagcgaacagcttctccaaggcggatacacgatcagtgttccgctcgatgtttcgattcaaaaagcggcctacacgctgatgaagcaggacggctattttcccggcacagacaacaaagctgaagggagcgccgtttttatcgataacaggacaggcggcgtagtagccgctctcgggggacgggaatatgctccaaaaggctataacagggccaccgcccagcgccagccgggttcgacgtttaaaccgcttgccgtatacggccccgctcttgaagaaaagctgttcaagccgtattcgatgctcgaggataaacagctgtcatacggcggctactcgcctaaaaactatgacggccaatacgcgggcaaggtctcgatggtggatgcgctgacatacagcaaaaacgcgcctgctgtatggacgttaaatgagatcggaatcgaaacggtgaagccttatctcagccgtatgggcatgaacgtgccggatgaagggctggcattggggctaggcggtctggaaaaaggggtgtcgccgctcgagcttgccggggcataccggacattcgcaaattcaggacaatacaccgagccgttttttattaaaaaaatcaccgatgaaaacggggatgtcatgttccgccacgaggaaaaatcggaaaaggttttcagcaaacaaacagcgtggaacatgacgcggatgctggaggaggtcgtgaaaagcggaacgggaaaggccggtgatttttccggggagattgcaggaaaaacgggttcgaccacgtataccggaaaagagggcggaactaaagacgcctggtttgcggggtatacgcccgaagtgacgggagctgtctggatgggatacgataaaacggatgagtcccattatttaaaaggcggcagcgcttatccgacaaggctgtttaaagacattttaaaacgcaccaaccataagcctgaacggtttaaggcgcctgaaggggtaaaagatctggacaggccgatacgcctcgaagacctggaaagcgttaaagcagactattcctttacgccgatggggctgattacggtgtcattaaaatggcatgaacaagaggataaaagggttgaataccgaatatatgaaaggaaaaacggaaaagaaacgctgattgatacggttaagggaaaaggaagcttttcaatcccttatgcaaacatcttttccgatgcttcctacaaaattgttccatacaatccgcagacgaaaacagagggaaaagggactgattatgttgaaccgaaagtgtttccttc

SEQ ID NO: 1669 - DNA, 1803 bp, Bacillus licheniformis
atgtgtggtattgtaggttatattggccagcttgatgcaaaggaaattttacttaaaggtttggagaagctggagtatcgcggctacgattcagctggaatcgctgtagcgaacgaagacggcgtacacgtgtttaaagaaaaaggacggatcgccgatcttcgcgcagccgttgatgcaaacgtgaagtcacaagcgggaatcggacacacgcgctgggcgactcacggagaaccgagccgtctaaacgctcatccgcatcaaagcgcatcaggccgttttacacttgttcataacggcgtcatcgaaaactatgttcaactgacgcgcgaatatttacacgatgtaacccttaaaagcgatacggatacagaggttgtcgttcaagtgatcgagcaattcgtcaataacggccttgacacagaagaagcgttccgccaaacgctcatgctgctcaaaggctcttatgcgattgcattattcgatcatgaaaacaaagaaacaatctatgttgcgaaaaataaaagcccgcttcttgtcggccttggagacaatttcaatgttgtcgcgtctgatgcgatggcgatgcttcaagtgacaaacgaatacgtggagcttatggataaagaaatggtgattgtcacagacaaaaaagtcgtgatcaaaaacctcgacggagaattgatgtcacgtgcctcatatattgcagagcttgatgcgagcgatatcgaaaaaggcacataccctcactacatgttaaaagaaatcgatgaacagccgcttgtcatgcggaaaatcattcagacgtaccaagatgaaaacggcaagctctccattcctggagacatttcaaacgctgttgctgaagccgaccgcgtctatatcattgcctgcggaactagctaccatgcaggtcttgtcggcaagcaatttattgaaacatgggcgaaagttccggctgaagtccatgtcgcaagcgaattctcttacaatatgccattgctttctgagaagccgctgtttatctttatttctcaaagcggagaaacggctgacagccgcgcggttctcgtacaggtgaaaaagctcggacacaaagcgctgacattgaccaacgtaccgggatccacgctttcccgtgaagcggactatacgcttttactgaatgccggccctgaaatcgcggtagcgtcaacaaaagcatatacggcgcaaatcgccgttctcgcaattttggcagccgtgactgcggaaagccgcggcaaagaactcggctttgatcttgtcaaagagctcggcattatcggaaacgcgatggaagccctttgcgaccaaaaagacgaaatggaaatgatcgcccgtgaatacttgaccgtaacacgcaatgcatttttcatcggccgcggcctcgactatttcgtctgcctcgaaggatccctgaagctgaaagagatttcttacattcaagctgaaggcttcgccggcggcgaattgaagcacggtacgatcgcattgatcgaagacggcacaccggtcatcgcccttgcgacacaggagcacgtcaacttaagcatccgcggaaacgtcaaagaagtgacagcccgcggcgccaacccttgcgtgatctccctgaaaggcctggaagaagcagacgaccgcttcgtcctgcctgaagtgcatccggagctcgcaccgctcgtctccgtcatcccgctgcagctgatcgcatactacgcagcgctgcaccgcggctgtgacgttgataagccacggaacctggcgaagagtgtgacggtggagtag

SEQ ID NO: 1670 - DNA, 2136 bp, Bacillus licheniformis
atgcaaaatgccgaaaaaaaataaattcatgaacagaggagcggcaatactcagcatttgttttgccctctttttctttgtcatcgtaggacggtttgcgtttattcaagcgacgggaaaagtgaacggcgaagtgcttgcgcagaaggcgaacgaacagtatgagaaaaagcggacgatcgaagcccaccgaggatcgatccttgaccggaacggaaaagtgcttgccgaagatgctacgacatataagcttgtcgcgattatgagcgaaaagatgaagcctcaatacgttaaggacaagcagctgacagctgagaagctcgcgccgatcctcggcatggatgaggggaaagtgctcgatattctaaataaaaaaggagcgtttcaggtcgaattcggatcggcgggacgggatttgacatacgcccaaaaagagaaaatcgaaaagctgaagctgccgggcatcgtgttcacccgcgatacgaagcgctactatccaaacggaatcttcgcctccaacctcatcggctattcgcagatcaacgaaaaaacgggtgaaatgcaaggcatgatgggccttgaaaaaacgctgaacgattatttgaaagaaacggacggatacatgacgtacgataccgacagaacgggctggcgcctgccgaacagcaatgaaaagattaaagcgccaaacaacggagacaacgtgtatttgacgatcgatcaaaaaatccaggcgtttttggaagacagcatgacgaccgttcaaaaagagtacaagccgaaaaagattatggcggcggttgttgatccgaaaacgggcaaagtgcttgcgatggggcaaaggccgagcttcaacccgaacgtgcgcgatgtcacgaactattacaacgaccttgtctcctacagctttgagccgggctcgacgatgaagattttcacattggcggcggccatccaagaaggcgtatataatggaggagaacaatacaagtctggatcatattcggtttctaaaaaagataagccgatcaaagaccataacggtggaaacggctggggcccgatcacttttaatgaaggtgttgaacgctcctcaaacgtcgcgtttgcgatccttgccaacgataaactcggcacggaccggttcaatcaatatttgcggaaattccatttttacgacaaaacggggattgacctgcctggggaagcgaacagcaaaatcaactttgaatatttgcgggataaagtgtcgacggcttttggacagagctctgctgtcacgccgatccagcagcttcaggccgcgacggcgatcgccaataacggaaaaatgatgaagccttatgtgatcgatcatgtcgttgattctgacaaaaacaaaacgatttatcaaaataaaccggaacaagtcggccagccgatctctgccaaaacggcaaaagaagtgcgcgagctgttgggaaaagtcgtcacatctgaaaaaggaacggggcagccgtacaagatcgaaggatttgatgtcgccggaaaaaccggtacggcgcaaattgccggagaagacggcagatatttgaccggccgcgaaaactacgtgttctccttcatgggcatggccccgaaggacgatccgcagcttctcgtttatgtggccgtgcagcagccgcaattaaaagctacggaaacaggctctgctccggtgtcaaaaattttcaatccggtgatgaaaaacagtcttcactacttaaatatcacaccgaaagagactgaaaaagaagaaaagcaggaagaaaaacagctgaaaatgcctgatttctccggcaaacgagccgaatccgccgcaaaagaggcgcaaggcagcagccttgttcccgttacgatcggcgatggcttggctgtgaaagaacagtacccgaaagcgggcgaagccgtcctgccgaaccaacgggtcttcctgaaaaccgacgggaaaatcacactcccagatatgacaggctggtcaaaacgggacgccctccgcttcggcgccatggcaggcattcatatcgaaacgagcggccagggctatgtgaagagtcaaaatgtaaaagcaggcaaagaattaaaagcaaattcagtcgtgaaagtcagattgaaaaa

SEQ ID NO: 1671 - DNA, 2229 bp, Bacillus licheniformis
  misc_feature (1)...(2229): n = A,T,C or G
cacagctggtcgtcaaaactcccttctgtcacatgaaaaaacgctgaaacggaaagtccaggaagtctggctgtctttccagctggaaagaaaatactcaaaagacgaaattcttgaaatgtattntaaatcggatttacttctcgccgcaggcctacggtgtcggaaaagcggctgagcagttctacggggttacagatctaaacgacttaacggtcgagcaggccgcaacgcttgccggcatgccgcaaagcccgaataactacaacccgatcaaacatccggaaaaagccgagaaacggcgcaatgtcgtgctgagcctgatgaataaacacggctttatctctgacgcagagtacaacaaagcgaaaaaagtagccgtcacaaaaggccttgtatctccgaaagagtacgcaaaaacaacgtccaacaaatacagcgcgtttatcgagcaggccgtcgccgaagtgaaagaaaaagcgaacgtcactccgggaacggacggactgaagatttacacgacgattgatacagacgcacaggattatgtggatgagctgatggacggcgattctattcagtataccgaaaaaatgcaggccggcctcaccctgctcgatacgaaaaccggagagatccgcgcgctcggcggcggacgcgaccggaaagcaggcgactttaactatgcagtagatactaaacgtcaacccggttcaacgattaagccaatccttgactacggccctgtcattgagaacaagaaatggtcgacgtatgaacagattaaagatgaagcatacacgtattcaactggagatccgattaacaactatgacagaagctacagaggctggatatcgatgagagaggcgctggtcgattctcgaaacatcccggctttaaaagcgttccaggcagccggcaaagacaatattgtaaaatttgcaggcaaccttggccttaacataaattcagatgacttagtggaagcttatgcaatcggcggcttcggaaatggtgtgtcgcctctgcaaatggccggagcgtacagcgccttcggcaacaacggctactacaatgagccgcatactgttaccgcggtggaattcaatgacggcactaagcttgatttgacgcctgaatcaaaggctgccatgagcgattataccgcatttatgataacggatatgctgaaaagcgctgttcagcgaggaacaggaacagcggctcaagtccccggcgtcactgtagcaggtaaaacgggtacgacgaactttaccgaggacgacattagaaaacacggcataaatcgaaacggagcgagagattcatggttcgtcggctatacgccgcaatataccgcagcggtctggaccggtaaagaaggctttaattcgctgagccagagcgaacagcaagtcgccaagctcctattcaaaaaactgattgccaaggtggacaacggcagcggctcatttgaaaagcctgacagcgtcgttgaagcgaccgttctaaaaggctcgaacccgccggtgctcgccagcagcaacacgcctagcgataaaaaagtcactgagtactttgtaaaaggcacacagccgacgaccgtttcgaaaaaatatgaagaaaaagaaaatgccgacaagccgtcaggtttgagcgcagagtatgatgaagcatcaaagagcattaagctttcatggtcatattccggagacggtgatgtatcctttaaagtcaaacagtctgttgacggaggcggatacagcgaaattcaaaacagcagtgcgaaagaagccgtcataccgaatgcaaaagaaggatccgtttacagattccaagtcactgccgttaccgaagatggtgaaagcgaccctgcttctgtaacgcttaaagtcaacgcggctgatgaggatgagtcaaaaacggacgatgaaaagaaagacgatgacgagaagaagcaggatgctgatgatgatcaggacaaagacaaacaaaataacggcaattcaaatcagccgaatgatcaaaatccaggaaattccgatcaaaacaatcaaaatccgggaaattcagaccaaaacaacggcagaaaagatgatgacgccgatgatcaagacaacgatcaaaataaagataaagataaagacaaaaacaaaaacccggatcaaggcgccaacacaggtgatcaacaaacaaattccaacggtcaatcaaccggcaccaatt

SEQ ID NO: 1672 - DNA, 1887 bp, Bacillus licheniformis
taaccatcaagacgatacgcgcatttttgttcatgggagcattgatgctgatcttcctttcaatcgttgtcatgacggtggtcttggcggccaaatggcaaggcgctccttcgattcaggtgccgaggtctaccgtgctgtatgacggaagcggaaagcaaatgggggaaacgcattacgggcaaaagcggtactgggtttcgctgaagaacatcaatcccgcagtcatcgatgccacgcttgccgttgaagaccggaactttttccggcaccacggctttgactatatgaggatgggcggcgccctcattgccgatttaaaggcgatgtccaaagttcagggagccagcaccatcacccagcaatatgcgagaaacctctacctcggccacgataaaacatggaaaagaaagtggaatgaagctttttatacgataaggcttgaacaaaactacacaaagaaagatattttggaaggctatttaaatacgatttattacgggcatggagcatacggaatcgaagcggcttcccggctgtattttggcaagcgggccaaagatatcaatacggcggaggctgcaatgcttgccggcattccaaagggtccttcagtttattcgccctttgtcaatgaaaaaaaagcgaaagaacgccaggaaatgatcctgacaatgatggagaaacaaaacaagctgacggaaatgcaggcggcagcactgaaaaaaatgccgctccgctttgaaaaacaggataagcaaacaaccgaaaaaaccgctccgtacttttatgacgaagctgttaaagaaatttcgcgattgctgcgtttgacgccggagcaagcggaaacaggcggctacaacgtattcaccacgctcaacccgcgtctccaaaaaattgccgaggatacgatcgaacacacgatagattcgtcatccgacattcaggcgggatttgcagcgatcaacccgtccgacggcagcgttctcgcgcttgtcggaggacgcgactacgaaaaaagcccttttaaccgcgtaacgcaggctatgcggcagcccggctccaccatgaagcctttcctttattattcggcggttcaaaacggctttacaccggccacccgaatgaggagcgcggaaacgacatttgagctcgggcaaggcagcgcttattccccgagcaactatcacggctattatgcagacggtccgatcacgcttctgcaggcactggctttgtccgataacatttacgccgtgaaaacccaccttttcctcggcatggacaaactgattgatgccgcaaagcaattcggcatcaacagcccgctgcaaaaagtgccgtcgcttgcgctcggaacatcccctgtgaagccgattgaaatggtgaacggatacgccatgtttgccaacggcgggaaaaaaatcgaaccttcctttattacgaaaattaccgatccgaacgggaaggttctttatgaaaaaccgaagcggagcaaacaaatccttgacccaaaagcggcttttatcacggcgaacatgatgagcgggatgttcgacaaatcactcaacggctatacatctgttaccggccggacgatcgcagatcagctgacgcgccgatacgccggaaaatcgggaacgaccagcaccgacagctggatgatcggcttttatcccggtcttgcttcaggcgtgtggacgggatatgacaaagagcggacaatcgatgccgtcgcagagaaaaactatgccaaacaaatttgggctgagtttatggaaaaagcgcttgaagacgcgcccgccgcagctttaatgccgcctgaaggcgtgaaagggatgtacatcgacccggctacaggttatgcggcggcgcccagctgcccgt

SEQ ID NO: 1673 - DNA, 1731 bp, Bacillus licheniformis
gggatatcggccttgtacaaaacagctacatgtatgacagggacggcgctctgatttccgaaatcgtttcagatcaccaaaaccgggtattcgtcccctataaagatatccctgaacatgtgaagcagctgtttctgacttcggaggaccgtcatttctttcagcataaaggctttgattttatcgggatggcccgggccgccgcagccaatgtcaaaaaaggcggcattgatcagggggccagcacgattacacagcagctttcgagaaacttgtatttgaaccatgaacgaaccttcgaccgcaagttcactgagctcctgtattcctaccagctggaaaaaaagctttcaaaagaagaaatttttgagaaatacttaaacaccatctattttaatcacggggtctacggaattggatccgcgtcttctttctatttcagcaagcctttgaaatctctcagccttgccgaaacggcgtttatttgcgcgatccctaataaccctacattatatgatcctttgaaacattttgactacacaaaaacccgccaaaagcggctgcttgaagggctgaaaaaagcgggcgtgatcaccgaaaaagaatacagcaaagccgttaagcaaaaaattacgcttaacgtgaaagaaaagaaagacgactatcccgactatacgacctatgtcaacgaggaattcaccaaattggtgtccgctacggaagggtttgacgaacggctgaaaaaggcaaaaacaaaagaagaaaagaaaaaaatcgaaaaagagctgtcaaaccgaatcagctccctcacgacaagcggaatcaaaatttatacggcgctcgataccagcatgcaaaaccgtgtcgtccagcaagtgaagaaccgcctcccttatgaaggcgtacaaggcggagcagtggtgatcaaccaccaaacccatcaaatcgtcgccatgtccggcgggaaaaactataaaaagtacgattataacctggcattccaagcatacaggcagccggggtcatcaattaagccgctccttgactacgggccgtacattgaagaaacgggtgcgacggcaggcagcatgattgacgcaagcaaattttgcagcaaggaatactgtccgaacaacttcaacgaaagaacatacggaaccgtgtcgatcaagacagcctttaaatattcgtataatacaccagccgtacgtatgctgaaccgggtcggcgtgcaaaaaggattcagctatttaaaaccgttcggattcgataaaatcgttcaaaacgactaccgtcttcctgctgcgctgggcggatttacatggggcttctcaccgctggagatggctgatgcctatacgaccttcggcaataacggaagctacacatccagccatgcaatcacaaaggtgacggatttaaaaggaaaaacgctatacaaatggaaagacaagccgcagcaagtattcagcatgcggacaaacagccaaatgcgcgaactcttagcagcggttgttaaagaaggaaccggaaaaaaagcgaatttcagcggcggatatgtaggaggaaaaaccggaacatccaacgggtacagagacctttggtttgtcggattgacggatacatacacaatgagtgtatgggtcggaaaagaggcaaaaggcactgtcgagtacctgcatcacgcgggacctcaacttttaatctggagaggaacgctgcaatacgcat

SEQ ID NO: 1674 - DNA, 2001 bp, Bacillus licheniformis
atgaaaaagagagtcatccatttgtttatagccgccggatttctattgctcgccggagcctgttctaacgagccgacagcaaaagaaagcatggaccaatatgtagacaaatggaacgagcaaaaatttgaagaaatgtatgaacagctgtcggctgaagcgcaaaaatcgatttcaaaagacgatttcatcaagcgtaatcaatctatttatgaacagattggagtttccgatttgaaggtttcaaccgtcgacaacgatgaagatgaaaaaaataaagagaaaaatgattcggtgacgataccgtataaagtcagcatgaagacattggccggtccggtttcttttcaaggcaaggcaaagcttgtcaaagaaaaaaaagacggagacacttcatggaaggtcaactggaaccaatcctttattttttcacagctgaagaaaggggagaccatccggattaccgccaaggagccaactagaggcatcatttatgacagaaacggaaaggcgctcgctacgaatgcgacagtgcctgaaatcggcgtcgttccggggcagctcggagatgataaagacggtgtcatcaaaaagctcgcgaacatgcttgatatggaaaaagaagacatagaaaaacagctgtccgcaagctgggtgacggacgattcattcgttcccctgaaaaaagtgaagcctggcagcaccgagcttctcaaaaaagcgacctctctccccggggttttgaagcaggatacgcagtcaagatactatccttacggtgaaaaagccgcacatcttaccggttacatacggccgattaccgaagaggaattaaaacagaataaagaaggctacagcgagcattcactgctcggaatcgtcggtctcgaacatatttatgaaaaagagctcagaggagaaatcggctggacgatttcgatccctgaatcaggcgcgacggttgcgtcaaaggatgcaaaagacggaaaagacatccacaccacgatcgacattaagaaacaggaagaactgtacagccagttaaaagatgactccggcgctgccgttgctttagaaccgcagactggagaaacgctggcgcttgtcagcgcgccttcatatgatccgaacgggtttttgttcggctggaaaaaaggagaatgggaaaagctcaacaaagatgcgtctgcgccattcacctctaaatttaataaaacttatgctccgggttcaacgatcaaaccgatcaccgcttcaatcggtctgaaaaatgatgcgatcaaagcggatgaacctaagaagatcgaagggaaggaatggcagaaagattcgtcatggggcggatataaagtcacacgggtttccgatcgactaagcgacgtcaacttggaaaacgcgctgatcacatccgacaacatttatttcgcccagactgcccttgatacaggcaaggatcaatttgtcgaaggcctgaaatcattcggctttgaggaaaagcttgattatgaattcccgacgaagtcttcctccatatcaaacgaaggaatcgactcggatattctccttgccgattcaggatacggacaggggcaaatgctgatgtcgccgatacaccttgcggcaagctatacgcctttcttgaatgacggtaatctgatcaagccgcacctgatcaaaaaggacggcgaagagaaagaaatatggcataaaaacgtactgcccacaggcggagcagaagcgattacaaaagggttaaaaggcgttgtagaagacccgcgcggctcggcttacaagccggttgtcaaagggcttacgatcgcagggaaaacgggaacggccgaactgaaaacgaaaaaagacgaaaaaggcaaagaaaacggctggttcaccgcctatgattacaaaaacaaaaaccttttaatcacgatgatgatcgaggatgtttcagaccgcggcggcagctcatacgtcgttaataaagtgaaaaaagtgtttaaataa

SEQ ID NO: 1675 - DNA, 1650 bp, Bacillus licheniformis
gatttttcagcgaactttatcacgctggctgcaatcatgcaggcaaaaacaaacggagacagctcgggacagcatcttctcgcttatgcacccgctgatgttctgtatttcatcgacacctttttttaatcgggctggctgttttctataacagaccatctgaaacaacaacgaagcgtccgtttaaaattgtgatgggagcaagcatcctcgtcttcctcgccaacctggccgttgccgagatcgatcgtccggagcttctgacccgttcttttgaccgcaactaccttgtgaaatatttgggaacctacaacttcacaatctatgatgcggtgcaaaatatcaagtcaaacagccagcgcgcactggcaagttccagcgacgtaacggaagttgagaactatattaaagccaatcatgataagccgaatgccgaatacttcggaaaagcgaaaggcatgaacgtggtttacatttcactggaatcacttcagaccttcctgatcgattataagctcgacggcaaagaagtcacgccattcttaaattcactggcgcacgacaatgaaacgttttatttcgataactttttccaccaaaccggacaaggtaaaacgtccgacgccgaatttatgatggacaactcgctgtatcctttatcgcaagggtcagtgttcattaataaagcgcaaaacacgctgcagtcggctccggccattttgaagtctcaaggctatacatcagcggcgttccacggcaactacaaaacgttctggaaccgcaatgaaatgtataaagccatcggttatgacaaattctttgacgctacgtattacgatatgagcgaagataaaacgaaaaactacgggttgaaagataaaccgttctttgaagaatcaatgccgctgttgaaaagcctgaaacagccgttctatacgaagtttatcaccctttcgaaccattttccgttcgagatggatgaaggcgatacagacttccctgccggggataccggcgacagcgtcgttgaccattatttccagtcggccaactacatggaccaggcgcttgaacaattcttcaacgacctgaaaaaagccggactgtatgataatacgattgtcgtcatgtacggggaccactacggtatttctgaaaatcacaccaaagcgatggccaaagttttgggcaaagacatcacaccatatgaaaacgcccaattgcaaagggtgccgctgttcatccacgcgcctggggtcaagggaatcaaatccccataatacggcggcgaagtcgatgtagcccctaccctgcttcatttgatgggcgtgaatacgaaagattacctgatgagcggttcagaccttctgtcaccggaacaccgtgaaattattccgttccgcaacggcgatttcgtctctccggaatatacgaaaacgaacggaaactactatgacacgaaaacaggagagctactgaacgaaaaagacatcgatccgaacatcgaagaggccgtgaaaaaagaactcgaaatgtcggataaaatcgtcgacggagatttgctgcgcttctataaaccgaagggctttaaagcgatcaatccgagcgactacgactataccaaccacaatccgaaaacatcagaatctg

SEQ ID NO: 1676 - DNA, 1755 bp, Bacillus licheniformis
atgaaatggcaaaagcgtatgaagtgggtatcgattatcatttcggctgctcttttatttctgctgatcaggctggctgaaattcaactgttttttaccgagtccttttctaaacggaatgtgaacttaatccaggaaagcgtcaaacagcgcacggaggaagttcggatttcagacgggagaggatcttttttagatcggaacggcgaacatttgtccgtcagccaaaaaccggccatcgtcttgttcccttttttaaaaaatcagccgtggccggccaaagaagcagccgaaattttaaacatgacagaagatgagcttggaagcaagctggaccatgcaaaaaaacccgtgattctcacaaaacatgacggagcgtccgtttcaaagacggctctcgaaaaaatcaataaactgaaatatccgggcgtttacggcgtatacatagaagaaacagaaaagaacaggctggcttcgcatacgctcggtatgaccaatcaagacccggacctcctcagacgcaaatatcccgataaagagggcctctccatcagcacgaaaatcggcaccttcggcatggagcggacgtttgatgaattcctgctgcctgaacaagacacaaaactgttgtatcatgtggacggattgggaaaccctttgttcggcatggacgtcaaatatacagcagacgcaaatccgttttacccgctgcaagtcaaaacaacgctcgataaaaaggttcagcaggcaatggaagatgtacttgatgaccatcagctcgataaaggctgggcggtcctgcttgacatcgagacgaacggcgtggtggcgattgcgagcaagcccgacttaaacatggctgcgcaaaaaacaaggcagaactatatgctgactccggtatatcccggctcggtttttaaaaccgtgattgccgctgcagcgattgaaaacggcttggatcatccgtctaaaacctttaactgcaatttgaacctgtacggtgaggccggagaggacaaaggaaagctcagcctggaagacagttttgcggaaagctgcaactacacgtttacaaatcttgccggacagctcgtagaaaaaaacagctccgtgatcgaagatactgctgcaaagcttgggctgaccggacgggtcggctgggaaggaaagctgtatcatgaagatgagttcagacagttttatcatgaaactgcaggatcaatctggggggatgaaaaggacaaaaaagttaaaaaagctgtagcccagaccgctatcggccaaaagaatgtgaagctgactccgttggaaatcgtcaacatgatggcgaccatcgcaagaggcggagagaaaaaacaagtcaagatcgcagaccagatcgaatataaaaacggcacattgatgacggcttttaaagatcacgagctcccaggagagaaaatcgaccagtatacagcgcaaaagctgcaaaaactgctcagaaaagttgtcacatctgaaaaggggacgggccggcgcttcagcgatcttccgtacgatgtagcgggaaaatcgggcacagcgcagacaggcaggacgacagatgacaaaaaaacgctctatcataaatggtttgccggttattttccggcggacaagccgaaatatgcgctcgtcgtcgtccatatggatacgccggatagcaaggctgcgacaaatgccgtattttatgatattgttaaaaaagtatatgaaattgaaaagaaccagacatag

SEQ ID NO: 1677 - DNA, 1307 bp, Bacillus licheniformis
ttggaaaaaatcatcgtccgcggcggtcgaaagttaaacggcacagtcaaagttgaaggagcaaaaaatgccgttttaccagttatcgctgcatctttattagccagtgaagaaaaaagcgtaatatgtgatgtgcctacgctctccgatgtatatacgattaacgaagtgttacgtcatttaggcgcaagtgtacattttgaaaataatacagtaacggttgatgcatctcgcactttgtctacggaagctccgttcgaatatgttcgtaaaatgcgcgcatccgtattggtgatgggtccgcttcttgctcgcacaggccattcgagagtggctttgcctggaggatgtgcaatcggttcaagaccgatcgatcagcatctgaaaggctttgaagcaatgggggcaaaaattaaggtcggaaacggctttattgaagcgactgtagaaggccgccttcaaggagcgaaaatttaccttgatttccctagtgtcggagcaactgaaaacctgattatggctgcagctttggctgagggcacgacaactctcgaaaatgctgctaaagagcctgaaatcgttgatctggctaactatatcaatgcaatgggcggtaaaattcggggtgccggtacaggcaccattaaaattgaaggcgttaaggcgcttcatggggcaaaacatacgattattcctgaccggatagaggcgggaacgttcatggttgccgcggcgattaccgaagggaacgtactggtaaagggagcggttcctgagcacttaacatctttaattgcgaaaatggaagaaatgggcgttcaaatcttggaagaaggagacggtcttcggatcatcggtccttctgaattgaagcctattgatttaaaaacaatgccacatccaggtttcccgactgatatgcagtcacagatgatggctcttttgatgcgcgcaaatggaaccagcatgatcacagaaaccgtctttgagaaccgcttcatgcacgcggaagaattccgccgtatgaacggagatattaaaatcgaaggccgttctgtcatcattaatggtcctgtgcagcttcaaggcgctgaagttgccgcaacggatcttcgcgccggcgcagctcttatccttgctggccttgttgctgacggtcatacacgcgtaaccgaattaaaacatttagaccgtggatatgtcaacttccaccaaaaacttgccggtctcggcgctgatattgagcgcgttaacgatgaagaagcagttcatattgaaaataaagaagttgtatccgatttaaatgc

SEQ ID NO: 1678 - DNA, 1974 bp, Bacillus licheniformis
taagcgattcagggcagttaaaagcagcggagatatctttaaataacctttctaacctgataatagacgaaacggtcattgatttttatgtgctatatgaaaataatgaaaaaaatcaatgtaaaaagaggatttacacagcctcaaaaccgattgagctgtattggcatcaggatcgagtcaaacagttcatttatttgccgtatacgacccgaaaaggccacttcgctcttgatgtttcacggagaaaagcagtagcggaaccggacagcattaagttaagctccgaaggaaaactaatgatcagaggctatacttttctgctcgatgcggaagaatgttcgataataaaaagcagaaagctggttttaaaggaaattagccaaaacgataaagaaagggttttcaatttccctttaaaaggcgttcagcgcgtcgatttgtcagctgattcttctgatcatgccgttggatttgaggcggaaatcgatctgaaaaagctgtatgaggagaacaggatgcctgctttctttaagttttatatagaatacgtaggtgaagatgctgcaacaggggaggaaatcgctataaaaagcagggcattcaagcttatagatgatatagaaagtttttcaattgttaacacaaaaaaaggaccggctcgttttcacatttatccgcagaagcgaaaacggggtatgcgtctaagaatgaatgactatacgatcaaaacccgtgcggtttattttgccaaaggaaaaggaaaaaggctgatgtcagtcatacgcaaaggcaagaataaagcaaagaaaaagatttcgggcatggtgaagagagcatactattttacttttggactggccggcaaactccctgttaaaaagaaaaccgtcatttttgaaagctttgccggcaagcagtacagctgcaatccgagagcaatttacgaatatatgaaggaacatcatccggaatacaacttaatatggagtgtaaatccgagttatacagaaatttttgaagaaaaaaatgtcccttatattcaccgattcacgctgaagtggctgttcgccatggcaagggccgaatattgggttgtaaacagccggcttcctttgtggatcccaaaaccaaagcacacgacatatgtgcagacatggcacgggactccgctgaaaaggcttgccgtcgatatggaagaagtgcacatgccgggcaccaacactgagaagtacaagcaaaatttcactaaagaagcatcgaagtgggactatttaatctccccgaatcgctattcaaccgaaatctttgcccgcgcttttcaatttaacaaaacaatgattgagtccggctatccgaggaatgactttctgtatacggacaaccgcccggaaacgatgaaggccataaagagaaaaatgaatatccccgaagataaaaaggtcattttatatgcaccgacatggcgggacgatcagttctataaaaaaggaaaatacaaattcgaccttgatttgaatttggaaaagctgcgagaggagatcggcgataattatgtcatcgttttaagaatgcactatttagtcgcggaaaactttgacctatcgccgtacaaaggattcgcatatgatttctcatcatacgaagatattcgcgaactttatatggtatctgatttgttaattacagattactcttcagtattctttgatttcgcaaatttgaagcgtccgatgattttcttcgttccagacattgaaacctatcgtgacaagctgcgcggcttttattttgactttgaacaagaagcaccaggaccgttggtcaaaacgactgaggaagtaattgagaaaatcaaggaaacagagacatctgactatcgtctgcctgacatttttgagcctttttatgaaaagttttgttacctggagacgggcaattcaactgaaaaagttgtaaaaacggtatttaaat

SEQ ID NO: 1679 - DNA, 1290 bp, Bacillus licheniformis
atggaaaagttaaatatagctggcggcgatcctctcaatggcacagtacatataagcggagcgaaaaacagcgctgtcgctctcatacctgcgacgattttggctgattcgacggttacgcttgaaggccttccccatatttcagacattttgacgcttcgcgatctgctgagagagatcggcggaaacgttcactttgaaaagggagaaatggtcgttgatcctgcgccgatgatcagcatgcctttgccgaatggaaaagtgaaacagcttcgggcttcttattacttaatgggcgcgatgctaggacgctttaagaaagcggtcatcggccttccaggcggctgccaccttggtccgagaccgattgatcagcatatcaaaggttttgaggcgctcggagccgaagtgacaaacgaacagggtgcgatctatctgcgtgcggaggaattaaaaggcgcgcgcatttatcttgatgtcgtcagtgttggagcaacgatcaacatcatgcttgccgccgtgcttgccaaaggcagaaccgtaattgaaaacgctgcgaaagaacctgagattatcgatgttgccactcttttaacaagcatgggagcaaaaataaaaggcgccggtacggacgtcatccgcatcgaaggcgttgaatcgcttcacgggtgcagacactcgattattccggaccggatcgaagccggcactttcatgattgcagctgcttccatgggacaagaagtgctgattgataatgtaattccgacgcatttggaatcgttaatcgccaagctccgcgaaatgggggttcgaatcgaagaaagcagcgagcagattttaatggtcggcggacagaaagagctgaaaccggtcgatttgaaaacgctcgtataccccggctttccgaccgatctgcagcagccgatgacatcgcttttaacgaaggcaaacgggacgagcgttgtcactgacaccatttactccgctcgcttcaaacatattgacgagctgagacgcatgggtgcgtcgatgaaggttgaaggaagatcggcgatcattaccgggccagctcctttgcagggcgccaaggtgaaagcgagtgatcttcgggcgggagcatgtctcgttgttgccggtctaatggcggaaggtgtcacggaaatcaccggtttggagcaccttgacagaggctacagtcagcttgaagaaaagctgacaaagctcggggccactgtctggcgcgaaaaattgacagaccaggaaattgaacagctgcaaaactcgtga

SEQ ID NO: 1680 - DNA, 1545 bp, Bacillus licheniformis
tcatatgaagatgtttcaggcattcatggtgcttcccgcgttcttgctggtttatctcattgcggcccatgcgaattggaagaaaaaaatcgtttcagcggttttatcgcttattgtcctcaccggcatttcgctttcttgggcgcttgcggtcgactatacatcagccgacagccgcccgtatgtcggaagcagccaaaccaactctgtgcttgaactggctttcggctacaacggcactgagcggcttctcggccagacgacgggcaacgcccgcggcgatatgaacggctttggaggagacatgcagcagccgaacggcaatgcgcaagctcagaacggaaaccgttcgtccggcggctccaatggacaaaacggcgcgatgcagccgccgggtgcgggcggttcggcagacggcagttctcaaggggcaaacggcggcagccagcagccagccggaggcggaccgggcggaggcaacggcggtcccggaggcaatggcggcccaggcggaggtcaaggcggcggacaaagcatgaacatgttcggcaccggtgacgcaggaccgctgaggctcttccaatcggctttatcgggccaaatcagctggatgctcccatttgcattattaggactgctcggcacgatcatcacctggtttcgcggccgccgcgaaaaagcaggcgaaatgaaagaaacgatcttttggtctgcatggctcgttcctgtcgccgggttcttcagcatcgccggattcttccaccactactacttgattatgatggcgccgccgatcgccgctctgtcaggaatcggatggtacgcgatgtacggcctttacaacaatcataaagactgggcaagctatctgctgccggcagccgttctcacgacagcagcattccaagtgtacattttaagcgcttatacaaaccaaatcggcagcgcttggatgtatgtcatgggaatcctggggctgggtgtcaccatcgccttactaatgctgaagcgacgccatccattcggaaagcagctcaccatcatcagcttgtgcgtgcttcttttgacaccggtctattggtcggcaacaccgatcctttacggagggaacagcgttcttcctgaatcagggcctcagctgcaaagctccaacggaggcggaatgttcagctcggacgtggacacaggactgctcacatacctccgggaaaataataccggcgaagagtaccttttcgcgacattgacaacggtaaccgcagccacgtatatcatcaatgccgacgaaaatgtcatggcgctcggaggcttcaacggcacagacccgatcctgtcggtcagtgaactgaaaaacctcatcaaaaaaggaagagtaaaatacttcctgattagtgaaaactcaggcaacagcgagctcgtctcctggatcaaagaaaacggaaccgaaatttcgtctgaccaatacagcagtacagacagcttcgcacagcagggtgcaagaggcggcccaggcggcggacagcggcaaacgctctacaaggttga

SEQ ID NO: 1681 - DNA, 1503 bp, Bacillus licheniformis
agaaactgttaatccggtttcgatcgcgctatacctgaacaaggctctcatggtctggctggcaaaaacgcgcaaaagaaccgacagaaagctttccgctaaagccgataagatctgctatgcggcagccgccggaacggtgctgtttaatctcgccctgtcggagctggatcagccgaagtttttaagctactcttacgacagggaagtgcttgtaaaaaatatcggcttgtatcagtttcatctgttggacggcatttcacagacctttaatttgacacaaaaagcggtcgctgatgaaaacagcctggcaacgatcgaaaactacacaaatgccgactacagcaaaccgaaccaagatatgttcggaattgccaaaggacgaaacgtcatctttgtaacgcttgaatccacccagacatttgtcatcaatgaaaaggtgaacggccaggaaatcacgccgttcatgaacaagttcattcaaaaaagctattatttcgaccatttttatcagcagaccgaacaggggaaaacgtccgattcggaattcattgtcgctaattcgctctatccgtctctgagcggttcggtgttttttacgaagagcgagaatgcgtacaattcgatgtataaaacactggcgaaccacaattacagaacatcggttttccacgccaaccataaaaaattctggaacagggacgtcatgtacaaagccctcggcatcgacagcttttatgacgtctcccattttcatgtgacacctgaaaattcaacgggctgggggctgaaggataaggagtttttaacgcaatcggccgacttgatgaaagacttgccgcagcccttttacagcaacctgatcacattgacgaatcattttccatttcaaattgatgacgaggataagctgatcgatgagtacgattcagagagtgacattttaaaccggtatgtcacgactgtacgctatgaagacgaagcattgaagcatttcatcgcaaaactgaagaaaaacggcctttacgacaattctgtgatcgtgttcatgggagatcactacggcatatcagaagcgcacaacgatgcgctggctcaatttttgggcaaagacgaaatcaccccctacgataccgttcagctgcagcgggtgccgctgattatccacattccgggggtaacggatcaagacccgaaaacgatatccgaaacaggcggccaaattgatgtcaaaccgacattgctccatttgctcggaattgatacaaaaggcatgattcaattcggcaatgacctgttttcgaaagaaagaatgcctttcgctgtgttgagaaacggcagctttattacagatgattatatctacacgaaaaatacgtgctacagcaaaaaaaccggggacatgatcaacgatggagaggacaaatgcggccctctcatcgagaaggcgaatgaagaactttccctttccgataagattattaacggtgatttgctgagatt

SEQ ID NO: 1682 - DNA, 1314 bp, Bacillus licheniformis
agagattaaagcagctgatcatgttaatcgttgcttttgccgtgactgtaggtgcattttctcctatgtcaactgcaaaagctgcaaatgatccaatcaatgtagacgcgaaagcagcaatcctggtggaagcttcatcggggaaaattttgtacagtaaaaatgccgaccagcgtcttcctgttgccagcatggcaaaaatgatgacggagtatcttctgttggaagcgattcacgaaggcaaagtgaaatgggatcagaagtacacgcctgacgattatgtatacgagatttcccaagatcgttcactatccaatgttcctcttcgtaaagacggatcatacactgtaaaagagctttatcaggcgactgcaatttactctgcaaacgcggcggctattgcactttctgaaattgttgccggttctgaatcgaagtttgtagagttaatgaacaaaaaagccaaagagcttggaatgaaagatttcaaatttgtgaatgccacaggtttggaaaacaaggatcttcacggcaaacatccgagcggaacaaatgccaatgaagaaaatgaagtgtctgcgagagacatggcgctccttgccgatcatttagtgagcgattatccagagatcctcgatacggcgagcattgccaaaacgaagttcagaaaaggcacagacgatgaaatggatatgccgaactggaactttatgctgaaaggccttgttcagcaatatgaaggtgtggacgggctgaaaaccgggtcaaccgactcagccggatcatgctttacggctactgctgaaagaaacggcatgagagtgatttccgtcgttctgaatgcgaaaggcgaccttcatacggcgcgatttaaagaaacgaaaaaaatgctcgattatgcatttgaaaacttcactatgaaagagttttacgcaaaaggcgcacaagtgaaaggcaacgaaacagtcacagtcgacaaagggaaagaaactgaagtcggcatcgtcacagaaaaagccttttcaatgcctgtgaagaacggtgaagaaaagaattacaaagcgaaagtgacgctgaacaaagacgagctgaccgcacctgttaaaaaaggtgagaaagtcggtaccttgacggcctcctataagggagaagaaaaggactacggatttctcggcagcgatgtatcaggtgtaaacctggtgacaaaagaagatgatgagaaagcaaactggtttattttaacgatgagaagcatcggcggcttttttgccggtatatggaacagcattgttgaaatggtaaccggctggtttt

SEQ ID NO: 1683 - DNA, 1061 bp, Bacillus licheniformis
ttggtcaaagtaatcaataactttgtaaaagtcaatcaatacacccgtcccgggctgaagcttgcggcagtcaaaggcatcgtcatgcattggacggcgacgcccggggcttcggcattgaatgagcgaaattatttcaatggcacatgcattgccgacaagcgttatgcgtcggctcattattttgtcgaccgccatgaggcgcagcatattattcccgatcatgaagtcgcatatcatgcgcatgatcaaaaccgctgctatgtcagctttctgaagccgaatgccaataccacggctctcggggtcgaaatgtgcgtggaaaaagacggtaccatccatgaagagacgattcgcaatgcggcagagcttgtagcggatttgtgcaagacatacggtttgtccgcagatcggattgtccgccattacgatgtcactaacaaaggctgtccaaccccgtgggtgagagatgccggccaattgtcagctttccgtaaaagagtagattcccttttggggaggaaaaccgtttccgtatcggctgcctccaccagccagacaagttcatcgtcgggcattatcctcaaaaaaggaatgtcaggctctcatgtgaaaaagctgcaaacacgcttggtcgcggccggtttttcgctgcctaaatacggcgcggacggaagctatggagacgagacggtgcatgcggttgtttctttgcaaaagaaagcgggaattaaagccgacggcatttacggtccgtcaactgaaaaagccctctcggccgctgaagcgtcagcagccggcaagagcaagacgtggacccttcccgacggcatttataaggtgaaaaacccgctgatgaagggaacggccgtcacacaaatccagacagcccttgccgctctttattactaccctgataaaggggccaaaaacaacgggatcgacggatattacggaatgaagacggcaaatgcggtgaaacgttttcagctgatgtacggtttgggagcggacgggatatacggaccgaagacaaaagcgaaaatgttgtcccttttgaa

SEQ ID NO: 1684 - DNA, 1262 bp, Bacillus licheniformis
atgttcgtgaatactgtgatcgcgtttattcttatttttggaacgctcgtatttttccatgagcttggtcatctcatccttgctcaaagagccggaatactgtgccgggagtttgctatcggcttcggtccgaaaatcttttcgtttaagaaaaatgagaccgtttatacgatcaggcttcttccgatcggcggctttgtcagaatggccggcgaagatcctgagatgattgaagtgaagcccggttatacggtcgggctgttgttcgacagcgaaaacaaggtcgaaaagatcattatcaaccaaaaagaaaagtatcccgacgcattggtcattgaagtggagcaggccgacctggagcaccagatgaggattacgggctatgagcacggcaatgaagatcatctctcttcattttctgtcagtgaaacgtcctttttcatcgtagacggggaagaagtccagatcgctccttacaaccgccaatttcattcgaaaacggtttggcagcgcatcaaagcgattgctgccggaccgatcatgaactttattttggcttatgtcatactcgtgatgctcggactgatgcagggagtgccgtctgacgagccggtgctcggcaagttgatagacaacggacgggcggcggaagcaggcctccaggagggagaccgcattcaaacgatcaacggggagaacatgaggtcgtggacggatattgtcaacacggtcagagaacaccctgaaaaagaactgaaaatcgttttgatgcgcgacaatgtcaagctgacgaaatacgtaacacctgaagctgtcaaggcaggggatgaaaccgtcggcagattcggcgcttacaatcctgtgaaaacaggcgttctgacatcgatttcctacggtgcgaccgaaacggcgacagtggcccagagcatcgtcaccaatctcggaaagctcgtcacaggacaattctcaatcgacatgctggccggtcctgtcggcatttatgacatgacagaccaagtggccaagacaggcgttatcaacctgctgaagctggccgcatttttaagcatcaacctcgggatcgtcaaccttctgccaatccctgcgctggacggcggaagactgttgttcctgtttattgaagcgatccgcgggaagccgatcaaccgcgaaaaagaagcgtttgtcgtctttatcggcgtcgcattttgaatgctcctaatgcttgtcgtcacatggaacgatatccagcgcttatttct

SEQ ID NO: 1685 - DNA, 1352 bp, Bacillus licheniformis
gtggatactcaagatttattgcaaaatcaaaatgtgctcgtactggggctggcgaaaagcggatatgctgccgcttcgatccttcatgagaaatgcgtaaaggttgtcgtgaatgaccagctgccttttgaggaaaatgaacctgcgcggattctcgcggaaaaaggggtggaagtcgtctgcggctctcatccgacggaactgtttgatcttcattcgatcgacattctgattaaaaatccgggcatccgctatgaaaacgtgatggtcgaagaagcgctgaagcggggtatcccggtctggacggaggttgaactcgcctatcatctgacagatgctccgttcatcggcattaccggttcaaacggaaagacgacaacgacaacgcttgtttatgaaatgctgaaggccgattcgaaaaaagcgctcgttgctgggaatatcggtacggcggcaagcgaagtggccaatcaggccagcggagacgaatggatcgtgacagagctgtcgagttttcagctcatggggacttatcaattcagaccgaagattggattattattaaacgtatttgatgcccatctcgattatcaccattcgcgcaaaaattatgagcttgccaaacagcaggtctatcgaaatcaatcggaaacagacgttgccgttgtcaatttggacgatgagacagtcgtccggctcgcggagtgttcaaaagcggagaaggtgtatttttcggtccgccggacacttgagcgcggagcgtgcgtgaaagacggcgcaatcatgtttaacggcgaaccggtcatgccgctggaagacgtcgttttgccgggagagcacaatttggagaacattttggccgccctttgcatcgttaaaacagcaggcgtttccgacgcggccgtccgtaaggtgctgacgagctttacaggtgttaagcacaggatgcaatacgtcgcgacgatcaaaaacagactgttttacaatgacagcaaagcgacaaacattcttgcgacgaaaaaagcgctgtccgcctttcaaaagccggtcattttgctggcaggggggcttgaccgcggaaatgaatttgatgaactaaagccgcatatgtcttttgtaaaagcggtgatcactttcggcgagaccgcgccgaagtttgagaagctggccgaagaaatgggaatacaacaggttaaacgtgtcgataatgttgaacaagcagcaactgcggcgttcagcctgtcagacgaaggagatgtcattcttctgtccccggcctgcgcaagctgggatcagtacaaaacatttgaagaacgtggtgacatgtttgtaaacgccgtgcatatgcttaa

SEQ ID NO: 1686 - DNA, 1257 bp, Bacillus licheniformis
cgctggccgacagcaacagcctcacggagattgaaaactatgtcaacgcaaaccgcacggacaccaacaaggatctggccgggatcgccaaaggacggaatgtgatcctcgtttctctggaatccacccaaagctttgtcgtaaaccaaaagttaaacggcaaagagattacgccgtatttaaatgacctgattaagaaaagctacagcttcgagaatttctatcatcagacaggccaaggcaaaacggctgattccgaattcattgtcgacaactctctctaccctcttggaaggggagcggtcttctttacaaatgcaggaaacgaatatacggcaatgcctgaaatattgaagaaccacggctactattcctcgattttccatgcgaacaacaaaagcttctggaatcgggatattatgtacgaaacgtttaaatacgataagttttacgatatcaaatcctatgatgtaaacgaagaaaattcagttggatggggattgaaagataaggaatttttcgaacaaacatcagagctgatgaaagaaatgcctcagcctttttatacccgtctgatcacgctgacaaaccattttccgtttgagcttgatgaggaagataaactgatcaatgaattcgattcaaaaagccgtacgttaaacagatatttcccgaccgtccgctatcaggatgaagcgcttaaacgtttcattgaaaagctgaaagaagacggcctctacgataattctgttatcgttttatacggtgaccattacgggatttccgaaaaccataacgaagcgatgagccaattcctcggcagagaagtaaccccttttgaggaagtgcagcttcaaagagtcccgcttgtgatccacattccgggagtgacggataaagagccgaaaaccattgacacggtcggcggccaaatcgacattcgaccgactatactgaatcttctcggaatcgattcaagcgatcagatccagtttggaaacgacctgtttgccaaagacaaaacggagttcacagtgctccgcgacggcagctttattacgaaagacaaagtatacacagacggcatatgctatgataaatcgacaggcgagccgtctaaagataaaaaaggctgtgagccgtacattgaaaaagccaaacaggagctttcatactcagatcaaatcatttacggcgacttgctgaggttttatgacagcgagcgcttaaaaaagcaatctgactccaagccaaaag

SEQ ID NO: 1687 - DNA, 1393 bp, Bacillus licheniformis
ttgaaacagcagttgaaactctttttggctgtattgattacggccgtcgccgcctccgcactgacgctttatctggtgggcaaaggcagcggcggttcagtatattccgcttcagattccgagaaattcgaaaagctgatggcggcgtacgacaaaatcaagagcgactattatcaaaatgcagacgatgaaaagctgactgacggcgcgattaaagggatgcttggagctttggatgatccatattctacatacatggataagaaagaagctaaaagctttgaagaaagcattacatcttcttttgaaggaatcggcgcccaagtagaagaaaaaaatggacaaattctaatcgtcgcgcctattaaaggatctcccgcagaaaaagccggcttaaagccgcatgatgaaattcagaaagtggacggcaaaagcgtaaaaggcaagaccgtcaacgaagcgacagcgatgatccgcggcaaaaaaggcacgaatgtcaaacttgttctcaacagggaaggcgtcggccaaatcgatgttacgattaagcgcgatacgattccgatcgaaacggtttattccaaaatgatcgacggcaatatcggtgaaatccaaattacgtctttctctgaaaataccgcaaaagaactgacaaaagccattgatgacttgtctgaaaaaggtgcggaacgattcgtgctggatctcagaggaaatccaggcgggctgatggaccaagcgattatgatgagcaacatgtttgtcgataaaggcaaaaccatcatgcaggttgaatccaaaaacggaaaaaaagaagtgtacaaagctgagaaggagcgaaaagtgaacaagccgaccgttgttctcgtcaacggaggaacggcaagcgccgctgagatcatggccgcagcacttcaccagtcttcaggcatcccgatcgtcggtgaaaatacgtttgggaaagggacggttcaaaatgcggagagcttctccgacggatcgaccgtcaagctgacgattgccaagtggctgacgccgaatggggactggattcacgaaaaaggaatcaaacctcaatataaagcggagctcccaagctatgccaaactgccgtacctggattccaaaaaagagtataaggcaggcagcaccggagacgaagtgaaagccgcccagcaaatgcttcaagcgctcggctataagctgaatgcgactggagctttcgacgcacagacggaagctgccgttaaggcttttcaaaaagaccaaaagctgaaaacgacaggcatcctaacgggcgagacgacaatcagcctgacaagcaagctgcaggataagctttccgacaatgatacgcagttggataaagcgattgagatcttaaaaaaagaga

SEQ ID NO: 1688 - DNA, 1191 bp, Bacillus licheniformis
ttgaaaaaatcagaaaagctgtgggtataattctccttgtttctttaataagtgtaggattttacaaaccggtgaaagaatacattgtaataccaaaaaatttgaacatttttgagacgggtacccgtgcggttgaaacgagcttatccgtcagtactccgaaagatggatcatcagaagcattcacattgaaagaaaatcaaaacgaagtggaaataaaaggcgaaaagaatggaaaggcagaactcgtctatgactttgccggatttccggttaaaaaaacgaaagtaaatgtcctgcctgatttgaaagtggttcccggcgggcagtccattggtgtaaaacttcattccgttggtgtattggtcgtgggttttcatcaaatcaatacctctgaaggcaaaaaatcgcccggtgaagcagccggaatcgcggtaggcgacattatcaccgaaatcaacggcacgaaaatcgagaaaatgaatgacattaccccttttattcaaaaggccggaaaaacaggagaaaccttacatctgtcgataaaaagagataaacaggaaatcaaaacgaagctcgttccgaaaaaagaccaggctgaagacaaatacagaatcggcttatatatcagggactctgccgcaggaatcggcacaatgacttttttcgagccgaaatcgaaaaaatacggagcgcttggccacgtgatttcagatatggatacgaaaaaaccgatcgttgttgaaaaaggacaaatcgtgaaatcgaccgtcacctcgattgaaaaaggaacaggcggaaatcccggagagaaactggctcgtttcgcatcagaacgaaaagtgatcggcgatatcaacagaaacagtccattcgggatcttcggaacgcttcacgagtcaattaaaaaccgcatcgctgacaaagccattccgattgcattttcagatgaagtaaaagaaggccctgcccaaattttaacggttattgaaaacgacaaagtcgagaaattcgatattcaggtcgtcagtacgacacctcagaagtttccggccacaaagggcatggtgctgaaaatcaccgacccgaggctgttgagtaaaacaggaggcatcgttcaagggatgagcggaagcccgatcatccaaaacggaaagatcattggcgccgtaacccacgttttcgtcaatt

SEQ ID NO: 1689 - DNA, 1148 bp, Bacillus licheniformis
ttgaataccaataaaaatatattaattttgactgcaaattacggaaatggccatgttcaagtagccaaaacgctctaccaagagtgcgaaaggctcggttttaagaatgtaactgtttcgaatttgtatcaagaatcaaatccgattgtgtcagagattacgcagtatctctacttgaaaagcttctcaatcggcaaacagttttatcgccttttctactatggagtcgataaaatttacaataaaaggaagtttaatatttatttcaaaatgggaaataaacggctggaccaactggttaaaaaacatcagccagacattatcatcaatacgtttccaatgattgtcgtgcccgaatacagacggagaatgggaaaagtcattccgacttttaacgtcatgacggatttctgtcttcataaaatttgggtccacgaacatattgataaatattacgtagcaactgattacgtgaaggaaaagctgctcgagatcggcactcaccctagcaacgtcaagatcacgggcattccgatccgcaggcagtttgaagaagaaatggacaaagataaaatctacgagaagtatcagctgtctcccgacaagaagatattgctgatcatggcaggcgcccacggggttcttaaaaacgtaaaagaactgtgtgaatctctggtgacgaaagaggatgttcaagtcgttgtcgtgtgcggaaaaaatacgatgctgaaatcttcattggaagacattgaagccctttatccaaacaagctgagaacgctcggttacatcgaaagaattgacgagctgttcagggtggcagactgcatgatcacaaagccgggcggaatcaccctgacggaggccacggcaatcggcgttcccgtcatcctttacaagcctgttcccggacaggaaaaggaaaatgccctgttcttcgaagacagaggggctgccatcgtcgtcaacaggcatgaggagattcttgagtcagtctcttcccttttggctgatgagaaaaaattaaacgaaatgaagaaaaacattaaaagcctgcatttatccaattcatcagaagtcatcctgacggacattatcgagcagtctgaaatcatcatgaacaaaaaacagactgtccgggcgctgtc

SEQ ID NO: 1690 - DNA, 1156 bp, Bacillus licheniformis
atgacgccttatggttcatttcttttcttcattatattaggaattttactggcgccgaccatcattctcggactgaacggaaaaagcttccgcttatataatatggcggtttccgttctggttctggcgcttattttttcgaacagcctgcacgggctgatcatgctgtgcctgtttacgctttggcagacggttctgatcaaaggctatatcgcttaccgtctaaaagcgaacagcggcatcgtattttgtctggctgcagcagcttctatcctgcctctggcactgtcaaagctgctgccgtttttcgccgttgacaactgggcaacatttctcggaatctcgtatttaacttttaaaggggttcagctcatcattgaaacccgcgacggtctcattaaaaagcagctcccaatcagcagactgctttactttattctcttttttccaaccatctcgtcaggtccgatcgacaggtaccgccgttttgaaaaagacgatcagacggtttggacaaaggagcaatacgaagaactgctttacaaaggaatcaataaaatttttctcggctttttgtacaaattcattatcggctactgcattaatacgtatgtcataatgaaactgccgtttttgacttccggcagcttctcgcatggattggcatacatgtatgcgtacagcctttatctgttttttgatttcgccggatacacggcttttgcggtcggcgtcagctatatcatgggaatcaaatcccctgaaaactttaataagccgttcatcagccgcaatattaaagatttctggaaccgctggcatatgtcgctttccttctggttcagagactacgtcttcatgcgctttgtcctttggatgacgaagaaaaaatggatcacaaaccggatggctgtttccaatatcggatatgtgctgctgttccttctgatgggcgtctggcacggccttgcccctcagtacatcgtctacgggctgtatcacgcgctgctcatggtcggctttaacttctttgaaaaatggaataagaagcacaagtggtggccgaacaacaagtggacgacagccgtctcaattgtggtgaccttccactttgtatgttttggatttttaattttctcagggaaactaatacact

SEQ ID NO: 1691 - DNA, 1348 bp, Bacillus licheniformis
gtgaaacagaacaaaagagaacaacttgttaacctgtttagtgtgttaaaagaaaaaggtcagatcaacgcggcagtgctagtcgctgaagacggagacattctttatcaaggcgccttcggatatgaaaacttggcagataagcgtttattgcaggaacattccttatttgaattagcatcgctatccaagccgttcactgctttgggcatccttcaattagcccagcaaggggaattgaaaatcgaggatcccgtagaacggtggataaccgggtttccctaccagggcgtaacgattcgcgatttattgacacatacgtcgggtctgcccgattatatggagtggtttctacaacattgggatcataacaagattgctgttaatcaagatatcgttgatatgctgatgaatcatcatccgcaacgctattttgccccgggtgaaggttggctttacagcaatacgggatatgtgctgcttgcggttatcattgaaaaggcatcaggtctgagttttgcagaatatatgaaaaaaaacatctttgaaccggtgaaaatgcggaactcaagggtttataacagaaggctgcagcctgaaaccattgagaactatgcgtatggatatgtgtatgacgtgcatacagcacagtacgttctgcctgatgaccttgaagaaacaaaatatgtctgctatcttgacgggattcagggggacggaaccgtaaactcaaccattcatgacttatatttgtttgatcaagccttatatacagattgtttgatcaatcaagtctcaaaagagcttgctttttctcccgcgtctctgaaaaacggagagtctatagattacgggtgtggatgggtgcttcgggatagtcctgaaacagggagaattgtcggtcacagcggcggctggccaggctattcaaccgtaatgatccgatatatcgatcagcaaaaaaccttcatttatttgagcaatgtggaacaggatgatgaatatgaacaggccatctttgaagccgttgaaaatatcctgtttgacaaggcctacaaaatccctgatcgccctgccgataaaaagaaaaaagagatcgatccggccatttacaaaagatatgtcggaagttattcacttcaggatggcaccgccgctgatgtgacagttgataagggccggatttatatgcaaatcaccggacagatccgttttgaattatttccagcctcggaaacgcgcttttttctcaggtcattgtctgttgaagtggaatttattttggaggatggtgtcgcaacccggttgattatttatcaaaatggcgcagaggaagaagcggtgcgga

SEQ ID NO: 1692 - DNA, 1083 bp, Bacillus licheniformis
ttcaagtgagtgaaatcacacatcgtacaaaaacgcgtcccgttaaagtgggacctttaacaataggcggcaataacgaagtcgtcattcaaagcatgacaacaacgaaaacacatgacgttgaagcaaccgtcgccgaaatcaacagactcgcggaagcaggatgtcaaatcgtccgcgtcgcctgtcctgatgaacgggctgccgacgccattccagagatcaaaaagcggatatccatccctcttgtcgtggatattcatttcaactataaattggcattaaaagcgatcgaaggcggagccgataaaatccgcatcaatccgggtaacatcggccgccgcgaaaaggttgaagcggtcgtcaacgcagcgaaggaaaagggcattccgatccggatcggcgtcaatgcaggctctctggaaaaacgaatccttgagaagtacggctatccgacagcagacggcatggtcgaaagcgccctgcaccacattaaaattcttgaggatctcgatttccacgatatcatcgtcagcatgaaggcgtctgatgtaaacctggcgattgaggcatatgaaaaagcggctaaagctttcgattatccgcttcatttaggcatcaccgaatcgggaacgctgtttgccggtacagtgaaaagcgccgcgggtctcggcgcgatcctttcaaaaggaatcggcaatacattgcggatttctttaagcgcggacccggtcgaagaagtaaaagtcgccagggagctcctgaaatctttcgggctcgcttccaatgcggcaacattgatttcctgcccgacttgcggccggatcgaaatcgatttgatctgcattgccaatgaattcgaagattacatcgcgaaaatcaaggcgccgatcaaagttgccgttctcggctgtgccgtcaacggtcccggagaagcgcgcgaagccgatatccggatcgccggcgcacgccggtaatgaactccgttctctccaaggcaaatctccccgagaatgtctgaagaaacaatagtccaagaatttaaaaaagagatctacaaactcccccaaaatatttttgccc

SEQ ID NO: 1693 - DNA, 1163 bp, Bacillus licheniformis
atgaaacgtcatttatccaaattgctgatttttacgataatcctgatgactgcgccgtcggcgcttgcaaaagagagcgcaaagaaaccgtcggagcttgctgatgacgcaaaatctgccgttttaatcgagcgggataccggtaaggtgatgtatgacaagaacagccgtgaaaagcttcctccggccagcatgacaaaggtgatgaccatgctgctgatcatggaggcccttgatgaaggcaaaatcaaaatgaaagacaaagtcagaacaagcgagtatgccgcttcaatggggggttcgcaaatttttctagagcccggtgaagaaatgacggttgaagatatgctgaaagggatcgccatcggatcgggtaatgatgcctctgttgcaatggcagagcatattgcggggtctgaagaggaattcgtcaaaagaatgaatgaaaaagctgctgagctcggcctcaaggatacgtcttttcaaaatacgacaggtctgcctgaagaaggccattacagcacagcctatgacatggcgctcatggcgaaagagcttttaaaatatgaaaacatcacgaaatttacgggaacgtatgaagactatctgagagaaaacactgataaaaaattctggctcgtcaacacaaaccgcctcatcaaattttatccaggagttgatggagtcaagaccggctttacaaatgaagcaaagtactgtctgacagcttcagcgaaaaaaggaaacatgcgcgtcatcgctgtcgtttttggagccagcacgccgaaagaacgaaatgcccaaatcacaaaaatgcttgattttgcgttcagccaatatgaaacgcatccgatgtataaacgtaacgaaatcatttccgatttgaaggtcaataaaggccgtgagcaaaaaataaaccttgtcacatcagaaccgatttcccttttgacgaaaaaaggcgaaaatatcgaatctgttaaaaaagaaatcaaacagaaagaagatatccaggcccctgtcaaaaaaggcacagagcttgggacgctcgttttgaaaaaggatggaaaggtgctcgctgaaagtcctcttgtcgctgaaaaagatatggacaaagcggggatgtggacgatgttcaagcggacgatgacccactggacgaagtg

SEQ ID NO: 1694 - DNA, 1085 bp, Bacillus licheniformis
atgcggattgttgttagcggaggcggaacgggcggccatatttaccccgcccttgcgtttattaaagaagtgaaacggcatcacgaagatgttgagtttttatatatcggaaccgaaaaaggcctggagaaaaatatcgtcgagcgggaagggatccctttcaaagcgattgaaattacgggttttaaaagaaaactttcatttgaaaacgtcaaaaccgtcatgcgctttttaaagggtgtaaaagaatgcaaagaagaattaaaacggttcaagccggatgccgtgatcggcacgggcggctacgtgtgcggccccgtcgtatacgccgcttcaaaactggggattccgacgattatccacgaacaaaacagccttcccggactcaccaataagtttttatccaaatatgttgataaggtagcgatttgttttgatgaagcgaaaacacattttcctgcagaaaaagttgtttttacaggaaacccgagggcgtctgaagtcgtctctataaaagggggccgttccctgaccgctttgggtcttgcagagggcaaaaaaacggtccttattttcggaggcagccgcggtgccgctccgatcaatgaagcggtcattgcgatgcaaaacgaattaaaaaagcgggattaccaggttctttatgtcacaggggaagttcactatgataaagtcacagctgcgcttgaaaaagaaggcgccgctccgaatatggtcgtccagccgtttctccatcaaatgcccgagtacttaaaagcgttcgatgtcgtcgtgggccgcgcaggggcaacgacaatagcggaaatcaccgcgctcggcattccaagcgttctgattccgagtccgtatgttacggccaaccaccaggaagtaaacgcacgctcactcggggagcagaacgccgctgtcgttttaaaagaatcagagcttaatggagaccgcttaattcaggcgatcgatcatattttacaagacgaaaagacgttggaagagatgaagatccgcgcgaaatcgcttggcgtgccggacgctgcggaacgcttgtacaatgtgctgaaagaattgaa

SEQ ID NO: 1695 - DNA, 1135 bp, Bacillus licheniformis
atgaaacagttaaaaatcggaatcacatgttatccgagtgtcggcggatcaggaattatcgccaccgagctcggcaagctgcttgcggaaaaaggacatgaaattcattttattacatcaagtgttccgtacaggctcaataaagtgtattccaacatctattttcacgaagtcgaagtcaatcaatatgccgtttttaagtacccgccgtatgatttggctttggccagcaaaatggcggaggtggcaaagcgggaacagcttgatgttctgcatgcccactacgcggtgcctcacgcgatttccgcttttttagcgaagcaaatgctgaacggaaacattaaaacggtcacaacgctgcacggcacagatataaccgtgctcggctatgatccgtctttaaaagacctgatcaagtttgcgatcgaatcgtctgaccgcgttaccgcggtttcttcggctcttgccgcgcaaacgtatgatttgatcaaaccgaacaaaaaaattgaaacgatctataattttgtggatgagcgcgtgtatttaaaaaaacaggagcatcattcgctgaaagagcagtacggcattgcacctgatgaaaaagtgatcatccacgtatccaatttcagacaggtgaagcgcgtacaggatgtcatccatgtattcagccgcattgtcaaacaaatgaaatcgaagctgattctcgtcggcgacgggccggaaatgaccgtgatctgccagcttgtcagacagctcggattaaaagacgacgttcttttccttggcaaacaagacagcgtagaagagctttacgccatcagcgatttaaagctgcttttgtccgagaaggaaagcttcggtttagtgctgcttgaagcgatggcctgcggcgttccgtgcatcggcacaaatatcggggggattcccgaggtgatcaaaaacggagtatccggttacttggtcgatgtcggagatattgaaggtgcagctagtaaggcgcttcatttactgactgatgaaagcctgcagcgccagtttgcggaagcggcgctgcaaagcatcaaggaacgcttttcttccaacaaaatcatcgcgcaatatgaagaaatttatcaacaattaacagactgggagt

SEQ ID NO: 1696 - DNA, 1050 bp, Bacillus licheniformis
gcactgtaattgcgttttttgtctctctcattactgttttaattattactccgcttgtcaaacgtctagcaatcaaatccggggtcgtggatcagccggataaacgaaagatacatgataaagtaatgccgagaatgggcggtttagccatttttataggagtattgaccggttcgtttgccggcggcctttatgaaaacagaataacagcaattacactcggtgcttttatgatcgtaattttaggcattgtagatgacaaatacaatttaagcgcgagaattaaatttatcgtacaagtattagtagcctgcatcatcgtcagtacaggcttgaaaatggaatttttatcgattccgttttgggatcttcgctttgatttggggtggctcgcatacccgttgacgattttgtggatcgtcgggatcaccaatgccatcaatttaatcgacggattggacggactggctgcgggtatatccgtcatcggcctctcgacgattgccgtcatggcgttttctgccgataaaatcttgatcttctctttgtcgctggtagtcatcggaagcacggtcggctttctgttctacaacttccacccggcgaaaatttttatgggagacacgggctcgctgtttttgggctatgtgatctcggttctgtcgctgctggggctgtataaaagcgtgactctgttcagcgtcgtcatcccgattattatattaggagtgccgatatttgacacgacatttgcgatcatcaggcggattttaaacaagcagccgatttcggctcccgataaatcgcatattcaccacaggctgatggccttcggcctgtcccatcggaaagccgttatcgtcatttatttaatcggcgtcgtcttcagcctgagcgccattcttttaaaaaccgcaaccctatgggtgtccatcttcatcatcttcggcttaatactgttcatgcagatcatcgcagaggtgacaggccttgtaaatgagcagtacaagccttttacgaagttttacaggcggatggtgaagaggaatt

SEQ ID NO: 1697 - DNA, 1019 bp, Bacillus licheniformis
atggataagcggtttgcagttgtgttagcagctggtcaaggaacaagaatgaaatcaaagctatataaagttcttcatcctgtttgcggaaaacctatggtcgagcatgttgtcgatgaagctcgcaagctatcattagaaaaacttgtcacaatagttggacatggtgcggaagatgtcaaaaaacagctcggggaaaaaagcgaatatgccctgcaggctgaacagctcggcacggcccatgccgtcaagcaggccaagtcgattcttggaagcgaaaaaggaacaacaatcgtcatctgcggagataccccgcttttaactgccgaaacgatggaagccatgctcacggagcatcagaaaaaagcagcaaaggtgacgattttaaccgctgtagcggaagatccgacaggctacggacgcattattcgcaatgaaaacggcgatgttgcaaagattgtcgaacacaaagatgcaacagaagaggaaaggcttgtcaaagaaatcaacacaggcacctactgttttgacaacgaagctctttttcaaacgatcgagcaggtttccaatgacaacgtacagggggaatattatcttccggatgtcattgagatcttgaaaaatcaaggtgaaactgtagccgcttatcagactgtcaacttccaggaaacgctcggagtcaatgacagagtcgccctatcacaagcggaaatctatatgaagcagcggatcaataaacgccacatgcagaacggcgtcagcttaatcgatcccgacaacacatacatttcaccggaagccgtgatcggcagggataccgtgatttatcccggcaccgtcattaaagggcgggttgttatcggtgaagacgcggtcatcggacagaacagcgaactggaaaacagtacggtcggcagcagaacggtcattaagcagtccgttatcgtggacagtgaagtcggcgacgatgttacaatcggaccgtttgctcatatcaggcccgactcaaagatcgacaa

SEQ ID NO: 1698 - DNA, 1348 bp, Bacillus licheniformis
ctgaaaaagtttatgatcagtgcggccgcgtccctattgctgctgacatgcttttttccgcttccgtccacagcacagactgccatcgggaacgagacaaaacagcggctgacatatcctgttttaacgaaagcgaaaacgcctgaagaagccggtttttcttcgaaaaagcttaaagctgtggaccgtctgatcgaacaggatgtcaaagcgggctttcccggcgctgcccttattttgattaaagacggaaaaatcatcaaaaaagaagtctacggctacaagcagaaatacaacggcctcatagcgctcaaacatccaaaaaaaatgaaagcaaacacgatgttcgacctagcctccaatacaaaaatgtatgccgtcaattttgccttgcagcatttagtgagcaccggaaagcttgacttgaacaaaaacatttctcaatatctccctgatttcaaagatcacccggaagacgatgtaaagggaaaaaaccggctccgcgtgattgatttgcttcatcataacgcaggcttccctgcaagctggaattattacgacccgaaatcagccggacacctctactctcaatcacggagcaaaacgcttgaatatcttgtgaaaacccccttggcatatgaacccggcacaaagcaaatttacagtgacatcgactatatgctcctcgggctgatcattgaaaaaatcacaaacgagcgtttagatacctttgttgaaaaccggttttaccggcctctcggattgcggcatactttgtttaatccgctccaaaagggctttaaacggtcgcattttgcagctacggaacgattgggaaacaccagagacggcaccatttcgttcccaaacatcagaacttacacacttcagggggaagtccacgatgaaaaagcattctattcaatggaaggcgtttctgggcatgccggcctgttttccaccgttgacgacgcagcagtgctccttcaagtcatgctgaacggcggcggttacggaagacagcatctattcagcagttctgtcatttcacaatttacagagccgtcaaaaacaaatcccacatatggactaggatggcggctcaacggcaataccgatatggagtggatgttcggcaagcacgccagcagcaaagcatatggccataccggctggacgggaacggttactatcattgatcccgtgtatcaaatcggcattgtgttgttaaccaataaaaagcactctcctgttatcaaccctaaagaaaacccgaatcaattcgaaggtgatgaatttgcaaccggaaagtacggcagcgtcattacagctgtttacgaggcgttac

SEQ ID NO: 1699 - DNA, 1451 bp, Bacillus licheniformis
ttgacaaagcttcttacatatttaaaaaatgtaccttcctatgccggccaagaagaccctgatataacttcaattgagatggactccagggaagtcaagacagggagtctttttgtttgtataaaaggctatacagtcgacgggcatgactacgcccgccaagccgctgaaaaaggggccgccgccattgtggcggaaagggaagtggacgccgatgtgccggtgattatcatccgtcatacgaagagagcgcttgccgtgctgtcggacgctttttacggccagccgacaaagcagctgaggctgatcggaattacaggcacgaacggcaagacatcgacttctcacatggtggaggagatctttagaaaagccgggagccgtacaggactgatcggcacgatgtacacgaaaatccacgacgaaacgttcgaggcgaaaaatacgacgccggaaagcgtcacacttcaaaaaacgtttagaaaaatggttgatcagggtgtggatacagccgtcatggaagtatcttcacacgctctccacatgggccgggtgcacgggtgtgattacgatatcgccgcatttacaaacctgacccaggaccacctcgactaccacgagacaatggaagaatataaacatgcgaaaagtctgcttttctcgcagctcggcggatcctttaaccacgaaacaccgaagtgggccgtgctgaatgcggatgaccctgcttcagcctatttcgcccaagtgacgtcagcacatcttttgacatacggaattcaaaacgatgccgatgtcatggctgaaaatatcaaaatggctccgaaagggacaacctttgacctggtgacgccaaaaggttctgcacaagtgacgattccgcttgtcggcctgtttaacgtctacaatgttttaacggctgccgcgatcgcgattgcagcggatatcccgtttgccacgattacagaaggaattgaagggctgaaaggggtcagaggaagatttgagcttgtggacgcaggccaggacttcccggtgatcgtcgattatgcccatacccctgacagcctcgaaaatgtcttgaatacgtgcagaggcttaacggaaggaaagctgtttgtcgtcgtcggctgcggtggagaccgcgataagacgaagcgtccgaaaatggcgaagatcgccgttgaccttgctgatgaacccgtctttacagccgataacccgagaagcgaaaacccgctcgccattttaaacgatatggaggaaggcgtaaaaggagcttactatcacagcatcgtcaaccgcgagcaagcgatcttttttgcaattgcaaacgccaaaaaaggcgatgtcgtcctgattgcaggcaaaggccatgaaacttaccagcagatcggcggtcaaacctttgattttgatgacgctgaggtggccaaaagagccattcttga

SEQ ID NO: 1700 - DNA, 1230 bp, Bacillus licheniformis
  misc_feature (1)...(1230): n = A,T,C or G
cttcgtttctgaaanaagagatctgaaagatactggcttgccagaacacccgaaaaaagctgctgcacttctgaaagacagcgagaaaaccctcaagtctgatcaaacatacaagcttcaggtggaccgcgttccggcggaagagatcaaagcgctggaaaaggacaaagatgagcttaaagtcgcagcgattttcagaagattttctggcggctatgcgtatgagccgcaaatcgtcaaggcgatgagcccgaaaaccgcggggaaaaacgatgcgcagctccttgatgagaaggcttctaaacagatgccggccaacgatttgacgtatgaggaagtctcacgcgtttccgagcatcttgaggaactgcccggcgtcgacgtcatcatggactggaccaggaaatatccttatgaaaaaacgctctactccattttcggaggcgtcacaacgcctgaacaagggcttatcaaggaccgggaagacttttacctgacaaggggatatgcccggaatgacagagtgggaaaaagctatctcgagtatcaatatgaagaatatttaaatccgaaaaaagcgaaagtccaatataccgaaaaccgttcaggaaaggttatcagccaggaaacggttgatgaaggaagacgcggctacgatctgcagctgacgttcgacatggagctccaaaagaaagtcgaagaggctatcgaagaggagcttaataaattccgcggctcaaactacatgctggacagagcgttcgtcgtcatgatggacccgaataacggagacattctgtccatggccggaaagcggatcgtcgacggcaaaatcaccgactatgcaatcggcgcgtttacaacccagtacgaaatgggatcggcggtcaaaggcgcgaccgtgcttgccggctatcaggacggcatgccgcatgggcagagttatttagaccaagagctgagcttcgcagggggagttaaaaaaggttcctacagaggaaacactatcggttgggctaatgaagttagagcgctggaaaaaagttcaaacgtttatatgttctatgtggcaatgagaatggcaggaattacgtatgtaccgaacggcccgcttccggcgaacctagaggacttaaagaaaatgaggtattacttcaatcaatttggccttggggtaaaaacaggcatcgacttgccgcagagtcggccgggatgcagacaaacccaaaa

SEQ ID NO: 1701 - DNA, 877 bp, Bacillus licheniformis
ttgaagaaagttcgtaaagcgatcattcccgcagcgggccttggaacacgtttcctccctgcaacgaaagcgatgccaaaggaaatgcttccaatcgtagataagccaaccattcaatatattattgaagaagccgttgaagccggcattgaagacattatcatcgtaaccggtaaaagcaaacgagcgattgaagatcatttcgatttctcgccggagctcgaacgcaacctggaggaaaaagggaaaatcgaactccttgaaaaagtgaaaaaagcgtcaaatctcgctgatatccactatattcgccaaaaagaaccaaaaggactcggacatgccgtttggtgcgcccgcaactttatcggagacgagccgttcgcagtgctccttggagacgacattgtccaagccgaaaaacctggccttcgccagctgatggacgagtacgaaaagactctctcatccgtaatcggcgttcagcaggtgcctgaagaccaaacgcaccgctacgggatcattgatcctttgacaaatgaagggcgcctataccaggtcaaaaactttgttgaaaaaccaaaaccgggcacagcaccgtctaaccttgcgattttgggacgctatgtctttactcctgaaattttcatgtacttagataaacagcaaatcggcgcaggcggagagatccagctgacagatgcgattcagaagttaaacgaaatccagcgcgtattcgcttatgacttcgaaggcaaacgctatgacgttggagaaaaactcggttttatccagacaactctcgaatttgccatgcaggacgacgaactgaaggattcgctgattccatttatgcaggaccttctggcaaaagaagaagttt

SEQ ID NO: 1702 - DNA, 1135 bp, Bacillus licheniformis
atgacaagaacggttttgttttgcgctactgtggattaccatttcaaggccttccacctcccgtatttaaaatggtttaaagagcaggggtggaatgttcatatcgccgcaaaaggagatatgacactgccctatacagataaaaaatttgatatcgatatcaggcgttctcctttgaatgcaagcaatatcgctgcctatcgggagctggcgcgaatcattgacgaacaccggtacagcatcattcattgccacacgccgatgggaggcgtgctggcaaggcttgcggtccggaaacagagaaaagaggggacgaaagtgatctataccgctcacggtttccacttttgccaaggtgctcctttaaaaaattggctgctgtattatccgattgaaaaagggctgtccgctttgaccgattgcctgattacgatcaatgaagaagatttcgtccttgcaaaaggcttgcgaaaagcgctgcgcacggaaaaaatccacgggatcggcgtcgatacggagcggtttcatcctgtcagtgaaacagagaaaatgctgctcaggaaaacatacggtttcaaagaagacgactttatcctcatatatcccgcggagctgaacgcgaataaaaaccaggccttgctcatcgaaacggcggctgctttaaaagacagagccccgaacttaaaggtcgtgtttgcaggaaaagggcagatggagcaaaaataccgaaatcacgctgaacaaaaaggcgtttcttcgctcgtcatgtttgccggttttcaaaaaaacatccacgaatggattcagcttgcagacgtgtctgtcgcctcaagcatcagggaagggctcggcatgaacctccttgaaggaatggcgtcaggaaagcccgccgttgcagcggacaaccgcggacaccgggaagtcattcaagagggcgtgaacggatttttggttccgcagggagacgccggaacgttcagcgaccggatattgcagctgtaccgtctgccttctttgcgaaaaaagatgggagacgcggggagacgaacagccgccgctttttcccagcagcgcaccgtcaaagaaatggcgggcatttactcttcctttatggataacgaaacagttgaaagga

SEQ ID NO: 1703 - DNA, 903 bp, Bacillus licheniformis
aaaactgagacggctcggcgccgtcatgctggtcctctcgcttttgatcagcggctgtgcgctgccgggccttggcggggcttccgataaaacgatcaaaatcggagcgcaaaacctgaccgaatccgaaattcttgccaatatgatctcgcttttgatcgagcatgatacggatctcaatacggtgctggtcaaaaacctcggctcaaactatgtgcagcaccaggccatgctcggcggagacatcgacatttctgcgacgcgctattcgggaactgacctgacaagcacgcttggaagggaagcggagaaagacccgaaaaaagcgctccgcatcgtacagcaggactttcaaaagaaattcaactacaaatggttcgattcttacggatttgacaatacgtacgcttttacagtcacgaaagaactcgctgaaaaagggaactatgaaaccatatccgatctgaaaaaagacgcggatcaactgaagcttggcgttgacaatgcatggctgaaacgaaaaggcgacggatatccgggatttaaacaggaatacgggttttcatttggctcgacctttccaatgcagatcggactcgtttatgacgccgtcaaaaacggcaaaatggatatcgttcttgcctattcaacagacggcaggatcaaagcctatgatttaaagctgttaaaagacgataaacgctttttcccgccgtatgactgttcgccggtcgtgccggaaaaagtgctgaaggagcatccggagcttgaagagaccatcaataaactgattggaaaaatcgacaccgaaacgatgcaggagctcaattacgaagtcgatggaaagctgaaagagccttctgtcgtcgcggccgagtttttaaagaagcacaattattttga

SEQ ID NO: 1704 - DNA, 955 bp, Bacillus licheniformis
gtgaagaaaggattcgtttcaatcattattccttcatacaatgaagcaagcaatattaaattgatttatgaatcgttaaggaacgaatttcaatccattgattatgattatgaaatttattacataaatgatggaagcactgatcgaacattggaggaaattaaaaaactagccgaaaaaagcgagcatgtgaaatatatttcgttttcacggaatttcggcaaggaggcagccatccttgccggttttcagcatgcccgcggcgatgctgttgtggtgatggatgcggatttgcagcacccgacatacctcctgcacgattttattaaagggtatgaggaaggctatgatcaagtggtcgcccagcgcaacagaaagggagacaaccccgtgcgctcctatttgtcatccctttattaccgctttatcaacaatgcggtagaggttgatttaagggacggcgtcggcgattttcgtcttttaagcagaaaagccgttaatgcgatgctgaagctgagcgaaggcaacaggttctcaaaagggctgttttgctggatcggttttgaccaaaagattgtttattacgagaacgtcgaaaggaaaaacggaaaatccaagtggtcgttccgccacttgttgaactatggaatcgacgggattgtgtcgttcaacaacagaccgctgagaatgtgtttttacgccggtatttttatcctttttctatcgcttatttatatcgcggccacattcatcaggatcttaaaatacggtgtgattgttcccggctattttacgattatttccgccgtcctgtttctcggcggcgttcagcttctcagcctcggaattatcggcgaatacatcgggcgcatttattatgagacgaaaaagcggcctcattacttgatacaggaggcaaacatcgctcatggagaaactcatgaaaatcgtgaat

SEQ ID NO: 1705 - DNA, 1170 bp, Bacillus licheniformis
atcaattcatacacgtcatagtagcgacaggtgaatgggggcaggatcagctaagatacagaaggcaccgccttgctgagtttttagcaggccgcaaggagacgaaggaagtcatttgggtttgtccgtctgaaaatccttcccgtgagacttttacattgcttgacaacggaatcaagcaatttgcagtcaaagattttttgaaaaagaaaatattcaggtttgcccgctacaaagatgttttctatcaaagcaagctgaagccgctgcttgaccggctgaaagaagacgttcagggagaaaaggtgtgcttatggtacaccttccccggctttccgctgctgtcgtcgctttatcaatgggatcaggtcatctatgactgcagcgacctgtgggcggccccgatcagcggtagccaaagccttgtctcaggattcaggcaaaaggtcatttttgaagctgaaggcagaatcatcaaagctgctgatacgattttttgcacttccgaatacttgcaacaaaatgtagcagaccggcttcaaggagagacaaagccggtttttacaatcgaaaacggtgtggagtacagcttgtttgcagaaaatatgcaaaaagcggatgtattgaagggaagggaaggaaccgtcctcggctttatcggaggaatcaagccgaagctcgattttaagctcgtcaaagaagctgccagaacaaaaaaagagtggacatttttatttgtcggtcctgacgggacaaacggagacgaagattttaaagcgcttcttgaagaagataatgtcatctggacgggccccgctgcgccgtcagaagtaccagcttatatgaatgtagtggatatcggtatcatgccgtataaaccgtcgccatataacaatgcggtatttcctttaaagctgtttgaatttttggctgccggaaagcctgtcgcaggtatgaacctcccttcaacggaaaaggttgaacaggaacacgtttaccgtcatttaacaggaaacgaccccgctgaatttacagcggtttgtgaagagctggagcttgcgcatgatgatgtttcccatgtggaactgcgcagaaagatcgcacgtgaaagagactggcatcatctatttttaatgatgcttgataaattgaacttgaataaggatgcat

SEQ ID NO: 1706 - DNA, 1227 bp, Bacillus licheniformis
ggcaaacaaaaagttggttttgttttgtggaattgcggtgctttggatgtctttatttttaacgaatcataatgatgtacgcgccgatacgatcggcgagaaaatagcggaaactgccagacagcttgagggtgcgaaatacagctacggcggagagaagccgaaaacggggtttgactcgtcaggctttgtgcaatatgtgtttcaatcgctcgatattacgcttccgagaacggtaaaggaacaatcgactcttgggagcagtgtcggccgtcagcagctcgaaaagggggaccttgtctttttcaagaatgccgagctggaatcggacggaccgacccatgtcgccatctatttgggaaatgatcaaatcatccacagcacaaaatcaaacggggttgtcgtgacaaagcttgaaggcagctcttactggagctcggggtattttaaagcgaaaaggatcacaaaagagcctgagatttcgatggatcctgtcgttcaaaaagcaaaaagctatgtcggtgttccttatgtatttggaggcaactctccggatctcggatttgactgttcggggttgacccaatacgtcttcagagaggtgctcggcgtttatttgccaaggtcggctgaacagcaatgggctgtcggtcaaaaggtgaagcttgaagatatccggccgggtgatgttttgtttttcagcaatacgtacaaaccgggaatatcccataacggcatctatgccgggggcgggcggtttatccatgcgagccgttcaaataaagtgacgatatcctacttgtcggcttcctattggcagaagaagttcacaggagtcagacgttttgacaacatgtccctgccaaaaaatccgattgtatccgaagccatcaggcatatcggcgaagtcggttatcaaaaaggcggcacatcgcctaaagaaggctttgatacggctgggtttatccaatatgtctacaaaacggcggcaggagtggagcttccgaggtatgctgacaaacaatacagcacgggtaagaaaattaccaaacaggagcttgagcctggagacatcgtcttctttaaaggaaccactgttatgaatcccgccatctatatcggaaacggccaggtcgttcttgtcaccttgtctgccggtgtaacgacagcagatatggagacgagcgcctattggaaagataaatacgccggaagcgtcagaattga

SEQ ID NO: 1707 - DNA, 1168 bp, Bacillus licheniformis
ttgaaggttctttggattaccagcgtttatccaagcagtcaaaggccgggagaaggcgtttttcatgaaacacaggttcaggcgctgcagatgcagggcgttgatgtgacggtcatatgtccattgcctgtgaatcctgctcctctcaggctgctgaaaaaaaaataccgtcaagtgcgaacagtcccggaatatgaagaaagaaaaggcatcccggtttacaggccgccgtatacggctttgcctggacagctaaaatgggctcagccgcatcgccggatcgcaaagtctgtattgaggacgatcgagaagcacgggcttgcgccggatcttatccatgcccatttcgcgatgccatccgggggtgccgctgccgttgtttcacagaagctgaaggttccttatgttctgactttgcacggaagcgatgtcaatatttatccccattacagcaaaggcgcttttcgagcatttgaaacagctgtgcattccgcagcaaaagtattggctgtcagcgaagcgctgaaagccaaaacgaaagaaatgaccggtgctgaaagctcggtgcttcctattggagtcaacctggaccggtttcaaaagccctccgcttcaacacttgaattgagggagaaactcggcctgccgcaagacaaaaagttgctgacgttcgtcggccgcttggtgaagggaaagggagtagccgagctggcagaagcggtcaggcagcttgatgacagctacagagctgtattcatcggcgacggaccggagaagcagaacatccgtcaaatcgccggtgaaaaagcagtattgacggggcaggtcgcaaaccatgagatatcagaatatctggctgcatcagatctgtttgtgctcccttcgtattctgaagggatgccgactgttgtcattgaagcgctcgctctcaaggttccggtgctttgtacggcggtcgggggggttccgtctttattcggaaagcatgaacaccttctgatcaagccgcactcggcttccagcataacagaagctgtcaagggatatttggaaggcggcaattggcaagaagccatcgctgaagagctgtatcaaacggtgcacgaggattatgacgcctttaaaaatgccggaaagctgctggatgtgtatggggatgttgtcaaga

SEQ ID NO: 1708 - DNA, 846 bp, Bacillus licheniformis
cagggtgtataaacaaattggctatgacaaattctttgacgccagcacatatgatatgtcagaggataatctcgtcaaccttggcttgaaagacaagccgttctttgaagaatcaattccgaagctgaaatcgctcaagcagccgttctatgcgcatttaatctcgttgacaaaccactatccgttcattttggatgaagaggatgccacccttgaaaagggaacaacgggagacaaaacggtagacggttacttccagacggcgcgctatcttgacgaagcgcttgaagatttctttaaagagctgaaaaaagcgggattatttgatgattctgttatagtgatctatggtgaccacaacggaatctcagagaatcacaaccgtgcgatgaaagaagtattaggtaaagagattacaccgtatcaaaacgcgatgaatcagcgcgtaccgcttatgatccgcattccgggcaaaaaaggcggagtcaaccatacgtatggcggtgaaatggatgtcatgccgacacttcttcacctgcaaggtattgacagcaaaaaatacatcaactttggtacagacctcttttctaaagaccacgaccaaaccgtggctttcagaaatggaaactatgtaacgccgaagtacacgatgattgatacgaccgtatatgatacaaagacaggaaaagagatcaagggcaaccaagagacggaaaacctgaaatcgcaggtgtccgaacagctggatctgtccgaccaagtactctataaagatctgttgagattccacgagatttcagacttcaagcctgttgatccatcaaaatatcattacggaaaagaaaa

SEQ ID NO: 1709 - DNA, 795 bp, Bacillus licheniformis
aagcggagatgaaagatgatttgcaaaactcgaggagcaatttgatgcaaaactcgggatctttgcattagatattggttcaaaaccgaacggtaacgtatcggccggatgagcgcttcgcttttgcatcgacgattaaggctttatccgtaggcgtgcttttacaacagaaatcaatagaagatctgaaccagagaataacatatacacgtgatgatcttgtaaactacaacccgattacggaaaagcatgttgatacgggaatgacgcttaaagagcttgcggatgcttcgcttcgatatagtgacaatacggcacagaacctcattcttaaacaaattggcggacctgaaagtttgaaaaaggaactgaggaagattggtgatgaggttacaaatcctgaacgattcgaaccggagttaaatgaagtgaatccgggagaaactcaggataccagtacagcaagagcacttgcgacaagccttcaagcttttgctcttgaagataaacttccaagtgaaaaacgcgagcttttaatcgattggatgaaacgaaataccaccggggacgccttaatccgcgccggtgtgccggaaggctgggaagtggctgataaaactggagcgggatcatatggaacccggaacgacattgccatcatttggccgccaaaaggagatcctgtagttctcgcagtattatccagccgggataaaaaggatgccaagtatgatgataagcttattgcagaggcaacaaaagtggtagtgaaagccttaaacatggaaagcaaat

SEQ ID NO: 1710 - DNA, 955 bp, Bacillus licheniformis
atgcagaaacaagtcacattttcaatcgtagtacctgtctacaacgaagcggaagtgcttcaaagcacctatgaccgattaaaaaccgtcatggactcgacaggcgatccctatgaactgatttttgtaaacgatggttcaagcgatgacagcattcacacgctgaagtcgcttgctcagtcagaccaggcagtaaaatgcatcaatttctcaagaaacttcggtcatcagatcgcgattacggccggcacagactatgctgccggcgaggcgatcgttgtgatcgacgccgatttgcaggatcctcctgaattgattttggaaatggcggaaaaatggcgccaaggctttgacgttgtatacgccgtccgcacaaagcgagaaggagaaacatttttcaaaaagcaaacggccgccatgttctaccggattttaagaaaacttacagacgttgatatcccggtggatacaggagacttccggctcatggaccggaaggtggtcaatgaaatgaacaagctgaaagaaaaaaacccgttcgtccgcggtcttgtcagctggctcgggttcaagcagacagccgtctattacgagcgccacgaacggcttgcaggggaaacgaagtacccgctgaaaaaaatgctgaagctctcgctcgacggcatcacttcattttcctttcagccgctgaaactggcaagctactcaggaatcgtgctgtcagcgatcggctttatatacgccttcatcgtcgtctgcatgaagctgtttacgacaagcaccattacaggatggtcgtcgatgatcattctgcaatgcttgttcagcggatttatcctgatcatcctcggggcaatcggcgaatacatcggccgcatttatgacgaagtgaaagacaggccgctttatatcattgacggaaaatacgggtttgaagaacagcggcgggcgcgag

SEQ ID NO: 1711 - DNA, 1275 bp, Bacillus licheniformis
gcaaacagctatttgtccttctgaatgatttgaaggaaggaaagctcgctggtgaatgccgtatagacgacacactggccaatcaaaaattaaaagagacattgcagcaggatcaattcgacataaccgccaatttgctgaacagaatggattccccgccctccagagttgactttatgccgcttcatcgactgatcacagaagaagaagtagatgacgtggttcatgcggtgaaagacgtgctgccgaccgggcaatttacaagcggtttttatgttggcgtatttgaagctgaaatagctgcttttttgagcaaaaagcatgtcatggcttcatccagcggaaccgatgccatgattgtcgcgctgaaggctgcgggtgttggacaaggtgatgaagtcattatgcctgcaaacagctttgctgcaacggaaaacgccgtgctcgcagctggaggcactccgattttctgcgatattgaccctgttacattttgcatggatccttcagaaattgaagcatgtgtcactttgaaaacgaaatgcattttgcctgtacacctttatggaaagctgcctgacatggaagccattgcaaaaaccgctgataaatacggcatcccgattattgaagacgcctgccaggcgatcggcgtttccgatctgggaaaaaacagcctttgctccatattaagcttcaatccgtataaaaatctcggcacttgcggaaaagccggcgcaattgtgacggatgatccatcatttgcatccgcatgcatggaatatatgtatcacggctttgaactgaatcaaaaaaataaaaaggcggctgactacggctttaacgctaagattgataatctgcaagccgctattggactggcaaggatgaaatatctttctttaaataatctgaagcgcttatatttagcagatcgttatattgcgcatttgcagcagtatgaagacagaggtctgatcaaattgcctcaaatgaccgatgatcatgtatggcatttgtttacaattaaaatactaaacggaaatcgtgaccaagtcaaagatatgatgcttaaatttcataatgtccaaacagatatatactacccgattttatcccatcatcaaaacacaccacttgtaaaagccaattatcggcacacatcactgccggtcactgaatcagtgcataaacaaatgcttcagcttcctctctatccggggctcaccgtagaagaacaagacaaagtaatggaggccttaattgatgtcgtat

SEQ ID NO: 1712 - DNA, 1097 bp, Bacillus licheniformis
atgacaaagattctgattttcccttttttaagcatttccaccggtcatcatcacgttgccgattcgctgcagacagaactgctcctcaaatcccatcactgtgaaaaaatcgacattttttcacatgcttatcggcggctggaaaaggcctcctctgcggcatatttgtcatggattcagtattttccgaaagtctacagctcggtctatcatctcctggcgtgcgggcgccatgaaacggcaaagcgccacctcttgtatgagctgatctttttgaaaggcatgcagcagattattgcagaaaaaaagcctgatatcgtgttctgtacgcatgcattgccctcctatttgctgaaccgcttaaaaggccaatttcccgacatgaaagtggccaatgtatataccgattttttcgtcaaccgaatctggggaagagagaagattgattatcatttcgcgccgatcaaagacatcaaagaccagctgatcgcagaaggcgttgatgaagagaaaatttttctgaccggaatacctgtgcaccgttcctataaaacggagagaaagcctgagcaggacggggacaaaaaagcgttttgcaacatcctcataaccggcggaagcatgggggtgggcggcatttttaaactcgtgcgggaactgtcgccgaacgggaatgtcgcataccaaatactatgcggaaaaaaccgaaagctctaccggtatgttcgtgatttaaacaatccatatattaaagcgctgccttatatcgaaagcaagactgaaatgaaccgcttatacgcggaggcgtcgggcattattacgaagcccggcggcgtcacgatcagcgagtgcattgaaaaacagctccctgttttcatctatcatgcgctgcccggacaggaagagatgaatctcgatattctgaaaaagaaaaaccttgtcatcgaactgaatcagcaaaaacagcagccgattgaacagcagctgctttcctttttccgttcggatgaagacatcaggcgctatcaaatgagcgtcgatcaatatttgcgcgaaaaatcggaccgtgatttcagcgatattttagacgggatcat

SEQ ID NO: 1713 - DNA, 760 bp, Bacillus licheniformis
gtggtaaaaatttttatcgatcccggccatggcgggactgatccaggcgcttcagccaatggtttgcaagaaaaacagttaacattgcaaatcgccttggctttaagaaacattctcctgaatgaatatcaaaatgttacagtccagctgagccggacaagcgaccaaaccgtcagtctgacgcaacgcacgaacgccgcgaacagctggggggcggactactttctatcgattcacatcaatgccgggggcgggacaggtttcgaggattacatttatcccggcgtcggcgcacctaccaccacctatcgggatatcatgcatgaagagattttaaaagtggttgatttcagggatcgcggcaagaaaacagccaattttcacgtgctaagggaaacagcaatgccagcactgcttacggaaaatggctttgtagacaatacaagcgacgccgagaaactgaagtcatccgcgtttattcaatccattgcgagaggccacgccaacggactggcaagggcatttaacctttcaaaaaaatccacagccctttttaaagtgcaaatcggcgctttcagggacaaagccaacgccgattcacttgccgctcaagcgaaagcaaaagggtttgatgccattgtaattgacagggacagcctttacaaagtgcaaattggcgccttttcttcgaaagagaatgcagaagcgcttgttcagcaagccaaaaacgccggatttgatgctttcatttaccaggaat

SEQ ID NO: 1714 - DNA, 846 bp, Bacillus licheniformis
  misc_feature (1)...(846): n = A,T,C or G
ccttgtgcttcgtttcaccccgctgagctgtgtgaaagaagcggccgnttggcatatatcgttatccgcttttcaagttgactggcttaaagaagcgaacgcgatattggaaaatgaagccgatcctaaccggctggctgttcatatcaatgtggataccggcatggggcgtttcggtgtacgaacaaaggaaaagcttttcgcaatcgtggaagcgctgacggcaagtgaaaacctcgaatgggaaggaatttttacgcatttttccacagctgacgaaccggatactgagctaaccatgattcaacacgaaaagtttatcagctttcttcgctttctgaaagaacaaggctttaagctgactacggtgcatatgaacaatacggccgcggcgatcgcttttccggaattcagcgctgatatgattcgcttaggcatcggaatgtatggattatatccttccgattatatcaggcagcttaatctcgttaagcttgtgcctgcactaagcttgaaggcgcgaatcgcttatgtgaaaaccatgttgactgaaccgcggacggttagttatggtgctacatatgttgcagagcgcggggaagtcattgccacaattccggtcggctatgctgacggctattcccgtgaactttccaaccgcggttttattcttcatcgaggaagacgagtgccggtggcgggaagagtaacaatggatatgataatggtcagtctgggagagggtgaaggtaaacaaggagaggaagtcgtgatttacggccggcaaaagggagcagagatatctgttgatgaaattgcggaaatgctatgaaggaccgactatga

SEQ ID NO: 1715 - DNA, 1119 bp, Bacillus licheniformis
aacgggtgcttcacatcgtaagcggaatgaaccgcggcggcgcggagacgatgattatgaatatataccgccacacagacaggcggcatattcaatttgattttatttcccaccgggaagaaacgtgcgattacgacccggagatcatcacgcgcggcggccgggtgttttatgtaccgagcatcggtcggtcgggtcctgtcgcctacatcaaaaacatcagaaggattttggttgagaaagggccttatgccgccgtacacgctcatacggattttcagacgggctttgccgcattggcggccaggctcgccggcgttccggtcagggtctgccattcccacaacacggcctggaagcctaacccccggttttgggatacatggcagcttcttgcattccgccgcttgattttctccagtgctacggctctgtgcgcttgcggcaaagatgccgggcgttttttattcggcgcaaagaagatgggtgaaaacgcggtccatcttttgcaaaacgggattgaacttgaccggttcaaagaagcgaacggcgtttcaaaaacgaatgcgaaaaagagcttcggtatcaaagaagacgcactggtgatcgggcatgtcggccgtttttttgaacagaaaaaccacgcgtttctgctcgggcttgccgcttattgcaagaaatcgggcataccttttcaagcggtgttcgcaggtgacggtccgctgcgcagacagatggaagaaaaagccgctgctctcggtgtaaaagacgacattctgtttctcggcgtcgtcgaagatatcccggctctcatgcaggcatttgatgtatttgtcatgccgtctttgtttgaagggctacccctcgtactggtcgaagcgcaagcgtcagggctcccctgcattgtatcagacaacattacggaagaaaccgatttgggactcggcctgctgcaacgtctcagcttaaatgccggttttgaacggtgggctgaggatatcagccgtgctgctcagccgaaaaagcctgcatggccggaaatagagagaagccttgctgagagaggctatgatgcaaaagcaaatttggcgagactgatggacatctattcaatctccg

SEQ ID NO: 1716 - DNA, 992 bp, Bacillus licheniformis
ttggcaatattagtatgcggaggggcgggctatattggaagccatgctgtagcggaactgttaagccgcaatgaagatgtcgtaattattgataacctgcaaactggacatgaagaggcggctttaaagggagcttctttctataatggagatctgcgcgatgaagcatttctaagaaaggtgtttcaggaaaacgacattgaggctgtcatgcatttcgcggccgattcattggttggagaaagcgtaacagatcctctcaaatattatgacaacaacgtttacggagctgtttgcctgttaaaggtcatgaaagagttcgatgtgaagcaaattgttttctcatcaaccgctgcaacatacggagaaccggatcgggtgccgattatggaaacagatccgacggatccgacaaacccgtacggggaaacgaagcttgcaattgaaaaaatgctgaagtggtctgaaaaggcatacggaatccgtcatgtcgtccttcgctactttaatgttgccggggcgcatgtagacggcttgatcggcgaggaccaccagcctgaaacgcacctgattccgatcattcttcaagtcgcgctaggcaaacgggacaagattatgattttcggcgacgactatccgactccggatggcacgtgcatcagagactacatccatgtgatggatctggtcgacgcgcatattctcgctgtcgagaggcttcgaaacggcggagaaagcgccgtatacaatctcggaaacggaacgggcttctcagtcaaagaagtcgttgaaactgcccggaaagtgacaggctgtccgataccggcggaggttgcagagcgccgcgcaggagacccggcacagctgatcgcctcttcggaaaaagcggtgaaagagcttggatggcagccgaagtacgccgaactggaaacgatcattgacagcgcgtggaagtggtttaaagcacatccgaacggctatcaaagctagaa

SEQ ID NO: 1717 - DNA, 980 bp, Bacillus licheniformis
atgagcgtgttggttttgggcggtgccggctatatcggttcacacgccgtgtaccaattaatagacagaggcgaaaacgtcgttgtcgttgacaacctcgagaccggccaaagacaggcagtacatcctgatgcgatcttttatgaaggggatgtgcgcgatcgcgatttcctccgcacggttttcgaaaaggaacgtattgaagaagtgatccattttgccgccagttcacttgtcggcgaatcgatgaaagatccgctcaaatattacgacaacaatgtatccggaacacaggttttgcttcaggcgatgctcgagcacgatgtaaaaaaaatcgtattctcctcgacggcggccgtctacggagagcctgaatcgttgccgattacagaagacatgccgacaatgccgacaagcacctacggggaaacgaaactgatcatggaaaagctcatgaagcggactgaagaagcccatgggatcagctttgtgtctctcaggtacttcaatgttgcaggggcaagggagacgggagaaatcggagaagaccaccgtccggaaacacacctagtccccctcatcctgcagaccgctctcggccaaagaccgcatataacgattttcggcgatgactatgatacgcccgacggcacatgcatccgcgactatgttcatgttgaagacctcattgacgctcatctgtcggcattagactatttaagaaaaggcggcaaaagcgatatattcaatctcggcagcagcgaaggattttcggtgaaagaaatgattgatgcggccagaaaggcaaccgggaaagacattaccgccgagatcggcaagcgcagagccggcgacccgagcatcctgattgccggctctcacaaggcaaagcaagttctgggctggaggccttcgcgcacatctgtagcaaagattattgaagatgcatggaagtggcattcctcgcatccaaacggtta

SEQ ID NO: 1718 - DNA, 846 bp, Bacillus licheniformis
agcctttgctgacgatcgtcgtaccctgttataacgaagaggacgtgtttgccgaaaccgcaaaacagctgactgcggtattggatgatctcacagcagataaactgatttcttcagagagcaagcttttatttgtcgatgatggatcgacagaccgcacatggccgctgattgccatggaaagcacaaaaaaccgctatgtgacaggcttgaagctggcccgtaattcgggacatcaaaaagctctgttagccggactcgataaagcaaagcaaaaatccgattgcgttatttcaatcgatgccgatcttcaggatgacatttcggcgattcgccggtttatcgaaaaatatcatgaaggctatgaaatcgtctacggtgtacgccgaagccgccaaacggatacatggtttaaacgaacgacagccggatggttctacaagatcatgaataagcttggcatccagctggtcgataaccatgccgactttcggcttttaaataaacgggcgcttgaggagctcagccgctatgcagaagcaaatgttttcctgcgcggtttggtgcccctgatcggccttcggtcggcaaaagtgtactatgaccgaaaagagcggatggctggagaaacgaaatatccgctgaaaaaaatgctgtctttcgcttttcacgggattacgtctttcagtgtcgctccgatccgattttttaccctgattggcttcttcttatttttcctaagctgcatcgcgggtatttatgcaatgattcaaaaactgctcgggtatacgaatgcaggctgggcttcgctgatcatttcgatatggtttttgggcggtatgcaag

SEQ ID NO: 1719 - DNA, 990 bp, Bacillus licheniformis
atgtgtacaagtatcacgttgacgactgcgggccgggagcatttattggcgaggacgatggattttgattttgagcttaacggggaggtgctgttgcatccgcgtcgctacaaatggaaaagtgaagcggacggcagcgagcatgccggccggtatgcgtttatcgggatgggcagaaggctcaagaatgctctgtttgccgatggtgtgaatgaaaaaggattgtcttgcgcggcgctttatttcccgggctatgctgtgtatgaaaacgaagcaaaagagcaaagccgcaatcttgcgccgcacgaattcgtgacatgggtgctgtcggaatgcggcgatttggaggatgtgaaaaaagcggctgtttccttaaacattgttgagagagaggtcagcttgctgagtacggtgacgccgctgcattggctattaacggaccgctccggggcaagcgtcgttgttgaaccgacggcagacggcattcaaattcatgataatccggtcggcgtgctgacgaacagtccggatttcccttggcatttgaccaatttgcgcaactttatcggtcttcagccgggacagtttgccgcgaaaaaaatgggaggcctgacgctgtcggcttttggtcaaggttccgggctgtccggattgccaggagattttacgccgccatcccgctttgtcagggctgcatttttgaaagagcacatgaagcctgtgtccgatgaaacagaaggcgtctctgccgcgtttcatgtcctctccaatatgaatattcctaaaggggttgttatgactgatcaaggcgaagacgattacacccaatatacggcggtaatgtgcagcgagacgtgcagctactattttcaccattatcaaaacaggcagattcaaaaggtttgcttattacaggaagacctggacagcaacgaattaaaggcgtttcagccaaagcaggaagagacggttcattctcttcaatcataa

SEQ ID NO: 1720 - DNA, 1194 bp, Bacillus licheniformis
agaaaaggaaaatcgatatattcctggtcttcattcttgtattatctgcagcattaaacttgtacggcatctggaatagtgacacagacaacgcctactatacggcggccgttgaaagtatgacccaaagctttcataacttcttttacgcatcatttgatccggcaggctttgtaacagttgataaaccgcctgtcgcactctggattcagacactttttgcacttgtattcggcgtgcacggctggagcgtcgttctccctgaagccattgcggaagtgatttccgtagcactcttgtactttattgtaaaacctacttttggcaaaacggcggccagaatttcagctcttattatggcgtgtacgccgattgccgttgcggtcagccatacaaacaacgtcgacagcattctcgtcctttgcttgatgattgcaacgtggctgttgtttaaagcagtccggaaaggaaaaatcggctggctgctcggcgcattctgtatgatcggtgtcggttttaacgtcaaaatgctgcaagcttacatggtattaccggcattcctgctgttttacatgattggagccaaaacgacgattcgcaaaaaagttgtgtctcttatcacagccgtgatcgttctggcaggtgtttccgtttcctgggcggttgtcgtcgacagccagcccgagatttcgcgcccttatatcggaagcagccagaccaactctgtccttgagctggcgtttggctataacggcatccagcgtctcacaggtcaaaacggtgcaggcgggggcggaacctcctcatctgatcatgatcaaaagaatcagcagcaaagcggcgatattgaaaacaactcagactcggcaaatggacaaatggctccgccgagcggaggcgaaatgccttcgggcggaccggatggccggcagggtgatgtccaaagcggcggcggaggtcccggtggcggcacaggcggcatgtttggcactggaaccccgggtcctctcagactattccaatctgagctttcaggacaggctagctggctgatcccgtttgtcctcttcggcatcatcggtttgctgatcgcgggtcttcgcagacaaagaaaattcaatgaaacaacgactgaaacaattttctggatgatgtggcttctgccggtcgctgcattcttcagcatcgcaggat

SEQ ID NO: 1721 - DNA, 805 bp, Bacillus licheniformis
ttgttggatcaaccgataggagtcattgattcgggagtcggcggtttaaccgttgcaaaagaaatcatgaggcagctgccgaaagaaaaaattatatatcttggagacacgaaaaggtgtccatacggaccgagggacagaaaagaagtcctgtcatatacatgggaaatgacaaattatctgttatcccgccaccatattaaaatgctcgtgatcgcctgcaatacagcaacggccatcgcgctagaggaaatcagcagggaagttgcgatacccgtcatcggcgtggtgcagcccggagccagaaccgcgattaaagtgacggaaaaccagcgaatcggcgtaatcggaacggaaaacacgatcaaaagcggcgcatacgaagaagcgcttctttcgctgaacggagatttaacggtggaaaatctggcttgcccaatgtttgtcccgtttgtggaaagcggcaaatttttggatgagacggctgatgaaatcgtcaggacgtcactgcacccgctcagagattcatcaatcgatacgctgattctcggatgtacgcattatccgattttaaaagagccgattcagcgctatatgggagagcgcgtcaacatcatttcctccggagatgaaacggccagggaagtcagcacgatcttgtcatacaacggtttattaagcaaaacggcggaaccgccggaacacttgtttttaacaactggggagcgtgcccgcttcacaaaaattgcaaacgattggtttggatacgaagtgaaaaatgtggaaagcatttctcttcaggaga

SEQ ID NO: 1722 - DNA, 829 bp, Bacillus licheniformis
atgaaaagcgaccgaaccatgcatattatttcttgtacagacaataactacgcacagcatttaagcgtgatgttctcatcattgctgacgaatatggatcagacgcgcgaggtgaaactgtatgtcatcgacggagggattgaaccggagaataaaaagcgtctggaagagacgaccctccaattcggagctcctattacatttcttaatgtggaaaaaagccagtatgacaaagcggtcgaaagcagccatattacaaaagcggcttactatcgaatttccattcccgatctgattgatgacgaatccgttaaacgaatgatctatgtcgactgcgacgccttagttttagaggatatatcgaagctgtgggacatggacatttcaccttatttcgcggcggcggttgaagatgcaggccagcatgaacggctgaaaaagatgaacatcagcgatgaagcaaaatattttaactcgggcttaatgatcatcgatatggaagcttggagaaaaaacgacatttcgaaaaaagtcatcgactttatcaataacaacgatgaagacatgtttgtgtttcatgaccaagacgcattgaacgcgattctttatgatcagtggctcgaacttcatccgaggtggaacgcccaaacacacattattttaaaagaaaaaacaccggcttccctcatcgatcaaaagcgctatatggaaacaagggcaaacccggcaatcgttcatttctgcggcggaaacaagccttggaattcaaacacctcacacccgtacgcccgtcaatattttaagtatttgcagtccacagcctttaacc

SEQ ID NO: 1723 - DNA, 1023 bp, Bacillus licheniformis
atggaaggcatccagtctgttttaaatgagtacggtcttacgcctgaatatatggagtccgtcagttcaaaggtgtggaaagtgtatacggatcacggtgtatttgctctgaaaaaattggcggcttcaagaaacacccgcttcacggaacagatgatcatgctggaggaaaaaggctacaggcagttcgttcctgtctatcgaaaccgcacaggcgaatttttaacgcaagccggagaagatgtctgctatctcatgccctggcttactcttgaaagggaggaagagcgggatcaaaaacacgaatatatgtttaaagaaatcgctcttcttcaccagcggacggaaaaagagctcggcgtgaggcgggaagaaatactcggacactatgaacggacaaaacggaaatgggaacagcaaaaacagaaatatgaagcattcatcatgaaagcggaaaacgaatggtatatgtccccgttccagcttcaggcggccatgtatttcaaagagacgatatcagctgccgactttgcgctcgcccgccttgaagattggcatgaagccatgagagaaaaagagtctgccagaatggtcttaaaccacgggcacctgtccgttcggcattttctctataacgataccggaacgggttactttacgaactttgagaaagcgggacatgcgccgcctgcaaatgatctcatcgtattttttactagaatgtttaagacgaaccccgttatgtgcacggaatgtgtaaactggttttatacgtatcacaatgtctatcctttgcgggaggaagaaatcggcttattcctcagctatatggcttacccggggcctgtattcggcgtactgaaccgctacgaacatgagaaggggctcggggaaaaagaagcctgtacaaggcttttaaaggcgtactggcaaatgaaaaacgctgagccgcttgtgatgagcattcacgagacggaagaaaacagaaaactgcaggaagaaacagagtccccatcatcatga

SEQ ID NO: 1724 - DNA, 2235 bp, Bacillus licheniformis
atgattaagaaaaggaaaatcgatatattcctggtcttcattcttgtattatctgcagcattaaacttgtacggcatctggaatagtgacacagacaacgcctactatacggcggccgttgaaagtatgacccaaagctttcataacttcttttacgcatcatttgatccggcaggctttgtaacagttgataaaccgcctgtcgcactctggattcagacactttttgcacttgtattcggcgtgcacggctggagcgtcgttctccctgaagccattgcggaagtgatttccgtagcactcttgtactttattgtaaaacctacttttggcaaaacggcggccagaatttcagctcttattatggcgtgtacgccgattgccgttgcggtcagccatacaaacaacgtcgacagcattctcgtcctttgcttgatgattgcaacgtggctgttgtttaaagcagtccggaaaggaaaaatcggctggctgctcggcgcattctgtatgatcggtgtcggttttaacgtcaaaatgctgcaagcttacatggtattaccggcattcctgctgttttacatgattggagccaaaacgacgattcgcaaaaaagttgtgtctcttatcacagccgtgatcgttctggcaggtgtttccgtttcctgggcggttgtcgtcgacagccagcccgagatttcgcgcccttatatcggaagcagccagaccaactctgtccttgagctggcgtttggctataacggcatccagcgtctcacaggtcaaaacggtgcaggcgggggcggaacctcctcatctgatcatgatcaaaagaatcagcagcaaagcggcgatattgaaaacaactcagactcggcaaatggacaaatggctccgccgagcggaggcgaaatgccttcgggcggaccggatggccggcagggtgatgtccaaagcggcggcggaggtcccggtggcggcacaggcggcatgtttggcactggaaccccgggtcctctcagactattccaatctgagctttcaggacaggctagctggctgatcccgtttgtcctcttcggcatcatcggtttgctgatcgcgggtcttcgcagacaaagaaaattcaatgaaacaacgactgaaacaattttctggatgatgtggcttctgccggtcgctgcattcttcagcatcgcaggattcttccatcattactatctgattatgctggcagctccaatcgccgctttgtcaggtgcaggctggacggcgctcgttcgcctctatcaggaagaaagcggctggaaaaaacggctgctgccaatcggcattttgctgacaaccgcatttgaattgtatattttgagtccttatctcagcgaaatcggcttcatctggagcatattgatcggcgctttcggcattgtcacaagctgtcttctcatctttctcaagaaaggaaagtcattcagctactatgtatcacttgcagcgctgcttggcatgctgatcgggcctttctattggacaacggcgacgcttgctgacggtgtaaacggcatgattccacaggccggacctaaatccgcacaatcatttgccggcggtggcggaggaggtaagatgcagaataacgacggcagcggacctcccggatttggcagccaagacggccaaacagacagtaatcaaaacaacaataatggccctggcttcggtccaggttcaaacagccaaaacagcaacgattcttcagctgataccggttccggccaaaacagccaaaatcagaatgacgaaggcgcaagcggccgtcaacaaggcagaccaagcggcggcggcagccctggaagcggcgagtcggtcgatgaagaactgttgagctaccttgaaaagaacaacaccggtgaaaaatatttatttgcagtctcaagtgcaacttctgctcaatcttacatcatcaaaacgggcaaagctgtgatggcgatgggcggattctcaggaagcgacccgattttgacggttgaaaaacttgagaagctcgtcaaaaacggcgaagtcaagtacttcatgatcggcgacggccgaggccgggacaattcagaaatcaccaactggattaaagaaaacggcacagaaatttcaaaaagcgaatacagcagctcttcttctgatgattcacagtcaggcggacctggcggaaatcaaacgctttataaagtggagctggattga

SEQ ID NO: 1725 - DNA, 734 bp, Bacillus licheniformis
atgaatgaaacgattgaaccattaaatccgatgctttttcaactggggccgatcgctgtccattggtacggtattatcatcggccttggcgctttgctcggtttgtggctggcagtcagggaaggcgaacggaggggactgcataaagacacctttgtcgatttggtgctttttgcgattccgattgccattttatgtgcaagagcatattatgtcatttttcaatggggttattacagtgaacatcctgaccagattattcaaatatggaacggcggccttgcgattcatggcggactgatcggcgccgtgctgacgggaatcatttatgcgaaagtcaaggggctttcgttttggaagctggctgatatcgctgctccaagcattctgcttggtcaggcgatcggacgctggggaaactttatgaaccaggaagcgcacggtgaggcggtctcaagagcgtttttagaaaacctccacctgcctgattttatcatcaatcaaatgtatattgacggacaatactaccagcctacctttttgtatgaatcgctgtggagctttacgggagtcgttgttctgcttcttttaagaaaagcgaatttaaagagaggcgaactgttcttaatctacgttatttggtattcgatgggacgctactttatcgaaggccttagaacggacagtctgatgctgacggagaatcttcgcatcgcacaggtaaatcgggtcgt

SEQ ID NO: 1726 - DNA, 861 bp, Bacillus licheniformis
acaggtaatacagcggggggcgaagggggatgatgtgattgaactgcaggcaagacttcaatacaatggctattacgatggcagaattgacggagtatacgggtgggcgacatactgggccgtccgcaatttccaaaatcagttcggcttaagggatacagacggcctggtcgggccgaaaacaaaacgattattaatcaatcatactaaatattacagcgactacgtgcacagacagcttcgaaaaggaaaccaatttacacattacggcgggctgccgctgaagtatcagacgaagccttcaaaagaagtgcagcagcaggcgagaaaaaaggcggaagcaagacagcggcagggcgcacaacagcagggtaccgcccaaaaacagccgcagcaaaagcagcaggccgctcctgcacagccgaaaaaacaagcacagccaaaggctgcacctaaacaagccgcgcctaaaaaacaggatgccgttgcagccaatatgccgggcggattctcgaacaacgacattaatctgttggcccaagcggtttacggtgaagcgcgcggagaaccgtatgacggccaggttgccgttgcagctgttatattaaacaggctcgatagccctacgttcccgaatacggtggcgggcgttatctttgaaccgcttgcatttacagctgtcgcggacggacagatttatatgacgccggatgaaacggcgaaaaaagccgttcttgacgccatcaacggctgggatccatcagaaaatgccacttactattttaaccctgacacggccactagctcatggatttggggcagacctcaaattaaaaggatcggtaaacacattttctgtga

SEQ ID NO: 1727 - DNA, 831 bp, Bacillus licheniformis
tgaatgccattacatacacaaggacatcatcgacctctcaggaggacaggctcaaaatagcaaaaaaacttgcagaaatgatcaaaatcgatacagataaaataacggagcgcgataaaaaggactactggattttaacgcgcccgaaagaagccgagaagctcatcaccgatgaggaccggaaaaaagtcaaggacggcaagctgaaggaagacgatttataccagctgcagcttgacaggatcacggaagataaactgaatgaattgacagatcaagatttgaaagtcttggcaatcaagcgtcagatggattctggatacgcgctgactccgcagtatattaaaaacaaaggtgtaactgcaaaagaaatggcggttgtcagcgaacacctggacgagctcccgggagtcgatgtgacgtctgattggaagcgggattatccttataacggtctgctcagaacgatgatcggcagcatatccgattcaaatgaagggcttccgaaaagcctgcttgatcattatttgtcgctcggctacaaccggaatgaccgcgtcggaaaaagctacctcgaagccgaatatgaaaatgtgcttcagggacagaaagagaaagtgaaaaatattaccaataaatcaggggatatcgtcgatacggaagtcatttccgaggggaaaagcggaaaggatttagtcttgacgattgatgttgatatgcaaaaagcgattgaaaaaattgtcgaggatgaactgaagtctgccaaagccaagcatagcgctccgcttctcgaccgcgcattcgtcgttatgatggatccgcgaaacgggg

SEQ ID NO: 1728 - DNA, 819 bp, Bacillus licheniformis
gaataagcgaatttatttatcaccgccgcacatgagcggagacgaggagcgctatgtagccgaagcgtttcggacaaactggatcgcgcccctcggtccccttgtcgacacatttgaagaaaagcttgccgcctatgcggggacgtccggagccgcggcagtcagctcaggaacagctgcgatccacctggccttgaaattgctcggcgtcggcaaaggcgatacggtcttctgctcttcttttacgtttgtagcgagcgccaatccgatcatatatgagcaggctgaaccggttttcattgattctgaacgggatacatggaacatgtcgcccgaggcgcttgaacgggcgcttgacgaagcggagcgggccaggaatctcccgaaagccgtcatcgtcgtcaacttgtacggccaaagcgcgaaaatggacgagattatggccatttgcgatcgatttgccgtgcctgtcattgaagatgcagccgaatcgctcggttctgtttataaaggcagaaaaagcgggaccttcggacgcttcggcatttattcgttcaacggtaacaaaatcatcaccacatcgggcggaggaatgctggtcagcgatgatgaagacgcgttgaagaaggcgcgctttttagccactcaggcgcgcgagccagccattcattatcagcacgaaaaagcgggctacaattaccggatgagcaatgttctggccggaatcggcatcgcacagctcgccgttctggatgaccgggtacatgccagacgggcggttttcgagcgctataaggaggcgctttccggtatcgaagg

SEQ ID NO: 1729 - DNA, 888 bp, Bacillus licheniformis
aaataaacggttgatgcttttactcctttgtatcatcattttagtggcaatgattggattttcgttaaagaatgaccggaatgcaacttggcccgaaaaatttattggcgatacaactggtgtattccagacgatttttcatacgcccgctcaattttttgcgggcttctttgaaaatatcgaagacttaaaaaatacgtacagcgaaaatgagcgcctgcggaaaaagctcgacggccagacacaatacgaggcaaagctgcaggagcttgaaaatgaaaataagtctttaagaaaagagctcggccatctgaaatcaattaaagactacacgccgattctggcgaccgttatcgccagaaatcccgataagtatgagtggtggaacctgattacgatcaacaaaggttcaaagcacggcgttgagaaggatatggcggtaacagatgaaaacggcaacttgatcggaaaaatcaaaagcacaaaagtgaacaatttcacttccaccgtccagcttttaagcgcaacagacagaaacaacagaatctccacagttatcgctgcagataaaggcaagaaaacggtgaacggaatcatcaacggctacgactcagataaaaaggcgctttccatggaaatcatcgagcctgatgaagacagggaagtgaaaaaaggtgacctcgtcgaaacttccggtgcgggcggcgtttttcctaaaggcctgacaatcggaaaagtgacagaggttgaaccagattcctacggtttgacgaaaatcgcttatgtagagccggcagccgatatgtataaccttgataacgtcatcgtcgtcgacagaacgcttgatacggtggatgtcgacaagatggacgatgaggaggaagggtc

SEQ ID NO: 1730 - DNA, 1108 bp, Bacillus licheniformis
atgaaaattgcgatatttacggacacgttcacaccagatgtgaacggctgcgccagaacgctgaaaaggtatacggattatcttgaaaaaaacgggatgccctataaagtatttgcgccggaaagcacgcatgaaacacaattttcgagccgcatccgccgttttacgagcatgccgttcttcttataccccgagtgcagaatcgctcttcctaatctcatcaaaatgaaatcagaactccgcgaattccatcccgatctcattcacatcgcgactccttttaatatcggcctggcggggctcaagcttgcgaagaaatggaacatccccgtcgtaggctcttaccataccgattttgaccagtacctttcatattatgatcttcaaatgttttccaaactcttatggaaatatatgctctggtttcataaagattttcgaaaagtttttgtgccttcgcgcgaaacatttatgcagcttaaagccaaacaattcaggaacctctccatctggaagcgcggcgtggactgctcgcagttcagtccggcgcatcaaaccgaacacatccgcaggcgatacggcataaaggaaacctatatcctcagctatgtcggaaggcttgcacctgaaaaagacttggagacgctgctcaagatcgcaagtcaccccgctttgaaagatgacgtccactggctgatcgccggagacggcccgttaaaaaaagagcttgagaagcgagctcccctcaacatgacttttgccggctatgtcaaaggagaagagctggcaagcatctatgcgagctcagatttgttcgtctttccttctccgacggaaaccttcggaaattccgcccttgaagcgctcgcctgcgggacgcctgttatcggggcagactccggcggcctgaaagattttatacagaacggaagaaacggttttctttccgaacctagaaatccggaagcattcaccgcaaatatattgcgcgtcctctccaacccatcgttaaaaaaacggatggcatacgaagcgagaagctatgcccttacccagtcgtgggacgtgatctttgacaatctcctctccgaatgtgaaagcgtgcttg

SEQ ID NO: 1731 - DNA, 1118 bp, Bacillus licheniformis
atgaatatacgttctttattggttatggtttactcggccggtctcgctttgaccggttttattttcagattggtaaaagcgcgcgacagagctgtattgcttgtttcctttccggataatgcgcgcgcgctgcttgatgagtatgtcagcagcagccggccgtttgaaatggaagtcctctatacaaggcacgccgtttcccttgcagatgaatatccttccgttcgatcgcaagtgatcaacgagaaaaatccgattcatctcataaaagccgtataccgaatgttcaggtgtaaattcgtgttgacggataattattttctgctgacaagtgttttgaataaacgccctcagacgacatgcattcaaatttggcatgcgtccggcgctttgaagaagttcggactcgaagatatcggaaaccgctatcgatccgccggcgatatcaaacggtttaaaaaagtgtatcgttcatttgatcatatcgttgtcggctcggaaaaaatggcggatattttcaagcggtcattcggcttgggagatgaccgttttttgcggacgggtgttccgttaactgatgagtattttcatgccggaagacaaacagcggagcgtccggaccaaaaggttattctgtatgcgccgacatacagggactattgtttgacgtccgttcgtctccctttctctaaggagcagctctccggggaactgcagggagaatttttgctgctggtcaaactgcatccggccgtgcgggaacagattgcttttgaagagcacgaagggctgatcaaagacgtatcagacgttccgttaaaggatttgctgatggaaagcgacatcctgatttccgactactcgtcggtcgcctttgagtacgctttgttaaataaaccgattttgtttttcacgtatgatatggcagagtataatgaaaaacgcggactgatcgatgattttgaagcagtcattcccggcaaagcctgcatggacagcgaaatgctgctgaaagaaatcaaagaaatgtccgatacaaaggaagagatcaagaagtttgcggaagagtggcatcaatattcaacaggtgatgccagcatgcgcctgttgaactttat

SEQ ID NO: 1732 - DNA, 831 bp, Bacillus licheniformis
atgaaaaaaggtttattaacagctttattcatcatttttgcaggcgttttggccgcttgcggatcttccagcagcgaaggagataaagacagcaaagtcattacagtcggagcgacgccgacgcctcacgccgaaatccttgaagaagcaaaaccgcttttgaaagaaaaaggctatgagcttaaaatcaaaaatttcacggactacaaactgatcaacaaagcgctcgctacaaaagatcttgatgcgaactacttccagcacgtcccttaccttgaacaggaaatgaaagaaaacaaagattacgatctagtcaacgtcggtgcggtacaccttgagccattcggcatttactctaaaaagtataaatctttaaaagaccttcctgacggtgcaaaaattattatgagcaacaatgccgctgaacagggccgcatgcttgcaatgcttgaaaatgcgggactgatcaagctgaaatcaggcattgaaaaagtagatgcgacagtaaaagatattacagaaaacaagaaaaacctgaaaatcaaaaatgatgtggcgcctgaaatgacggcaaaagcatacgaagctaatgaagcagacgcagtgttcatcaatgtgaactatgcgatccaaaacaagctgaatccgaaaactgattcaatcgaacttgagtctccaaaagacaatccttacgctaacatcatcgccgtccgcaaaggcgacgaagattctgacaaagtaaaagctctgatggaagtattgcgctctgacgacatcaaaaagttcatcgacaaaaaatataaaggctctgtcatttctgtatctgagtaa

SEQ ID NO: 1733 - DNA, 712 bp, Bacillus licheniformis
atgaagaaaaaaataaaatggctcgggtttttactcggctttgtcgttttattatgtttatttcaatatcaattcaacaatgatgattcttggcggtcatggaatcttccgctgagcggcaaaatcatttatattgatcctggacacgggggcgccgatggaggggcatcaagcggtgaactccttgaaaaagacgtggctcttgaagtatccctaagaatcagggactatctccaggagcagggcgccttggtgatgctgacgcgggaggacgatcatgatctcgctcctgaagaaacgaggggactcagcagaagaaaagctgaagacctgcggaagagggtcgatatgatcaacaattctgaagccgatctttacctcagcatccatttgaatgcgattccttccgcgcgatggagcggtgcgcaaagcttctattacgggcaatatgaagagaatgaacgggccgccaagtttattcaggatgaattaagacataatcttgaaaacacgacgcggaaggcaaagcggatacacggaatttatttgatgcaaaatgttaaaaagcccggggcccttgtcgaaatcgggtttttgtctaacccggaagaggcaaaacagctggccaagcccaaatatcaggacaaaatcgcagcatccgtttataaaggcgtattgcgctactttacagaagacagagaccctcctgaat

SEQ ID NO: 1734 - DNA, 757 bp, Bacillus licheniformis
atgacgaggcaaaaacctttaatctctgtcattacgccttcctataacgcggaggaatttatcgaaaaaaccattaagtccgtcttaaatcagacgttttccgactgggaaatgatcattgccgatgattgctcaacagatgggacaagagacattttgaagcgctatgaagaagatgatgagcggatccatgccatttttctgaaagagaatcaaggtgctgcagcggcgcgaaatgcggcgctcagcaaagccgaagggcgctatgtcgcctttttggacagcgatgatgtttggaaagcagaaaagctggataagcagctcgccttcatgagaaagcatcagcatgctttctcatttacggcatacgagctgatcagccaagacggcgaaccgcttcataaaaccattcatgcacccgtaagccttacatatgatgatgtattaaaaaatacgatcatcggctgcttgacggtgatgattgacagagaacaaacgggtgatatccggatgccgaatattagaacccgccaggatttggcgacatggctgtccgtattaaagcgggggttcaaggcatatggactgaacgaacccctcgcggaataccgcatcgttgaaacatcgatctccagaaacaagtggaaggcggcgcgaaaaacctggtacgtatacagggaaatcgaacgacttcacttgatgaaagcgacatggtgctttttccattacgctaagaacgcagtaatgaaaagattat

SEQ ID NO: 1735 - DNA, 630 bp, Bacillus licheniformis
taggcaaagtctcgaggtagagaataaaggaaacaaaaacgtttcaaaggaacaggatcatttccctttcttcaatccataaaggacagacggaattttggagtctgagcaagcaaaaagccgcagaaaagatcgagcagaataaactgatcaaaaaagccgaaatttctaaacaactgcccaacaaaatcgccatctccatcgaagagtataaaagcattgcgtttttgcaaaaacataatgtgtactactccgtgcttgaaaacggcacggtgcttcctgaagaggtgacgccgactgacatcggaccaacccttaataactgggaggaagacgaaaagctcgttcaaatggcaaaacagctgaacaagctttccgattccgtgaaaaaatcgatttccgagatcaactatacgcctcaaaaatcaaacccttggctgatcaaactgtatatgaacgacggctatatcgtgacagcttcgctgaaaacgttcggacagaaaatgaacagctatccggcgatcgtaaaagagctgccgaaaggggaaaaaggcattatccatatggaagtcgcgacttattttgaacctctgaaaaaaacggatgaaagcaaaaagggagacggaaatt

SEQ ID NO: 1736 - DNA, 681 bp, Bacillus licheniformis
tatgacaccttatttcggtatcgtcgtttcactggccgcatttggcaccggcacttttttatttaaaaaatcaaatggttttttcttattcacgcctctgtttgtcgcgatgattcttgggatcgcgtttttaaaaatcggcggtttttcatatgaggactacaagagcggcggagacatcattaagttctttttggagcccgccacaattgcgttcgccattcctttatataaacaggcggacaagttgaaaaagtattggctgcaaatccttggtgccattattgcaggctccgtctgctcggttgccgtcgtctatctgatcgcaaacgcgctccatcttgacggagccgtcatgaaaagcatgctgccccaggccgccacaacggcgattgctcttcctttatcaaaagggatcggcgggattcaagatattacggccttcgccgtcatctttaacgcagtgatcgtctatgcgctcggcgcgctttttttgaaaatcttcaaagtgcagcatccgatcgccaaagggttggcgctcggaacatcaggacatgccctcggcgtcgccgtcggaattgagatgggggaagtcgaagcggcaatggcgagtattgcagttgtcgtcgtcggcgtcgtgaccgtgtttgtcgttccgttatgtgttcaaatgatcggcgg

SEQ ID NO: 1737 - DNA, 873 bp, Bacillus licheniformis
gcatcggtatccttcttttatttttcgcgtttagaaaaatatttacgaagtacttattcaacctgatactgaaattgacgaataagacgaaaacggactttttcaatcaggtggtgctggcgtttgaaaagccggccaggtggttttttgcgatactcggtatttatctggcgattatttattccccgttttttgaggggcatatggggatcgttcataaactgtacagagtgtccgtgattttggtcattgtaagcggcctgtataacttaacggcggcttcgtctgttttattcgataaaatcaataagcggcttgagcttgatatggatgatattcttgcgccgtttttgtccaagattctccgatttatcattgtagcgcttggaatcagcgtcatcgccggagagttcaattatgatgtcaacggatttgttgccggactcgggctcggcggattcgcttttgcccttgcggcaaaagacacagtcggaaactttttcggcggagttgtcattattatggagaagccttttacaatcggcgattggattgaaacgaaaattgtcacaggaactgttgaagatatatcgttcagaagcacgaaagtccgcacggccggagaggctctcgttaccgttcccaactctgtgctggccaacgaagcgatcatgaactggacgaaaatgcgaaagcgtcaggtcacctttacgctcgaaatcgatccgtcaaccccgcgggagaaagtcgagcggtgtgtggagcgttttaaagaaatgctcgaatcgcacgaaggggtcaacccggatgtcattatggtcaatttcgatgtcctgaaggatacgcatttaagcatcttcttcaactactata

SEQ ID NO: 1738 - DNA, 1027 bp, Bacillus licheniformis
ttggaaaatccagcagttagtctactggtcgctgtttataatacagaagcttttttgccgaattgtttgcagtcgctgatcagccagaccttgaaaaatattgaaatcattatcgtcaatgacggttcaacagacggaagccagaagatcattgatcattacgcccgaaaggacgggcgcattaaaacgattcagcaggacaatcagggcctcggcgctgtccgcaataaaggcatcgaagcggcgtcaggcgagtacttggcattcatcgactccgacgactggattgagccggactattgccagtctatgtatgaaaaagcgaaggatgaggatgccgatcttgtcatctgtgattatgccgttgaaattcaggataccgaaaaaacggtctgcccggacatcgggaagaactatgaaggaaagccgaaagaggcatttatgaaggatttgttaaagggtaaagtaagcggcttttcctggaacaagctctacaggcggagtctgattgagcggcataagctcgttttcccgctccgcgacgagctggaaaacatcgaagatcaatatttcagcttcagatgccttctatatgcgaataccgcggcgttcgtgactaagccgctttatcattacagggtccacctggcgtccatcgtccaaaagtatcaggcagggctgtttgaagacggtctcgctctttatgaagcaaacctggactgcctgacaaagcacggagagctcccggctttaaaggaggcgctgcacgtctttatcgtcaaccacggctgcatcagtattttaaatgaatgcaagagccgaaacaaaaacccttcaatagaaaaatataaaaatatccgcagcatatgcgcctgtccggaattcagggggaaaatctccgcagtggacatgtcggcattcgattccaagaagaagcttttgcttatgctgattcgcttgcggttgatgccggcagtgtatggatttgcggccatttaccagaaaatgatcgagcacagaatgaaga

SEQ ID NO: 1739 - DNA, 1982 bp, Bacillus licheniformis
  misc_feature (1)...(1982): n = A,T,C or G
atgaattatttagaggagaaaatcggcagtgattataatgtgttaattaaagttcacccgtttttatatagtgaggcttctaaagtttcagagttaaaagggaaactgatacctgactttattgatactaaccagttgttaagtactgtcgacatattaataactgactattccagcatattttttgattttcttgtcactgatcggccgattttgttttatatgtgggatgccgatgactacaataaacaacgaggaaaatatattaacaatgaagatcttccaggtcctgtcctatacaatgtaagggaattagtcgaagcaattggcaatattcatcaagtgaaatcagaatttcaaacaaattatgaaaagaataaagtgaaatttacgaatcacgacgacggaaatgttacgaaaagagtagttgagaaaatcttcaaaaacaagggacaattgaatgtaattagagatctggataaaaagaaagaaaagatcttgatctatccaggaggaatgaaaaataacggcattacatcttctttccttaatttaatgaataatattgactttgataaatatgatgtaagctgttttatgaaaactccccactcaagagaggttctaaacaatatcaacaaagtgaataaaaatgttaggttcatatttaagcctggtttaccagtttacacgttgtttgatgtatataaagataagctggtgcacaataggggagctaacggtaaacttgaaaagaagttgtacccagaggatgcatatttaagagaacataaaaggctttttggaaaatctaaatttgattatgtaattgatttcagcgggtacagcttatactgggccaagtatttagtttgtgcagatgcaaaaaagaagatttgctatatgcacaatgacctcttgtcagatagtgaaagattggttaatgggcgtcgtccgcacaaaattaatctgagaggattattctctatttacaataaattcgataagctagtaagtgtttcaaagggaacgatggagttaaataaaaagaatcttgctatatatgctgatgaggacaaatttgactatataatgaactctattaatcctgaaaaaattctcgggatcgatcattttaaagaaaaggatactgagaaattagcaatcgctgaacagaaccatgaagaaatcatagccaataaaagttttaaagcaagggcaaagattgtaaatgtcgaaggcttcttcattatcaattcactgtttgataaagtgaatcaaaaattaacaccggctaaggaatttgaaaataaagaagtcaccataatacgagaagctcatacgaatgatggaaaagttttttataaatttactatagatgacagtattattgggtggctgaacctagaggcttttgagttattgccagacagcattttacttgagaggaaagtcaataaactggcagtcattcaacaccctaatggaaacgacatctggaataaaccttataaaactttagatgtacaaaaagtatcttccagcaaacaatataaagggattatcgttgaggtagataaagaagtcagaactcaacattctttctacagcagaatatatattaatgatatattaatagggtggattgataattcagcattgaaaattgtaaaagagtatcagtcacatccagaggatacagaaaagcaatctgcgataaagaatgaaaaagccaaaattaagcgcaaaaattataaaaaacactcaaagattattcaggggctggagaacagaacattagaagaaataaagatgaatttattcgcgactattacaaatggcgaaaattatacaatctggaccaaagcctatcctaataacgggtgtaaagaaatatcaactgctgaagaatttaacgataccattgtcattgtcaaaaaaagccataagacanaagaaagggaatactaccggttctatgc

SEQ ID NO: 1740 - DNA, 804 bp, Bacillus licheniformis
aatacgtgacgattgcttcattgctgagtgcagcggtcctgcttggcacaggatgtaccatgaccgaacagaagcaaaatgacacggctaaaacacagaatactgcaaatgcaagcaaggatgcaaaagaccaaaagtcagacagcagcctggaagatcaggacttcatactcgagagcaagtactttaatcaaataaaagatgtagacgggctgccgacgattcaaaatccggaaaacataatggcgcttgtaaataaagaatacgcgcttcccggcaactatgcaccgagcgacctgacagtgcctgatgtcgcgttttcttttaccgaggatatcgacaagcgttatatcagaaaagaagccgccaaagcgcttgaagagatgttcagcgccgctaagaaagaaggctatgaactcgttgcagtgtccggctacagatcctatgacagacaaaaagcgatctataacaacgaagtcagccaaaagggagaagaaaaggcgaaagaagctgtggcatatccgggccaaagcgagcatcagacaggacttgcgatggatatttccagcaaaagcaacggcttcgccttatcagaggaattcggcaatacgaaagacggacaatgggtcgagaagaacgcctacaaatacggctatatcatccgctatccgaaaaataaagaagacatcacgaaatataagtatgaaccttggcacctgcgctatgtaggaaaaaaagcggctaaagccatccaagaacacgacttgacgcttgaagagtattttaaacaggtgaaaaagatat

SEQ ID NO: 1741 - DNA, 621 bp, Bacillus licheniformis
gatcggtcagatcgtgattgctctcgtattctatgccgtctaccacttccaaggaatgccgactgacatccgcattccgggaacagagctgtcgtttgacttcggctggatttatccagtgctcgtcatctttatgcttgtcggcggttcaaatgccgtcaacctgactgacgggcttgacggtctgttgtcgggtacagctgccatcgcgttcggtgcgtttgcgattttggcgtggaaccagtcgcaatacgatgtcgcaattttcgcggttgccgttgtcggagcggtgttaggatttcttgtgtttaacgcgcaccccgcgaaagtctttatgggagatacagggtcgcttgccctcggcggcgcgattgtgacgatcgcgattttaacgaaactggaaatcctgcttgttatcatcggcggtgtattcgtcattgaaacgctgtccgtcattttgcaggtcatttcatttaaaacgaccggcaaacgaattttcaaaatgagccctcttcaccatcactacgagcttgtcggatggtctgagtggagagttgtcgtcactttttggacagcggggcttctgcttgccgtcttaggaatttacatcgaggtgtggtt

SEQ ID NO: 1742 - DNA, 879 bp, Bacillus licheniformis
tttatacgacagccgtctcagtcgccaatgtctggaccagtccggaagcgccgcgcacaattgaccggatgatgctgtcaaaccctgtacatgtgagaagctggcttgacgaattgtcctacgaggagcgccttgagctatgtacggcaaaccttgttcaaacgcaagtgcttttcggcgaagatgtccaacttataaaggagcggggagactgggcgttcgtcatcattccgggacagccgtctgcaaaagacaaacgcggctacccgggctggattccaaaggactgcctggtcgaaaaaagcccggcgaagtctgagacaagcgccgttattcaaaaaccgacggctttcttatatgatgacaagaaaacgaaagttattgagctgagctttctcaccaagctgcccgtcttgtcttccggcggcgtctggtttgaggtcgatacaccgcttggccgcaaatggctgaaaaaagaagatgcggatctcgaaacacctgtaaaaggcagcggagacgatatcgttcaaaccggtcaggcgtttttgaacctgccctatctttggggagggatgagcgggtttggctacgactgctcaggatttgtcttcaatatgctgaaggcgaacggccgctccgcgccgcgcgatgccggcgaccaggcgaaaggcggaaaagaggtatccttcagcagcccgaagcggggcgatttactgtttttcgcatatgaagaaggcagaggacgggttcaccacgtcggcatttactgcggaaacggagagatgcttcactctccaaaaacgggcaaatcgatcgaggtcatatctcttaaaggtacaatttatgaaaaagagctgtgtgccatcaggcgctattttt

SEQ ID NO: 1743 - DNA, 993 bp, Bacillus licheniformis
atggcaatgacatccgtactcgtaacaggaggagccggatacatcggcagccacaccgtactcgaattgacaaagcaaaaccgctccgtcgtcgtgcttgacaatttatctaccggacacagggaagccgtcagcggggtcagcttttacgaaggcgatatcgctgatgcggcacttgtcaaagccatcatcaaacatcatgatgtcgatgctgtcatccatttcgccgccaaaagccttgtgtccgaatcgatcgaaaagcctgagatatactttagggaaaacacgctaaagtcttgtgcatttttcgaaacggccatcaaggaaggcgtcaataacatcgtcttttcgtcaaccgccgccgtatacggcatcccggagaaagccccgattaaagaggctgctcccctctcccctgtcaatccttacggggaatcgaagctgatgatcgaaaaatatctgcactgggtcggaaaaacgcacggtgtcaaatgggccgccctccgctacttcaacgccgccggcgccgctttaaacggagcgatcggcgaggaccacgatcccgaaagccacctcattcccctcgtcctgcagacggctttgggacagcgaaagcagctgtccattttcggagaagattattcgacgccagacggaacctgcatcagggattatattcacgtcctcgatctggcttccgcccacctggctgcccttgatggattatatgaagacagactgaagcaaaatgtttataatgtagggacaggggccggacattccgtaaaagaaatcattgaaaccgcggaaaacatgacagagcgaagcattgcagcaaaaacggacgagcgcagagcgggagatccgccagtgctggtggcggacagccggacactggtggaagataccggatggaagccgcaatacagcgatttgcaaaccatcattcaaagcgcatggcaatggcacaaagcgcatccggacggtttttga

SEQ ID NO: 1744 - DNA, 1281 bp, Bacillus licheniformis
caaacaggaaattcataacgaaacgatagcggtcatcggcttggggtttgtcggtctgcccttggccatgttgttgatatcaaaaggaatgcgggttatcggtgttgatttggacaaaaagaaagtcgaggcattgcggaaaggaaccagctatatttcggatataaacgatcaagcggtgcaggacggaataggcaccggtttctttcgtcctgtttcggactacagtttaatcggtgaagcggatgccgtcatcatctgcgtgccgacgcctttgaatgatgatgcgggtcctgatttgaattatgtgaaaagagcggcgcaattgattggagcgcacttgaaaaaagggcagctcgtcgtgttggaaagctcgacatatccgggtacgacaagagacatcgtcaaaccgatcctggaaaaaagcggccttgtatgcgggaaggatttttacttggcttattctccagaacgcgttgatccgggcaatcagttcccgattgaggtcgtgccgaaggtagtgggaggagcgacggatgcatgccttgaaaaggtgcatcaattatacagcggcatttatgaagaggttgtgcctgttacatcgccagaaacagcggagctgacaaagctgctcgaaaatacgtaccggtttattaatatttcattcattaatgaattcgcgatgatatgcgacaggctcggggtgaatgtgtgggaagtcatcgaggcggcaagcacgaagccgtatgggtttgcggctttttatccaggccccggcatcggcggccattgcatccccgtcgacccgctgtatttgcagtttgtcatgaaacaaagcggattatcgagcgactttatcgagctgtcggaagcgacaaatgatagaatcgtccgctatatttcagagcgctccttgcagctggcagggaaagacaaggcgacagacgcccgcatcttaatctacggcgtcacctataaacgaaatatcgcggatgtccgcgaatcaaaatcgcttgatattatagagaagctgatcggcatgggagcagatgtttcctaccatgatccgcacgttccggacctcgacctcagcggcaaaaagctagcaagcgtgccgatagattcaaagatgctgaaagagtatgactgtgttgtcattttaactgatcatgacgcactcccgaaagagctgttattaaaccatgcaaacgtgatatttgatacgagaggagtgctgagggaagcagccggaaaagcaaaagtcatccagctcggaaacgg

SEQ ID NO: 1745 - DNA, 696 bp, Bacillus licheniformis
ggactacggggaagacggtttgaaggatacgctcaataaattttcaaatgagaatctggagcttgtcggagcaggaaataatcttgaagacgcgaaacagcacgtatcctatcagaatgtgaacggcgtaaaaattgcaacgctcggttttacagacgtctacacaaagaactttacagccaaaaagaacagaggcggagtgctgccgctcagtccgaaaatctttattccaatgattgcggaagcatcgaaaaaagcggatcttgtccttgtccatgtgcactggggacaagaatatgacaatgaaccgaacgacagacagaaggatctggccaaggcgattgcagatgccggagcagatgtcatcatcggcgctcatccccatgttctcgaaccgatcgaagtgtataacggtactgtgattttctacagcctcggcaactttgtatttgatcagggctggtcaagaacacgggacagcgcgcttgtacaataccatttaatgaatgacggcaaagggcgctttgaggtaacgcctctcaacattcgcgaagcaacgccgacgcctttaggcaagagcgacttcttaaaacgaaaagcgatcttccgtcaattgacaaaaggaacaaacctcgactggaaagaagagaacggaaaattaacgtttgaagtcgatcatgcggacaagctgaaaaa

SEQ ID NO: 1746 - DNA, 759 bp, Bacillus licheniformis
gttagaagcggggccttcgacatcctcagcgatcgtcaaacgcacgggaaaaggcgagtcttacccgatcgtctctacaaaaggagactggtatgaaatcaaactgtcaaacggcgattccgcttatgtcgcaagctgggtcgttcagactgttgaccaggcaggctcagccggagattcgaaaagcgcagcaccgcctttggcaaagcggtcaagctcgggaggcacaatcaaaaataaaacggttgtcatcgatgccggacatggaggacatgacagcgggacaatcggaacgcgggggacgctcgaaaaacggctgaccatcaaaacggcaacgcttcttgccgcgaaactgagagccgatggcgtcaacgtctatatgacgcggaatgacgattctttcgtcagccttcagtcgcgggtcgcgacctctcattaccgaaacgccgacgcttttatcagcattcattatgatagctttccaaatgcgtccgtcaggggaaatacggcctattactacagcccgtccaaagaccggaagctcgcagcagacgtgcagtccgagatcgaaaggcactcgcctctgccaagccgcggcgtactattcggggactacttcgtattaagagaaaataaacagcccgccgcattgtttgaactcggctacttgagccatcctcaagaagaagcggtagtcagcacgaacgcttacagagaaagagtgacagacggcatcagaagcggtctagaaaactattt

SEQ ID NO: 1747 - DNA, 518 bp, Bacillus licheniformis
atgagcttaaaaccattctatagaaagacatgggccgaaatcgatttaacggctttaaaagaaaacgtccgcaatatgaagcggcacatcggcgagcatgtccgcctgatggccgtcgttaaagcgaatgcctacggacacggggatgcacaggtagcgaaggcggctcttgcagaaggggcgtccattcttgctgtggctttattggatgaagcgctttcgctgagggcgcaggggattgaagaaccgattcttgtcctcggtgcagtgccgaccgaatatgcaagcattgccgcggaaaagcgcattatcgtgactggctactccgtcggctggctgaaagacgtgctcggttttctgaatgaggccgaagctcctcttgaatatcatttgaagatcgacacgggcatgggccgccttggctgctaaacggaagaagagatcaaagaaatgatggagatgaccgaatcgaacgataagctcaattgtacgggcgtgttcactcatttcgccacggc

SEQ ID NO: 1748 - DNA, 653 bp, Bacillus licheniformis
atggataaggtgatacaagaattaaaagaacttgaagtcggcaaagttctggaaaacgagccgctcagcaaccatacaacgattaaaatcggaggaccggctgacgtgctggtgattccgaaagacattcaagctgtcaaagatacgatgaaggttgtcaagaagcacggcgtcaagtggacggccatcggcagaggctcgaatcttctcgttctcgatgaagggataagaggcgtcgtcatcaagctcggccagggactcgaccatatggaaatcgacggcgagcaagtgacggtcggcggcggctactctgtcgtaaggcttgcgacaggcatcagcaaaaaagggctttccggccttgaatttgccgcaggcattcctggttcggtcggcggagcggtttacatgaatgccggcgcccacggctcagatatcagcaaagtattggtgaaagcattgatcctttttgaagacggaacgatcgaatggctgacgaatgaagagatggcgttcagctaccgcacatccatccttcaaaacaagcggccgggcatttgtcttgaagccgttctccaatggagcaaaaagaacgcgatcagatcgtcgcgcagatgcagaaaaacaaagactaccgaaaagaaacgcagcctgtg

SEQ ID NO: 1749 - DNA, 1082 bp, Bacillus licheniformis
atgatcccgttagtcaatttaaaacgtcaatttcaaacagtaaaacaggatattttaaaagagtttgaacatgtgctggacagcggccaatatatattggggccaaaggttgaagaattagagaaaagaatagctgaaaagcttggtgtaaaagaagcggtcgcggtcgccaacggaacggatgcattggtgctgacgcttgaagctttcggcatcggcaaaggggatgaagtgattacgaccccgttcacttttttcgccaccgccgaagccgtctcaagggtgggggctgaacctgtgtttgctgatgtcgatcctgaaacatacaatcttgatccgaaaaaaatagaagaaaagatcacccctgctactaaagcgatcattcccgtccatatcttcggacagccggctgatatggacgagatcatggagcttgccaaaaaacacggactgcttgtgattgaggatgcctgccaagcgttcggcgcatcgtataaagagcggcctgtcggcagcatcggggatgccgcctgtttttcatttttccctacaaaaaacttgggaacattgggagacgggggaatggtgacgatttcagacccggatgcagcccggcaattaagaacactcagaacccatggcactagcaaaaaatacttccatgacaaaatcggtttcaacagccgtcttgatgaattacacgccgcagctttactcattcttcttgagaaaatcgacggctggaatgaacaaagaagaagagtggccagccgctacagagaaggtttgaaaacggcggagcacctcacactgccggcagagaaagaggaccgcacacatatctatcatctctattgtatcggcgcgaaaaaccgcgactacatcatacaatcgctgaaagagcaggacattcattcaggtgtgtattatccttgctgccttcatctgcaatcggtctattcttcactgcagtacaaaaaaggcgattttcctatagccgagtccttgtccgaaacccttttcgccattccgatggatccttttctagccgccgaggaacaagatcagattatttctgcgct

SEQ ID NO: 1750 - DNA, 689 bp, Bacillus licheniformis
  misc_feature (1)...(689): n = A,T,C or G
atgcgcttttttctaaaacaagcggcagcagccatcatgatatgctctcttttatgctcttcatacgaaaccgctcaagcacagccctcccttcatatcagcgcaaaaagcgcgattgtcatggacgggcaatccggacgggttttgtttgcaaaggatgagcatgaaaaacggcgcattgcaagcattacgaagattatgacagccattttggccgtggaatcgggcaaattggatgagacggtcacggtcagcgacagagcggtcaggacagagggatcatcgatctatttaacaagcgggcaaaaggtgaagctgaaggaccttgtttacggtttgatgctgagatcgggaaatgatgcagccgttgcgattgccgaacatgtgggcggaagcctggaaggctttgtctacatgatgaatcaaaaagcggccgagctcggcatggaaaacaccctgttccgcaatccgcacggacttgatgaccaccctgatcactattcctcggcctatgatatggcgcttttaacaaaatatgcgatgancaatgaaacgtacaaaaaaatcgccggaacgaaacgctataaagcagaaacgatgcaaggcatctgggagaataaaaacaagcttttaacagggctttacaaatacagtacaggccgggaagacgggatatacaaggcttgcaa

SEQ ID NO: 1751 - DNA, 930 bp, Bacillus licheniformis
acaggcaaaaagggatcgacgggttacactgaaagttcaccgacccggaatgaaagaccagctgacatttacgattaagcgcgatgaaatcccgctggaaacggtgtttgcttccataaagaaagtacaggataaacctgtcggctatatcgcaatatcttccttttccgaacatacggcaaaagattttactgctgaactgaaaaagcttgagaaaaagggaataaaagggctcgttttggatgtaagaggaaatccgggcgggtacttgcaaagcgtggaagacattttaaaacattttgtgacaaaagatcatccgtatatacaaatcgccgaaagaaacggaaataaaaaacaatacttctcaaaattaaaagagaaaaaaccataccctgtgagcgtgatcacggacaagggcagcgcttcggcttcggaaattcttgcaggcgcattaaaagaagccgagggctacgacgtggttggcgatccttcctttggaaagggaaccgtccagcaggcggtgccgatgggagacggtagcaatattaagctgacgctgtacaaatggctgacacctaaaggaaattggatccataagcagggcattcagccgaccgttccagtcacgcagcctgcatatttctcggcggggcctttacagctgaaagaacccctcaagccggatatgaacaacaatgaaattaagcgggcgcagttcctgctgaaaggactcgggtttgtccccggccgggaagacggctattacaatgaaagcacaaaaaaagccgtcatggcgtttcaggcagcaaacaagctgaagcaaacagggatcattgaccaaaaaacggcaaatacaatgaacctgcggattgaggagaaaaagatggatgaaaagaacgatcttcagctgcaagccgcattaaaagtgct

SEQ ID NO: 1752 - DNA, 801 bp, Bacillus licheniformis
atgagggttatgagtcatagagcagatgagattcgaaaaagaatggccaggaaaagaaagcggaaaacaccggacaaacagcccttttcatcagacggcaaaaagcggccgctcaagccgcctgcatggacagccttttcggaagatgaaaaaggaggagacttccctccgcctgaaggaagttccctgctgataaacgggaagcacccgcttgtcaaggcggatgcgctcatcttgaaatgtcttctgtcggcatgccttgttcttgtgtccgccattgcctacaaaggccagtttgaacccgcaaaccaaatcaaaccggttatcagccaggtgtttactgaagagttccaatttgcggccctccagaattggtatgaatccaagttcggcgatcccctcgcattctttcagccgaaaggcgccaaaccgtccggccaggtcgaggtgaatcaggatctcgctgtacctgccgtaggaaaggttcaggagaaattctcagggcagggcattaaggtagaaacagaagacgaaacgatccgcagcatgaaggaaggctatgtcattgaagtggacaaaaatccggaaacaggcctgacggtggtcttgcagcatgcggacaacagctatacctactacggccagctgaaaaaagcggatgtcgctttatacgattatatagataaaggaacgaagctcggaacgattgagcaggataaaaatcaaaaaggcatctattactttgcgatcaaacaaggagaggaatttgttgatccgatacaggtgatcacatttgagtaa

SEQ ID NO: 1753 - DNA, 696 bp, Bacillus licheniformis
gcctctaggcacttcaagggtcataccatgggttgcggtttgggagccgtcagaatatgcactcgatttatttaaacaggctttacatcaacaaggcattcgaatcctgggaaagactaaaatcggcaaagcgccaaaaacagcgcaccgcatcaccacacatcaatccatgccgctgtcagagctgatgattccctttatgaagctcagcaacaacggccatggcgaaacgctgatcaaggaaatgggaagggccgcgagacgtgaaggaagctgggatcaagggctagaggtgttaaatacggaactgcagagatttggactggacacggaaaaaatcgttctcagagacggctcaggcatctcgcatatcaatttgatttctgcacatcagatcacaaagctattgtattccgttcaagacgagaaatggtttccgtcgtttgcccgttcactcccagttgcaggtgaaagcgacagaatggtcggcggcacattaagaaaccggctgaaagacccggctctaaaaggaaaagtcagggcgaaaactggctctctttcaaccgtcagttccttgtcgggctatgtcgatactgcaagcggaaagacattgattttctccattctcctcaatcagctcgtggatgatgagaaaggaaaggatattgaagacaaaatcgttcaaatattagcttc

SEQ ID NO: 1754 - DNA, 684 bp, Bacillus licheniformis
acccgaacacggtccttaaagtgaaaggaacagtttccagcggaagcaaaccatcttctggttcgtcttcaagctcttcatcaagtaaaacgaacacaggcagcagttcaaaaacgaccacttacacggttaaaccgggcgattctctgtggaaaatcgcgaattcgatgaaggtaacggtacagagcatcagagaggctaatcaattaaaaacagatgtattgcaagtcggccagaagcttaaaatttctggtgcatcgtcttcagggtcatctggcagcccatcttccagctcgccgaactcttcagtttcaaccggcacttcgacaagcgcaaaagtcgagcggatgattgcagaggcagaaaagcatatcggcgtgccttacagatggggaggcaacaatccttccggttttgactgcagcggattcatctattacacgttgaacaaagttacatctgtctcaaggctgagcgcagcaggatactggaacatcatgtcgccagtcagccagccttcaagaggtgattttgttttcttctcaacatataaagcgggcccttcacacgtcggcatttatttaggaaacaacaagtttatcaatgccaacgattccggcgtcaccgtgagcgacatgaacaattcctactggaagcagcgctatctcggcgcaaaacggtatt

SEQ ID NO: 1755 - DNA, 1527 bp, Bacillus licheniformis
atgcgcaggctccaggctgggaaagaccgttttaatgctgtcatgtacgtcggcagcaatacggttttcagaagaacggctttggaggaaatcggcggttttgcgacaggtgtgattacggaggatatggcaacagggatgcttttgcaaacaaaatttaaatctgttttcgtcaaagaagtgcttgcggtcggtctctcgccggaaacgtggatggatcttttgaaacagcgcgaccgctggtgcaggggaaacattcagtgcggaaagaagtggaatccgcttttcttaaaaggcttgacgcccatgcagcgaatcctttattttgacggcattctcttttggtttttcggcgtttttaagatggtatacatcctcgcgccgctcatgtttttgctgtttggcatacatagcttaaagactgatctgtggtcgatcacttcgttttggctgcctgcgtttttaggttcttacctttcatttaaagccgtttcggaccggcagcgcagtatgaactggagccatatttacgatacatcgatggcgccgcacatggcgatatcggccttgtcggaattcattttcaaaaagcggtttgattttaaagtcacaccgaaaggcgtcaacacagatcggcgaaaattcaaatatacaacggcgctgccgtgtgcgattttgctcgcaatgacgctgcttgcactcggaaaaaccctttatgaattgttgtttcttcatacgtttgatataaacgtcacttcgtataatttattttgggttctctataacatgacagggctcatacttgcgctgctcgttgcctttgacaggccgaggttccgaagctctgagcgtttcacagtcaacaagccggcggctttttccaccgtttcagtagatgagcacaaatgtgaactgatcgatgtgagcgacacgggcgcgcgtatcagactgccttatacggctgattcggatatgtactatcatgtagacggtctgatcatagatgcggtcggaaaagtcccggcccgggtgatgtggacgacgaaggacgaggccgacattgaaatcgggctgcacttcaaagagatggacaaggaactgtatgtgaaactgatcggttttatgtttaatgaagaaaatgcaaaaaaggccgaccgggaaaagcgggctgatacgttgtcaacagtgatacgctttttaacgaaaactgaaaaaagccctgatgcattcaagagaaaatacgtgcgcgaggcctttcaaggtctgggaacactgctgtttccccgtgattcagagaaaggggctcacgaggttatgattaaggatatcagcttgtcaggctgtcagattgaatccggcttcccgcttgaaatcaatgaacatgtgctggtttctatcaatgagaaggacccggatcagcggctggcgctcgtctgctggataaagaagcggagaaagcgatacacagcgggattgaaatttttagatgaacatgcatcaaaatcaatgggagacccggtagcataa

SEQ ID NO: 1756 - DNA, 587 bp, Bacillus licheniformis
gtgctagcgaaacggtttttcgatcttgcattgtcagttattttgctggtcgcgctcagtccggccatgattctgacggcttgtctcatcagatggaaaatcggctcgcctgttttatttcgccaaacccgtccggggctgaatggcgagccttttacattatataaattcagaacgatgactgatgaaagagatgcagcaggcaatctgctaagcgatgaaaagcggctgacaaagacggggcggctgatcagaaaaacgagccttgacgaattgccgcagctgatcaacgttatcaaaggagacctcagcctcgtcgggccgcgcccgcttttgatggagtatatccccctttatacgaagcggcagtggagacgccacgaagtcaagccgggcatcacgggctgggcgcagatcaacgggagaaataaagtgacatgggaggaaaaatttgaactcgatgtctggtatgtggatcatcgttcttttttgcttgatctcaaaatccttttgttgactgtcgtaaaggttttgaagtcggaaggcgtcagccaggaccggcatgtgacagcagaaaaatttacagg

SEQ ID NO: 1757 - DNA, 1497 bp, Bacillus licheniformis
atggcggtattggctgatgaagggaaaatggagtgggataagccggtaagggaatatctccctgagtttaagatgcacgatccggtagcaactgaacggatgactccccgtgatcttgcgtgccatcgttctggtctcccaagacacgaaatgatgtggtacaattcctccttttcaagggaggagcttttcagacggatccgctaccttgagccgaatcaggattttcgatcaaagtggcagtatcagaacctgatgtatatgacggctggttatcttgctggaagaatagcggggacgacatgggaggatcttgttcatgagcggcttttcaaacctttgcatatgacatccagcagcttttcggtcgaagatatgcaaaagctttccgattttgcctttccatatcaagagaacaacggaacggttgaaaaaataccttttcgtaatatcgatgcgatcgggccggctgggtcgattaattccaatgccgtggatatggcaaattggctgcttcttcagcttggcagcgagaaattcaacggggttttatcagatggaagccttcatgaactgcatacgccttgcatttcctgcgactccattattaaagcgaaggagcttccggtctgcagctatggactcggctggtttgtggaaccgtaccgcggtcgccatatgattcatcatggcggaaatatcgacggcttttcatcgcttgtcgctttcatgccttatgaaaagatcggcattgtcattttgacaaatatgaacggcagctttcttccaaatgttctggcgtacaacatttttgaccgcttgcttggattggaagagatcgattggagcggccggctgaaaggcgaagcggaaaaaataatgaaagccgctttaggagtggatcgaaccgcggatcttaccaaaattgaaggaacgaatccttctcatgccctgaaggactacacaggtgtatatgagcatcccggctacggcgaaatcaaaatagagcttaaagacggcgtgttacaggcgctcttcaattcgtttgtgatgcctttgaagcattatcattacaatatattcgagatgaaaatgccgctcacggagatggcgatgctcgcatcattcgacaccgatatacacggacatatcagccgcctttccataccgtttgaaatggcggaaggcgctagagaaatcgaatttgtcaggaagccggatcagcaattgtacgaccctgaatttcttgcttctttaacagggaagtatgcattgggagacggaacagatgtcgttgtgtctctcagaaacaaccggacgctctgggtttcattgcccggtcagcctgattacgaacttgaaccttaccgtgagttgacatttcaaataaaaaatctgccgggattcagcgtccgatttgaagccggcgattccggacaggtaacaggtttgcgcttcatccagccgaatggagaatttcctgctgtccggaaatag

SEQ ID NO: 1758 - DNA, 525 bp, Bacillus licheniformis
tatacggcggaaaatcagcggagcataacgtttctctgcaaaccgcgctggccgtcacgaaagcattagatactgaaaaatttgatatacacccgatttatataacagaaaaaggcgagtgggtgagagggccgcaactgacagaaccggtttcaaatgtgaaaatgctgcaatttgaacagacgggccagacattttctccggctgtgttgaaccgcgatatgtttcctggcgaagctgatgcaaaagaagactctatcgatgttgttttcccgcttttgcacggaccgaatggggaagacggcaccattcaagggatgcttgaactattgaatgtgccatatgtgggcaacggagtcttggcttcctctgcgggcatggataaagtggtcatgaagcatctgtttgcacaggcaggtcttgaccaggcgaaatacgtttcatttttgaaaaaaacttggagtcagtctaaagaagaatgctatgctcaagtggaaggggaacttggctatccgtgctttgtaa

SEQ ID NO: 1759 - DNA, 612 bp, Bacillus licheniformis
atgtcacaaactaaccgtattcaaactgaaaggagctaaggacactgtgaaagctgtattatccgttctcatcctccttttgctcatcttgcagccgtgcgctcttgcaaaggagaaaaaagagcccgatctgcaaaagagaatggccctttatcataagacagaagccgcaacccatattccttggtatgttttcgcggcagtcgaccaatacgaaatcaatatccgcaaaaaccgcaaagacttgccgaagcaaaaagggcacaccgggatatatattccgcaaagcgtgtggagcggacctgaaaaccccaatcctaaagatacatcgccgctcagcatcaaggtttttgacggaattggaatggacggaaacggagacggactcgcagaaccggatcaggatgaagacgtcctttatacgtttggacaatacttgttgacatacggaagggacattgaaaatatccgcatcggtctgtgggagttttacgaaagggatcagacggtcggcatcatatcaggctttatcaggctttttcaaaaatacggccacattgatttgggcaagcacgcctttccccttcccgtaagagcagatcacagttatag

SEQ ID NO: 1760 - DNA, 690 bp, Bacillus licheniformis
cgggagccgcttccgcgcaaaccataacggtgaaaaaaggagacacgttatggggtttttcgaagaagtatggcacaactgtcagcaagattaaacaggaaaacaagctgaaatccgatatcatttacataggacagaggctgtcgatcaatggaagcagttcttcgtctgcaaaagcgtcgaaagtttcatcagctacgcataaagtggtcaaagtagacagcctttggaaaatttcgcggacatacggcatgactgttaacgaactgaaaactctgaacggtttaaaaacagatttaatccggattggacaagtattaaaagtcaaagggacgaaaagcgtaaaagcagcatcaacaaccaagccttccgcatcaagcgggacaagcaaaacaagcgcacctgcgcagaaatcttcaacgctgaatacgtcaaaacttgtttctgatgcaaaagcccttatcggaacgccttataaatggggcggaacatctacatcaggatttgactgcagcgggtttgtctggtacatcctcaacaaacagacaaatgtagcgagaacgaatacagtcggatactggaattcaatgaagagcgtatcaagcccggcagtaggcgatttcgtattcttcacgacatatcagccgggaccttcgcatatgggggtttacatgggaagcaccaattggt

SEQ ID NO: 1761 - DNA, 486 bp, Bacillus licheniformis
aatcttctttaaatacggagaagagaagttcagcaagcaaattgccaggaaaatcgaaaaagcaagagaacaatcgcctattgaaacaacaggccagcttgtcgatatcatcaaagaggcgattcccgcaccggcaagaagaagcggcgggcatccggctaaacggatcttccaggcgattcgaattgcggtaaacgatgagttgagggtatttgaagaagcgcttttgcaggcgattgaggtgctgaagccgggcggaagagtatcggtcatcacattccactcgctggaagaccggatctgcaaatcgacatttaaagacatgtcgtcgcctcctgaactgcctcacggactgcccgtgatccccaaggagtttgaaccgaaattaaaattagtcaacagaaagccgatcacagcttccgaagaggagcttgaacacaataaccgtgcgcgctcagcgaagctgcgcatcgcggaaaaagcacg

SEQ ID NO: 1762 - DNA, 910 bp, Bacillus licheniformis
atgagcgtactagttgtcgggggagccggttatatcggttcccacgccgtttacacgttaattgagaaaaaagaaagagtcgttgttgtggattccctggcaacaggacacgcagaagccgttcactccgaagctgcgttttataaaggggacattcgcgaccggcattttctcaagcaagtatttgaaaacgaggacattgaagccgtcatgcatttcgcagcatctccgatttcctcgaaatccaaaaacgtgtttacttcctttaacgaaaacatcacaggaatggaaacactgcttgacgtgatgaaagaatacgatgtcggccggatcgttttcgcgtcaagcgcggccgtctacggcagtccagaagacctccctgtcacggaagaaaccgaacctgagcccgttcacgcgcacggcaaagtcaaatggatgatggagaaaatgctgatggaagcggaaaaagcgtacgggctgaaatatgtgatcctccgctccttcaatgcgtgcggcgctcacccatccgccatcatcggcgaagaccgggggagcgaaacacatctcatttcaaatgttctgcgaaccgctctcggacaccttccttttgttcacatagatcaatctgaagacggaactggcgtccgcgattatgttcatgttcaagatttggcagaagcacacgtgctcgccatcaatcacttgcggaaaggcaaggatagccgaatctacaatctcagctatggcgaaagctactccgctgaacaaatcatccttgccgcccaatatgtcacaggcattcccctcatcgccgcaaagctgacagaaacggacatcgattcacaagcaacatttgccgcttcttcctccagagccagaaaagaattaggctggaccccacagcacaaca

SEQ ID NO: 1763 - DNA, 534 bp, Bacillus licheniformis
ttggagcggaaaatactgcccgcaccgtgtactcgatgaggggcgttggggtgcggtaaaagcggccatcgctgcggaattgaaagcgctcggaggaaagtcgtctagccctgcgaaatcagcaccgaaagcatccggtaagacgtataccgtaaagaaaggcgacacgctttcggaaatcgcggttaaaacaggcgttagtgtggcgaaactccagtcctataacggtattaaaaatccgaataaaatcatggtcggtcaggtgctgaagcttacgggcagcgttagttccaaaccgtcctctagcggtaagaaatacgtatatcttccggcatctgccgactcatggcgcatctatccgactaacaaagcgccggtcaaggggaacgagtgcggatttctgcgtccgaagaaatttggcggccttaaatacgaaatccttgcgaatccccaaacggacgtctatacgatcaaaacggatcagttcggaaaagtgaatatctacgcggcgaaatcaaccggcgcaactattaa

SEQ ID NO: 1764 - DNA, 480 bp, Bacillus licheniformis
ttgccaagccatttgagcttgcattccaatatgaccggaaaattgtcgttgaagagggcgtcatcggacgggaaatagaactcggcgttttagggaatgatgaacctgtctgctcagtcgcgggggaaatcgctccgaagaaagacttttatgactataaagcaaaatatgaagacggcgatactgatttgattattccggcttccctgacagaagacgaatacgaaacaatgcgcagcatggcggtcaaagcgtttcaggcgattgacggttcaggccttgtgagagcggactttttccttacaaatgaaggcagggtcctgatcaatgaagtcaatacgatgccgggattcaccccgttcagcatgtttccgcttctctggaagcaatcaggggttgagtacgctgaactgattgaaaagcttgtcgctttggcaatcgagcgccacgaagaaaaacagcagattaaacatacatttt

SEQ ID NO: 1765 - DNA, 771 bp, Bacillus licheniformis
agcttcataagccatttcaaacgaaaatcgtcaagtctaaccttgaaagtgcagaaatgattaaatacgctgcaaatgcatttttggctacaaagatctcgttcattaatgatatcgcgaatatttgcgaaagggtcggagctgatgtatccaaggtgtctgaaggcgtcggactcgacagcagaatcggcagtaaatttttaaaagccggaatcggctttggcggctcttgcttccctaaagacacgatggctttattgcaaatcgcgaagtcagtcggttatccttttaaattgattgaagctgtcatcgagacgaatcaaaagcagcgcgcccacattgtgcaaaagctccttgatgtgttcggcgatttaaacggcatgaccatttcggttcttgggctggcattcaagccgaatactaacgatatgcgctcggcgccgtctctggatgtcattccgatgctgagaagcctcggtgctaaagtcaaagcgtttgatccgattgctgtacctgaagcagaaaagcttctcggcgatcaagccgtttacagcgaagatctgtatgagacgattcaggatacggatgcgtgcgtcatattgacggagtggccggaagtacagaacatggatattgccaaacttaagtctgctttgaaaaaccccgtcttaatcgatggaagaaatatatttgaaattgaacaaatgagaaacgaaggcatgatctaccattcaatcggacggccggaagtacagggagaaggaatcctga

SEQ ID NO: 1766 - DNA, 617 bp, Bacillus licheniformis
gtgaaactgttaataaagagttttgttttgctgctgttttcgtttatggcggcttttccagctgcttttgcggctgagccgctttccgggaagacggtatatgttgacgcaggtcacgggggtgaagacagcggtgctgtcggaaacgggctgcttgagaaagatgtcaaccttgaagtggcaatgctgattgatgaaaagctgaaagaagaaggagccgacacagtcgcctcaagaacggatgatacgtttttgacgctggaagaccgggtggccaaggcgagcaaaaatgcttcagacttgtttatcagcattcatgcaaactcggccgtccctgaagcgtccggtacagaaacatatttcgattccacgtatcaagccgctgacagcgaacggctggcatctgacattcaagagcggcttccggatgcgctgggcactcgggacagaggtgtaaaagaatcagggttttatgtcatcaaaaattctcaaatgccgagtgttttagtcgaactgggctttatcacaaacaaaactgatgcagataaactcgaaagtccggaatatcaggaaaaagctgcagacgcgattgctgacgctgtcgtatcttattatga

SEQ ID NO: 1767 - DNA, 384 bp, Bacillus licheniformis
ggggcagacgcattcacgaaaggacggatttgttcgcccattacggcctccccgtccggtcgacatgctacggcattgtggaaatgaaaggctggaaccgtttcggcggatggcggatcggaatcagagacatcaacaatacgtaccattatttcgctcatttgaacggtttcacaaaaggcttgaaagtgggagaaatcgtcgagcccggccaggtgatcggctcagttggagcgacgggatacgggccgccgggaacatcgggaaaattcccgccccaccttcactacggcatgtataaagacaatggaagaacagagtggtcttttgacccttatcctcatttaaaggcatgggaacggaaggaacttcgaaagaaaaaat

SEQ ID NO: 1768 - DNA, 441 bp, Bacillus licheniformis
aaaaaggactcggagccgttacacagtctgtgcagcctgaagtattgaacaaagtggacatgagcgatgaatatataaaagaagtccagaaaggattcaggcgcgtaatgacaaaaggtacggcagcgggacagtttgcctctgcttcatataaaccagctggaaaaacaggaacggcccagtctttctatgacggaccggacaaatcgaaaacgggaacatcgacatacaatacaacgcttgttgcctacgcaccttacgataatccggaagtcgctatttccgtcgtcgttccttgggtttataatgactatggccagagatattcgatcacaaacgaaatcggccgaaaagtgcttgataagtattttgaactgaaatcaaaacaatcaaaagaaaatactgtcgaaaaaaataaagacaaaatcgaaaaagaagcta

SEQ ID NO: 1769 - DNA, 942 bp, Bacillus licheniformis
taaccagctctgtctgcacctgacgattctggcgatgcccgaagacacagaagtcgccattttggaaatggggatgagcgccaaaggagaaatcgattttctcactcgtctggcgcggcctgatattgcagtcattacaaacattggtgaatcacacctccttgaactcggatcaagagaaggaattgcagaggcgaagctcgaaattgtcaatgggctttcaaaagaaggcacactcatttatgtcggagatgaaccgctgctcaccgaaaggctgaaccagccgccttacgatacaaagacgtttggagaggatccggctttcgattatcagcttgaggatatgacacagactgaagaggggacggcattccgcgtgagaggaatcgaaaacgggttcttcatcccggtccttggaaagcataatgtgaaaaacgcattagccgcgattgcggccggagacctcttgaatgtcagccgcgctcacattgcagaagggctgactaaactgaaagtgaccggaatgcggcttgagctagtaaagacgccggacggcgttgcgatcattaatgacgcctataatgccagcccgacatcgatgaaagcggcgatcgagcttgtcgaacagatgaagggatacggcaagaagattcttgttctcggcgatatgctggagctcggagaaggagaaaaagcgtttcatgaagaaatcgggcaggcggtcaacccggactcgatcgactttttatttacgtatggagaactcggtgcatatattgcaaaaggggcgcttaaacatttcccggaacaccgcgtccttcatttcaacccggaagaaaaagacagtttgaaaaagacactgaaagaaaaagcgaatacaggggatttaatcctcgtcaaagcgtccagaggcatgcgccttgaggatgttataaaagattt

SEQ ID NO: 1770 - DNA, 1236 bp, Bacillus licheniformis
atgacgctggggctgaccgctgtgctcggatcgtcggcagtgctgatccccttaaaaagcaaccatgctttagcttatgaagacttggagaaaaaaaagagcgacgttcaaagcaaaaaatctgaaaacgagtcaaaactcgaaaaaacgaaacaggagctttcagagcttgaatcaaaggaagcaagcctgagaagcgagatcgagaaaatcgaccgtaagatgacggacacgaatgaaaagctggaaaagaaaaatgaagaaatcgataaaacaaagaaaagcatcgaagagctgaaaaagcaaataaaaaagcttaaagaaaagattgagaaacgcaataaaatattgaaagaccgtgttcgctcaatgcaggaaaacggcggttctgttcaatacatagatgtgcttctcggctcgaaaagcttcggggatttcatcagccgcgcgggtgcggtttcgacaattgtagaagctgataaagacctgatggaagagcaaaaacgcgatcttcagcttgtcgaggaaaaggaaactaagctgagcaaggatcttgaaagccttgaaaaagcgctcaaagacctggaagatttaaaaaagacgctcgacaagcagcaaaaagagaaagcaaatgtcatgaaaaaagtgaagcaagataaagatcatgcacatgaagaacttggttcactcgaaaatgaagcagaaattttaaagcgccaggatgaagcgatcaaagccgaagaggcgcatcgcaaaaagcaggaagctgaagcgagccgccaggcttcaagcggccaatcggaagcttcctcatctaaaccgtcggcaccaagcagctcaggctttatccgccctgcttccggcacatttacttccgggttcggaaagcgttcgctcggaaatcacttcggcgtagacatcgccaagcgcggttcaggcgttccgatttatgcggccgccgccggaacggtctataacgcccattactcgtccagctacggcaatgttgtgtttattacccataacatcaacgggcaaacatatcagacggtttacgctcacatgtcttcaattaaagtgcagacaggccagcgtgttgaacagggacaagtgatcggaacgatgggaaatacaggccaatcctacgggcagcatcttcactttgaaattcataaaggcctttggaacaacgcgaaatccaatgctgttgatccggccaattatataccgctttaa

SEQ ID NO: 1771 - DNA, 1227 bp, Bacillus licheniformis
atgaaaagggagatgcttatgaaaattcttcttgccacttattggagtattccgcacgtaggtggtgtgtggacatatatggtccagctgaaagaatcgcttgaatctatgggacatgaagtcgatctgcttggatatggagaagagaacgagattgttcatattgtaaacgaagatcgcaaggtgaaaaaagaacagcttttgcctatgattgagcaatcagtcgatcaacagtcttttccgcaattatatgacaatcaattggtccactttactgagatccagcgctatgtatacgaacttgcagctatttatttagggctggaaaaatacgacctgatccatgcccaagatgtcatctcaagcggctgcctgaaaagagtgaagcaaaaagacacgccgcttgttgccacgcttcacgggagtgtagcccatgaaatcagacatcagcttacaacgatccacaggaagtctaattctgacatcgcaagggcgtactttgaccatcttgaacgggtcggcgctgtttcggctgacgctacaattgttgccaacaattggttgaagaatctgttgacaaaggaattcgatacaccggaggaacaaatcagcgttctccattatggctatgatattgacagctttctaaaacgaaaggatacaaagtcagcggaaataccgcaaacagataagaaaattatccttttcacaggaaggctcgttgaaaacaaaggtgttcagcatctgcttgccgcactttcgcatttaaaagaggttcgggatgattgggtatgctggattgccggcgacggggagagaatggcgggactgagaattttatgcgggcagctcggtttggaaaacgatgtcgtgtttatgaaaaagcgcgatgatgtcccatatcttctgtcaatcgctgatgtgtatgttttgccgagtcttctcgaaaatcagccgctgtctgttattgaagcgcaattagccggacttcctattatcgtcagcgatgcagggggacttcccgaaatcgttgaacataatgtgaccggtatggtgacgcctaaaggagatgcacaggcaatttgcaactctatcaatcagttgttggaagatgagacgcttagaaaaactttagggtccaatgcacacaaatttgcaatggagtattggaatatggatgaagctgtcaacaaggttttggacatttatcaacaaactttaaaataa

SEQ ID NO: 1772 - DNA, 420 bp, Bacillus licheniformis
caagacaggggagaatgggtctaccggaaatgaaacggtgcaggcagtcaaagctctgcaaaagaaagccggtattgcggtggatggaatttatggaccggcaaccgaaaaggcgctcgcggccattgaagcgaaaaagaaaaaatcatcatcaagcggcaaaaaatcatcctacacgctgccgtccggcatctataaagtgaaaagcccgatgatgaaaggaacggccgtctggcagattcaggaggctttagctgccctctatttctatccagacaaagaggcgaagaataacggcatagatggctattacgggccgaaaacggcaaacgcagtcaaacggttccaactgatgcacgggctgtctgccgacggcatttacgggccgaagacaaaggcgaaaattgaagctttattgaa

SEQ ID NO: 1773 - DNA, 787 bp, Bacillus licheniformis
ttgatgactttttgacgtttgcaaacttaaaacaagccggaaacctcggcaatatgtctgacggcgtttttgacatcatggcatttcatgacatcgtctatttcgcagatttgatcattttgattgctctatgtgtgaagctgcctgaactgaaggcgtcacaactgaaaaaaagatgggctgctgccgttgttctcggcggagtggctctgtttttcatcaaccttgcagttgccgagacagaccgtccggagcttttgacaagaacatttgaccgaaattacatcgtcaagtatttggggccttacaattacatgatctatgatggtgttcaggccgctcaaaacgcgagccaaaaggcatacgcgagcagcgacgacctgacgagcgtcatcaactatacaaattcgcattatgcgaaaccgaatgacgagtatttcggcgcagcaaaaggtaagaacatcatcaagattcatttggaaagcttccagacgtttttgatcgattataagctgaacggaaaagaagtcacgccgttcttgaacaagctggcgcacggccaggatgacatgatgtatttcgataactttttccatcagaccggccaaggtaaaacagcggatgccgaattgatgatggacaacagcctttacggacttcctgaaggcagtgcgtttgtaacaaaagggcaaaatacgtaccagtccctgccggcgattctgaaccaaaaagaaggctacacaagcgccgtgctgcacggggactacaagtcattctggaaccgcga

SEQ ID NO: 1774 - DNA, 1170 bp, Bacillus licheniformis
atggcaagaacatacagaacgcgaataaagaaaagaaaaaagcagaaaacaaaaagaaggcttatcatattttcctttttggttgtttgtggattaatttatcttgcacttccaagcggtatgcgagatcaccaggaaaaccaattgcaagcaactgaaaaaaaggcacagcctgaagcaaagaaaaagccaacacaaaatgaaacaaaaaagagcaaaatcgtcacaaaaaatgataatgctcaattggatcaatatttgaaaagcattggattcagcggcacagcattgatcgtagaagatggaaaagtggtgacaagcaaagggtatttatatgcaaaccgcgaggaaatggttcccaatacaccagataccgtcttttatgtggggtcatcacaaaaagcgattattgcaacggcaattttacagctggaggaaaaaggattgctatctgtaaatgaccctgtttctaagtatcttcccaattttccaaacggctcaaagatcaccctttatcatttcttgacgcacacatccggaattaggggtcacaaagaaggccgcggatatatttcgccggaagatttaattaaagatatcgaaaaacggggtgtaaaatacccaacagggaaatgggattatagagactccaattactcggttctggcatacattgtttccatggtaagcggtgaaccagtcgaccaatacatcaaaaagcatatttttaaacctgccggtatgaaacatgcaggcttttataaaacatttgctaaagagtcaaatccatcgacaggatataaattaaacctgcaaaaaaagctttatacgcctgacatgccggatttatcacagctttacggggccggtgatatttatatgaccgcttatgacatgtatttgtttgataaagcactttacgaaagaaaaatcatttccaatgaaagttttatgaaaatgtttacgccgaataaagcaacatacggcatgggcttttatgtgtctccaggaagctattcaagccacggtgtcatgcccggctacaacatattaaacagtttcagtctgacagggagcagatacgtcattctattttcaaacatccaaaacaacattaagtcttttggcagtgtgaataatcggatcttctctattttaaatggattttga

SEQ ID NO: 1775 - DNA, 408 bp, Bacillus licheniformis
atgaacattgagcaatttacagccggtttggagaagaaaggcatttccctttcctccttccagctggagcaatttgagacttattacgaatggcttgttgaatggaacgaaaaaatgaatttaacctcgattaccgagaaaaaagaagtgtacttaaagcatttttacgattccatcgccgcctctttttatgttgatttcaaaaagatgaacactctctgtgatgttggagcgggtgccggatttccaagccttccgattaaaatctgctttcctcaccttcacgtcacaatcgttgactcactgaacaaacggattcactttttgaatcagctgtcagacgctttgaagctggaaaacacagctttttaccatgaccgcgcggaaacattcggaagatcccaggag

SEQ ID NO: 1776 - DNA, 507 bp, Bacillus licheniformis
cttccttcttcccgtcgtcatgatgtttgttttagtatctgacagcgtctatgcggattttgtcaacttgccttttgtgacggaagaacagcagctcatcccgcgttttctgctgcttgtcttagtttttatgacggcttatgtcaatcagccttttgccattacatatggatttattttcggactgttatatgatattaattacaccgaccttttaggtgtatatatgtttggttttgccggtatttgctatttatcgtcaaaagcgttcaaagtattgcagacaaacgcgctggtcgtcatttttatttcgctgctcgccgtctgtgttcttgaattttaccaatatggcgtgcagatgctgatacgtccggaaattatgccgttccatcaatttgtgctcggcaggctcctgcccacgcttgcgctgaacgccgttggcggccttctgctcatttacccgttcaaatggttttttaccagtcttaagaaagagctgaggaatga

SEQ ID NO: 1777 - DNA, 488 bp, Bacillus licheniformis
atgaaaaaacaactgaactttcaggaaaaactgctgaagttgacgaagcaggagaaaaagaaaacaaacaagcacgtctttatcgtattgcccgttattttctgtttaatgtttgtctttacttgggtcggaagcgccaaaactccttcgcaaatggacaaaaaagaagatgccaagcttacagctacttttgttggcgatatcatgatgggaagaaacgtagaaaaagtgacaaacttgcacggttcggaaagtgtcttcaaaaatgtgaagccgtactttaatgtgtcagattttatcacaggaaactttgaaaaccctgtaaccaatgcaaaggactatcaagaggcagaaaagaacatccatctgcaaacgaatcaagaatcagtcgaaacattgaaaaagctgaacttcagcgtactgaattttgccaacaaccatgcgatggactacggggaagacggtttgaaggatacgctcaatgagtt

SEQ ID NO: 1778 - DNA, 507 bp, Bacillus licheniformis
ggggtacgatgtatttataaccttctcagcttggctgaccgcaaaagaaaaggtctttttatacggggccaagcaggaggttattcaagctgttgcagatcggctttcaaccgaatatcccggaattgagctggccggatactcacacggctatgtcaaagacaaaggcgaagttgcgaagcaaatcgcggctgccaagccggacatggtttttgtcgctctcggatatcctcatcaggaaaagtttatttatgaacataagcatctatttcctcaggcgattgcgatcggcatcggcgggagcttcgacgtgttcagcggaaaagtgaaaagggcgccgaaaatgttcatcaagctgaatcttgaatggatgtaccgcctgctgaccaatccgacaaggtggaagcgcatgctgaacatcccgaaatatgtcttctccgttctgaaagaggaaagagttcaaaaacagcggcactactatccggagcagatcaaagagcaatctaa

SEQ ID NO: 1779 - DNA, 608 bp, Bacillus licheniformis
atgaagatttatttggatccgggacacggcggaagtgatccgggagcatcgggaaacggtttgctggaaaaggacgtgacgcttgccattgctctcaaaatcaatgacattttattaaaagagtatgcaggcgcagagacgaggctgagcagaacgacagacaaaacggttacgcttcaggagcgcacagacgatgcgaattcgtggggggccgatttgtttgtctccattcatacaaacgcttttgacggcacggcgtacgggtatgaggattacatctacagcggcctgtccgatgaatcagttaccgctctttatcaacggatcattcacggcgaagtaatcaagcagaacggactcagggacaggggaatgaaaaaggcgaactttcatgttcttcgggaaacagcgatgcacgccgttttaacggagaacggctttatcgatcaccccgaagattcggcaaaaatgaaaagcgccgcctggatcgaacagactgcgcggggacatgcaaatggcatcgcgctctgcctcggcctgacgcagcgcgaattccccttgtataaagtgacgatggacggggggcaaatcggggcttaccaagaaaa

SEQ ID NO: 1780 - DNA, 471 bp, Bacillus licheniformis
  misc_feature (1)...(471): n = A,T,C or G
taagagactcggcaancagctttttcagccaagctctgtaatcactcaattgaagcagtttatccaggcccggcaatatccgataccgcagctggaccaggcccttttgtatctggagcaccatcttgaagatgtacagtccggagaaaaggtcgtctgtcactgcgatgtcaatcataataattggcttcttacagatcagaaccagctttatttaatcgattgggatggagcgatgattgcagaccccgcgatcgatctggggccgcttctttatcattacgttgaagagcgggaatggggaagctggctcgaacgctacggctcttctcttacagacaatctcaggctgagaatggcctggtacgtattggcggaaaaagcaatgacgacactctggcaaaaagcgaaaggcaatcaggaaggctttcaccaggggctggaacagctgcatgaattaatggagcgtct

SEQ ID NO: 1781 - DNA, 464 bp, Bacillus licheniformis
atgctcatcggatgcttaagcctgatcgcaacagttttaatctatttgggcgcaaaagcggtgtattcacgccatccaaaggtgtatgcgtcacctttattggtcacgccggtgatactggtcggcctgctgcttttcatcaacgtcccttttgaagcgtacaatgcgggcggacgcttgttgacggacatgctccagccggcaaccgtggcttttgcgattccgctgtacaaatactttccagtcttgaaaaaatacgcggttgagatcattatcaacgtggctgtaggctgctgtatcgcgatcctgtcaacagcggttattgccaaaaaaattcaagggggatggagaccccataggggcctcgttcccagatatttcaaaaacccaaattcaatggaagtttttgaaatgattgggggaataccggcggtgacccctttttttttcatattgaccgccct

SEQ ID NO: 1782 - DNA, 1062 bp, Bacillus licheniformis
atgattgtcaaaaatgaagaagaagtattagcgagatgccttgatacagtgaaagacattgtagatgagattaatattgttgatacggggtcgacagataaaactgtagagattgcgaagcgatacacagaccgcgtctttttctttgaatggatcggcgattttgcggctgcccgcaatgaatcgttcaaacacgccactaaggattatattctctatctggatgcggatgatgttttgcttgaagaagatcagaaaaaactgaaagagttgaaggaaacgcttgatccttccgttgattccgtgtctatgtactatgatgctggaaccgacgaattcggaaatgtgacattaaggtaccgccgcaaccgtctggtgaaaagggagaagaactttaaatggaaaggcgactgccatcaatatttggaggtattcgggaacatcatcaatgccgatatttcagtgacgcataaaaaaatccgccactctgtcggacgaaacctcaatatttaccaaaagaagattgatcgcggcgacacgtttaccccgcgcgactatttttactacggtaatgaattaagagaaaacagacactacgaaaaagcgattgaaagctacaataaaaacattgaaatgaaagaaggatggattgaagacaaagtatacgcctgcatcaacaaagccgactgccaccgctttctcggcgacatggacaatgagctgagatctctgttccagtcatttgaattttctaaaacgcctcgtgccgaaacatgctcaagaatcggctataactttcagcggaggcgggaatacaaggccgctatctactggtatgagctggccacaacattggtgcctgattcaaataaatggagcttcacctatccggcatactatacttggtaccctcatttgcaaatgtgtgtgtgctattacaatttaggagactttgaaaagtcgtatcatcataatgaagaggcgaggaaataccgtcccgaagacaaatccgtccttcataacaaacagctgctggaagggaaattaggcattaacaattag

SEQ ID NO: 1783 - DNA, 327 bp, Bacillus licheniformis
aacctgaattctctcgattatcttggtttgccatgctttttagcgcaggtatgggcattggtctcgtattttatggcgcggctgaaccgatcagccattatgccattagctctccatcaggtgaaacagaaacagcccaggccttcagagattctctgaggtatacatttttccactggggattgcatgcttgggcgatctatgcgatcgttgccctttgcatcgcatactttcaattcagaaaagacgcgcctggcttgatcagcgcgacgctgtttccggtcttcggcgacagagtcaacggaccgcttggaaaagggatcgacc

SEQ ID NO: 1784 - DNA, 1035 bp, Bacillus licheniformis
atgaaaggactgttgttattggtatatacagcggaacatcttgatgattatttaatggaacaagcatccaacaatcattttcacggcagcattttgctggcagattcaaacggtatactgttatcgaaaggatacggttatgccaattgtaaggacaaggtgaagaatgaaccgtctacacgctaccaaattgcctcactgacaaagcaattcacagctatagcggtcatgcagctgcaagaaaaggggctgcttcgtacagatgacccggtacaaaactatttagaaggctatccgaacggcgacagcattaccatcaaacatttattaagccatacgtccggaattcctgattttttagaggaagaattgctcgatattgagctggagcgcgcaccgttggaccaatttatcagacgttttattgacaagccgcttgaatttcggccgggacaaaggttcaattacagtaattcaggatacatactgcttacaaaaatcattgaaacgatcacaaatgaagcttatggagacgttattcaacaattgatctttgaccctttaggcatgaaaaactccggttttttctcttctccggaagatatttcgcctacagtcggatatttatgcctgaatcgtgaaatgatcaaagcgcctatcgtatacggctacggggaaagcgggctgtattcaaccgttgaagacttgtacttatgggacagggcgctttacaccgagaagcttgtctcaaaagatgctttgaaagaagccctttacagccgcgtcaaaaagcaggcttttgcagccgaaggcccttctccggcgctcattcaaaacaattcgatcggatacggatggtttattaatcatcaaaataagtataaaatatggcatgatggagaaatccacggttttatcagctcaattaaccgatacatggatgagaaaaaagtgctgattatgctcagcaattgcaacctctcaaaaactgacgagattttggcacacttagaagaagctttattgcaaatgtag

SEQ ID NO: 1785 - DNA, 357 bp, Bacillus licheniformis
  misc_feature (1)...(357): n = A,T,C or G
aagtaaaaaaagcagtcatcccagcagccggattaggtacgagatttttgccggcaacaaaagcgcagccgaaagaaatgctgccgattgtcgataaaccggccatacaatatatcgtggaagaagctgtccaatcaggcattgaagacatccttatcattacaggaagaaataagcgttcgattgaagaccattttgaccgctctgtggaacttgagcaaaacctgctggccaaaggaaaaaacgatgtgttaaaagagatacgcgagatcgccgatatggcgaatattcattatatccggcaaaaggagcccatcggcctcggacatgccagtgtnttatcggcccaagcatttc

SEQ ID NO: 1786 - DNA, 963 bp, Bacillus licheniformis
atgagacgtatgtcagtgcaaagcatgcttttttaacaacatcggcaacaacggctttatcgatgtgccttaaaagcctgaacgtgcaacccggagatgaagtaatcgtctcagacttctcgttccccgccactgtcaatgtaatagaagatttaggagccaagccggtttttgccgatgttgatcttgaaacatttaacatgcttccagaagaactggaaagtcaaatcacgtcccgtacaaaagccgttctttttgtagatgctcttggaaacccgacaggcatcaccaacattaagcaaatttgtaaggagtacggcttaccccttgtggatgatgccgcttgtgcgatcggcagcagcgaatacggctgtaaatccggaaaaattgccgatctcacctgtttcagctttcacccaagaaagctgcttacgacaggcgaaggcggggcaattacaaccgaccgggaagagttgaaagactggctttcggtcaaattaaaccatggcgctgccatctctgacggaaaattggattttatagatttcggctacaactacagattatccgatatccaagccgctcttggaattaaacagctccaaaaacttgatgacatcattcatcggagaaaccttcagcagaaagcatatagtgaacagcttgaacccctcggattccaaagtcaaaaaatcggtccagccgttgtacacaacatacaatccgccgttttcaaagttccaaaaaacatcgttcgcgacgaattgattcaatatttgagcgactgccatatagagtcgactttcggcacttattgtttaagcggcactccctattaccgccggaaataccaacagctaaaatcgaattctctctttcttgaacaacatacgattaccctcccttgccatgatgaagtcgatttagatcatgtggtttcagccatacaatcatttatcaaat

SEQ ID NO: 1787 - DNA, 292 bp, Bacillus licheniformis
ctgtggaagttaccgacgtaagattacgccgcgtgaataccgatggtcgcatgagagcgattgcatccatcacgctggatcacgaatttgtagtgcatgatattcgtgtaattgatggaaacaatggtcttttcgttgcgatgccaagtaagcgtacacctgatggagaatttcgtgatatcgctcatccaatcaactcaagcacccgcggaaaaattcaggacgcggtgttaaatgaatatcatcgtttgggtgacgttgaggaaatagaatatgaagaaattggagcttc

SEQ ID NO: 1788 - DNA, 378 bp, Bacillus licheniformis
agtcggcgacgatgttacattcgccccgtttgctcatatcatgcccgactaatagatcggcaatgaggtaaggatcgggaatttcgtcgaagtgaaaaaatcggaatttggtgatcgcagcaaagcatctcatttaagctacataggggacgcggaaatcggaacggatgtcaatctcggctgcgggtcgattaccgtaaattatgatgggaaacataagtttaaaacgaaaattgaaaatggggcatttatcggctgcaactccaatttggtcgctccggtgacaatcggcgaaggcgcatacgtagctgcgggttcaacgattaccgacgatgtgccaggccgggctttgtctattgccagagcaagacaagtcaa

SEQ ID NO: 1789 - DNA, 367 bp, Bacillus licheniformis
atgtggaaagaatttaaaagttttgcgattcggggaaatgtaatcgatcttgcaattggtgtcatcatcggaggcgcctttggaaaaatcgtaacttcgcttgtcaatgatttgatgatgccgctcctcggtcttctgcttggaggcctggatttttccgcgctgtcgttcacatttgttgatgccgaaattaaatatgggctattcattcagtcgatcgtcaatttctttattatttcgttttccatttttctatttatccgctatatctctaagctgaagaagaaggatgccgaagaagaaaaagctgctcctgatcctcaggaagaattgcttaaggaaatacgggatttgttaaaagagcaga

SEQ ID NO: 1790 - DNA, 486 bp, Bacillus licheniformis
ggatgatgcggtagaagtaggcaaaccagtcgaaaatgtcgcaatgccggttgctgattctgaaaatgtttccgtcgttaaaaagttttttgaaactgacgcaactaaagaagagaaagaagcagcacttgtaaactataataacacgtacagcatgagcaaaggtatcgacttggctgagaaagacggaaaaacatttgatgtttccgcatctctaagcggtacggtcatcaaagctgcaaaagaccctgtactgggctacgttgttgaagttgaacatgaagatggtttatcaactgtgtatcagtctctttctgaagtaagcgtcaaacaaggtgacaagattgaacaaaatcaagtcatcggaaaagcaggcaaaaacctttacaatgaagaaggcggaaaccatgtgcattttgaaatccgcaaagacggtgttgcgctaaacccgctgaacttcatggacaagccggtctccagcattaa

SEQ ID NO: 1791 - DNA, 414 bp, Bacillus licheniformis
cggtgcaggtcgttccggtttaatggggaagtcatttgctatgagattaatgcacctgggtatcaatgcatttgtaacaggagaaaccgtaacacctgcatttaccgaaaacgacttgcttatcgtgggcacaggatcagggaaaacagaaagtttgcttcatatggcggaaaaggcaaaagatatcggaggcactgtagcggcagttacgacctcttcagattcgccaatcgctgaaatagctgatctgatcctgcagctgccgggttcacccaaggatcaaacgacgggcagtaaacagactatacaaccgatgggatcgctttttgaacagactcttttattgatttatgatgctatcatattgcgaataatggaaataaaagggctgaatactcataacatgtacgcaaa

SEQ ID NO: 1792 - DNA, 561 bp, Bacillus licheniformis
  misc_feature (1)...(561): n = A,T,C or G
agggaatgataatgttgaaaagaatcgctgtcattggaacgggatatgtcgggctggtgtctggaacttgttttgccgaagtgggaaactcggttgtctgctgcgatattgatgctgaaaaaataagaggactctcagccggagtgatgccgatttatgaaaacggcctaaaagaacttgtggataaaaacgtaaacgaaaatcgcttatttttctctactgatattccaaaagcgattgaagaagctgagattatttatattgcagtcggtacaccgatgtcggaaacaggggaagcggatctgacatttgttaaatccgttgccgaaatgatcgggaagcacctgaacggctataaagtcatcgtcaacaaaagcactgtccctgttggaacangaaagctcgtacaagccattatagaacgcaattcaaaaagggaattccctttcgacgtcgtgtcgaatccggaattccttcgtgaaagaacagctatttacgatacgatgaatatgaaagagcagtcatcggcgcgacaagcgaaaaggctgctgccattattaa

SEQ ID NO: 1793 - DNA, 393 bp, Bacillus licheniformis
tttacagcggaacgtgagccaatacggcatcattcagacatccgcgcaaaagaacaaagtgtatcaaatcgacgatcttgtagaaaagccgaccgtcaaagatgcgccttcaaatatcgcggtcatgggccgctatgtgctgaggccttcgattttccctgtgctcgaacaaacgaagcgcggcgcgggaaatgaaattcagctgactgacgcactaagggaaatctgccgggaacaaagcatgtatgcgcgcaaattgaaaggaagccgctttgatatcggcgacaagctgggcagctttaaagcgagtacggaaatcgccctcatgcgggacgagatgcggccaaaactgctcgcctacctggagagcgtcttaaaaaaagaagcgcagaa

SEQ ID NO: 1794 - DNA, 786 bp, Bacillus licheniformis
cgaaagtttctgtcattatgggagtctacaattgtgagaacacgatcgcagagagcatcgagtcaattttaaatcaaacctataaaaattgggaactgattatatgcgacgatgcttcgacagacgggacatatgctgttgccaggcggtatgccgatcattacgcagataagattaagctgatcaaaaacgagaagaatcagcggctggctgcctcgttaaaccactgtctccaatacgccggcgggaaatatatcgcgcgccaggacggagatgacatctctttgccgaggcggtttgaaaagcaggtcgcgtttttggaatcgcaatctcattatcatgtcgtcggaagcggcatgatggccttcgacgaaaacgggattagaggcgtcagaatgcttccttcctctccagaaccgagaatcatggcgaaagggacgccgttttgccatgcgacgatcatgatgagagccgacgtctacgaggcgctggacggctatcgggtcggccggagaacaagaaggatggaagatgtcgatttgtggcttcgtttttttgaggcgggcttcacgggctacaaccttcaggaagccttatacaaagtaagggaagacgaatcggcgtttaaaaggagaaagctcagctactcgattgataatgcgtttatcgtctttgccgcctgcagacggctgaagctgccgctatcggactatatttatacaatgaaacccatcatcagggggcttatgcctccttttatcatgaacagatatcataaaagaagat

SEQ ID NO: 1795 - DNA, 279 bp, Bacillus licheniformis
attagagccgctcgatgtcatcgattttcacaactctgcagctgaagctcacttcatcctcaccgactctggaggtgtgcaggaagaagcgccgtcgctaggaaagccggtcctcgtagttcgcgatacgacggaacggcccgaaggcgtccaggccgggacgcttaaactggcaggcacggatgaagataagatttaccagctgactaaacagctgttgaccgatcaagatgaatatcgaaaaatgtccagggcttcaaacccgtacggggacggaca

SEQ ID NO: 1796 - DNA, 306 bp, Bacillus licheniformis
attgcaagctcttgcagcggaatagaaaaagccttcttcaagcggcaaaaaatcatcctgcacgctgcggtctggcatctataaggtaaaaagcccactgatgaaagggacggccgtccggcagattcaggaggctttagctgccctctatttctatccagacaaaggggcgaagaataacggcataggtggctattacgggccgaaaacggcgaacgcggtcaaacggttccagcatatgcacaggctttctgccgacggtatttacggaccgaaaacgaaagcaaaactcgaatccttactgaa

SEQ ID NO: 1797 - DNA, 810 bp, Bacillus licheniformis
atgggaatcaatatgaaaaaaagagcggtattgatcctatcgatgatgctggcagcacaagcagccttttatacatcgtcaaacacagcttctgcagccatcggggaagccgtgattgccaccgatgaaatcaatgtcagaagcgggcctggactgagccacgaaatcgtcagcgtcgtcagcaggaatgaaagctatccgattcttgaagaacgcggggattgggtgcaaatccagctgaacggcgggcaaaaaggctgggtcgtatcctggctgatcaagaaaaagagccaagtctccagcggatctgattccgcatcgggaaaagtcacatcttccgaagcaaacttgagaatcagaaaaggccccggcacttcatatgaagtccaaggcgtattccctgaaggagaacaggctgacctgctaaagaccgacggaaaatggataaagatttcctatcagaacatcacaggctgggtctattcagattatgtcaatcaaggttcaggcgcgaaacagtctcaatcgtcttcatcacatgcttcatcatcaaaatcgggaacggtcggcgtatccaccttaaatgtcaggagcacagcttcccatcaaggccggattattgccacgctccaacggaatgcaagtgtgacgattttaaacgaacagcacggctggtatgaaatcgaatttaatggacaaaaaggctgggccgcaagccactatattctcgaaggaaacaaacagaacagcggaacctccggaaacaagcagcagctccgaagcaaaacggcagggcaccatcgtgtatga

SEQ ID NO: 1798 - DNA, 690 bp, Bacillus licheniformis
ttgaaccgattaaaggagagatcacagatcaattcggtacgagaggcggaaagcataaggggcttgacatcgctgctcccgaaggggaagcagtagcggcagccgcagacggaacgataagcaaatcgtatcaatccgactcctacggccaagtgatatttattaaacatgacaacggatatgaaaccgtttatgcccacttaagcaaacgcctgaaaaaggaaaaggagcgggtgaaaaaaggcgagcaaatcggaatcatcggcattacgggaatatcgaccggaacccacctgcattttgaaatgcatcacggttcatggactgaagataaaagatatgcaatcaatccgctgacggtgcttcgtgaggaggcgttccggcaaaattctatccacgttcatcaaaacgccgggacaatgagcggtgcggtgaccgttcaaaaaggggacacgctctggagaatcagcaaggatagcggtatatccatcgaggagatcatgagaataaacgggttgaaacattcaaatctcaaggccggccaaacactccgccttcatgacgatgaatcgaagaccggtacatatgtagtgcggaaaggggatacgcttcatcatatcgccgaaaaaatgggcgtaactgtacagcgcctcaaagaatggaacgatttgaaaggagagcggatttatc

SEQ ID NO: 1799 - DNA, 264 bp, Bacillus licheniformis
ttatcaccagatttccgtcggccatgtagagtcggggttcaggaccgtaaacaaatactcgccgtttccagaagagctgaacaggcagctgacgggatcgattgccgatcttcattttgcgccaacagagcaggccgaacagaatctgctccgcgaaaataaagatcctgagacgattttcatcactggaaatactgcaatcgatgcacttcgcacaacagtaagggacggctattcacaccccgttcttgaaaaaatcggaca

SEQ ID NO: 1800 - DNA, 753 bp, Bacillus licheniformis
atgaacaaaaaagttttgaaaagaaaaataaaatttattaaagaccctattgagaactatctcaaaaaaagaaatcatagaagaaacaataagtacgctaaattttataaaaaattgaatgttgtggacaacacaattttatacgaaagccgtgatgggaagagtatcactgacagtccttttgcaatatttgactatttgataaaaaatccagaattcaaccattataagcatatttggactattgcagattttgaagcgctcgagccagttatctccaagtataaagatatgccgaatgttgagtttgttaaaagaaattcagataaatacctgcaatatttggctactgccaagtatctaatcaataactctacgttacagtcattttttatatgcaaagaagaacaagtatatataaacacatggcatggaacgccactgaaaagcatgggatttgatattccaggaaatccagcccattcacaaaacgtacttagaaactttataagtgcagattacctgctgagtccaaataagcatactaccaatatgtttttgaacagctataagttagaagggctgtacagcggtgagatcattgaagaaggctatccaaggattgatttaacccttaacacgagccccgaagagtttaaaagttatttaaaagacttaagtttacgatctcaaatgataagcaaacgatcttatacgctccaacatggaaagggaatagtgtatcaaaagtaa

SEQ ID NO: 1801 - DNA, 317 bp, Bacillus licheniformis
atgtcagatcaatttaacagccgccaggaacggcgaaaagcccagcagggcaaaagcaggtctaatactcattctaaacccaagaaaaagaaaaaagcaggattgtttaagaaaattcttttatccattttaatcatcggtgttatcggcttgattgccgggggcgtcacttttgcggtgatggtagcggactcgccgtcccttgatgaagcaaaactgaagacaccgtactcttctaccatctatgacaaaaacggaaaagaaatcgccgaaatcggttcggaaaaacggacgtacgtgtcgattaaagacatccc

SEQ ID NO: 1802 - DNA, 1152 bp, Bacillus licheniformis
ttctgttcctagtctcgttaagcttaatatgggtcatgcttctgtatcacatgtttttgatgcagggcggattccgccactatatgaccttcgaacggaacattccgaagtggaaagagaacgtgaaggatctcccgaaggtcagcgttctgattccggcgcataacgaagaggtcgtcattcggcagacgctgaaggcgatggtcaacctctattatccgaaggaccggctggagattattgtcgtcaacgacaattcatccgaccggacgggtgacattgtggatgaattttccacgcaatacggctttattaaaatggtcgtgaccaaaccgccgcatgccggaaagggaaaatcgtcggcgctcaactgcggttttgccgagtcaaacggggacgtcatttgtgtatatgacgccgacaacacgccggaaaaaatggctgtttattaccttgtcctcgggctcatgaatgatcagaaagccggagcggtggtgggaaaattccgcgtcatcaatgcggcgaaaacattgctcacaaaatttattaacatcgaaacgatttgttttcaatggatggcacagggcgggagatggaaatggttcaaaatcgccacgatccccggcaccaatttcgccatcagaagaagcattatcgaacagctgggcggctgggatgataaggcgctggccgaagataccgagcttacgatccgggtctacaacctcggctaccacatccgcttctttccggcggccgtcacttgggaacaggagccggaaacgtggaaagtctggtggcgtcagcggacaaggtgggctcgcggcaaccagtatgtcgtcctgaaatttttggctcagtttttcaagctgaagagaaaacggattatttttgatttgttttatttcttttttacgtattttttgtttttctttggcgtcatcatgtcaaatgcgatttttgtcatcaatttattttataatctgcatctttcattcggttttttgtctatcattttatgggttttggctttctttctatttatgacgaaggtcatgattacactgagcatcgaaaaaacagaaatgaacaggcaaaactttttcatcgtttttctgatgtactttacatactcgcaggcttggattgtgc

SEQ ID NO: 1803 - DNA, 351 bp, Bacillus licheniformis
  misc_feature (1)...(351): n = A,T,C or G
gctgctttaatnnagtttttatccaaatcttcaatggcttgaatatatttactatttgttttgcatgattgtttttatgttcgcattcagtttgtttaattcaacgatcagtgtactggtcagggattatcagtttctgctgcaatcggtgacaaggctgttgtttttcctgctgccgattttttgggatatctctacgcagctgggggacaagcacccggcattgttgaacgtgattaagctgaatccgctttttttttttttctacggatttatattttttttttttcgacggaagctggttcttcgaaaatataacatatacgttgtatttctgggctttcacattat

SEQ ID NO: 1804 - DNA, 235 bp, Bacillus licheniformis
atgaaaaagctttgccgtgaagtttgggtagaggtaaatcttgatgcgatcaaaaaaaatttgcgcgcgtttcggcggcatattccgaaaaagagcaaaattatggctgtcgtaaaagcgaatgcttagggtcacggatcggtggaagttgcacgccatgcacttgaacatggtgcgagtgagctcgccgttgcctcggtggaagaagccggcgttttaccgaaaacggggatta

SEQ ID NO: 1805 - DNA, 654 bp, Bacillus licheniformis
atgaacgtcaaccatttggccgctctcttggaacttcaggcgatacggtcgttttatccggcttcagacagcggttccgaagatgcgggttttgatttcagctcgattttaaaccaatatttaagcaatgtcggcggcttggagtcttcacagcccgcggttgctccgactgtgtcgacagcgtctcagcttcaggccccgctggcagctgaaaagcctgaggcaattgcggccgtcccatctgccgcagcgaaacccgtctctttcggcggccaaaatcagaacattgaccagatcatcaaaaacgccgcagaaaaatacggggtcgatgagaaactgattcatgccgtcgtcaagcaggaatcacgctatcaagagaaagcggtcagcccggccggcgccatgggcctgatgcagctcatgccgtccacggcgaaggcgctcggcgtgaataacgcttttgaccccgttcaaaatatagaaggcggaacaaaatacttaaagcagatgctcgataaatacagcggaaatgtgaagctcgcattagcggcatacaatgccggaccgggaaatgtccaaaagtacggaggcattcccccttttaaagaaacgcaaaattatgtaaaaaaaatcacctcaaattactacgcttaa

SEQ ID NO: 1806 - DNA, 206 bp, Bacillus licheniformis
atgctcgaacaagtaattttatttaccattatcatgggctttttaatcagcgttcttttatctccgattttcattccgtttttaagaaggctgaaattcgggcagagcatccgtgaggaaggtccgaaatcccatcagaaaaaatcgggaacgccgacgatgggcggcgtcatgatcatattgtcgattatcgcgacgaccattgt

SEQ ID NO: 1807 - DNA, 340 bp, Bacillus licheniformis
atgaaagaacaattttttaaaaagcagtggtttttatgcctatccatatttttcatatggatgaagacgtacttcatctacaagctgggctttaatttacaaatcgacaacgcacttcaggaactgatcctgtttatcaacccgcttagctttctcatccctgtactcggcatcagcctcttttttcgcgaaaaatcgcagcgcatctatttaatcggggctaatgtcgtcctgacgggcatcttgattgcaaacagcattttttatgggttctacatcgatttcatcaccattcccgtcctgttccaggcaaaaaacctcggggggcttggaaacagtt

SEQ ID NO: 1808 - DNA, 313 bp, Bacillus licheniformis
gtgagtatcgacaaaagtttaagaatgtacaatgaatattcaagccagcaaacttattcctgtgctctatctaaaaaagcagtacgttatttatatatgaaacggataatggatatcgtcctttccttgattgggctcgctcttacactgccgtttattctgctgttttgtatattaatctgtatcgaaacaccgggttctccgttataccggcaggaacgcgtcggaaaagacgggaagcatttcaaggtgatcaagctgcgttctatgagaattgacgcagaaaaatccggtgcgaaatggctcagaagga

SEQ ID NO: 1809 - DNA, 246 bp, Bacillus licheniformis
aagtcagcatttaccttcatgaagaccacggcggcaaaggggcgggttctgcggtgcttgaaaaagcgcttgaagctgctccaaagcttggaatccgttctttaatggcgtttattttcgctcacaatgaaccgagcatgaagcttttcaaaaaatacggcttcaccgagtggggacactttcccggaatcgccgagatggacggaatccggtacgacttaaaaatattaggaaaagaattgaatg

SEQ ID NO: 1810 - DNA, 585 bp, Bacillus licheniformis
tcaaaaagcttggtgtgttatctgtcgaacgcatcggcggagcgaatcgctacgaggttgcggcgaatattgcgaataagctgccgagcaattcgaaagctgtcatcgcaaacgggacggcctatgctgacagccttgcgatcggcgcatatgccgcgagaaacggcatcccgattcttttaacatcgtcgaattccataccgacagcgacaaaaaatgcgatgaagagcaaaggaacaacatcgaccattgtcgtaggcggtgaagtcagcatctccagcagcgtttacaaacagcttgcttctccgacgcggatcggcggcagcaaccgctatgaagtcgcggccaatgtcgtcaagaaatattattcttctgccaagaatgcaatcatcagcaacggctatgcgtatgccgacggattaacaggatctgttctggcggctaagcaaaaccgtccgatgatgttcacgaatgcatcatctttgccgacaccgacaagagaagtgatcggttccaaaaacatgacgacgtttactgtgcttggcggaacggtttctcttcaatccaatgtcgtgtcacagctga

SEQ ID NO: 1811 - DNA, 498 bp, Bacillus licheniformis
cctcgatgaagcgatcggccagtttgacacgtacacgcctttgcagctcgcccaatatgtttcaacgatcgccaacggcggatacaggttgcagccgagagtcgtgaaaagcattcaccagccagaaagcgaaaaactcggtccggtcattgaagagcgctctgccaatgtgctgaatcgtatcaacaattctcaaagcgacatcgccatcgtcaagcaaggatttaaacgagtaacccagacgggaactgcagccggcgcattcggttcgcttgacgtatcaggcaaaaccggaacggcgcagacgcaatactacggcacaaaccgaaactggtgggggactaggacttacaatatcacctttgccggctattacccgtcggaaaatccgcaggtcgccttcagcgttgtcgtcccgaatgtcgacgacaaaacgaagatgaacaaaaacatcgccgccaaaatcgtcaaagcctatgtcgatctgcaaaaaaaata

SEQ ID NO: 1812 - DNA, 537 bp, Bacillus licheniformis
tccgatcgtcggcaaaaaaatcttcattgatgcagggcacggaggtacagacagcggtgcccgtcggcaacggtttatatgagaaaagcgtgaaccttgatgttgcaaaattaattaatacgaaactatcaaacggcggtgctctgccaattatggcgagaacgaacgacacttacctgacgctcgcacagcgcgtgtcaaaagcgcagtcaaatcatgcggatttgtttgtcagcatccatgcaaactcggcaacgccagctgcttccggaacagaaacctactattatacaacatatgaatctgccaacagcaaacggctggcaaccgagattcaaaaccgtctctatgttgcattgaatacaaaaaaccgcggtgtaaagatcggcaacttccatgtcatcagggaatcaaaaatgccaagctgccttgttgaacttgcgtttatcagcaatgtaagcgatgcgacaaaactcaaaagctcgacttacaaagaaaaaggcgctaaagcgatttacgacggaatcgttgcttact

SEQ ID NO: 1813 - DNA, 392 bp, Bacillus licheniformis
atgactgtttatcaatctgtcggaatataagggacaggtatgagtccgcttgcccaaattgtccatgataatggatataatgtccaaggatcggatatcgaaaagcacatttttacacaaaccgctttagaggagagaaatatcccgatttatccgtttgatccggaaaacatcaagccgggaatgactgttatcgccgaaaatgcttttcccgacactcatcccgaaattgaaaaagcgcaagctgaaggcctgccagtcgtgcggtatcataaatttctcggcgattatctgaagaagtttacaagcgagccgaaacaggggcacacggcaaaacgtcaacgacgggccttttgtcacatgtcatcaaaaaagcaaaaccgacttcttat

SEQ ID NO: 1814 - DNA, 498 bp, Bacillus licheniformis
  misc_feature (1)...(498): n = A,T,C or G
atggaatttattttacactactatcccgcggcaatgattgctatgattctcatcggacattggggatcgccggtgaattcgcgttttaagaagcttttaatcatactgtgtcttatgacgaacggtgtgtatattgtatggcggttcggctttacgctgcccgtctctcgccccgccgatatcgtgatgggcgtcatcctgattgcaactgaatgtatcggctttttacagctcttggtcttttatacgctagtatggaaggaaaagaagcgggagccggaaaagctgggcgatcaagaccatcggccgagcgttgatattctcattgcaacttataacgaggagcgccatgtgctgaaaaagtcggtggcaggctgtctgaacctcgactatccaaaagatgcttgtcaacatttactttgtgtgttgctgaatgctggggagccttatagcgtagcttacgccaancgtcgtatcacacgctgttttgacgactga

SEQ ID NO: 1815 - DNA, 485 bp, Bacillus licheniformis
atgcataacataaacattcgaaaagctatttctgccgatttgccatttatcttaactatttataatcagggcattgaagatcgaattgcgactctggagcaagatttaaaggaaatgagcgatatcgaaatatggtttcaggaacatcaagggcgctattctgtccttgtggccgaatcaaaaggagaaattgtaggctgggcttctttgaacccgtactcccaccgttgtgcttatcaaggtgttgccgacctttctgtctatgttgatcgtgcatgccgcggaaaaggaataggcggcctccttcttcaagctctagaaaaaacagctaaagagaatagtttttataaaatcgtcctctttacatttccctttaacgaacttgggcaaaacctatacaataaaatgggctacaggcaagttggcatctttaaaaatcaaggaattttagatggacgttttatcgatgtaatggcaatggaaaa

SEQ ID NO: 1816 - DNA, 495 bp, Bacillus licheniformis
atgacgtcttcttatgcgatgggctcggctgtcaaaggggccactgttttaacaggtctgcagacgggagccattaatttaaatacgacttttcttgatgaaccgctctatatcggaaaaggaaaaccgaaaaaatcttgggcgagcaacttgggaacactgggtatccagggagctcttgaaaagtcttcaaacgtgttcatgtttaaaacggcgatcgcccttggtaaaggccaatataaggcgcatcagccgctcgaccttcaaacaaaagcatttgatacattcaggtattatttcagccagttcggcctcggcgtcaaaaccggaatcgatctgccaaatgaagcttcaggctacaaaggatctcaaagactgcccggtttcctgcttgacttttccatcggacagtatgacacatacacaccgctgcagctggctcagtacgtgtcaacgattgccaatgggggataccgcataagccgcagcttgtaa

SEQ ID NO: 1817 - DNA, 483 bp, Bacillus licheniformis
atgggcagactctcccctgaaaaagggcaagataatctaataaaagctttccatactcatattcagagttatcctgatagcaggctttatattttaggggatggtcctttaaggaaagatctccaaaaaatagtggacagtttggaacttcaagattacgtctatctgatgggacaactggaaaatccgtttggtttcatgaaaatgtgcgactgttttgtactgtcttcccattatgaaggacaaccaatggtattattagaggccatgactttaggaatgagaatattggcaactgacattattgccaatagaacagttttagaaaacggcagatacggaaccttagtagatgatagtatagccggtcttgaaaatggtttaaaagcagtaagaacagagattaatactgttatgcaagcttttgattataatgagtataataaaaaagctatggataccttctacaaagttttgaactaa

SEQ ID NO: 1818 - DNA, 167 bp, Bacillus licheniformis
atgaatgcattagtgaaaatactgaaagaacaagtaacatcgtttcctttaatcttgcgtttggcagcttacgaaacaaaatcaaaatatcaaatgaattatttgggcgtgttatggcagtttttgaatccgctcattcagatgcggctatatggtgttgtagttgg

SEQ ID NO: 1819 - DNA, 234 bp, Bacillus licheniformis
tcgatgtggcaaacaatgtcgcatctgccggatggacgaacccgagcactgtcgtggttgtcaatcgggacgcttttgcggacgcgctttctgcaactccgcttgcaaagaagtacgatgcgccgattctattaacggatgcgggtacgctgacggcgaaaaccgaaactcaaattgccaagatgaatcctgataatatcttaattatcgggggaacaacgagcgtttccaaaa

SEQ ID NO: 1820 - DNA, 240 bp, Bacillus licheniformis
gtgtctcttttccttgcagaagaaagagagggacatacatgataacaagaacggtaaaagaaattgctgaaatgtcggaaggcgttttgacgaatgaagcttttgaagggcgtctcatcaaaggcgtctcaaccgattcgagaaaactggcgaaaggccaactgtttattccgcttgcaggcgagcggttcaacggacacgtttttgcagagcaggcttttcaagaaagcgttgcggccc

SEQ ID NO: 1821 - DNA, 408 bp, Bacillus licheniformis
caaaagaattgggcattaaggacagtgtgaccattcttcctttcctttgtgaagaggaaagagagagctggctggcattttgtgaaatggctgtttttccaagttcttatgagccgttcggcattgctgttcaagaaagcatggccgccggcgctgccgtctctgccggaatcaacgggggctggaacgatttcgttatcgatcgggtgaccggctttcgaattgattttagtgatccgcataaggctgcaaatgcgctcgcagaaattgtcggcaataaggagcagctgctcaaggtcggacaaacggcaaaggcttatatatttgatttgcatgatcctggatatgtaaaaaatatgtttctgcatcatgtatatcatacgtctttctaacaaaccgtgataaact

SEQ ID NO: 1822 - DNA, 327 bp, Bacillus licheniformis
  misc_feature (1)...(327): n = A,T,C or G
tgccctgtggttcatcccgtatttnttttcaatttggcggaattgggcaaatttgtttctgggaatgcaaaggatttaggttcaatggaatcgggagaattcggtcaagatttcagggggcatcttccagttcgcaatgggcgggggggctcctgtattcagggggatattcggcgttgcaaaacccggcattcttgccggcaccccgttctcgttcgtggtgattctcaggatgtattcgtaatataaatttctgtcacaagaacgaaaagagattaaacaagccgagaaattccagaagccaagaagcccgagggtgaaaaaagc

SEQ ID NO: 1823 - DNA, 372 bp, Bacillus licheniformis
atgggcgcggcaggttcagacatgttgaggggatgcatcgggtatttattgccggatgctcacgggagcagacagacgaattttaccaggcaatttttgaacaggtattgcgaaatatctcggcctttgtggtggatcaagcaaccggcaacatcggccccgaaaaagaaagcacgaaaaagcaggagcaaaaaagtacccattccgcccggaatttacaaaagcctaattatgaagggaacggccgtccgacagattcaggaggctttagctgccctctatttctatccggacaaaggcgctaaaaataacggcattgatgtctattacggaacgaagacaaaggcgcagctcgagtcgctattggtttaa

SEQ ID NO: 1824 - DNA, 705 bp, Bacillus licheniformis
gtgatacaagaattaaaagaacttgaagtcggcaaagttctggaaaacgagccgctcagcaaccatacaacgattaaaatcggaggaccggctgacgtgctggtgattccgaaagacattcaagctgtcaaagatacgatgaaggttgtcaagaagcacggcgtcaagtggacggccatcggcagaggctcgaatcttctcgttctcgatgaagggataagaggcgtcgtcatcaagctcggccagggactcgaccatatggaaatcgacggcgagcaagtgacggtcggcggcggctactctgtcgtaaggcttgcgacaggcatcagcaaaaaagggctttccggccttgaatttgccgcaggcattcctggttcggtcggcggagcggtttacatgaatgccggcgcccacggctcagatatcagcaaagtattggtgaaagcattgatcctttttgaagacggaacgatcgaatggctgacgaatgaagagatggcgttcagctaccgcacatccatccttcaaaacaagcggccgggcatttgtcttgaagccgttctccaatggagcaaaaagaacgcgatcagatcgtcgcgcagatgcagaaaaacaaagactaccgaaaagaaacgcagcctgtgtccaacccttgcgcaggcagcatcttcagaaacccgctgcctgaacatgcgggccggctag

SEQ ID NO: 1825 - DNA, 327 bp, Bacillus licheniformis
atgacggttcaacagacggaagccagaagatcattgatcattacgcccgaaaggacgggcgcattaaaacgattcagcaggacaatcagggcctcggcgctgtccgcaataaaggcatcgaagcggcgtcaggcgagtacttggcattcatcgactccgacgactggattgagccggactattgccagtctatgtatgaaaaagcgaaggatgaggatgccgatcttgtcatctgtgattatgccgttgaaattcaggataccgaaaaaacggtctgcccggacatcgggaagaactatgaaggaaagccgaaagaggcatttatga

SEQ ID NO: 1826 - DNA, 308 bp, Bacillus licheniformis
atgaaaaaatttgcatgtgttgtgatcttcctgctgcttgcggcagtgatcgcggggtgcgcggcagactctgatgcgaaaaccattaaaatcggcatcagcggaacggatacgagaatttgggactttgtgaagaaaaaagccgaaaaagaaggcttaaagcttgaaatcgtcaaatactccgactatgttcagccaaaccaggctttggcgagcggcgacattgaccgccaacgcttttcagacgatatcctactttaatgcattcaaaaaggaacgcaacttgaattatcgacggtcggcacaac

SEQ ID NO: 1827 - DNA, 276 bp, Bacillus licheniformis
atggtgcattcgtcaaacagcgccgcgggtctgcgcttcatggaacatctatttaatgccgtccgcttcggcatcggcatgtacggtttggcgccgtctaccgaaataaaacacgagctgccgtttcgtctgcgggaagtgttttcgcttcataccgaactcacccatgtgattaaaattaaaaatagccagagcgttctcttacgggcgacttttactctccccccgaccaatggatcgggacatcccccgtccggtttgccgaccgatggctga

SEQ ID NO: 1828 - DNA, 1110 bp, Bacillus licheniformis
cattattaccgcactcgattcgtacttggttttgctgtccatctttatcggatatcagctgattttgccatcatatgatttatacccttcggaaatgctgctgatgacttcactgatactgcttggcgctcagcatttattcgcccattgcttccacctttataaaaaagtatgggagtatgcaagcatcggtgaattgtatgtgctgcttaaatcgattacattgtcccatcttgtgacggcggccctcgagctgtttttctttcaaaacgttccggttcgtcttttatgtttaagctggctgttccagctcattttgatcggcggatcgcggatgatgtggcgcatcatcagggaacaggtgaacaaagaaagcaaaggatctctaagggcgcttatcatcggagcgggctctgccggcagtttgattgcaaaacagcttgtgcagaagccggaattgaacattaagcccgtcgcctttatcgacgatgacaaaacgaaataccggcttgaaatcatgggtctgcccgtcttaggcgggaaagagcagattatgcaggcggtccggcaatggaatatcgaccggatcatcatcgccattccatctttgagcgtcactcagatgcaggaaatgtacaaggcgtgtgcgcaaacaggtgtcaaaacgcaaatcatgccgaaaatagacgaaattttgcttggcagacatcctgtcggccagcttcgcgatgtcaaagcagaagatttgcttggaagggagcctgtccagctcgatacgagcgaaatctccaatacggtcaaggaccgcgtcgtacttgtgactggggccggaggttcaatcggctcggaaatctgccggcaaatcagcaaatttaaaccgaaatcgatcattttagtcgggcacggagaaaacagcatccattcgatcctgcttgaactgaaggagaaattcggaaagcatgtcgcctattatcccgaaatcgcgggcatacaggacagagaaaaaatggttttgctgatggaacgctacaaaccgaaatgtcatttatcatggcggtggccacaagcatgtaccgctgttggaaaaaatggcccgaaagaagcttgcaa

SEQ ID NO: 1829 - DNA, 763 bp, Bacillus licheniformis
gtgaaaaaggtgacgatcgtcggagggaacggcacggtcggccgcgtattagcgggcggattggcaggcgaagggtatgaggtgacagtgctggatttaaaagaaccggatgacaaacaggctgtccgttttatccgggtggatgcgacagattacaacgaagtcgtcaaaagcattcctgcacagacgaatgcgctgatcaatcttttggctgtaaagccgtcgggcgatttgcttgaccggcaggagtttgcgaaaatgacggatatcttttttaaagcgacatatacgattttgcgggcggcggcggagctcggcgtgccgaaagtggtatttgccagcagcaaccatgtgacagatgtatatgaaaagggcggcgattctctgttggggaggcagatcaacacaaatgactacccgcagtccaaaagcttgtacggcttgctaaaattggcgtccgaaaatctcggctaccttttctcgcaccaattagacgccaaggtttccgtcatcaatctgcggatcgggacagctgctgaaaatgagctagaaacgctgcacgcaaaaccgagaagcaaaaaaacgcttttatcccaccccgacctcatcggaatctttaaagccgctatcaaatccggcaaaacatatggtacatattatgctgtcagcgacaataaggggcggccgtggtcgatcgattccgccattcgggaactggggtacaggccgcaagtcagcgcctctgacatccttgatgaagact

SEQ ID NO: 1830 - DNA, 930 bp, Bacillus licheniformis
atggaaaaagtactagtgacaggcggatgcggatttatcggctcgcatattgctgaacagcttctaaaagaaaattaccgggtttcaattcttgataatttaactacgggacaccgctccaacattgacggtctcccaattgacttttatgagcaggatatcacgaagccggaagtcatcgacgtcatcaaaagcattgatcccgattatattgttcatttagctgcacaagtaagcgtagcggagtctgtcagcgattttttaaatgatgaaaacatcaatatcagaggatcgctccatatcattaaagcagctggtgaatgcaatgtgaaaaagatcgtctttgcatcatcagcggctgtttatggaaatccggattacctgcctgtcgacacccgtcaccaaacaaacccaggctcaccctacgggctgacgaagcttacagtggagaactatttaaaactggcttatgatctatatggaaccgagtattgcattttgcggtacagcaacgtgtacgggccgcgccaggatgcaaaaggagagggcggcgttgtatcgattttctccgatttgctgaccagcggcaaggctccggtaatttttggagacggagaacaatcacgcgattttatttatgtcggtgatgtagcttgtgccaacgtaaaggcgctaaaagctcaatcaaacgtttgtttaaatgtttcaaacggcttttccatcacggtcaatgagctgtttacagagatgaaaaaagcgacgaactctgagctttctccgatttatcaagatgaacggccgggggatatccgccacagcacactgtgtaatgaagaaacaaagaaaatcttaaactgggaaccaaaaatgccgcttgctgaaggactggaaaagaccatttcatattataaaaaagaaatgaatacgtaa

SEQ ID NO: 1831 - DNA, 498 bp, Bacillus licheniformis
aatttgtcgccgtccgcttcggaaatgttctcggcagcaggggaagcgtcattccgattttcaaaaaacaaatcgctaaaggcggcccggtcactgtcacacaccaggacatgacgaggtacttcatgacgattccggaagcttcaaggctcgttattcaagcgggggcgcttgccaaaggaagacagatattcgtgctcgatatgggcgaaccggtcaaaatcgtcgacctcgccaaaaatcttatccagctttccggctatacgacagaacagatcaaaatcgaatttacaggcatccggccgggagaaaaaatgtacgaagagctgctgaatcaaaatgaagtgctggcagagcaggtttttccgaagattcatatcggcaaggcggtcgacgtcgaatggacggtgctgaagtcatttatggatgaatttatgtatttgtcagaccgcgagctgagagaacgcttgttcaaagcgatcggccagcacgagaaaa

SEQ ID NO: 1832 - DNA, 975 bp, Bacillus licheniformis
atgagcgatatgacagagttatccggccagcatattttcataactggcggagcaggctttatcggatcctctttaataggaaagctgatagagcgcaacagcgtcaccgtatatgacaatttttcaagagactccctccggtataagccttaccgggaccatcctcacttgaaagtgctgcagggagacattttggatttgaacgcgcttaaaaaggcgatccagggggccagccacattgtccacgccgccggcatcgctgggattgacacggtcattcaaaacccggttaaaacgatgcaggtcaacatgatcggttcagccaatctgcttgaagcggctgccggtttaaccgaatgcaaaagggttgtctgtttcagtacaagcgaagtgttcggccaaatcgctttcagagcgcgcgagaccagtcatactgttttaggagcggtgggagaagcccgctggacatatgctgtcagcaaactcgccgaggagcatatggcatatgcctattttaaagaacttgggcttccgaccgtcaccgtccgcccttttaatgtttatggaccggaacaagtcggcgaaggcgccatcaaaacgatggttcacagagctctgttagatgagccgatctatattcacggcgatggaacgcaaatccgggcctggtgttacgtagatgacatgatcgacggaattttgcgttgtttgacgatgaaggaagccatcggagagtctttcaacatcggcaatgaacgcactgtgatcaccgtatacggattggcaagcacgattatcagagttctcggatcaaaatcacaaatcttctttggggagaaaaaagaagccgatattgaactgcgcatccctcaggtcaataaagcaaaagagatgctcggtttcagcgctaaagttgatctggaagaaggcatcagaagaacagctgaaagcattaaaaaaaatttggatcaataa

SEQ ID NO: 1833 - DNA, 632 bp, Bacillus licheniformis
atgaaagtgtttgtagtgggggcgaacggacaaatcgggcgccgtttgacgaaaagtttgaatgagagcagcgaacatcaggtcagggcaatggtgataaatgaagagcaggcgcaagctttgaaacaatcgggaacagaaacagcgctcgctaatttagaaggcaccgttgaaagcatcgcagaagcggcggagggctgcgacgcgattgtctttaccgccggctcaggcggcaatacgggcgctgacaaaacgcttttggtcgacttggatggggcggttaaaacgatcgaagccgccgaaaaagcaggcattcgccgctttattatggtcagcacattgcaggcacaccgccgtgaaaattggaatgaagcgttaaagccgtattatgtcgccaaacattatgcggatcggatgcttgaaggcagcgaattaaactacacgattatccgtccgggaggcctgttaaacgaaccgggcacaggccgggtgaaagccgcggaaaatcttgagcgcggaacgattccgcgtgaagatgtggccgataccatcttggcggcgctcaccgaggagcacacattccgtcgttcgttcgatttggtttcgggtgatcaaacgcccgccgaggcgct

SEQ ID NO: 1834 - DNA, 420 bp, Bacillus licheniformis
aaagcggatgtttgaaaataaaacgatattcattactgggggaacaggctcatggggtcaggaactcatacttcagctgctagcctcaagccctaaaaagatcattgtattttccagaaatgaagaaagacaagttcaaatgagaaggcagattgaagatccgaggctgacgtttttcatcggggatattagagatcggaaagcgctcaatacaggattaaaaggtgtcgactatgtcttccatttagcagcgctgaagcatgtcccggtttgtgaagaacagccgcttgaagcattaaaaacaaatgtcacagggaccgaaaacgtcattgaagcagcgatcgaaaacggcgttaaaaaagtcatcaacgtctcgactgacaaagcggccgaccctgccaacttctacggaaagacgaa

SEQ ID NO: 1835 - DNA, 294 bp, Bacillus licheniformis
taccggcggaaccggtacgacagggagccgaatcgccaaaaggctcgtgcatttgggtgccggcgtccggatcgcaagccggagaatacctgcaattaccggagcagaacatgtatattttgactggaatgatcaaacaacttacaaagacgcattaaaaaacacggactcattgtatttggttgcgcctgtcggtgtatacgaaccgtcgccaatcgtactgccttttttggaaatggcatcggcattcggcgtccgccgcattgtcctgctcagcgctgcaattattgatga

SEQ ID NO: 1836 - DNA, 1834 bp, Bacillus licheniformis
gtgacagataaagaaaaacgattactaaggcagtcgagaatccgaaatttctctattatcgcccatatcgaccacggcaagtcaacgcttgcggatcgaatcttggaaaaaacggcggcaatcactcaaagggaaatgaaagaacagctcctcgactcaatggatttggaacgtgaaagaggaatcaccattaaactgaactccgtacagctgaaatatcaggcgaaggacggagaggaatatatttttcatctgatcgataccccgggacacgtcgattttacgtatgaggtttcgagaagccttgccgcatgcgaaggcgcgattctcgtcgtagacgccgcccagggaatcgaggcgcaaacgctggcaaacgtttaccttgcgcttgacaacgaccttgaaatcctgccggtcattaataaaatcgaccttccgagcgcagaacccgaacgcgtccgccaggaagtcgaggatgttatcggtcttgacgcttcagaagccgtccttgcttcagcaaaagcaggcatcggaattgaggaaatattggagcagatcgttgaaaaggttcccgcaccaagcggagatccggaagcgccgcttcaggcgctgatctttgactccctgtatgatgcttaccgcggggtcgtcgcctatatcagagtcgtgcaaggtaccgtaaaagccggtcaaaaaatcaagatgatggcgaccggaaaggaatttgaagtcactgaagtcggcgttttcacaccgaaggccgttccggctgacgaactgactgtcggcgacgtcggattcctgacggccgcaatcaaaaacgtcggagacactcgtgtaggggatacgattacgagcgcggaaaaccctgcacccgaagccctgccaggctacagaaagctgaatccgatggtttattgcggcctgtatccgattgatacagcgaaatacaacgacttgcgggaagcgcttgaaaaacttgagctgaacgattcagccctgcagtacgaagcggaaacgtcccaagctctcggattcggcttccgctgcggtttcttagggatgctccacatggaaatcatccaggagcggattgaacgcgaattcaacatcgatttgattacgacggctccgagcgtaatctacgacgtgtacatgacagacggtgaaaaaatcgtcgtcgataacccgtcaaacatgcctgatccgcagaagatcgaccgggtggaagaaccgttcgtcaaagcgacgatgatggtgccgaacgactttgtcggagcggtcatggaactgtgccagggcaagcgcggccagtttattgatatgcagtaccttgatgcgaaccgcgtcagcattgtctacgaaattccgcttgcggaaatcgtctacgagtttttcgatcagcttaaatcaaatacgaaaggctatgcgtcatttgattacgaactcatcggatataaaccgtccaagctcgtgaaaatggatattatgctgaacggcgaaaaaatcgatgccctttcctttatcgttcaccgcgattatgcttatgaacgaggaaaagttatcgtcgaaaagctgaaagagctcattccgcgccagcagtttgaagtgcctgtccaggcagccatcggtacaaaaattgtcgcccgttcaaccatcaaagcaatgcgcaaaaacgttttggcgaagtgctacggcggggatatttccagaaagcgcaaactgcttgaaaagcaaaaggaaggaaagcgaagaatgaaacaggtcggctctgtcgaagttccgcaggaagcctttatggcagtcctgaaaatggacgacagcggcccgaaat

SEQ ID NO: 1837 - DNA, 1837 bp, Bacillus licheniformis
gtgaaacttcgagaagatcttcgcaatatcgctattatcgcccacgttgaccatggaaaaacgacgctggtggatcagctcctccatcaggccggtacattccgtgcaaatgaaaacgtggctgagcgcgccatggattccaatgatttggaaagagagcgcggcattacgattttagcgaaaaatacggcgattaattataaagatacacgcattaatattttggatactccgggacacgcagatttcggcggggaagttgaacggatcatgaaaatggtcgacggcgttctgcttgttgtcgacgcttatgaaggctgcatgccgcaaacccgctttgtgctgaaaaaagcacttgagcaaaacttgacgccgatcgttgttgtcaataagatcgaccgcgattttgcccgtccagaagaggtcgttgacgaagtgctcgatttgtttatcgagctagatgcaaatgaagaacagcttgaattcccggttgtttacgcttctgcgatcaacggcaccgcgtcagcagatccgaagcagcaggatgaaaacatggaggctttattcgaagcgattgtcaaccatattccttgtcctgtcgataaccatgaggagcctttgcagttccaggtggctctgcttgactacaatgattatgtcggccgtatcggaatcggacgcgtgttcagaggaacgatgaaggtcggacagcaagttgctttaatgaagcttgacggttctgtcaagccgttccgcgtcacgaaaatcttcggtttccagggcttgaagagagtcgagattgaagaagcgaaagccggcgaccttgtcgctgtatcaggaatggaagacatcaatgtcggagaaaccgtctgcccgattgagcatcaagaggcgcttccggttcttcgcattgacgaaccgacgcttcaaatgacgtttgcggttaacaacagtccttttgccggtcgcgaaggaaaatatgtcacggccaggaagattgaagagcggcttgaacagcagctgcagacagatgtcagccttcgagtcgatccgacgccatctcctgacgcatggatcgtgtcaggacgcggtgagctgcatttgtcgattttaatcgaaaacatgcgccgcgaaggctttgaactgcaagtatcgaagccggaagtcatcattaaagaaatcgacggcgttcgctgtgagcctgttgaacgcgtacaaatcgatgtgcctgaagagcataccggatctgtaatggaatcaatgggtgcgcgcaaaggtgaaatgatcgacatgatcaataacggaaacgggcaagtccgcctgattttcaatgtcccttcacgcggattaatcggctactcaaccgaattcctttcccttacacgcggtttcgggattttaaatcatacgtttgacagctatcagccggttgagccggggcaagtcggcgggcgccgccaaggcgtgcttgtctcaatggataccgggaaagcttcagcctacggcattcaaggcgttgaagagcgcggcgtgatttttgtcgagccgggcacagaagtatatgaaggcatgatcgtcggcgagcacaaccgtgaaaacgaccttgtcgtcaacatcaacaaaatgaagcagcagacaaacgtgcgctcagcgacgaaagatcagacggtcagcatgaaaaaaccgcgtatcatgtcgcttgaagaatcgcttgaatacttgaacgaggatgagtactgcgaagtcacacctgaatccatcagattgagaaagaaaattctcgacaaaaacgaacgcgaaaaagcagcgaaaaagaaaaagctggcaggattgtcgt

SEQ ID NO: 1838 - DNA, 1761 bp, Bacillus licheniformis
aaaacaaaggcgttcagctgactgaagaggggatgacaaaagctgaaaaggcatttggcatcgaaaacttgtttgacgtccgccatgtcgccttaaaccatcatattgcccaggcgctgaaagcccatgcggcgatgcataaagacgtcgactacgtcgtcgaagacggtcaggtcgttatcgtcgactcttttacaggccgtttgatgaaaggccgccgctacagcgacggacttcaccaggccattgaagcgaaggaaggccttgagatccaaaatgagagcatgacgctcgcgacgatcaccttccagaactatttccgaatgtatgaaaaattggctggaatgacgggtaccgcaaaaacggaagaagaagaattccgcaacatctacaacatgcaggttgttacgattccgaccaacaagccgattgcccgcgatgaccgaccggatttaatttaccggaccatggaaggaaaatttaaagctgttgcagaggatgtcgcccagcgctatatggtcggacagccggtacttgtcggtacggttgcggttgaaacatctgaattgatatcaaggctccttaaaaataaaggaatcccgcatcaagtgttgaacgcgaaaaaccatgagcgggaagctcagattatcgaagatgccgggcaaaaaggcgcggtcaccatcgcgaccaacatggcgggccgcggaacggacatcaagcttggcgaaggtgtaaaagagcttggcggactggccgtcatcggtacggaacgccatgaatcaaggcggattgacaaccagctgcgcggacgttcaggccgtcagggggaccctggtatcacccaattttatctgtccatggaagatgaattaatgaaacgcttcggcgcagagcggacgatggcgatgcttgaccgcttcggaatggacgattcgacgccgatacagagcaagatggtttcaagagcggtcgaatcttcacagaagcgtgtggaaggcaacaactttgatgcccgtaagcagcttctgcaatacgatgacgtgctccgccagcagcgcgaagtcatctataaacagcgctttgaggtcatcgattccgataacctccgctccatcgtcgaaaatatgattaaagcttcactcgagcgggctgttgcttcatatacgccgaaggaagatctgcctgaagagtggaatcttgacggccttgtggagcttgtaaatgcgaatttccttgatgaaggtggagtggagaaaagcgacattttcggaaaagagcccgaggagattacagagctcatttacgaccgcatcaaaacgaaatacgatgagaaagaagagcggtacggctctgaacaaatgcgcgaatttgagaaagtcatcgttctccgcgaagtggatacgaaatggatggatcacatcgatgcgatggatcagctgcggcaaggaattcatctgcgcgcttatgctcagacaaacccgctccgcgagtatcagatggaaggctttgcaatgtttgaaaacatgatcgcggcgattgaagatgatgtagccaaattcgtcatgaaggctgaaatcgaaaacaaccttgagcgcgaagaggtcattcaaggacagacgacagcccatcagccgaaagaaggcgatgaggaaaaacaagcgaagaaaaaaccggtccgcaaagcggtggatatcggacgcaatgatccttgctactgcggaagcggaaaaaaatataaaaactgctgcggaagaacagaat

SEQ ID NO: 1839 - DNA, 2022 bp, Bacillus licheniformis
atggatatgaatcaatatttagacgtctttattgaagaaagcagagaacatttgcaaacctgtaacgaaaaattgctcgaactcgaaaaaaatccgacagacttgcagcttgtccatgatattttcagagcggctcataccttgaaagggatgagcgcaccgatgggctatgaagacatggctcatttaacgcacagtctggaaaacgtgctggatgcgattcgaaatgaagaaatgaccatcacgtcagagtggatggacgtcatgtttgaagcgctcgatgaccttgaagcaatcgtcctttcgatcatcgaaggcggcgacggcaaaagagatgtttccgaagtctgcgccaagcttgatgtgacaggggcaaacaaggaggcggcagcagcggcagaagcgcctgaagcggcgtcttccgaaacgaaatggtcctatgacgaatttcaacgaacggtcatcgccgaagctgaggaacaaggctttaaatgtttcgaaatcaaagttgcattgaaagaggactgtctgttgaagggcgttcgggtgtacatggtatttgagcagctgaacgaggtcggcgaagtcgttaaaacgattccggaaacagaagtccttgaatcggaggattttgattccgaattcgtcatctgctttttaagcaaacacggaaaagaagagattttcaacaaaatcaacggcgtatctgaaattgaaaaaatagaagtgaccgagctgaaaaacgatttttcggcacaagaagaagcgaagcccgccgcatccgaaaaagaaaccgcaccgaaagaggcggagaaaaaaccggctaagcagccggacggcaaaaaagacgcggcgaaacctgcggcaggcggcggaacgaagacgatccgcgtcaacatcgaccgcctcgattcattaatgaacctgtttgaagagctggtcattgacagggggcgcttagagcagatcgccaaagagctagaacacagcgaattaacggaaaccgtcgaacggatgactagaatttcaggcgacctgcagtcgatcatcctcaatatgagaatggttccggtagaaacggtgttcaaccgattcccgcgcatggtccgccagctgacaaaagaattaaataaaaagatcgagctgtcgattttcggagcggaaacagagcttgacagaacggtaatagacgaaatcggcgacccgcttgtccacctcttgagaaacagccttgatcacgggatcgaggcgcctgaagtcagggtgaaaaacggtaaacctgaaaccggtcaagtccgcctgaaagcataccacagcggtaaccatgtctttatcgaggtggaggatgacggcgccggcatcaaccgcaaaaaggtgctcgaaaaagcgcttgagcgcaacgtcattactgaacgcgaagccgaaacgatcgaagatcatgaaatcgacgcgctcatttttgcgccgggattctcaaccgcagatcaaatctcggatatttcaggacgcggagtcggcttagacgttgtcaaaagcaagctggaatcgttgggcggttctgtcagcatcaaatcgagcgaaggcgaaggttcgcttttctccatccagcttccgcttacactgtcgatcatttccgtgctgttagtcaaacttgaaaatgaaacgtttgcgattccgatttcttctattatagaaacggctgtcatcgataagaaagatattcttcaaacgcacgaccgcgaagtgatcgatttcaggggccatatcgtaccggtggtttacctgaaagaacagtttaatgttgaggattcttcagatgatcttgatcagcttcacgtcatcgtcgtgaaaaaaggagacaagctgacggcatttgttgtcgactcctttatcggccagcaggaagtcgtattaaaatcactcggcgattatttaacaaacgtctttgccatttccggcgcgacgattttgggagacggacaagtagccctgatcatcgactgcaacgcccttattaaatag

SEQ ID NO: 1840 - DNA, 1584 bp, Bacillus licheniformis
tgaatacgtcagacgtgatgattgaaggcaactttacgattcaggaagcaaaagacatggcgagcattttaaatgcgggagctcttcctgtcaaactcgttgaaaagtattcgacatccgtcggagcgcagtttggggagcaggctttgaatgataccgtgtttgcgggaatcattggtattgctattattttcttatttatgcttctttactatcgcttgcctggttttattgcggtcattacgctttcggtctacatctacattacactgcagatattcgactggatgaatgcggttctgacccttccggggatcgcggctcttatattgggcgtcgggatggcggttgacgccaacatcattacgtatgaacgcataaaagaagagctgaagctcggcaaatcggtccgttcggcttttaaagcaggaaacagaagatcgtttgcaacgatttttgatgccaatattacgacgatgcttgccggaatcgtgcttttcatatttggtacaagctctgtcaaaggcttcgcgaccatgctgatcctatccattttgacaagctttattacagctgtcttcctgtcgcgcttcctgctcggcctgctggtcgaaagccgctggcttgaccggaaaaaaggctggtttggggtgcgcaaaaaagacattttggatatcagaaagacagacgaaaatacggagcctccgaacccgttttccaaatgggatttcgtcgggaagcgcaaatggttctttgcattttcgggcgttcttctggccgctggtcttatcgtcttgcttgtgtttaagctgaacctcggcatcgatttctcaagcggatcgagaatcgaagttcaaagcgatcataagctgacaacccagcagctcgaaaaggactttgaacaagtcgggcttgatcctgactcgatcgttctttcaggcgaaaaaaatgatcatggcgtcgccaggtttgtcggcgtgccgaatcagaaaaagatcgctgaagtgaaagattattttaaagacaaatacggaagcgaaccaaatgtcagcaccgtatcgcctaccgtcggcaaggagctggcgagaaatgcgctttatgcggtgatcatcgcgtcaatcgggatcattttgtatgtctcgatccgctttgaatacaagatggcgattgcggctattacttcattgctgtatgacgcgtttttcatcattgccgtcttcagcctgacaaggcttgaggttgatgttactttcattgctgccgtgctgacgatcatcggctattcgataaatgatacaattgtaacgtttgacaggatcagggagcatatgaaaaagcgcaaaccgaaaaccttcagcgacttgtcgcatattgtgaatttgagcttgcagcagacgttcacgcgttcgattaatacggtgctgactgtcgtcattgtcgtcattgcacttctcatcttcggcgctgcatcgatttcgaacttctctgttgcgctgttggtcggacttttgagcggagtatattcatcactctacatcgcagctcaactatggcttgtctggaaagggcgcgaactgaaaaagc

SEQ ID NO: 1841 - DNA, 1986 bp, Bacillus licheniformis
atgaaaaagatattggactggcttaaacgtccgtctatctcaaaaaggctgtttttcagctttatattggttttaactttgccgattttggccttatcctatagtgcgtaccaaacggcgggaagctctcttgaaacggaaatcatgagaagcgcacgcgataatgtcgaacagctgaatgagatcatagaccagaatatcggagagaaagaagaggccgtctcctttttcagcggcttggtaaatgaaaagctttatcaagaaaaagagaacgcatcactcgtagaaagactcgagcagtacgccaagctgaatcaggatgtggaagcgatctacacaggttcaaaagacggcaagttcatccgatatcccgccgagaaaatggcgaaaggctataacccggcggacagggactggtataagcaagccgttgaaaataaaggaaaggtgatcatcacaaacccttataaaacagcgtcaaccggaacgatggtcattacgattgcgaagcagacggaggacggctcaggagttgttgccgtcaacatgaaaatcgatgagcttatcaaagcgacagagcgcgtcaacatcggaaaaagcggctttgcgtttatttcaagcaatgacaaaaaatatgttgcccatccgacaatcgaagccggaaccgaaggcaaaggcgactgggttggacaaatgtacggcagtgagaaaggcgattttcaatatacatttgaaggaaaagaaaagaaaatggcttttacgacgaacaagctgaccggctggaaaatcggcggaacgatgttcacagatgagatatcagaggccgcccagcccgtcttccacatggcgataatcattttggcagcggcgatcgtgctcggcggcattctcatctactttattatccgcggaatcagcaagccgttaagcgagctcgtgtcatccgcaaagagcatcagcggaggcgatttgacgcaaaaaatcgaagtccgttcaaaagacgaattcggtcagctcggtacaagctttaatgaaatggccgaatcgctgagatctttaatcagcgtcatccaatcatcagttgacaatgtagcttcttcatctgaagagcttcatgccagcgcggcgcagacaagcaaagcgactgagcatattacaatggccattgaacaattttccgacggaaatgaaagccagaaagaaaaagtggaagcgagctcgcatcagctgaatgaaatgaacaacgggttatatgacatgtcaaaaacatcagctgcgattaccgatgcgtcgctgaaatcgactgagattgccggcaaaggagaagagcttgttcaaaagacggtcggccaaatgaactcgatcgatcggtctgtcaagcaagcggaagcggtcgtcaaaggacttgaagccaaatccaaagatatcacaagcattttgcgcgtgattaacggaatcgccgatcaaacgaatctgctggcgctcaatgccgcgatcgaagcggcaagggccggggaatcgggccgcggcttctcggtagtggctgaagaagtcaggaagctcgccgcacaatccgccgactcggcgaaggaaattgaacatttaattcaggaaatcgtcaaggagatcgacaactctttgaacatgttcaaatcggtcaatcatgaagtacagtcagggcttcgaatcaccgatgaaacagagacaagcttcaaaacgatttacgatatgaccaatgatatcgcaggaaagctgcagaccatgaatgccgctgtcgagcaattgacgcaaggttcccgccaagtcgcgggcgcggtcgaagaaatcgctgatgtatcgagagaaagttcggcaagcattcaggacatcgctgcttcagccgaggagcagcttgcctccatggaagagatcagcgcctcctccacgacattggcggagctggctgaagaactgcgtgatttgacacagaaatttaagattgaatag

SEQ ID NO: 1842 - DNA, 1601 bp, Bacillus licheniformis
atgatttcttctacggtgaaaaagaatgaagaacttaaggacaagatggaatttcaaaaagagattaagcatattcaataccgtctgaccggcttgtcgaatgacgagagagcccttattatgaccggagacgatgaatacagtgaaggaatgaaggacaaggccgacgatgttttaaagagtcttgaccgggccggaaaactgatccgggaaaaatcatacaaagcgaacgtcgaagaaattaaagaaaacttcaaggcttattgggatttaaatcaacaagtcatgcagacttacgcttcaagccttaaaaaagcggaatcgatccatttcggagaggaaagaacattaagaaaagatgtcctcgatccgtctgtcaatcagctggtcgaaagcctggaacaagaggtggatgatctgaaagcagagatcagagccaatgggacgatgagcgaatgggtcatcatcgctgtcacaggagtatcagcgatattgggaattgttttgagtctgctgctcttgaagtctattctggtaccgttgagaagcctgaatcagcagcttgaggacatcgcccacggcgaggcggatttaacgaaaaaagtgatcgtcaaaaataaagacgagttcggccagcttgccaattctttcaatgcttttgtccagtcgctgacgcaaattgtgaagcagatcagcagctcgtctgagcaagtcgccgcatcctctgaacagttgtccgcaagcgcggaggaatcgaaatcgacttccgaactgatttccgaagagatgcaggcgatcgccgacagcaacatgacgcaaagcgaaatgacagaaaagagttcagaagcaattcatgaattgctggaccgtttatcatccgttgcctccaatacaggcagcatagcggatctgtcgtcttcgatgagagacaaagccgaaatcggctccgagtccgttcataaaatgctcgaacaaatgaacttcattgataagtcagtcgactcggccggcagcggcctgcaggcgctcgtgtccagcacggcggaaatcagcaacatttcttcgctcatcaccgatatttcggagcagacgaatttgctggcgctgaacgcggcaattgaagcagcaagagcgggagagcaaggaaaagggtttgccgtcgtggcggaagaggtccggaaattggcggacgaaacgaataagtcagcgagccacattcaatcattggtcacaacgatccaaaatgaatcggtagaaacggtaaataatattaaagtcgttcaagaaaatgtcagctccggtatagctttgtcgcaggagacgaccggtaatttcaacgaaattttaaacttggtggaacaggttgcttctcaaatccaagaagtcgcggcttctactcagcagctgacatcaggtgtcgaaatggttcaaaacaccattcaaacattggcttccggatcacaggaaacgtcagccagcacaaaagcggttgcttcctcaacccaggagcagctggcttcaatggaagaaatctcatatgcagcggaatcgctgtcccaattggctgaagaacttcaaaccattatcaatcgatttaaata

SEQ ID NO: 1843 - DNA, 1986 bp, Bacillus licheniformis
atgaaaaaaatattggaatggttcaagcatccatctctttcaaaaagattagcggtctcatttttattgattttaacgctccctgttttaatcctttcaggtgtttcctattatacggcaggcgggtcgattgaagatgaaatcatgagaagcgcaagaaacagcgtggatcaattaaacgaaatgatcgatcaaaacattgagaaaaaagcggatgctgttacatatttcagtgaagagatcaaagaaaaaacatacaaggaaaaaggccagacttcgttaagacaaaagtttgaacaatacgccaggcaaaacaaagatgtagaagccgttttcacaggctctgaagacggtgtatacgtgcagcacccttatacgaaaatgcctgacggctataatccggcggaaaggccctggtttaaagaagcggttgagaaaaaaggcgaaattatcgttaccgatccatacacatctgccgctaccggcaacacggtcattaccatcgccaaacaaaataaagacgggtcgggcgtcgctgcgctcagcttgaatatcgacgagctgattaaagcgacaaacgatatcaaagtcggaaaagacggctttgcttttatctcaagtgcgtccaaaaaatatatcgcccacccgacgattaaagccggaactgaaggtgaaggcggctgggttgatcaagtttacggcaaaggaaaaggcgaattcaagtatacttttgaaggaaaagccaagcaaatggcttttacgacaaacaaactgacaggctggaaaatcgccgggacgatgttttccgatgagataacaaacgcaacaaagcccgtcctttatatggctctcatcgtcttttcaggggctttggtgcttggcggagttctcattttctttattgtccgcgcgattagcaaaccattgaatcagctcgttctatctgcaaagaacatcagcagcggcgatttgacacagcaaatcgaagtgcgttcaaatgacgaattcgggcagctcggcaaaagcttcaatgacatggcggaatcgctccgcacactgatcggcaccattcaggaatcggttgagaatgtcgcctcctcttctgagcagctgacagcaagcgcagaacagacgagccaagcgacagaacatattacatctgcgatcgaacagttctctaacggggctgaaagccagaatgaaaaagtcgaaacgagctcgcagcagctcagccagatgaatgatcatctgagcgaaatgaccgaagtgtcggaatcaatcaccgaagcatcgatcaaatcgacagaaatcgccgaaaccggaggagaactcgttcagaaaacggtcggccagatgagttcaatcgaccaatctgtcaaacaagctgagagcgtcgtcaaaggcctcgaaggcaaatcgaaggatatcacatcaattctcagggtcattaacggaattgccgatcaaacgaatctattggcattgaacgccgcgattgaagcagcccgcgccggcgagtcaggcagaggattttccgtcgtcgccgaagaagttcgaaagcttgccgcgcagtcagcggactcggcaaaagaaatcgaagcgttgattcaggaaatcgtcaaagaaatcgaacattctctcagcatgtttcaatcggtcaaccatgaagtgcagtccggacttaaaattaccgagaaaacagagtcgagctttcacgaaatcagcggcatgacgaatgagatcgcaggcaagctgcaaacgctcaatgcggcggtcgaacagttgtcgaatggctcgcaggaagtctccggtgccgttcaggaaatcgccgatgtatcaagggaaagtacagctggaatccaggacattgctgcatcagcggaagaacagctggcttcaatggaagaaatcagtacatcctctgccacgcttgagcagatggcggaagatctgcgagaattgacgaaaaaattcaaggtgaaataa

SEQ ID NO: 1844 - DNA, 1113 bp, Bacillus licheniformis
gcggtgcattgttcaacttctcccatcttgcgatgggaatcatgccttacatcacagcttctatcatcatccagctcctgcagatggatgttgtgccgaagtttaccgaatggtctaagcagggggaagttggtcgccgaaaactagctcagttcacaaggtacttcacgatcgttcttggatttatccaggctttaggtatgtcttacgggtttaacaacatggccggcggcgcgttgattacagacccgggagtcggtacttatttgcttattgcgattgtactaactgctggaactgcttttttaatgtggctgggagaacaaattacgtctcatggagttggtaacggaatatccattatcatcttcgccggtatcgttgccggtattccgcagacgattaatcagatctacgctcagcagtttgtagatgctggagatcagttattcttgcaaatcataaaggttgtcgttatattggttgcgattttagcgattgtcgttggcgttattttcatccaacaggcggttagaaaaatctcaattcaatatgcgaaaggttcaggccgttcaccggttcctggcggccagtctacacacttgccgctgaaggttaacccggcgggagttattccggttatctttgccgtagcatttatcaccactccgcggaccgtggcaacattctttggctccaatgacgtcacgaattggattcaaaaaacgtttgattacacgcatccggtcggaatgggagtttatgcagcattgatcatcgcctttacctatttctatgcatttgtgcaggttaaccctgagcaaatggccgataatcttaaaaaacaaggtggctatattccgggagttcgtccaggaaaaatgactcaagatagaattacgagcattttgtatcgacttacatttgtaggctccatattcttggccgtgattgccattcttcctgtcttgttcgttaatattgctgggctgccttcttctgcacaaattggtggaacaagtttgctgattgtcatcggggttgcacttgaaacaatgaagcagcttgaaagccagctggtaaaacgaaactatcgtggatttatgaagcact

SEQ ID NO: 1845 - DNA, 1275 bp, Bacillus licheniformis
attcctacaaacgatacggaaaagtcaaacaggcggtcggcctgatgattgaatccaaaggacctgaatgttcaatcggcgatgtctgcaaaatctatacaaaaggtgacgggccaaaggctattaaagctgaagttgtcggcttcaaagaccaaaatattcttctgatgccatatttggaagcggccaatattgcccccggcagcattgtcgaagcgacgggcgaatcgcttagggtcaaagtcggctccgggttgatcggacaagttgtcgatgcattcggcaatccgctcgacggcagcgtgcttccgaaaggtctggctcaagtatcgacagaccaggcgccgcctaatccgatgaaaaggccgccgatcagagaaaaaatggcggtcggcgtcagatcgatcgacagtctgctgaccgtcggaaaaggacagcgtgtcgggatattcgccggaagcggcgtcggaaaaagcacgcttatgggaatgattgcgagagagacggccgcagacttgaatgtcatcgctcttgtcggagagcggggccgggaagtcagggagttcatagagaaagatctcggcgaagaagggctgaagcgaacgatcgttgtagtggctacatctgaccagccggcgctgatgcgtctgaaagcggcctatacagcaacagcgattgccgagtacttccgcgacaaaggacaaaacgtcatgttcatgatggactcggtgacaagggtcgccatggcccagagggaaatcggcctggcgacgggcgaaccgccgacgacaaaaggttatacaccctcagtgttcgctattttacctaagctcttagaacgaacaggaacgacggaaagcgggtcaataactgctttctatacggttcttgtcgacggcgatgatatgaatgaaccgatcgccgatactgtaaggggaatcttggacggccatatcgttcttgaccgagcccttgcgaataaaggccagtttccggcagtcaacattttaaaaagcatcagcagggtgatgtcgaacatcgccgagaaagaccatatcagagcagcgaaccggttcagggaaatgctgtcaacctatcaaaactcagaggatctgatcaacataggagcctataaaaaagggtcttccagagaaattgatgaggccatacaattccaccctaagctgatcagcttcctcaagcaggaagtggatgaagcggcatcgctggaagagagcatttccttattaaagagtcttacaggaagagaggatt

SEQ ID NO: 1846 - DNA, 1524 bp, Bacillus licheniformis
atgacaaatccaacttttttagggctggaaatcgcaaaaagaggcttgtccgcgcagcaatcagctctgagcgtgacagcaaacaatatatccaacgccaataccgaagggtattcaagacagcgtgttacatttaaagcatcaaccccttatccgtccgtatcaagagactctgtcggacttgcaggccagatgggtacaggcgttgaaatcggttcggttgaaagggttagggacagctttctggactatcaatacaggacgcagaatacaaaggccggctattacaatgcaaaagtggacgcttttaaccaaatggaagggattatgaatgaactgaacgacaccggactaaacaaagttctgaattcattctggaattccattcaggaattgacgaacaacgcccacgaaccgagcgctgcttctgttgttgcgcaaaaagggcaggcggtcgccgatacatttaacactctgtatgaatcgctgacaaccgttcaatcaaatttaggcgaccagattgatcaaaatgtgatgacgattaactcgcttttgtcccagctgaacagcttgaacgagcaaatcgccaaagtcgagccgaacggctatctcccgaacgatttgtacgataagcgtgatcagctccttgatgaactgtcttcaatggttaatatcaaagtcagctatgcgaaaaccggcggcaatccactcgcaaccgctgaaggcattgtgtcaatagaagtccttgacgtaaacggccagtctctgggcaaggttcttgacgggccaaacttcacgactgaaactgtcaaagtgaattacgacaacgatacaggccttgtgacgggcgtttccctcggcgggacggacatcggcatcgattcgtttactagcaaagggtccctgctcggtttaatcgaatcttacggatatatgtcaaacggtgaagaaaaaggtttgtatcccgaaatgctcgcagatctggatacgatggcgcttgcttttgcgaaagagtttaatgcagtccatcaaagcgggtttacttcatcgggagaaccgggaggcattttctttgaatttaccggaggagaggctgagcctgcaaagggagccgccggcaaaatcaaagtagccgatgagatcatgaattcaaaaggcgataaagtcgccgcatcgctgaatggtgaagcgagcgacaacgccaacgcgacaaatctcgctaatgtcttcaccaagaaaattcaaatcggtgacaaaacgacgaccgttttagactattacgcaggcatcatcggtgaaatgggcgtaaaagctcaggaaacaaacagactggccaaaaatacagaaacgcttgtaaacactgctgaattgaacagacagtctgttagcgccgtatcattagacgaagaaatgtcgaacatgatccaattccagcatgcttataacgcggctgcgagaatgattacgctgcaggacgaagtcctcgataagattattaacggcatgggtgtcgtgggaaggtag

SEQ ID NO: 1847 - DNA, 1136 bp, Bacillus licheniformis
atggcattcgaaggattagccgaccgactgcagcaaacgatctcaaaaatccgcggaaaaggaaaggtaacggagcaagacgtcaaagagatgatgcgcgaagtccgtttagcgctccttgaagcggacgtcaattttaaagtcgtgaaagattttgtgaaaaaggtaagcgaacgagctgtcggacaagacgttatgaaaagcctgacgcccggacagcaggtcattaaagtggtaaaagaagagctgacggagctgatgggcggcgaggaaagcaagattgccgctgcaaagcgtccgccgaccgtcatcatgatggtcggtctgcaaggggccggtaaaacgacgtcgaccggaaagcttgccaacctgcttcgcaaaaaacataaccgcaatccgctgctcgtggcagcagacatctaccgcccggcggcgatcaaacagctggaaacgctcggcaagcagctcgatatgccggtattttcactgggtgacaaggtcagtccggtggagattgccaagcaggccatcgaaaaggcgaaagaagatcatcacgactacgttctcatcgatacggcgggacgccttcatattgatgaagagctgatggatgagcttgagcaggtaaaagaaaccgctcagccggaagagattttccttgtcgttgactccatgacgggtcaagacgcggtcaatgttgccaaaagctttaacgaacagctcggtgtgacaggtgtcatcttgacgaagcttgacggcgatactagaggcggagcggccttgtcaatccgcgccgtgacaaacacgccgatcaaattcgccggaatgggcgaaaagcttgatgcgctggagccgtttcatcctgaacggatggcttcgcggatactcggaatgggcgatgtgctcacccttatcgagaaagcccaggccaacgtagacgaagaaaaggcgaaggaactcgagcaaaaaatgaaaaatatgagctttacgctcgacgactttttggaacagctcggacaggtccgcaatatggggccgcttgaagacctgattcaaatgatgcccggcgcaggcaaaatgaaaggcttaaaaaacgtgaaggttgagtaaaaacagctcagccatatcgaagcgat

SEQ ID NO: 1848 - DNA, 1482 bp, Bacillus licheniformis
atggcgatcagaatatcaggattagcttcaggtatggatatagacgacattgtcagcaaattaatgaagacggagcgcgtcccgcttgataagcttactcaaaagaaacagactttggaatggcagcgcgacagctatcgtgaaatcaatacgaaaattaaagatttgcaggaatccatcaaccttatgctccgtcccagcacgtacggcgcgaaaaaggtgacaagctctgacgagtcggcggttacggcaacaggcaccacgaatgcggcgtcaggcacgatccaagtcaacaagctggcgactgcggccacctataaatcttccagcctttcagggtataccgggagcgatcaaacgctaactttccaagtgacagcacctggagaaacgactgcgaaaaaagttgaaatcagcgtcagcagcacggatacgctggatgacatcgtttccaaagtcaacaaatcaaatttgggcgtaaccgctatgaaagaaaagatttataacggttctgaatatgtagaaacgatcgctttcacatcaaaagcaaccggcgcagggggcagcatacaggcagctgatgatgcgacggcgagctttatgtccaatcagctcggatttgcgcttgatgccgacaacaagctgacagccagccaagccggccaaaacgccgaagttgtcatcaacggattgcagattgagaagacaacgaacaactttaccgttaataatgtgacatatcagttgaagaatacgacaaacagccccgtttcgcttgatgtagcgactgatgttgacgggatttatgaaaagattaaagactttgtcacacagtacaacgaactgatcgatatggtcaacggcaagctcacggaaaagaaataccgcgactatacgccgctgacagaagaacagaaaaaagatatgacggaaaagcaaattgagctgtgggaagaaaaagcgaaaagcggattgttaaggggcgacacgattttaagcggcgccaccaatcaaatgaggacagatttttattcgaatgtctctgtgaacggcgaatcgctgcagctcactcagtttggaattacgacatcaagcgtatacagtcagcgcggtcatttagagatcaacgaagaaaagctgaaagcgaaaattaaagaagaccctgacagtgtggcaaacctctttatggcgggaacgagcagcacggaaaattacaatgaaaaaggcatcatgagacgccttcagacggttttgaccgatacgaagaagcagattgaagataaagccggaaattcagcaatggcaaacaatcaatttacaatcgggaaaaacttgaatacagttgaatctgatatttcgtccatgaataaccgcctgacacaaatcgaaaatcgctattatacaaagttcacggcgatggaaaaagcgattcaaaaaatgaatgaacaatcgacatacttggcgcaattgcttggacaataa

SEQ ID NO: 1849 - DNA, 1017 bp, Bacillus licheniformis
atggcaaaaatgaaacaagacaggcttacaggcaaacaaaaagcggccattctcatgatatccttagggcttgatgtgtcagcttccgtttacaagcatttaacagatgaagagatcgaaaggctgacgcttgaaatatcaaatgtcagagctgtatcacctgagaaaaaagatgagattattcaggaatttcatgaaacggctattgctcaagaatatatttctcaaggcggcattcattacgccaagcaggtgcttgacaaagcgctcggcgaagacaaagccgccagcattatcaacaggctgacatcgtctcttcaagtcagaccgttcgattttgccagaaaagcggatcccgagcagattctgaactttatccagcatgagcacccgcagacgatcgcattgattctgtcttatctcgatcccgtgcaatcgggtcagatattgtcagagctgaatcaggatgtgcaggcagaggttgcaagaaggatcgctgttatggacaggacgtcgccggaaatcatcaatgaagtcgaacagattctggagcaaaagctatcgtccacattcactcaggactacacgcagaccggcggtatcgaagccgtagtcgaagtgttgaacggagttgacagaggtacggagaaaacgatccttgacgcccttgaaattcaggatcctgagcttgccgacgagattaaaaagcggatgttcgtctttgaagatatcgttacgcttgataaccgcgctattcaaagggttatccgcgatgtggaaaacgacgatctgcttctttctctcaaagtggccagcgaagaggtcaaagacatcgtcttcagcaacatgtcgcagcgtatggctgaaacatttaaagaggaaatggaattcatgggccctgtgcgtctgcgtgacgtagaagaagctcaatcgagaatcgtaagcgtcatccgaagacttgaagaagcaggtgagatcgtaatcgccagaggcggaggagatgatatcattgtctaa

SEQ ID NO: 1850 - DNA, 1289 bp, Bacillus licheniformis
gtgttattcaaaaaggatagaaagacagaacgatcattttttgctggggaaagccctgaccaaacaaaaagaatcaggctcaatcagcacgcagaatttaaaaaacagctggcaatggtcgatttgacggatgaggatctttgggtgctgagcaggctgaagcccttagtcactgaacatattgaaaccatcgtcacccgattttatcaaaatcttgagcatgaaagctctctcatggagatcatccatgacaacagctcggtcgaccgtctcaaaaagacattgacgatccacatccaggaaatgttttcaggcgtcatcgacgaagcctttttagaaaaaagaatccggatcgcccacgttcatcttcgcatcggactgttgccaaagtggtatctgggggcatttcaagatctccttctttcaatgctgaagatctttgaaaacgccttatccgatgaggaatacaggcggtctgtcaaagccgtcaccaaaattctcaacatcgaacagcagatcgtcctggaggcctttgaagacgaacacgcgagactccgcagacttgatgaagaaagcaaaaatgaacttcacaggcaaattaaagatacttccggttctttggccgctatatttgccgaaacgacgggcgccgtacaggaattggtcgacaaatcttccgagatcgccgaaacgtcaagagccggaacgaagacagccgtttctgtcgaacaaaaatcgatcggcggaaaaaaggagcttgaggaacaggaacagcagctgaatcaaatgggaagcagcatgacgcaaatcgagcaggaaattaaaaagctggaagaaatcgcgctgcagatcgaaaagatattcggcatcgtaacaggcattgccgaacagacgaatttgctttcgctcaacgcctcgatcgaatcggcaagggcaggagagcacggcaaaggtttcgcagttgtcgcaaacgaagtcagaaagctgtccgatgatacgaaaaaaaccgtctccaccgtatcagagctcgtcaataacacaaacgctcaaatctcgatcgtcacgaagcatattacagatgtaaatcagcttgtgaacgaaagcaaagacaagatgtcggagatcaatcgcctattcgatgatatcgtctccaatatgaaaacgagcaaagagcaaagcggccgaatcgaaggcgacctgcagtcgtttttaagcggccttcaagatgtcaatgccgccgtatcacaagtcgcagtttcagtcgattctctcgtagagctgacaaaaaa

SEQ ID NO: 1851 - DNA, 1078 bp, Bacillus licheniformis
atgaagctgacgttggatttgcaatttttcgcaggtgaaaaaacggaaaaagcgacgccgaaaaaacggcgggaaagcagaaaaaaaggtcaggttgccaaaagtgcagatgtcaatacggcggtcactcttctcatcgtgtttttatcctttttattcatcggaccttttatgagagaccgcctgctcggcctgatcgaaaagtattacaaagaattaatcacgatgaaggtgtcagtcgccaatattcccggcctgtttcaaagtgttgtgcttgaatcgggcctcattatggcaccgcttttgctgacagccgtcgtctctggggtattgagcaactatatgcaagtcgggtttttatttgcccctgaagcgatcaagcctgatttgaaaaagcttgacccgcttaatggattcaagcggatttacagcatcagggcgatcgttgaactgcttaaatcgattttaaaaatcgtgattgtcggaggcgtgacattcgccgttttatggctgaactttgacaaaattctcagaatcccggcgctgtcggctggcgaggctttgtcatatgtcggctggctcacctttttaatgggggtttccgctgcagtcgcattaatttttctcgcggtgctcgattacctctatcaaaaatttgactatgaaaaaaatattcgcatgtcaaaacaggacatcaaagacgaatacaaaaaaaccgaaggcgatcctctgatcaagtcgaagatcaagcagaagcaaaaggaaatggcgatgcgccgcatgatgcaggaagtgccaaaagcggatgtcatcatcacaaacccgacccattacgccgtcgcattgaaatacgacgaaaacaaaatggatgcgccgtttatcatcgcaaaaggggtcgatctaatggctctgaaaatcaggcagatcgccaaagaacacgatgtcatgacggtcgagaacaggcctttggcaagggcgctctatgaccaggttgagatcgaccaggccgttccggaagaattctttaaggccgtagccgaaatcctggcctatgtttacaaaacaaagcaaaaaatct

SEQ ID NO: 1852 - DNA, 987 bp, Bacillus licheniformis
atgagcttttttaaaaaactgaaagaaaaaatcacacagcagaccgattcggtctcaggcaaatttaaagaaggcctggcgaaaacgagaaatacgtttcaggagcgggtcaatgagcttgtctcccgctaccggaaagtggacgaggatttttttgaagagcttgaagaggttctgatcggcgctgatgtcggcgttgcgactgttatggagctgattgacgagctgaagagcgaggtcaagcgaagaaatattcaggacccgaaagaggtgcagtccgtcatttctgaaaagctcgttgaaatctatgaaggcggggagcaggaagcatcagagctccgcgtcgaagacggccgcctaaacatcattttattcgtcggcgtcaacggcgtcggcaaaacgacgacgatcggcaagcttgcccatcaattcattaaagaaggcaaaaatgtcgttcttgctgccggagatacattcagggccggcgcgatcgaccagcttgaagtgtggggagagcgcgtcggcgcgcatgtcgtcaaacaggcggaaggctcggatcctgcagctgttatctatgacgccgttcaagccgcgaaagcgcgcggcgccgatgtcctgctttgcgacacggcaggacgcctgcaaaataaagtgaacttaatgaaagagctagaaaaggtaaagcgcgtgattcagcgcgaagtgcctgatgcgcctcatgaagtgctgctcgtactggatgcgacgacagggcagaacgcaatgacacaggcgcgcgaattttccaaagcgactgatgtctcaggcatcgtgctgacgaagctcgacggaacggcaaaaggcggcatcgtcctcgccatccgccatgagctgcagattccggtcaagtttgtcgggctgggggaaaaaatggatgacctgcagccgtttgaagcagagtcatatgtatacggcctgttttccgatctgatcgagaaagaagagtag

SEQ ID NO: 1853 - DNA, 958 bp, Bacillus licheniformis
atgtctgcaagagatttatctattttatccggcgttgtcctcattgtggcaatgcttatcataccctttccaacatggatgttgagcatcttaattatcgttaatatttctcttgcgttaatcgtgcttctcaccacaatgaacatgcaagaaccgctgcaattttcgatttttccttctttgctgctcctcttgacgctgttccgccttgggctgaatgtatcgacgacgcgttcgattctgtccaacggtgatgcgggaaaagtagtcgagacgttcgggtctttcgttgtcggcggaaacgttttggtcggtctcgttgtctttatcattttgatcattattcaatttatcgtcataacgaaaggggcggaacgggtatctgaagttgctgccagattcacgctcgacgccatgccgggaaaacagatgagcattgatgccgatttgaatgccggaatggtgaccgagcaggaagcgaaggtgcgccgtgagaaggtggcccgtgaagccgacttctatggagcgatggacggagcgagcaaattcgtgaaaggggatgcgatcgcagggatcatcatcgtccttatcaacgtcattttcggaattgtcatcggcatgctgcaaaaacaaatgagcattcaggaagccgcttcacactttacactcctgtctgtaggcgacggaatcgtatctcagctgcctgcgctcttgatctcaacggcgacgggtatcgtcgtgacaagagcggtgtcggacggaaacctcggtttttatattacaggccagctgtttgcctatgcgaagcttttgtatgttacggtgggaacgattatactgctcggaattgttacgccgatcggtatagtgctgacaggacctctggctcttattctcgctcaaggcggatatgtgctctgttgatgcgggggttaaaatgaaattgtggttgatttat

SEQ ID NO: 1854 - DNA, 1053 bp, Bacillus licheniformis
cgatcgaatcattaagcggaagattaattgacgaggcatatagaatgaaggcgtcagacattcatattgttcccggtgaaaaagaggcggtggtacgcttcaggattgatgacgaactgtttcaaaaagacggattaacgagaaatgagtgctctagactcatttctcactttaaatttctttcttcgatggacattggcgagagacggctgccgcaaagcggggctttaactctttatatcaaccgtgagcccgttcatttaaggatgtccactctgcccaccatccatgatgaaagcttggtcatcaggcttcttcccaagatgagcagcaagccgctcacaaagctctcattgttcccgagtgcaacattcaagctgctgtcttttctgaagcattcccacggattaatgcttttcaccggcccgacaggctcgggaaaaacgacaacactctattctttaattgactacgccaagcggcattttaagcgaaatatcattacgttggaagacccggtcgaatcaagaagcgaaaacattttgcaagtacaagtgaacgaaaaagcgggcatgacttattctgcggggttgaaggcggtgctgcgccacgatccggacatgatcatcctaggggaaattcgcgatgccgaaacagcccaaatcgcagtcagggcagctttgacgggacaccttgttctatcgagcatgcatgcgaaaaatgctaaaggtgcgatatacaggctgctcgagctcggcgttgatatgacagaaattgaacaaacattggtcgcagtcagcgcccagcgtcttgtcgatatcgtctgtccgttttgcggcgacagctgcactttgtattgcagattgtcgagaccagttagaagagcaagcgtctttgaacttttgtacggaaaaagccttaatctctgcatcgaagaagcaaaaggcagatgcggtggcatcaaaacagacaccttaaaaatgctgatccgcaagggaatagcactcggatatctgccgtcgaaaacttatgaacgctggataggccatgaag

SEQ ID NO: 1855 - DNA, 933 bp, Bacillus licheniformis
atgagaatcaaccacaacattgcagcgcttaacacgctgaaccgtctgtcagcaaacaacggcgcaagccaaaagaacatggagaagctttcttctggtcttcgcatcaaccgtgccggagatgacgcagcaggtcttgcaatctctgaaaaaatgagaggacaaatccgcggtcttgaaatggcttctaagaacgctcaagacggcatctctcttatccaaacagctgaaggtgcattgactgagactcactcaatccttcaacgtgttcgtgaactagttgttcaagctggaaacactggaacacaacaaactgaggatttaacagctatccaagacgagatcaaagcattaaaagacgaaattgacggcatctcagaacgtacggaattcaacggtaaaaaattgttggatggtactttcaaagcaccagcagatccagcaaacccagctgcaggtgaaaaatctttagttttccaaattggagctaacgcaacacaacaaatttctgttaacattgaaaaaatgagcactgatgcattaggagtcaaagatcctgcagatactacgggcagaactctagtaaccaaccaatcagttaaagatatcgatgtaactaaatttgctgataatgcagcaactgcaacagatgtaggttttgatactcaacttaaaatcgttgattcagcgatcaaccaagtatctgcacaacgtgctaaacttggtgcggtacaaaaccgtctagagcacacaatcaacaaccttggtgcttcttctgaaaacttgacagctgctgagtctcgtatccgcgacgttgacatggctaaagaaatgagcgagttcacaaagaacaacattctttctcaagcttctcaagctatgcttgctcaagcgaaccaacagccgcaaaacgttcttcagttgcttcgttaa

SEQ ID NO: 1856 - DNA, 1029 bp, Bacillus licheniformis
tcagcggcggcgatctgacgcaaaaaatcactgtccgctcaaaagatgaaatcggacagctcggaacaagcttcaacgatatggctgaatcgctgagctctttaatcagcgtcattcagacatcggttgaaaacgttgcttcttcgtcagagcagctgaccgcgagcgcggatcagacaagcaaggcgacagaacatattacatctgcgatcgaacaattttcaaacggaaatgaaagccaaaatgagaaagtggaaatcagtgcgcagcagctgactgacatgaacagccgattgcatgaaatgtccaaagtctcagcatcgattacagaatcatccattcaatcgacggacattgccggtacaggcggagagcttgttcaaaaaacggtcggacagatgaattccatcgatcattccgttaaacaggcggaatccgtcgtgaaaggacttgagagcaaatcaaaagacattacggcgatcctgcgggtgatcaacggcatcgcagaccagacgaatttgctcgcgttgaacgcggcaattgaagcagcaagagccggtgaagccggaagagggttttctgtagttgccgaagaagtgcgcaaactggctgagcaatccgcgtcatcggcaaaagaaattgaagcgctcattcaggaaatcgtcaatgaaatcggaaagtcgctggacatgttccgggacgtcaaccgtgaagtacagtcgggactcaccatcacagatgaaacagatacaagctttaagcagatttatgacatgacaaacgaaatcgcgggcaagctgcagacgatgaatgcggcagttgaagagctgtcagaagggtcacagcaagtcgcgggagcggttgaagaaattgcagacgtatcgcgtgaaagctcaggaagcattcaagacattgccgcttcggctgaagaacagctcgcttcaatggaggaaatcagttcttctgcggctacgcttgaacaaatggctgaagaactgcgcgatttaacgaaaaaatttaagattgact

SEQ ID NO: 1857 - DNA, 999 bp, Bacillus licheniformis
aaaacgtgccgaaccttgacccgaaaaacatcgtgatcatggatcaaaactccacatattacgatcaaacaggcaaagagtccggttcttacgccgacagctattcttcccaaagggaagtcaaggcccagatcgaaaaggacctgcaaagacaaatccaaaccatgctcggcacgatgatgggacaggataaagtggttgtatccgtcacatctgacatcgatttcacaaaagaaaacaggacggaagacctggttgaacctgtcgacaaagaaaatatggaaggaatcacggtcagcgcagagcgcgtcagtgaaacatattccggacagggagcacaagcgggaggcgtcaacggaacaggtgaaaacgatgtaacgaactatgctgaaacagaaggcggaacaggcaacggagactatgagaaaagcgaagaacgaatcaacaatgaagtcaacagaatccataaagaaatcgctgagagcccgtacaaaatcagagatctgggcgtccaggtcatggttgaaccgcctgatgcaaacaacccgcagtcactgcctgctgaaagggaggacgatattaaaaaaatcctctcaaccattgtgaaaacatcgattgacaagaactatgaagaagagcctctgacagatgaggatgttgaaaataaaatcgttgtttctgtccaatcgttcgacggcaagcagacaatcgatgaaggaacggaaacaggcggcataccgatgtgggcttacatcgcaggcggagcagcgcttgttgctgtaatcggcctcatcatctggcttgtcagaagacgtaaaaatagagatgacgaatacgaggaagaatggtatgaaacgcctcaggagccgattcgggttgctgatgtgaacaatgaaaaagagacagaagaaactgtcagacgaaaacagcttgaaaaaatggcgaaagacaagcctgaagaattcgccaaattactgcgcagctggctgaccgaggatt

SEQ ID NO: 1858 - DNA, 911 bp, Bacillus licheniformis
gtgtcttcaaaccaacaggaaattttattaagttcgggaaccaatgaattagaaatcgtgaagttcgaggttggtctcaacattttcggcataaatgtcatgaaagtcagagaaatcattcagccggttgaaattacgaaagtgcctcattcgcataagcatatggagggcatgattacattgcgcggggaaattcttcccgtcattgatttattctctttctttggcgttgagcacggtgatgacgagcatcaagaaaaatacattgtgacggaatttaacaagcggaaaatcgtctttcacactggagcggtttcacagattcaccgggtgtcatgggaagaaattgagaagccgactgctttgaatcaagggatggaccgtcaccttaccggcatcattaagctcgacggcaccatgattttcctgccagattacgaaaaaatcatttttgatcttgagtctgagtcaggtatggacccttatcaaatgaaaaatgaaaaattcgatcagagacggactgacaaaaagctgatcattgtcgaggactctccgctcctcttgcggctattggtggaaaagctgaatgaagcgggatacaacaacatcgtgtcttttgaaaacggaaaagacgcttacgagcacgcgcttcaattgatggaagacggcacagctcttcacgaaaaagtcgatctgatgatcacggatattgaaatgccgcagatggatggacaccggctcacaaagctgctaaaagataacccgctgagtacggagctgccgatcttgattttctcttctttgattacagacgatcttcgccataaaggggaacaagtcggagccgatgaacaaatcagcaagccagagctcaatgaactgatcgaaaagcttgataaatatattttcaa

SEQ ID NO: 1859 - DNA, 912 bp, Bacillus licheniformis
atgcgggtaacccaagggatgattgcaaaaaattctttgcgctacatcaattcaagctatggaaaactggataagcttcaatcccagatttcttcgggaaaaaagatcacaaaggcatccgacgatcccgtcgtcgcgatgaaaagcctgaagtacaatacacagctgtcccaggttaaacaatatcaaagcaatgcctcgcaagcttttacatggcttgaaaacacggaaacgaacattacagaaggcattgatatcatggcgaaaatcagggagctgaccgttaaggctcaaaacagtacaaacggcaaggatgaattaaatgcgatcggggtcgaaatcggccaactgaaagaccagctgattcagatcgccaatacgcaggtcaacggccgctacctttttaacggaacgaactctgacgtcgctccgatcacaaaaaacgccgatggtacttacacatacaattttgaaaactatacaagcagctctgacgttctcatcaatgtttcgccaaacgcaaccttaaatgtaaactcaaatccgatttcggctttcggcggacaatcaagcagcggacaaaacgtctttgaaatgattgagtctctcgaaaatgccttaaaagcgggaacaatggaaggaatggaaaacgccctttcagacattgaccagttctccaatcagatgagcaatgagcggtctgatatcggagcgcgctacaaccggctcgaattgatcaatgcgcggctgagcgaacaggaagagacggcgacaaaggtattgtcagacaacgaagatgttgagcttgaggagatcattactgaatttattacacagcaatcggttcacagagctgcacttgccgtaaatgcgaaaatcgttcagccgacactggttgactttttaagataa

SEQ ID NO: 1860 - DNA, 816 bp, Bacillus licheniformis
tgctggatgcttttgtgaaagtggcgccgttcctgaatcagctgattcaggacgatgtgacagtggggatttacgataccgaaaagctgatcgtcaacatcccgggaaagacattttccctgaatgtcaaagcgggtgaccctttgcaggaaggcgatattattacagacgccatccgccaaaacaaaaagaaagtaagcatggtgcctaaggagctgttcggcttccctcttgcggcgagagcgatcccgctccacgacgagaacggaagggttatcggcggagtcgggctcggcacgagccttgaaaaatcggatcagcttcaccgcgtcgcggaaagcctgtcggtcatcgtcgagcagacggcttcggccattcaggatatcgccgaatctgtcagcggcttctccggacaaatgtccgacatctccaagcaggcgaaggaagtcagtgaaagcgccggagaaatcgagaaaatttcagtcaccgtaaaaggcatttcagatcaaagcaacctgctcgggctgaacgcggcgattgaagcggcgagagccggagagtcaggaaaagggttctccgtcgtcgccgacgaaatccgcaagcttgcgacacactcaaaagaaaacgtcggccagattgaccaaatcacgaagaaaatccacgcgttattaaaagaccttgagcattcgatcgaagtcatcaatgaacatacgagcggccaggccgcaggtgttgaacaaatttccgccacgatgcaggagatcagcagcaacgcgcaaaaccttgccaagatggcggaacaccaatttgaagact

SEQ ID NO: 1861 - DNA, 915 bp, Bacillus licheniformis
caggcgccagctcgcgcttgaactcggacttgtcattccggtcgtcagaatcagggataacatcgctcttcagccgaacgagtacaggctcaaaattaaaggaaacgaagtcgcgaaaggcgagcttctcctcgatcactttctggcgatgtctccgacaggcgaagacgatcagatcgaagggattgacacaatcgaaccgtccttcggtcttccggctaaatggataccggaatctcagaaagatcaggccgaaatgctcgggtacacggttgtcgatccggcttcagtcgtatcgacccatattacggagcaggtgaaaaagcacgcccatgagctgatcggaagacaggaaacgaaacagctgatcgaccacttgaaagaatcttatcctgtactggtcgaagaggtctcgccgaatccgctgtctgtcggtgacattcagaaagtgctggcaaaacttctgaaagaaaaagtatcgatcaggaacttggtgacaatctttgaaacgctggccgactacggaaagctgacgacggattcagatatgctgaccgagtatgtcagacaggctctggccaagcagatcaccgcccaatatgcgaaggaaaatgagacgctgaaagtggtgacttgttcgggccgcgtcgaaaaggccgtggcggaaggaattcagcagactgaacacggcaactttttatctcttgaaccaacattatccgaaaatatcattcaatctgtagcaagagaaatcgaacagctctcattgaggcaggaagtgccgatccttctatgttcgccgcctgtcagaatgtatgtcaagcagctgcttgagcgctatttccctgatctgccggttctttcctataacgaattggaagccaatgtagaagttcaaagcatcggagtggtgga

SEQ ID NO: 1862 - DNA, 955 bp, Bacillus licheniformis
gtgctctcccaaaatgaaatcgatgcactgctttcagcgatatcgaccggtgaaatggacgccgacgagctgaaaaaagaagagtccgttaaaaaagtaaaagtctatgactttaaacgggcgctccgcttttcaaaggatcaaatccgcagcttgaccaggattcacgataactttgcaaggctgctaacgacttatttctcagctcagttgagaacctatatccaaatctcggtcagctcggttgatcaggttccgtatgaggaattcatcagatcgattccgaatatgacgatcctcaatctgtttgaggttcgccctcttgaaggaagaatcatgatggagatcaacccgaccatcgcctatacgatgatggaccgggtgatgggcgggatcggctcgagccacaacaaaattgacagcatgacggagattgagacgaaaatcatgtccaatttattcgaaagctgtctcacgaattacaaagatgcgtgggaatccatcacggaaatcgagccggaaatgtccgattttgaagtgaatccgcagtttgtgcaaatggtatcgccgaatgagacggtcgttgtcatttcgctgaacacgcaaataggagacatcagcggggttatcaacctgtgcatcccgcacgtcgtcctggaaccgatcattcctaagctttccgttcactactggatgcaatcagacagaattgaaccaaaaccggaggaaacaaagtcgatagaaaagcggattttgacggcgcaaattccaattgtcgcagaactcggatcatcggaattaaccattgaagagtttttaaatttagaaattggagattgtatcactttggacaaatcagtagcagaacctcttactgttttggtcggagataaaccgaaatttctagcacaagccggccgaatgaatcgaaagactgcgattcaaattctagatc

SEQ ID NO: 1863 - DNA, 819 bp, Bacillus licheniformis
atgaaacgatttgattatctgacaccggtcggttttattctgggtattttcattttagtgctcggcgttgtctctggagcggggctttccggtttttattcgtttatcgatttgacgtctttttttattgtgacgggtggattgtgtgcagctgtattcatcagcttttccccgaaagatttaaaaagagcgccggctgtgctgaagcaggtctttatttcggaggaagatgatgtgcgcgaattggtcaaaacctttgtcagcctgtctgaacaggcgcgcaaacaaggaattttatcattggacgccaatgtcaatgaaatgaaagacccgtttttgaaaaaaggcctgctccttgccatcgacggatgggatgatgagacgatccgcaatgtgatgaactcggaaattgccgcgatggaagaacgacacacaaaggggagaaggatctttgaaaaagcaggagaatttgcgcctgcatggggaatgatcggaacgcttgtcggtctcgtcatgatgctcaaaaacctgaacaagccggaaacgctcggtccgaatatggcaatcgcccttttgacgacgctttacggatcacttttagccaacatgctgtttataccgatcgccgcgaagcttgaagaaaagacggagaatgaaatctttaagaagcaagtcatgatcgaaggcatcatcggcatccaatcgggaagaaatccgcgaaatcttgaaagtcagcttgtcgttttcagttcaaaagaagaatggacaaaaaagcgggcggaccgcatgaaacaaaaggacaggcctcatgaagcttag

SEQ ID NO: 1864 - DNA, 1100 bp, Bacillus licheniformis
atgaaaatcaaaaaatttgtagctggttctatgcaggaagccacaaagcaaattatacaggagctcgggaatgacgccgtaatcttgaattctaaaaaaattcaaaagagaaaatttctcggctttgtgaaaaaaaccggggttgaagtgatcgcggtcgtcgaccaggacttttccgacgcaaggaagcaagagcgtcaaaagcccgttttccgggaacaaagcccttcgcctgtcccgcagccggaccatcttgatttggcaagccaagtgaaagagctgaaagaactgctggaaatgcggcatcatgagcagcctgttgatgtgctgcctgaaccgctgaaaaaggcggaccagctcctggcaaagaaaggggtatcgccggccatccgtacgaaagcgctcggccggttgatcagcacttctttaagagacggcgaagagtggacggatgaaaagacgctggcgcacttaacagatgctttggccgatcttcttcccgataatctggaacaggacgtggcgattcattcgcaatatgtcgtgctcttcggatcgaccggagtcggcaaaacgacgacattggcaaagctcgccgcttcttctgtactggaaaagcagaaaaaaatcgcttttatcacgaccgatacgtacaggattgcagcggttgaacagctcaggacatatgccgagcttctgaatgcgccgcttgaggtgtgctacacgaaagaagagtttaaagctgcccagcaaaagttcgccgattttgaccacgtcttcattgatacggcgggccggaatttcaaagacgggcaatatgtcagggagctgaaggaaatcattccgtttgagcgtaagatacaggcgtttctcgtcatgtccgcgacgagcaagtacgaggatatgaaggagctcattaagcagttctcaagcattccgatcgatcagttgatattcacgaaagtggatgagaccgattcgttgggaagcgtcatgaatctgctcgccgaatcgagaatcggcctcggctatattacaaacggacaaaatgttccggaggatatccgctacttgtcaaacgcagcatttgtcagactgct

SEQ ID NO: 1865 - DNA, 820 bp, Bacillus licheniformis
atggacaaaacatcgttaattggaatcatcttagctatcatcggagtaggtgtcggcatggtcatgaaaggtgtcagcccttccgttctcgtcaatcccgcggcatggctgatcatccttgtcgggacaatcgcagcagttgtgatcgcttttccaatccgcgagctcaaaaaggttcccaaactcttcggcatcttgttcaaagagaagaagatgatcgaaatcaacgaactgatcccgatgttttccgagtgggcgcaaatcgcaagacgcgaaggacttctcgctttggaagcaaatttgaatgagatcgatgatgaatttttgaaaaacggcatgagcatggcggttgacggtcaaagtgccgattttatcagggacgttttaactgaagaagttgaagcaatggaagaaaggcatcaagtcggagcgggtatttttacccaggcaggcacatatgcgccgacactcggcgttttgggcgctgttgtcggactgatcgccgcacttgcggatatgagcgacacagaagcgcttggacatgcgatcagcgccgcctttgtcgccacccttctcgggatcttcaccggatatgtactatggcatccttttgccaataaattaaagcggaaatccaaacaggaagtcaaagtccgcgaagttatgattgaaggcatcctttcgatcttggaaggccaggctccaaaagtcattgaacaaaagcttttgatgtacgtttctccaagcgaacgctccagcatcgtcatcccagatggagacaaaggggacagcagcaatggctagaaaaaagaagcacaaa

SEQ ID NO: 1866 - DNA, 1116 bp, Bacillus licheniformis
aaagcgatttaagctgaaattggggacgaaaattaatcttctcgtgttagccgttattctgatcttttcgtcagcactcgggattttcattatcaaagagctttcaaaagagttagaacagatggcgacagagaaagccaaaagcgatttgaaattgagctaccgttatttgaatgaatctcttgaaggtgattgggaagtcaaagaagacaggctctacaaaggttcgacccttatcaacggaaatgaagaactcgtcgaccaaatcggcaatgatacgaaagacactgtcaccatctttcaatatgacacgcgcgtatctacaaatgtgacggtagacggaaaacgcgctgtcggaacgaaagtgtcttcggaggtagcaaatgcggttttaaaagaaggaaaaaacttttatggaaaagcagatgtagcgggaaaaacatatcaaacggcatatatgccgatcaaagacaagagcggtgaagttatcggcatcttttatacaggggccgaccaggatatgatcacaagcactcttcaatcgttcctgaaaatttttgctatcgttctgactgcttcaatcatcatctccattttgcttgtcctcattttcaccaaaaggataggcggaaggctcagaatgctgactcatgcttttgaacaggcgggcagcggcaatttgacaaccgagatccaggatgattcgacagatgaactgggcgacttgtcacatcatttcaatcaaatgaatgacagcctaaaccggctgatgcaaaaaatttcacagtcgtcgcacagtgtagctgccgcttctgatcagctgacatctggagctgaagaaacaagcctcgcttctgagaaaatcaccgaagccgtccagcatatcgcaagttcatcggaaatgcagacatcggggatagcaggcagcaaacaagccgttgaacaagtttccgccgatattcaaaacatatcagaaaacgctgcgatcctgaatgaaaagagccaatacgcccgcaaaaaagcaaaacagggggcaaaagatatctccgaaacgatgcggcaaattcacacgatgcatcaatcggtccatgaaagcggagaaatcattgaaatgct

SEQ ID NO: 1867 - DNA, 771 bp, Bacillus licheniformis
caataatcgaatcatttccagcctttttacttgtgtttgtcagaatcacagcattctatgtaacggtgcctctattttcttatcggacaattccggccgttcataaaataggttttgcattttttcttgcgctcgtcagttttcaagcgattgaaaagcctcctcaccttgacgttgacggaatttacatgatgttggccatgaaggaagcgctcatcggacttctgcttgggctgatcgcttacatgatgatctcagccgttcaaatcgccggatcgttcattgattttcaaatgggatttgcggtggcgaatgtgatcgatccacagacaggggcgcaaagcccgcttgtcggccagtttttatatacgatggcgctgcttctcatgctgagcctgaatgcgcatcatctcctgcttgacgggatctattacagctatcaatacattccggtcgacaagatggcgctgtcgtttggaagcgaagaatttgccgagtttatcgcaaaaagcttcaatacgatgtttattacagcatttcaattgtctgcgcctgttgtggcttgtttgtttttagtcgatctggcattggggattgtggcgagaacggtgccgcagctcaacgtgtttgtcgtcgggcttcctttgaaaatcgcgatcacctttatcatgctcatcatctgcatggccgttatgttcagcatgatgcagcacgtcttcgaatttgccattcggacaatgagagatctattaactttgcttggggtggcat

SEQ ID NO: 1868 - DNA, 666 bp, Bacillus licheniformis
atgaatgagtttatggatttatttaattcaagcgatgcggcaaatgtcagcgccagcgtccggctcttgctgcttttgacagtattttcgatcgctccgggtatcttgatcttgatgacttgtttcacaagggttgtcatcgtcctgtcctttgtccggacatcgctggcaacacagtcaatgcccccaaaccaggtgctgatcggacttgcactgttcctgacatttttcattatggggccgactttttcagagattaataaagaagcgctgacgcctttaatgaacaataaaatcaccttggatgaagcttatacaaaagcggaagccccgatcaaaacatttatgagcaagcatacaagacagaaagatctggctttatttatgaattacgcaaagatggaaacgcctgagtccatcaatgatattccgctttcaactatggttcctgcgtttgtcatctcggaattgaaaaccgcgtttcaaatgggatttatgatatttataccgtttctgattatcgatatggttgtggcaagtgttttgatgtcgatggggatgatgatgcttccgccggtcatgatttcactgccgtttaagattttgctgtttgtgcttgtagatggctggtatttaatcgttaaatctttgctgcaaagcttttag

SEQ ID NO: 1869 - DNA, 1983 bp, Bacillus licheniformis
atgaaaaagcttttaaattggacgaaacgtccttctatttctaaaaaattaattttctcatttatattcattttaacaattccgatcttggttctttcggttacttcatattttacggccagcagcacgctcgaggatgagattttgagaagtgcgaaagacaatatcgatgaactgaacgacattattcagcaagatatcggcagcaaggagacttccattgcgtatttcagcgaatggattgatcaaaaagcgtacaaagagaaaggccagactgcaattaaacaacggtttgagcagtttgcaaaacagaatcccgacgtcgaactcgtcttcaccggatcggaagatagtgtttacgcacaatatccgaatgctccactgcccgacgggtatgacccggtagaacgcgactggtacaaacaggctgtccaggaaaaagggaaaacgattgtaactgaaccttatgagtctgcatcaacggggcatatggtcgtcacgatcgccaagcagaataaagacggttctggcgtagtcgcccttgacttgaacattgacaagctgatcaaatcggcaaacagcatcagcatcggaaaaaccggatatgcattcatcatcggcgaggggaaaacgtatgtcgcccatccgaaaattaaagccggcacagaagcagaagctgatctgacagagcaaatgttcagcaaagagagcggcttgttcacctttaatgaaaaaggcaaagaaaagaaaacggtcttcacgacaaacaaactaaccggttggaaaatcggcggaaagatgaatacagcagagattaaagacgctgcccagcccgtgcttcacatggcagtcatgacattggcaggcgcgattattctgggcggaatccttgtttactttatcgtccgcgcgatcagcaagcctttaaatcaactcgtctcttctgcaaaaagcatcagcgaaggagatctgacacaaaaaatcgatgtccgctccaaagacgaattcggccagctgggcacaagcttcaacgaaatggctgactcgttgcgctcgctgatcagcacgattcaagaatcggtcgacaatgtggcatcttcttcagagcagctgacggcaagcgcggaccagacaagcaaagcgaccgagcacattacattagccatcgagcggttctcaagcggcgctgaaagtcaaagcgaaaaagtcgaagaaagctcacagcggctcagccaaatgaatgagaagctgaatgaaattgcaggcgtgtcagaatcgattacagaatcctcgggtaaatcgacggaaattgccgaaacaggcggagagctcgtccaacaaaccgtcgggcagatgaactcgatcaacaggtctgtcaaacaggctgaacaggttgtcaaagggcttgaagcgaaatcgaaagatatcaccgcgatcctgcgcgtcataaacggaatcgccgatcaaacgaatttattagctctgaacgccgccatcgaggcagcgcgggccggcgaatcaggcagaggcttctcggttgtcgctgaagaagtcagaaagcttgcggctcaatcagcgggatcggcaaaagaaatcgaagcgctgattcaggatatcgttaaggaaatcgaacattcgctcaacatgttcaaatcggtcaaccaggaagtacagtcaggactcgaaattaccgaagaaacggaatctagttttaaacacatttacgacatgacaaacgaaatcgcaggcaagctgcaaacgatgaatgccgccgtagagcatttatcaacaggttctcacgaaatatccgatgcggtcgaagagatcgccgacgtatcgcgtgaaagctctgccggcattcaggacatcgccgcttcagcggaagaacagctggcttccatggaagaaatcagctcatccgctgcaacgctcgaacagatggctgaagagctgcgcgatttaacgaaaaagtttaagatttga

SEQ ID NO: 1870 - DNA, 843 bp, Bacillus licheniformis
atgatgttaaaaggactttatacagcaacttcagcaatgatcacccagcagcgccgcacagagatgctgacgaataatatcgcgaatgcaaatacgccgggatataaagaagaccaaggatcaatacgttctttcccggaaatgcttttgagccggattgagtctgattctttcaaagccggcagcgcttcgcgttcgttttcaacacagacgccaatcggttcaatcaatacaggggtttatatgcaggaactgaagcctcaattttctcaaggcgatctgcaaagcacgaatgagccgacagatattgcaatcagcgaagccgaagttccggtcaacggcgaaacaaacgataaagcggcgcttttctacgcggtccggcttgaaaatggggatgtacgctattcaagaagcagccgtttttctttaaatgaaaataatcaattgacaataaacggccgactcgtcctttcaacggaaaaccggccgatcacggtgggaagcgagaattttcaagtcgctgaggacggaacggtgactgaaaacggccaaaatctggggaggatcgatgtcagaatcgcgctcgatacgagaaatttagcaagagaaggcgatgatctgtatcgtactgaaaacggtgaggcgctgccaagcgcagtcggcaatcctgaagtcacttattctgtcaagcaggggatgaccgaacggtcgaatgtcgacgtgacgagagcctatacggaaatgaccgctgcctaccgctcgtttgaagccaaccaaaaagttcttcaggcttatgataaaagcatggaaaaggcggccaatgagattggaaggatcggataa

SEQ ID NO: 1871 - DNA, 970 bp, Bacillus licheniformis
atgatgcagagtggctatacgattttggatgctttaagtatgctgaaattgcaattgaatgaaagacgaagagcggatctgacatttgcgatggagaagctgacagaagggtgtcctgtgtttcaagttcttgaaatgatttcctttcacaaggatgctgtcaccattgtttactttgccgaacagcacgggaatttgccatttgcctttaggcagagcggagagctgcttcaccgcaagatcgctcaaagcgaaaaattaaagaaagccgccagataccccttgtttttagttttaacggtctgcgtcatcatctctattatgaaatcagcaatagttccgcaattttccgccatctatgaatcgatgaacgttgaaacgtcttttgcaacgactctcatcttttatgttttcgatcacttttatctttttttcgcgggactgccgctggttgccgcagctctatccctctattatctgtgttcattccgccataaacctccagaagacaaaatggcctttctcattacaattcccttgctgggccaaaccttcaaactattcaacagctattttttatcgctccagctgagcaatcttttgcaagcgggtctgtctgtatatgacagtttaaaagcatttgaaagccagccgtttttacgatttcataaaaatgaagcgaagcgcttgatcgagcggctgaaacagggggagagtctggagcagatgctggccggacatccgttttatgaaaatgatttagcaaaggctgttgcacacggccaactaaatgggcacttatacagagagctgtattcatatagtcagtttttgattgagcggcttgaaagaaaggccgaaaaatggacaggcctgatccagccattgatttacgggctaaccgcggcgatgatattaattctttatttgtccatgcttttgccaatgtatcaaatgatgaaccagctat

SEQ ID NO: 1872 - DNA, 822 bp, Bacillus licheniformis
aaagcatatcgaagaagtggcgacaggcgcgactgaacaggcggctgaggtcgaaaatgtcaatgaacaatccgaacggctgtctgtcaaaattaaagaaatcgaacatcatgccgacagcatcaagaaactttcgagaacatcagaagaagcaagctatacaggaatcgatgccctcgggcagctgcttgcaaagtcaaatgaagcaaactcggagacaaagaaagtggaacatatgctattccagcttgaagaaaaaacgaaaaacattgaagacgttgttacagccatctcggcgatctctgatcagacaaacctgcttgctctgaacgccagcattgaagcggcccgtgccggagaaagcggacgcggttttgcggtagttgcagaagaggtgagaaagcttgctgaacaatcggcggtttcttcacagcacatcagtgaaacggtcaaacagattcagatggaaacgaaagaagccgtttcagcgatgacagaagcaagcaagatgaatgaagtgcaaaatggaatgattcacgaaacaggtgaagcgctcagcaaaattactgctgaaatgcaggcgctcgtcaactcaattgaccacatttattctgaaatctcggatatgagcggagagcagcaaaaaatgtccgattcgattcagagcatttcagccatttcccagcagtctgccgcggctgcggaagaggtcagcgcttcggccaacgagcagctgacagcgctggaaagcatcgcaaaatcggctgaagcgctgagcgaggccaaccaagaattattaaatgcgatcaataagtttaacgt

SEQ ID NO: 1873 - DNA, 1785 bp, Bacillus licheniformis
atgtggcagcctattatgcgaatgattaaacgtttgatcaataatgcgccgatccgtcataagctgatcagccttctcttgttaatcagcatgctgccgacgatcggcctgggcattttatcgggatgggccgttgaaaatattattgaaaaacaggtgatcgaccaaacactgcagctgatcggcgaagtgaacaagacggctgaagtgtatgtcagccacatgcagaacctgacatatttaatatcaatgaatgaagaaatggaagcgttttttagtcataaaaaggaggatggagaggcggattataagcgaaggacgtttttgcagggcctgacttctttatattccgaagcagcgggtattctcgttgtcaatgataagggtgagatgatcagcaatgagatgtatgaacgcacgccgacagatttgacaaaagaaccatggtatcaggcggctctcgacaatgaagggattttcaagatgatcgggaagcctgtcaaccggaatatcagaagccatgtgcactatagggaagatgaggtcgtttccgccgtcagagctgttatcgatcctgaaacacagcatgtgaaaggcgttgtactcatcgatttgaagctgcgcgtcctcgcagaagcgacaaaaaatatccgcttggggaaaacgggttatttgatgatcatggatgaaaatggcggcaatatttattcgccggagacttcgaatctatttctgccgaaaaagtggttccgtcaagaacgttctggatatttttcgaagcggatcaagggagaggaatatcagttcatttatgagacgtcttcctttacgaactggacgacggtcggcgtttttaaagcgggtgaaccggttttcgaagtgaaggaaatccacttgtatgtgcttttgtttttattgacggcggcgtttctcggaatgtcagcttcctattatttgtcccattccatgtcgcggccgattttgaagctgaatgctgtcatgaaaacggcggaaagcgggaatttttcaacattgtatcaggaggaaagggaagatgaaatcggccttttgggaaaaagcttcaatcgcctgatgttcagaatccgcgagctgatgtccgttacagaaagacaggagcgccaaaaaagagaagccgaattaagagcgctgcaggcgcagatcaaccctcactttctctacaatacgctggatacaatcaattggatggcaaggaaaaaaggagcggaagaggtcagcgatctcgtgcaggctttatccaagctgttccgcatttccttgagcaaagggaaagatatcatcccgctgtctgatgaatttgaacatgttgaaaactatttgaaaatccaaaaagcgagataccgcgataaattaaactactcaatcgaaatgaccgggctttgtgatgaccgcctgattttgaagctcgttcttcagcctatcgtcgaaaatgcgatctatcacggaattaaagaaaaaaaggggccggggcatattgcgatcaaaggcatggaggaggatggctcgctaatcatcaaaatcgaggatgatggagccggaatggatgaagagacgctaaagcaaataacggatcaattcaaacacagggacgatacagcgggctacggcatgatcaacgtccatgaacggatcgctcttacatttggcgagccgtacggtataacggttgaaagtcggaaaggagccggaaccgccgtcacgatacggctaccaattttagcaaaagggggaacaagccttgagtga

SEQ ID NO: 1874 - DNA, 1734 bp, Bacillus licheniformis
atgggagaacaccatatgaatctgttgagaaatataaaaatcagaagcaaactgtttgtcatcattatcatttcggcgctggctttgtcaattgtaggcatccagggggtaggcgggctgagcaagctttccaaaggttccgagatgatctatcaagatcaattgattcccaaccagttgtttgcaagattaaaagcgaacaacctcgatcttgatacgtacaaattcgagttaatggtgacgaaagacagcgatcgaaatgaaactttgcaaaaaaacatcaaggaaaaaaacgaagaaaacaacaccttaatggaaaagatcgatcagctgaaattaatggacaacgtctctgaaaaatacgagagcttcaaaagcgaatacaagaaattgcaagatatcagcagccagatgctcagcttggcggtgaagaacgaaaatgacaaagcttatgatgtctatctaaaagagatggagcctcaaagagaaacggtcaaccagctgattgaagacattcaaacgctaaatgctgacaacgccaaaacgatctatcagcgggattctaaagaagccggttccatcatcacgcttctcatcattgtgatcgcagcatcgcttgttttatccatctcgatcggactcttaatgacaaggctgatcacaaagccgatcaaagacattcaggcgctgttcgcagaaacagagcaaggcgattttactgtcaaaggaacatatcaatcgaaggatgaattgggattgctgaccgcatcgtttaacaaaatggtagcaggcgtccgttcgatcattgaaacggtcggcgaaacgtcccaccaagttgcttcatcatcacaagaattgagcgccagcgctgatgaaagcacaaaggcgagcgagtacatctcaacgacgatccaggagcttgcggtaggctctgatcagcaggtggaaagcgttgaaaacagcagaaccgttattaagggaatgaccgagtttgccggaagaatttcttctagcgccgaaaaggcagccgccaccgcagaccagacggcgaagatgtcgcttgaaggcacgaaagccattgataaagtgagcgcacaaatgcagtctattaatgaaacggtcgtttctctttcagaagcatttaaacatttaacagaacgttcaaatgagatcgggaatattaccgaagtgattacgagcatcgctgaacaaacgaacctgctagctttaaacgcggccattgaagcggccagggctggagaacaaggaaaaggctttgccgtcgtcgcggatgaagtcagaaaattagccgagcaatcggcccagtcagcagaacagattacaaggttgattacgatcattcaaaacgatacaaagcagacgatgaactcggtcatttcggcaaccggcgaagtcaaagaaggacttgtcgtcgttcatgaagccggaggcgctttccaaaaaatcgaaaactcgataactgaggttgtcacacagatcaatgatgtgacaaacttggtgaaaaacctgacagccggcacaagcgaaatcgaaaccgcgatttccggcgtcaaagaagtagccgagactgcagcgggaagcacgcaaacggttagtgcggcaacccaggagcagcttgcttcaatggaagaaatcgccgccgcatcacagatcctcgcgcaaaacgccgaagagctgcagcacctgattcagaaattcaaaattaaagattaa

SEQ ID NO: 1875 - DNA, 1725 bp, Bacillus licheniformis
atgaaaacgttgaagaaaaagctaacagaacacatttcagtcaaaattatgattggcgtcgccttagtgcttttaatcacgatcgcatcattttcagccgtgtttacttttatcagcaaagacttgtcagagcagctgaaacagcagttccaaaaccgcctttataccgatattcatcttgctgaaaatcaaatcaaacgtctggacgggaatccgcttgagatcgattccgcagacggtccgctttacaagcagacaaaaatggctgtggacagcctgaaaaagaaaaacaaacttgagaatatttatatcctttccaatgaaggcgggaaggagcggattctcgtgctgtcggatacgcccgatgatttcggcacggattacagcttttctcctgaaatgaaagaagccttgacgacaaacaaagagacggtaagcgacgtgtatgaggacgaatacggcatccaccagtcgatttttctgccgcttgagaacggctcaggagaaaaggtgggaattttggggatcgaccttgatgcttccgtgattccggagacagcggcaaaagcgaaatggtatacaattgcgatctcagcatttgtcttgctgctcggaatggtcatggcctattttctcggttcttacatcgcgaagccgatcaggcagctgatgaaggcttcagaaaaaattgccgacggcgatctatcggccgacatttctgtcaagagccgggacgaagcaggaaagcttgccgaatcgttcaagcggatgagcgaaaatttacaacaattgattggacatatttcagcttcctctgaagaggtatccaagacgagcctgcagctgaaaaatgtatcggctgaatcgagcgaaagcgcagctcaagtggctgaatcgatgaacagcatgagcgagggaatcaacgaggttgtctcttcagtttcggattgtcatacatcggctgccgaaatcgatcagcagcttacacatgtcacagaaaaagtgaacgagatgaagaacgttgccgagggcgtcagcaaggattccaagacggggcaggagcttgtcgaagaaacattgcggcagacccagacgattaaaaacgtgatggaagagtcaaaacaagcggcatcagagatgcaaaaccatacagaagaaattgaaaaagtcatcggaatgatttcctctattgctgaacagacgaatttgctggcgctcaatgcttccattgaagccgcccgggtcggtgaggaaggccagggctttgcggttgttgccggagaagtcagaaagctttctgaacgttcggcagatgccgctttatccgtttcccagcttgtggcgggcacgcaggagagcagccggcttgtcatggaacgcattcaggaaggaaacgaagcggttgacaaagggcagattttaatcaatggcacatacgagaatttttcaggaatttttaaaggaatttctcaattcgccgaacgcacagatcaattgcttcagtccttgttaaaagtcgaaaaatcgtatcaaaccatttcgtctgcgatggagcagatttccgccgttaccgaagagcaggcggcaggctctgaagaagtcgctgcggcagcggagcagcaaagcgccggcatgcaggaaatcgcatcggccattcagcagctctccgctttgtcggaagaattgaatcaggcggcatccaagtttaaactggccgctgaataa

SEQ ID NO: 1876 - DNA, 720 bp, Bacillus licheniformis
aaagggaaacacatttgattgcccatcttgaagagctgcgccagcgaatcattaaaacgcttcttacgtttattctgtttctcatcaccggcttcttgtttgttcaggacatctatgactggctgatcagagaccttgatgaaaagcttgctgtactggggccgggggatattctttgggtttatatgatgattgcgggggtgctggcgatcgcagccaccataccggtggctgcttttcagacatggcggtttgtggcgcctgcgctgaccgaccacgaacggaggacggcattattttatattccggggctgttcattttttttattttggggattgtattcggttattttgtactctttccgctcgttcttcagtttttgatcggcctgtccgccggccattttcaaacgatgtttacggcggagcattattttcgctttatgatgaacctcacactgccattcgggtttttgcttgaaatgcccctcatcgagatggttttaacgagcctcgggattttaaatccggccaagctcagtaaaatgagaaaaatttcttattttgcgctgattgtcgtatcgcttgggatcacgccctccgatttcatctcaaatgggctggtggatcgcccgctccttgcgttatacgaaatgagcatctgtttatcggcttttatctaccggaaaaaaaccgccggacaacaaggggctgaggccc

SEQ ID NO: 1877 - DNA, 828 bp, Bacillus licheniformis
atgcttagatccatgatcacggcttcaaacacaatgtttgaactgcaaaaacaaattgataatatcagccataatcttgcaaataccgatacaacgggatataaggcgaaaaacacgagcttttcggagctgatcaggcagcagattgaacaggtaaacgagaaaaataatgaagtagctgcaagcagaaagacgccgccaggacttcgcctcggcgtcggagccgtcatgaccgaccggctgacgcataagcagggaagccttaaggagacgggccgcgatcttgatattgcactgacttctccttatcagtacttccaggtcaatgtcggcggggaagtgcaatatacaagagacggggcattttaccttacgcctgcggcggggaacgccaaccagatgcagcttgtgacgaaagaaggacatgccgtccttgatgaaaacggaaatgccatccgcttcaaccagcgctataaacacatcaaagtcgatgaatcgggaagtgtcaccgtttcgtcagacaatcagggagaagcgccactgcgttttaacctggggatcgtccgggctgtcaaacctcaggctctaacagaagaaggaagcaaccttttttctgtcagcgatgaattgagagcaacggctcttatcaacatgaacggagccgggcggcaggacatttctctaaaacagggattccttgaatcatcaaatgtcgacgtatcgaaggaaatgaccgatctgatctcttcgcagaggtcatatcaaatgaattcccgcgccatcacgatgggcgatcaaatgatggggctgatcaattcagtacgttag

SEQ ID NO: 1878 - DNA, 572 bp, Bacillus licheniformis
atgaaaaaaggacgcttgattgcgtttttccttaccgttctcttgatcggtacaggactgggaatgttcacgaagccggctgcagacaacatcagcctcggccttgatcttcagggcggttttgaggttctgtatgaagtccagcctgccaaacagggcgacaaaattgacagggatgccctcatcagcacggttgaagcgctgaaccgccgggcgaatgtattaggcgtcagcgagccgaacattcaaattgaaggaaacaaccggatcagggttcagcttgccggcgtcgacaaccagaacagggcgcgggaaatcttatcgacacaggctcaacttacgttcagggatacgaatgacaaagagcttttgaacggtgcggatcttgtcgaaaacggcgccaaacagtcgttcaagcaggatacgaatgagccgatcgtgacgatcaagctgaaggatgccgataaattcggcgaagtgacgaagaaagtgctcgatatgaagccgaacaaccagctcgtcatctggcttgattacaaaaaaggcgactcttttaaaaaggaatcgacaaa

SEQ ID NO: 1879 - DNA, 528 bp, Bacillus licheniformis
gagttcgaaagcgatgcagggctctccagcctgaaatgcaaaaacttcgtgaaaaatacagttctaaagatcaaaaaacgcagcagaagcttcaacaggaaacgatggctctcatgcagaagcacggggttaacccgcttgccggatgtttcccgatcttaattcaaatgccgattttaatcggattctatcatgccattatgagaacgcgggaaatcgcagaacacagctttttatggtttgaccttggggagcgtgatccgtatttcattttgccgattctcgccggtgtgttcacattcattcagcaaaagctgatgatggcgggaacagcgcagcaaaatccgcagatggcgatgatgctttggctgatgccgatcatgatcgttgtatttgcgatcagtttcccggcggctctttccctgtactgggtagtcggtaacttattcatgattgctcaaaccttctttatcaaagggcctgatctaaaggctgagagacaggaagcggcagccggaggaaaaaaat

SEQ ID NO: 1880 - DNA, 1566 bp, Bacillus licheniformis
atgttaacagcgtttttaacatccgttttgattacatatggtctgttaaaagatacgagccagacggttcaggatacgaaatcgaaaaatgaaacggccgttcagtcggcaaagctgatgtccctatatcaaaataaatatttgcacattccggagtacatcataaacgcccaggatgaaaagctgaccgattatatgaagtacagccaggaatttgccgatacggccaaaaagctgaaaaaagagctgcattcggatgagcagcttgacatgttcgatcaaatcattgaaaacaatcattcactggatgagtactttttcagcgaaattgttcccaacgtgcagcaaatcaacaccgagaaatttttaacccttcagaaaaaagcgaacaagctcaaagaggagacgatgacgttaggcgaaagcttgaaagaaaacgctgtcaaaaccaatgttgagtcaattggacaagcccaatccaatatgacgaaaaccatttatattttaggcgtctcaattctgatttcggcgattgtgtcggcgggactcctgatcattgtcagccggcagatcaagaaaaatctgaagcgtgttgtggcagcaagcgaagaaattgcaaagggtcatttgaactttgaagcccttgattacaaaggaaaagatgaaatcggccagctttcgcaagcggtgaatcatatgggcggaagcctgcgtgagatgatcgtcgaagtatcagggatcgcagccgaagtcgacaagcaatgtcttacgtttacgagcgtctcggctgatgtcagagaaggaagcgaacagatcgctgtcaccgttgaagaattggcaaacggggccacgaatcaggcaaatgaagcagctaatatttccgagcagacacaggagctcaccgggcaaattcagcacgctcatgaaagcggcgaaacgctggcccggttttcaaaagaagtgcttcacgtgtctgtcgacggcgacaaacagatggctcaatcattggagcaaatgaatgtcatcaatcatgtaatggaagcatccgtagaaaaagtcagtgtgctggaggaacagacacagtcaatccacaagcttgtcgaaatgataacaggtatggccgaacaaacgaatttgctcgcattaaacgcgtccatagaagcggcaagggccggcgacgccggaaaagggtttgccgttgtagccggcgaggtgaaaagactggctgaagaagtgaaaagctctgtcggcagcatcaccgaaatcgtcacggcgattcaaaccgaaacatcttccatggccggtgatttaaaaaccggtttttcagaagttcataaaggaaaaaaccagattgagacttccggccgatacttttcagagattaaaaataaagtgacggatatggctggccgtgtatcggacatttcggaggcattatcgcatttcagacgttcaagcgaggagattaacggctcggtcgagcatatcgcggcgatttccgaagaaagcgcgggccgttctggaagaaatttcagcgcccgtacatgcacaaagggtctcgtttga

SEQ ID NO: 1881 - DNA, 651 bp, Bacillus licheniformis
aaagcaattgtttgcgactgcaatgtttttgatcatgactatgtttataggtgaacaagcttcggcagccaccggcagcaccggaggaagcgacaacttcttccaccattatgtcgtggtgcctttttcagagctgattaagggaatcgccggaatcttccacggaaactacggattgtcgattatttttgtgaccatcatcgtccgggttctcgtttttccgctgtttgccaaccagtataaaaagcagcgggcgatgcaggaaaaaatggcgcttgtcaaacctgagctggatgcgattcaaagcaggttaaaaaagacgaaagaccccgtgaagcagagggaaatccagcaggagatgatgcagctttaccaaaagcacaacatcaatccgctggcgatgggctgtctgccgatgctgattcagtttccgattctgatcggtttctattatgcgatccgctcgacgcctgaaattgcttcgcactcttttctctggtttaacctcgggcattctgatattatcgtatctttaagcgccgggttcatgtattttatccagttctatgtgtctcaaaagctgaacgcacagaacgcccaatcaaatccggcggctcagcagtccgccaaaatcatgggcttctttttccc

SEQ ID NO: 1882 - DNA, 646 bp, Bacillus licheniformis
atggcaaacacagattttataaaggaaattgcaccagacgcccaaagagtctataaaaagtatgatattctcgcgtctctcattattgctcaagcctgtttagagagcgcatgggggacaagcgggctggtgcagaaagggaaaaacttattcggcatcaagggtacttataacggtcaatatgttctcatgtggacgactgaatatgataagagcggaaatgcaaccaaagtacaagctcgctttcgaaaatatccatcttggtatgaatcgattcaggatttagccaagttgtatgtgaacggaacgagctgggatccgaatcactataaagctgtagtcggcgaaaaagattacaagaaggcgagtgctgcacttgtaaaagctggttatgcgactgaccccaattatgcgacaaagttgaataatctcattcaaacctacaagctaacacaatatgacactgtgggtggggtgccagaaggacctgacgaaccggaaacaccgatacctgatccagaaataccaagcaaggaatatgacgggaaagacattacactcaatcagaatctgccgtcagataccgatttcccacagcttcatgtgtcaacaaaagacggaaaaaaggttgggaaataaacgggtg

SEQ ID NO: 1883 - DNA, 1212 bp, Bacillus licheniformis
aggatacgccgttggaagggcttttgcatgaactgaagcaatggctttcaaataaggaagacagctctttcaatgaagactggctgaattcccttcagcagcttgaagagctgaatgcatctccggatgaactggcattggcagaacagctgttacaacaaataaaagagctgcttgaaaaagccgccctgcctgaacaatcaggcaaaacggctgatgctaaagctttgcctgccgacgaaagcgggacagaagagccgaaaaagcccgacctgcaaattctcggccagattcagcagctgctagctgcgattgtaaatgaaaatcaaccgtcactcaaaacttcgcaaatcgcagaattattgaaacaggcgccggaatttctcgccgctcttcaaacaaaggcgggagcagaagggctgattgatgagcttaaacgtcaatttttcacgaaagatccgagccaatcgcagcttttgtccatgtcaaacaccgagctgaaaagcttgaaaagcttaatggagcagatgatgaacgcaaacgctgaaccggatcaaaaagagtggaaaatggccgaaagcgaactcaaggcaatgctcatgagcaagaaaaccgatgtttctctttctgagaagccgttgtcctttgttttgaacagaagagaaattcaaactgaaggaaagcaaggccaaaaggaacagccgattcaatcctctgtactggccaatcatcggacaggcacagcgctgatccagggtctccagccttcggcggcagaggaagcttccgctcagccgaaaagcttttcagaacaaattctcagctcatggaaacagatgaagtatacgccgttcggcaggtcgacaggcagtttcacgatccgcctgaatcctgaaaatcttggctttatcacgatcaagctcgtcaaacagcacgggatgttttcaagcaaaatcatcgcatcgacccagtcggctaaagagctgctcgaacacaatctcgcgcatcttaaacaggcgctgcccaacatgtctgtgcaaattgaccgcttcggtgttccgcttcaaaacagcgatcagactttcggacagctggcggacgatgagaaaaaccagcatcagccgaagcaagatcagcaaagtaagcaggaaaatgaggattttcaggagtttctggatgagcttatcgagactcgatcacaggacagcgagg

SEQ ID NO: 1884 - DNA, 576 bp, Bacillus licheniformis
gtgatgaaatggatcagcaatttcttatatgtgattattttcacaatcatcatcgccgcggtcatcgtcgtgatttcgacaaagtcgtccggcggggagccgcagctcttcggctatcaattgaaaacggttttatccggatcgatggagccggagtttaaaacaggttctgtgattgccgttcaaaaagttgaaaatcccgggtctttgaaaaagggagatatcattacattcatgcaagacgaaaacaccatggttacccaccgaattatcggtataacaaaaaataaatcaaatctcatgttcaagacaaagggtgacaataaccaaaaccctgattccgatccggtactggcggaaaatgttgtcgctaagtattcgggcattacggttccgtatgccgggtatttgctggactttgcaagtaaaccgatcggcacagccattttgctgatcgtgccgggactcttgttgattctttatgcagtaattactgtatccgcggctttaagagagattgaccaaaaagctaaagcaattgaagccgctggaaaagatcaatcagtttccatgtaa

SEQ ID NO: 1885 - DNA, 726 bp, Bacillus licheniformis
cctttttacggcaggtttagtgctcggctctttttttaattcggccgggcgccgcattcctgaaaagatatcattgattgctccgcgttccctctgccgcgtctgcaaaaggcagctgggcttctcggagctgataccggttttgtcctatttgatgcagcgggggaggtgcaaaggatgtcaaaccccgctctcgatcgtgtatccggcagttgagctctccgccgccatcctgtttgcgtttgccggcatgcacgttgggcatgagggggagctggtgattgtgcttgctcttatatctctgcttttgatcgtctttgtatctgatgtgacacacatgatcattccggatgctgttctttgttttttcctgcctgtctttgccgtcggacgattccttgttcctctggaacagtggcactcaagtttgagcggtgcgatggccggcggtatgctgcccctcttgacgctgcttttgacgaaaggggggatcggctggggagacgtaaagctgtttgcggtaatcggcatggcgctcggcagccgcctcctcgttctcgcttttttcctctcggcagccgcaggaacggtgcttggtcttattgcactcctggcaggcaaactgaagaaaaatgaaccaatgccgtttgctcccgcgattctggccgggacgctgacgagctgcttctatggcgaaccaatgatcgagtggtaccttcaaacggc

SEQ ID NO: 1886 - DNA, 444 bp, Bacillus licheniformis
atggcttattcatttaaatttcaaaagctcctcgagcttaaagaaaatgaaaaagaccaatcatttgctgaatatcagcactcagtttccgaattcgaaaaggtcgcggaaaagctgtatgaaagcatgagccaaaaagaaacgctggaaaaaaacaaggaaatcaagatgcagacggggatgagcgttcaggaaatgcggcattatcagcaatttgtcacaaatcttgaaacgacaatctaccattatcaaaagctcgtcatgatgaagagaaatgaaatgaatgaaaaacagcacgatttgacggagaaaaatatcgagctgaaaaaatttgaaaaaatgaaagaaaagcagtttgaaatgtattcgctgcaaaacaaagcaaatgagttaaaggaaatggacgatatctccattgcccagtacataactcaaggaagctag

SEQ ID NO: 1887 - DNA, 514 bp, Bacillus licheniformis
ttgaaaaagcgttttttggtcatagccggggtactgcttgtcatcgtcgtcgggattcaggtcaaaaatgccgttttcattgaatataaagtagaaggcgtcagcatgaatccgacctttcaggagggcaacgagcttttgatcaacaggttcgcccaccgctttaaaacgatcagccgatttgacatcgtgctgtttaaaggacctgacaaagatatattcattaaaagggtgatcgggcttccgggcgaaaccctcaggtatgaagatgatcagctgtatatcaacgaagaaaagatcaaagagccttatctggacgacttaaaggccgtcaccgccggaggggacttgacaggggattttacactgcaggaagtgaccggagaggagaaggtgcctgaaaacgagtacttcgtcctcggggacaaccggatccacagctttgacagccgccatttcggctttgtttcagaacgggacatcgtcgggattgtgacggaaagaattgataaga

SEQ ID NO: 1888 - DNA, 555 bp, Bacillus licheniformis
ttcacacaaacgcagcgccttcgacaacaggccgccagcttgacatgaccattacaggagacggctacttccgcgtcggatcaggagatgaagtgtactacacaagatcaggaaacttctaccgatctgatgaaggtgacctcgtcactgttgacgggctgttcgtcttaacggccaataatggaagaatcaacattccgcaagacgcgcaaagcttcagcatcgctcctgacggaaccgtttcttatgtcgatcaaaacaacgagaaccagaccgccggccagatctcgcttgcgacattcagcaacacatccggattatcaaaagctggagacaacctttaccgcgaaacattgagttcgggagatccgcaagtcgttgtacctggggaaggcggctcaggaaaaattcaaacgagtgcgcttgaaatgtcgaacgtcgacctttcagaagaattttccgaaatgattatcgcgcagcgcggcttccagtccaatgcgaaaatcattacaacctctgatgaaattcttcaggaactcgtcaatctgaagcgat

SEQ ID NO: 1889 - DNA, 669 bp, Bacillus licheniformis
atgaacgaaggaagcgcgagcagggccgcaaatcgccaaactggatcatcacgttttcggatttgattacgctcatcctcgtgttctttattttactgttttcgatgtcgcaaatcgatttaaacaaattcaaagcagcagtcggttcatttcaagacagggccgacggcaaatccgccgcagagttgaaaaaagacgcgggcgatcagaaggctgaaaaaacggctaaaagccaagatgatttattaaagaaaatcaatgactatattgaaaaaaacgaactgtcaagtttgattgcggccaagcgtgacgaacggggcgtcattctcgtccttcaggaagcggttttgtttgattcagggaaagcggatctgaaagaccaagctcacccgcttttgcataaaatcgccgtccttctcaaatcggtgtccaacccgattcgtgtggaggggcatacggacagccgcccgatttcgacttaccgttttccatccaattgggagctttctgcagcaagggcgagcactgtgatcggctactttacgtcgaaggaaaagctcgactcgtcgcgttttcttgccatcggttatgcggatacaaaaccggtcagggacaaccgcactgagagccatatgaaggaaaacaggcgcgtcgagattgtcatcgcaa

SEQ ID NO: 1890 - DNA, 461 bp, Bacillus licheniformis
ttgaccacacagactaccaccggtgagaaaatgattgtgttcaaagtaaatcataaagagtatgccatctctgtatcagaagtaatgtccattgaaaaatggcagcagccaacaagggtgccgggagtggaaccgtatatttgcggcgtcattaatttgagaggtgttgtcacacctgtcatcgatttaagaaagcggattgaagcgcctggagacacgattactgatgaaacgagaatcatcatcatcacccatcaggacattgaagtcggctgggtggtggatgaggcgaacgatgtcatcacagtcgaggaagaggaaattgaatcggctcccgaaacggtaggaaaagacggcaggcaatggattaaaggcatcgtcaagcaagggtccagacttctcaatctgattgactctgaagctgttttaaaccggaagtcgagccttgccgccgcttctga

SEQ ID NO: 1891 - DNA, 397 bp, Bacillus licheniformis
atggctttaaacaatccgtatgcagcttatcagcaaaattcaatcaacatggcgactcctggagaattgacgcttatgctatttgacggctgccttaaatttatgaagctggcgaaacaggcgattgaacaagaggatatggaaacgaaaaatacgaaccttgtcaaagctcaaaacattatacaggagctcaatatcacccttgatcggaaagtcgaattggccgcttcgatgggggcgatgtacgagtatatccaccgccgcctgattgaagcaaacattaacaatgacaaagatatcgtggcggaagtcgaagggtatgtcaaagatttacgcgatgcctggaagcaggcgcttcaaattgaacggcagggccggtttggatcgggcggactgg

SEQ ID NO: 1892 - DNA, 410 bp, Bacillus licheniformis
atgtcatttatgaagggaaaagaaatgtcgctgttagaacatatcacagaactgcgcagacggcttgtgatcacttttttcttttttgttttgtttgttgcggcaggcttttttttggcgaagccgctcataatctacctgcagcagacggatgaagcgaagctgctgactctcaatgcgttcaagctgaccgatcctttatttgtgtacgtgcagttcgcgttcatcatcggcgctgtcttgacttcgccgcttgttttataccagctgtgggctttcatcagcccggggctgtatgaaaaagaacgaaaagtgacgctcagctatattccaatatcgatcattctttttttaggcggcattgcctttcttactttattttatttcccgtttgtcggggactttagacg

SEQ ID NO: 1893 - DNA, 610 bp, Bacillus licheniformis
atgaagaagacgtttatgtcctttgttgcagttgcagcattatcttcaactgcattcggagcgagtgcctctgcaaaagaagtaacagtccaaaaaggtgacaccctttggggaatctcgcaaaaacaaggggtaaatctgcaggacttaaaagaatggaatcagctttcctctgacttgattattccgggacaaaagctgaacgtttctgaaaaacagacagaagaaaagaaacaatataccattaaaaagggagacactctctggaaaatcgcccaaaaattcggcgtttcagtgaatgaccttaaaaattggaacaacataaaatcagatatcatttacccgaatacatccataactgttgacggacaggcgacggtccaggctgctgcggcgcaacctgcggaaacaaagcctgccgtacaaaaagaagcgaaagtcgagaaggctgcgcctgcccctgcacctaagcaggaaaaagaaccggcttcccgttcaaacgtatctcaaagcactgccaaagaactgacggttacagcaacggcatacactgccaatgacggcggtatgacaggcgtgacagccacgggtatcgatctgaaggccaata

SEQ ID NO: 1894 - DNA, 964 bp, Bacillus licheniformis
  misc_feature (1)...(964): n = A,T,C or G
atgcttgaagatgaggcaaaagaatcaacgtccagcctcctcggttcaattaaaagaaatattgagcttcaattagaacactacgagatttctttgaatcgtataagtgatggagaaatggctcactcattcttaaaagacggggataataaaattataaaaatcgtcaatgatgaattaaaacaattaaaagaaaaaaatgagtatgtcaatttagcttatatcggcacaaaaaagaaggaaatgtttacatttccgaaaacgacctttgatgatgattataatccggctgaaaggccatggtatacgtcagctgcaaaaacacccgacaaagtcgtttggacggaaccttacaaagatgcggtttccggagatatgacagttactgcggcaaaagccatcgtcgtcaataataaagttgaaggcgttgtcagtatagacttgtcattgaattcattgaacaaaattatcgaaaatcaaaagatgccttatgacggctacgcatttattttggaccaaaacgggacaatgctcgcccacccgtcaaaacagggcgacgatatatcgaatgataaaacatatcgggacatcccgtcatcaaaagacggaatcaaagtaggcaaagatactgtgatcgcttatcagactgtcggcggtacgggctggaaagtcggtacgcagttcgacacggcgaagctgatgtgggtcgcgcaggaaatgaacaaaatggtcattatcgtttcaatcattgctctggcagcggcgatcattttaagctatttcgttgccaaaacgatcacaggcccgattaagcagctgattgccaaaacaaaagcagtcgctggcggcgatttgacggtccaaacagcagctgcctcaaaagatgaaatcggtatattgacaaaagactttaacaagatggtcgatacatataaagcacagattgggctagtcnatacaagtg

SEQ ID NO: 1895 - DNA, 954 bp, Bacillus licheniformis
atgggaatcaaaggaatcgacgtatcacactggcaaggtaatatcaattggaagaaagttgcgggggacggtattaaattcgcttttatcaaagcaacagaagggacaacattacaggacaataaatttgtaacgaatatttcaggtgctaacgctgtggggattaaaacgggagcctaccactttgcaagattcggttccaagtcagaagcattggcagaggccaggttctttttgtcagttgcaaataaggtccatctcacgtatccgcttgtgcttgatcttgaagttaatcagcggaatgtcagtaaatcagttttgacagatgcagcagtggcctttttacgggaagttgaaaaagctggttacttcgccatgatatacagcggtaagtctttccttgagaattgccttgacgaatccaagctgaagccatttgcattatgggttgctcgttataacaacacacttggccgtcatgcagatatctggcagtattctgattgtggaagggtcgccggtatttctgggaatgttgatatgaatatttgttatcgtgacgggttacgggctcaggtagccgtgacaactgaaaaagctgctactgtaaaacctgtttcaaacaaaaagccagttaaaacggagacagtttacacagtcaaaaaaggggacacgctttcggaaatcgcacagaaaaacaacacgaccgttaaagctctccaaaatttgaataacattaaagatgcgaataagatttacgttggccagaaattaaagattagcggcagtccttcaacagcatcgaataaaaagcaatattacaccattaaatccggtgacactttgtctgggatctcgaaaaggtttaatacatccattaagacgctgcaagcttggaatggtatcaagaatgccaacaagatttacgctggtcagaaaattcgtgttagataa

SEQ ID NO: 1896 - DNA, 432 bp, Bacillus licheniformis
atgaataaaaaacttctaggaattatgatgacgattattttggcaattgctgtgttgggaaccgctgcgttctttgtcatcaagggaagcgcaagtgaaaaagatcaaaacgcagaaccttcgatcgatgaagtggtcgaatcttcagttgaagtcgccgaaatcacgacaaacttgaaatcagacaatgtagtccgtttgtcaatcaagcttgaaaccgattcgaaagaggcgaaagaagagcttgaaaagcgggatttccaaattaaagattcagtcatctcccttttggcgaacacgaacgcagatgagcttgagggcaaaaaagaaaaagaaaaatttaaagaacagctgaaagaaaagctgaacacgaactacatgaaagagggaaaagtgaaaactgtgtacattacctcctttaatctgcagtag

SEQ ID NO: 1897 - DNA, 402 bp, Bacillus licheniformis
aaacggttgacgatcttttggttgaagcgtttgccgttgtcagggaagcttcccggcgcgtgacaggcatgtttccgtttaaggttcagctgatggggggcgtcgcccttcatgaagggaatatcgccgaaatgaaaacgggggaaggtaaaacgctgacttccacaatgcccgtttacttgaacgctctgtcagggaaaggcgttcacgtcgtgacggtcaacgaatacctggcgagccgcgacgctgaagagatggggaaaatctttgagtttctcgggctgacggtcggcctaaacctgaacagcctgtcaaaagacgagaagcgtgaagcctatgcagcagatattacgtattctacgaataatgagcttggctttgactacttgcgcgacaacatgg

SEQ ID NO: 1898 - DNA, 530 bp, Bacillus licheniformis
atgaaaaatagtagaaaaaaagagatcttatcgtgggtgaaaacacttgtcatcgccgcagcgcttgtgatggtttgccgctattttctgtttacgccgtcaaccgttttgggagattcaatgtatccgactttagaggacggcaacatggtcatggttagtaagatcagcgatattcagcgctttgataaaattatttttcacgcgcctgattcggatgaaaactatgtgaaaagggtgatcgggctcccgggagatacgatcgaaatgaaggatgatgtcctttatataaacggaaaagcatacgatgaaccttatttaaagaaaaacaagcaaaagctgacgcttcatgaacatttaaccgataatttcacattggagaaattaacaggtgaacaaaaggtgccggaagatcacttgttcgtgatgggggataaccgtcaaaacagcaaagacagccgctttttcggatttatcacaatggactccgttgtcggcaaagttgagttccgttatttccctttcaatga

SEQ ID NO: 1899 - DNA, 270 bp, Bacillus licheniformis
atgaattcagaatttgttatatcgatggctgaaagggctgtatacgttacattgcttatcagcgggccgcttttggcgctcgctcttctcgtcgggctgatcgtcagcgtttttcaggcaaccacccaaatacaggaacagactcttgcattcattccgaaaatcgtcgccgttttggtcggactcgtcgttttcggcccgtggatgctgtcgacgattttgtcattcgcgactgagctgttctctaatttaaaccgttttgcagggtag

SEQ ID NO: 1900 - DNA, 693 bp, Bacillus licheniformis
ggacgatttcattaaaggaagtcaaacttcctgagacagaaaccgaacttgataccggacaggatccggaatacctcctcgaccatgccagacaagaagccggaaaaatatacgaaaaagcgagcgctgaactcgaacaggtcagacggcaaatcgaagaggaacggtcaagctgggaaacagaacgcgaagcgctgatagaccaggcgaaacaagaaggctttcaagctggatttgaagagggaaaggccgaggcccgaagcgcttatcaagcgtatttggatgaagccaatgccatcgtccgggcggctagacgtgactatgaagaaaaaatcgaacaatcatccgaagaaattgtcgaacttgccgtgtcactggctaaaaaagtttggaatcaaaaggctgacgacaaagaagcttttacagccctcgtaaaacaggtgctgtcggaaatgaaggaattcgatgacattgccatctatgtagatccggagtactacaccgaggttcaaagccacaaaaacgaacttgagcagctcctccaatacggcgcccatatcgcgatatacgccgatgaaaaagcgccgaaaggaacgtgctatgttgaaacggctttcggaagaatcgatgcaggcatcgacactcaattgcagcagctgaaacaaaaactgctcagcctgcttgaaacggcag

SEQ ID NO: 1901 - DNA, 246 bp, Bacillus licheniformis
gcttggaacattacttccgattattttaatgtttgcggttctttatttccttttgatccgtccgcagcaaaagcagcagaaggctgtccgccagatgcaggaggagctgaaaaaaggggataaggtcgtaacgatcggcggcctgcacggcatcgtggattcaattgacgaaagcaaggttgtcatcaaaacaggcgacaatacccgtctgacattcgaccgccgcgcaatcagagaggcgtcagc

SEQ ID NO: 1902 - DNA, 561 bp, Bacillus licheniformis
agccgaaaacgagcacaaccgaagatggaaaaagccctgaccaggcaaaagatctctccgaagctcaaaaagaaaaagacaagcagtcgctgaaaaaaattcaggagcaggtcaaccggtttattaaagagaagaatcttcaaaaacaggtcaatacgaagctgacagacgagggcctcctcctttccatcgaggataatatctttttcgattccggaaaagcggagatccgccagcaggacattccgctggccaaggaagtatccgaccttctcgtattgaacccgccccgcaatatcgtaatcagcgggcatacggacaatgtgccgattcgaaattctcaatttaaatcaaattggcatttaagcgtgatgcgggctgtcaatttcatggggcttttaatcgaaaatccaaagcttgacgccaagatcttcagcgcgaaaggctacggggaatttaaaccgatcgcttcaaatgacaccgaagaaggaagaagaaaaaacagacgcgttgaaatccttatcctgccgatcggccaggaaaatctgaataaaaaagaat

SEQ ID NO: 1903 - DNA, 292 bp, Bacillus licheniformis
gtgaatgaaaagggatttacactgatagaaatgttagtcgtcatgctcgttatctccatcctgctgttgatcaccattccgaatgtgaccaagcataaccaaagcatccaaaagaaaggatgcgaaggattaatcaatatggttcaagcgcagatcacggcctatcagatggatcatgacgggaaaacgccgaacagggcggagcttgaatctgaaggttacataaaaaagaacttaaagtgtccgaatgggaaagcaattaaaatttcaaacggcaaagcacaggctgatt

SEQ ID NO: 1904 - DNA, 620 bp, Bacillus licheniformis
atgaagaagaagatagcagcaggtttggcggcctctgcggtagttggaacttcattggcggcgtcaccggtcgaagcccaaaccatcaaggtgaaaagcggagactcactgtggaagctttcagctgagtacaatacgagtgtttcggcacttcaatcagccaacaatctttcatcgacggttatttatgtcggacaaactttaaaagttccggacggcaagtcgaaaagcagctcacagacaaaatccgcaagttccagctcaagttcaagcgctgccaagtccacttacacggtgaaattgggagattccttgtggctgattgccagagactacaaaacgaccgtacaagagattaaaaacttaaacgggctgagcagcgatatgatttatccgggacaaaagctggttattaaaggaagcgcaaaaagcgccggttccagctctggatcaagctccaaatcatccggctcatcatccggctcacaaagtgcaagcagttcaagcagcacatacaaagtcaaattgggcgactctttatggaaaattgccaatagtttgaatatgacagtcgccgaaattaaaacgctgaacaacttaagtcggacacgatccaaagc

SEQ ID NO: 1905 - DNA, 243 bp, Bacillus licheniformis
atgaggagtcctcccggattaatgccataaaaacagactatagacacattgactttaaagggaatgagccaaattattcagttgtgtcgagaaagaatacaacttatcaagaaaacgggaacaatgtggacgttgatcaggaaatgagtgaaatggcgaaaaatcaaatccagtatcaagcgctggttgaaagaataagcggaaaattcaactcgctaagaaccgcgattacaggaggtaaat

SEQ ID NO: 1906 - DNA, 334 bp, Bacillus licheniformis
ttgtcgatcaatagattgtcatctttagaacccattattgatgcttacaaaacacagatgttgaataaacagtatgaagctgtggaacgcccgcagcagacggacgctgcagaatttacatttgctcagcttgaaaaaaccatacaaggcgcaaacaaccttttggagccgtcgcaggtgcacctacagtttgtgcttcacgaaaaattgggagagtattatgtgaaggtcgtggacaatcggacagaggaagtcgtccgcgagattccgccaaaggagtggctcgatttttatgcggcgatggcggaatttatggggttaattgtcgataaaa

SEQ ID NO: 1907 - DNA, 232 bp, Bacillus licheniformis
atgggggtattcaatagcatcaacatttcagcttcagcgttgactgcacagagagtcagaatggataccgtttcttccaacctggcaaacatggatacgacgagagcgaacgtggttgacggacagtggcagccgtatagaagaaagcttgtatcgacggctccgaaaggcgaatccttttcatccgttctccaatcatcgatgaatgcatcggcgagagtcggcgaagggg

SEQ ID NO: 1908 - DNA, 483 bp, Bacillus licheniformis
atgaaaataagcagtttcacggcatgccgaatgtagctgcagcgggatatcatcaccatccatatccttatccgttctatcctggaggctgctggattcctgtttcaccggtgctgcctggatcgggattgtgccatccttggtatccatatcctgctcaaatgccttatatgcatcagcctagctatgtatctcctgctgaatatgacgatgatgacaacatggggcatgacaatgccggtcatcacggataccatcatcagccgatgactgccccggcatatgcgccttaccagccgttcccgggatttgcaccgccaaacgtcggtcacgccggggaccctaatatggcacacggcaaagaagatgactgcgggtgcgggccgggccaattcccgggaggttttccaggtgcggcgccatatggacagatgccgcaaatgggagctccgtacggtatggggggatacggacagcagcctg

SEQ ID NO: 1909 - DNA, 161 bp, Bacillus licheniformis
atgcttggaattttaaataaagtgtttgatccgacaaaacgcacgctcagccgttatgaaaagaaagcgaacgagattgatgcgctcaaggcagatatagagaagctttcagacgaagctttgaagcaaaagacgatcgagttcaaagagcgccttaaaaa

SEQ ID NO: 1910 - DNA, 399 bp, Bacillus licheniformis
atgtcaaagattgtcaattgggtgaagcgtccctccattgcaaagaaattaattctttcattcttgcttattttaaccgttccaatcatcgtcctttcctatagtgcgtatcaaacggcaagcagtacgcttgacggagaaatcatggacaatgcgcgcgaaaacgttaaccagttgaatgaaatcatcaatcagaatatcagccagaaaacaaacgccatgtcttatttcagcgggttcattaaagaaaactcttttacagggaaagaaagcgacgctttaaaagtgaaattcgaacagttcgccaagcttcatcccgatgttgaagggatctttaccggttcaaaggacgggaagttcatccgctacccggatcaaaagatgcccgcgcggatataa

SEQ ID NO: 1911 - DNA, 336 bp, Bacillus licheniformis
atgacagtgaaaacggaagcggtcaacggcgtcaaaatgatcgaaaagaacaaaaggacatttgaatctattgacggcttaatggaagagttcagcgtaagaatttccgacttgtcttccgacgcccggcatatatcgcaaagcattcaaaacatcacaacatcatttacagcaatctcaaaagaagttcaggaaacatctgattattcacaacaagtcgcaggtctgacagaagagcagtttgcggctatggaagaagtcaccgcctctgcaaatgaactctccaaactggctgaagatttgcatcagctcatcggtgaagtcaaaatgaaatag

SEQ ID NO: 1912 - DNA, 314 bp, Bacillus licheniformis
atgtctgatacttcaattgataccagaaccgccttaggaacaacaaacacgaaatcgacgacatccgattttttatccgaggcaaaaaaagccgagaaagcagggagcggctccaatcttgggaaggatgaatttttgaaactgctgatgaaacaactgcagtaccaagatcccttaaatccgatggaagaccgcgaattcattgcgcaaatggcgaccttttcaagcctagagcagctaacgaatctgaacacaacgatgtcgacgttcgtcggacttcaggacccgatgacgatgtatgtcagcggaaccaa

SEQ ID NO: 1913 - DNA, 348 bp, Bacillus licheniformis
tgaaacggaccgcttccaacattgtgcctggaggcgtgaagaagtcaaacgaagtagaagaagaccgtttcctcgcacatacaagggcccatcagaagcaagtgaagcaaaaggagaaaaaagtaacccagtaatcaatgaaaggatgacagcaaatgctttcaaatatcggtattcctggtctcatcttggttctggtaattgcgctgatcattttcgggccttcaaagctcccggaaatcggccgggcttttggaaaaacgctgaccgaattcaaaagcgcgacaaagtctttagtctctgccgatgacaatgagatcggacaggggtctgatgcgaagaagcaaa

SEQ ID NO: 1914 - DNA, 909 bp, Bacillus licheniformis
tgccgctgacaaaaagtcggaatcgctgtggctggctgaaatggaagacgcagccaaaaaaaacggacgtgatccgaaatacgctctcgcgatggccgatgcagacgtcgatgctaaagaagtaggggcgccaaagggcgagctgctcacattaagccctgacaaagcgctgaaagtcggctattccgaaggcacagtttcgagccttgatgatcttttgaaaaagctgaatttgaaggatgccaaaatcgagcgtgccgaggtaagctttgccgaaaaggtggccaggtttatcacgcatccggtcgtgattccgattcttctttcaatcggaagcctcgggctgattgtggagctttattctcctggttttgggatccccggctttatgggactcaccgcattgctgctctttttctacggtcatctcgtcgccgggcttgccggaatggaaacgatccttctgtttgcagcaggcattattttaatcattttagagatttttctgccgggcggaatagcagggattgccggcctgatcgcaattgttgcgagcctctttttagcttcgggaagctttaaggtcatggccgtctccattttgattgcaactgctgtttcgatagcggcatccattctattgacaagggtgttgggtaagcgtatgaaattttttaaaaaattgatcttaaccgactcgacaagcacagaaagcggatacgtgtcaaatgaaagccggcgcgatttaattggcaaaatcggcgtcacgtatacaccgctcagaccgtccggaacggtcatcatcgacgatgaacggcttgatgttgtatctgaaggctcgttcaccgcaaaggataagaaagtgaaagtggttaaagtggaaggctcacgcattgttgtgagagaatt

SEQ ID NO: 1915 - DNA, 1008 bp, Bacillus licheniformis
atgaatgcgaaaagatggatcgcacttgtcatcgcgctgggcgtttttgcgttatctgcggtgatgagccttttgcttgcagtatttgacacgatggggaatgacggaaagatgcagtttggcctcaatgacacccaggaagaaacggtgcttgaacaaggaaacagctcaagaaaaatcgccgttcttgaagtgaacggaacgatttccgacaatggcggcgcttcaggcctgttcagctctgaaggctacaaccacagatcgtttttgcaaatgcttgaaaaagcaaaagacgattctgccgtaaagggcattgttctgcgcgtcaattctccgggtggcggagtatacgagagcgctgagatacataagaagcttgaagagatcaaaaaagatacgaaaaaaccgatttacgtatcaatgggatcgatggctgcgtccggcggctattacatttcaacgcctgccgacaaaatctttgcagcgcctgacacgctgacgggttcactcggggtcatcatggaaagccttaactacagcaagcttgcagagaagcttggattaaaaacggagacgattaaaagcggtgagtttaaagatatcatgtcaccgacgcgcgatatgacgaaaaaagaaagagaaatcatgcagtcaatggtcgatgacgcgtacgaagggtttgtagatgttattgccgaagggcgcggcatgtccgaaaatgacgtgaaaaaaattgccgacggacgtgtctatgacggccgccaggcgaaacagaaccatctcattgatgagctcggctattatgaagatgcggtcaaagcgatgaaaaaggaccacaaaaaccttgccggcgcatctgttgtcagctatgaagaatcagccggccttgcctcgctgttttcaatgactgcaaataagatgtttaaaagcgaagctgatttcttaaacattaaagaagcgatttctcaatccggtgcaccgagactcatgtatttatatgccaaatag

SEQ ID NO: 1916 - DNA, 630 bp, Bacillus licheniformis
aaggggagcagccggctaagcaggacgcaaaagacagtctcgtcaacaaaatccagcagctcggcgaaacgacactcccgcagatggggcaggacaccaacattcactgcctgaccattatcggacaaattgaaggtcacgtccagcttcctccccaaaacaaaacaacaaagtatgaacatgtgattccccagatcgttgcagtagagcagaatcctaaaatcgaaggtctgctcatcatcttaaacacggtcggaggagacgtagaagcgggccttgcgattgcggaaatgctggcgtccctgtcaaagccgacggtctctatcgtactgggcggcggacattcaatcggagttccaatcgcagtgtcctgcgaccacagctatatcgctgaaacagctacgatgacgatccatacgatcaggctgacaggactagtcatcggtgtacagcagacatttgaatatctcgaataaatacaggaaaggatcatcaattacgtgacaagccattccaacatatcggaagaaaattataaagaactgatgtattcaaaaaacaatttaacccgtgacatcgagacgaatgtcataggaaaaaatgcggttaaatacggattaatcgatgaaa

SEQ ID NO: 1917 - DNA, 498 bp, Bacillus licheniformis
atattaattcgccaggcggctctgttttcgaagggaattcgatctacaacatcataaagcggcacaaagcccacgttaacgtctacgtcgacgggctggcggcctctatcgcaagtgtcatcgcaatgtccggtgacgctatttttatgcctgcaaacgcgatgatgatgattcataatccgtggactgttgcgcaaggcaatgcggaagaactccgcaaacaagccgacgacatggatcgtattcgcgaaagtcttatcgaggcatatctcggaaaagcaggcgaaaaactcaatcgtgatcgtttgatcgaacttatggacgcagaaacgtggctgacggcgcaagaatgtctcgaattagggctgtgtgattctatcgaagctcctagcgctgcggttgcgaaagtggatacgcagttatttgcgaagtaccggaacactccggaatcgcttcttaatcagacgaaagaggacgaaaagcaggcggaaaaagagc

SEQ ID NO: 1918 - DNA, 1134 bp, Bacillus licheniformis
atggagaataacaataggttatcacaggatgaaattgatgcgctgcttaaaggcggcgatgatacggctcaagagcagccagaatcagggttgtccctgatggaacaggatacgatcggggaaatcggaaacatttcctttgggagctctgcaacagctttgtccactttattgaatcaaaaagtcgaaattacaacgccgactgtttcggtgattgaaaaaagccatttaaatgatgagttcccgcacccgtatgtttcaatcggtgtgagctatacagaaggtttttcaggaaacaatcttctcgtcatcaagcaggaagatgccgcgatcattgctgacttgatgatggggggagacgggacgaacgcagatccgtcgcttggcgaaattcatctaagcgccgttcaggaagcgatgaaccaaatgatgggttccgctgcgacatcgatgtccaccgtcttcagcaagaagatcgatatttctccgccggaagttgacctccttgatgtgaaagaaggggaagggacagagcaaattccgaaagaggacccgctcgtcaaagtatctttcagactaaaagtcggagatctgatcgattcgcatattatgcagctttatccgctgacctttgcaaaagatctgattgatgaattaacaaatcaggacggcggagaagagcctgtgaagactgaagaggtacagacgcccgtacaggaaaaaccggcgcctaatccgaattcggcacctgctcagacacagagacaggagccggcgcctaaacggcaagggacggcaaaagtttcagagcctgtgcaggtggcaccggcagagtttcaatcctttgcccctcagactgaagcgcagccgcaccttcaaaaccttgacatgctcatggatattcctttgtccgtcacggtcgagctggggaggacaaaccgcagcgtcaaagaggtgcttgaactgtcaaccggcagtatcattgagcttgacaaactcgccggtgagcctgttgacatcttggtcaaccagcgcgtcgttgctaaaggcgaagtcgtcgtcatagacgaaaacttcggcgtcagggtgacagacattttgagtcaggctgaacgaatcagcaaattacgataa

SEQ ID NO: 1919 - DNA, 1074 bp, Bacillus licheniformis
atgattcgtgttcttgtcgttgacgactctgcttttatgagaaacatgatcaccaagtttttaacatccaatcacgagattgctgtagcaggaacggcaagaaacggcgaggaagcgctccaaaaaatcaaggagctccgtccggatgtgatcacattggatattgaaatgcctgtgatgaacggaaaagaaacgttgaaaaggattatggcgagcgatccgcttccggttgtcatggtatcgagcctgacgcagcagggagcagatatcacgatcgaatgtctggagcttggggcgatcgatttcgtcgcgaagccgtcgggttcgatttcaatagatttatataaagtaagagacatgctgattgagaaggttttgacagcaggacgggtgaaactgaaaggccggcaagttccgatctcaaagcccgccatcgagacggcgaagcagccgattgtgggcggcagcgattcagtccgctttcgggctggaaaacagctcatctgcatcggtacatcgacaggggggccgagggcgctgcaaagagtgcttcccaagcttcccaaaacgttgaaggcgcctgtttttatcgttcagcacatgccaaagggctttacggcctcattagcgaacaggctgaaccacctctcagaagtaaccgtgaaggaggctgaaaacggtgagagagcgaaagacggctgggtttacattgcacccggaggaaaaaacatggcggtcggccttgaaaagggcgaattggtgatcacgctcgatgaccgcgacacagaaagccgccacaagccttctgttgactacttgtttcaatccctggcctcacttcgggagtttgaaaaaatcgccgtcattatgacggggatgggaagcgacggaacagaaggcgtaaaaggccttttgaaacatgggagcggaacggtgatcgccgaagcagccgagtcgtccgtcgttttcggaatgccgaaatcggtcattaacaacgggcttgcaaacgacatcaagcatgttgatgagattgccgcagccattatgacgtatatgaaaaaagagagggcgtga

SEQ ID NO: 1920 - DNA, 761 bp, Bacillus licheniformis
atggacaattacagtttctttgttgataaatggaaaaaaatgactggtgtggatttggcattgtacaaagaggcgcaaatgaaaagaagactgacgtctctatatgagaaaaaaggatacggcgatttccgcgagtttgcgctcgctttagaaaagaatgaagctcttctgcaggaaacattggacagaatgacaatcaatgtttcagaattttacagaaactataagaggtgggaggttctcgaaaaaacgatcctgccgcttttaaagcctgcgaaaacgctgaaagtttggagcgcggcttgttcaaccggggaagagccttatacattatcaatgattttaagcagacagaaaggcctcacagactatcagattatcgcaacagatatcgatgacaaagtccttcagaaagcgaaagaaggcgtatatcaggaaaggtccctgcaggaagtgccgaaagagatgaaagaactttattttacgcaagacggaaaccgctttaaagtcaaagacgagatcaggaaaaacatccgctttcaaaagcacaatttactggctgatccgtatgagaaagattttgatatcatcgtatgccgcaatgtgctcatttattttacggaggaagcaaaagagaagatctatcataagttcagcggcagcctgaagaataaggggattttgtttgtcggaagcacggaacagatcttcaatccggaaaaatacggttttcaatcgacagatacgtttttctatcaaaa

SEQ ID NO: 1921 - DNA, 633 bp, Bacillus licheniformis
atgatgagcgtatttaacggaattagagaagagcatcttgatatattgcgggaagtcgggaatatcggagcgggccattccgcttccgccctggccctgttgctgaacaggaaaatcgaaatggaagtgccgtttgtcaagctgatgtcgtttgatgagcttgtcaacctattcggcggtgcagatcttcctgtcgcaagcatctttttgcgcatggaaggggattttccaggttctatgttcgtgatcatgcctttttcagaggccgagcagctgatcagggagcttgtcggcaatccggaattcgagattgacagcatgacgccgaacgatatcggagcctctgccctgcacgaactcggaaacattatggcgggatcttatttgaccgctctcgctgatttgacaaaccggcaaatgtacccgagcgtcccagaactgacgctagatatgttcggagccgtcatcagcgaagggctgatcgagctcagccaagtcggagatcaagttatcgtgatcgacaactccatttttgacgaggagcacaaccggaaagttaaagcgcatttgttccttctgccggactatgattcttttgaaaagctctttcatgcattgggtgcagcgctatga

SEQ ID NO: 1922 - DNA, 486 bp, Bacillus licheniformis
agaaacatcgattatcagagtgggaattgccgatgtaaaaatcgtccgcactcccgacaagatcagaacatcgggtctcggttcgtgcgtcgggctcgtgctgtatgatttggaagcaaagacggccggtctcgtccacgtcatgcttccggactcttccttatccaagacgccggacatcaacgtggcaaaatacgcggacacagccgtcgaagcgacggtcaagatgctgcttgaagccggatgccgaaaatacgctttgaaagcgaaaatggccggaggagccgaaatgtttaaatttaagatgacaaatgatttgatgaaagtcgggccaagaaatgtgcttgcgattaaaaaacatctatctctcttaaacattccgattgtaagcgaggatacaggcggaaacagcggaaggacgatcgagttcgatccgcaatcagctgaacttgtcatccggacagttaaacaaggtgtaacaacgat

SEQ ID NO: 1923 - DNA, 428 bp, Bacillus licheniformis
atgagcgtatttaccggaactagagaagagcatctcgatatatgtcgggaagtcgggaatataggagcgggccattcaggttccgccgtggccctgttgatgtacaggcaaatagacagggaagtgccgtttgtcaagcagagtgcgtcgacgtagctagtcaacttattcggcggcgcagattttcctgtcgcaagcatcattttgcgcatggaaggagatcttgcaggttttgtgttggtgataatgcctatttcagagcccgagcagatgattaggaagatcgtcagtcaataaggaagtagagattgtcagcatgacggagaaggatatatatagcctctaccgtgctcgatctcggaaacagtatggtcgggatagtatttgaccgctctggacgatgtcgacaagccaggcaaatgtccctc

SEQ ID NO: 1924 - DNA, 321 bp, Bacillus licheniformis
atgcgcaaaatgatgcttgcgacaggaaaatctgcgccgccgaataagttgactagctacgtcgacgcactctgcttgacaaacggcacttccctgtctatttgcctgtacatcaacagggccacggcggaacctgaatggcccgctcctatattcccgacttcccgacatatatcgagatgctcttctctagttccggtaaatacgctcatcattggctccttattccgtcacatgctcagaatcggcagcaaggctcgacttctgcgcttgaacaacttcagatgtcatcatattgagaattctcgggcgcttgcttga

SEQ ID NO: 1925 - DNA, 3825 bp, Bacillus licheniformis
tggaacaagtagcggcttttccggaagtagaaaaagtgcttccgaacgaaaaaaggcagctgatcaaaccgactaaacagtctgtgaaaaaatcagcagccaaggatgaaaaagaaatcgaatggaatatcaatcgagtcgacgcaccaaaagcctggaaattgggatatgacggatcgggcacggttgtcgcgtcgattgatacgggcgtgcagtgggatcatccggccttgaaagaaaaataccgcggatatgacccgcagcatcccgatcagcctaaccacgaattcagttggtatgatgcggtttcaggcgcttctgaaccatttgacgatctggagcacggcacgcatgtaaccgggacgatggtcggctcagagcctgacggccaaaaccaaatcggcgtggcgccgggtgcgaagtggattgctgtgaaagctttttcagatgacggcggtacggacgaagaccttattgcagcaggtgaatggattttggcgccaaaagataaagacggcaacccgcaccctgaaatggcgccggatgtcgtcaataactcatggtcagggggagccgggattgatgagttttacagggatatcgtaaaagcgtggcgagctgccggcatctttcctgagttctctgcggggaacgtcgatttcgccaatccgggaggacctgcttcgattgccaatccggcaaactaccctgaagcgttcgcaaccggagcgacagacatcgataatcgcttagccgatttttcacttcaaggtccttccccgtatgatgagactaagcctgaaatatcggcgcctggtgtcaacattcgctcatctgtgcctggaagcggctatcaagacggctgggacggcacttcaatggctggcccgcatgtcgcagccgccgccgctcttatcaagcaagccgattcgtcgatcactgttgatgagaccgaaaagattttgatggaaactgcaacaccgctcacagacagcaaatttaccgaatcgccgaacaacggatacggccacggactcgtgaacgtgtttgacgcagtgtccgctgtgacagacgggttgggcagagcggaaggacaagtcggaaaagaaggcgaagacaaaagtccgccggccttaaaccatcaagagatcaccgaaatttactcaggctcggaaacgcctcttaaagctgatgtagaagacgatgtcagcatcatatcggtcaaattgagctataaaacagatgacgccgattgggagacgatcgctgccaaacaaacttccggcgactataaaaaaggaacgtacgaggcggctgtaactgtttctgaagggaaaaccctttcctacaagtggattgtcaccgatttcggaggcaacaaaacggaatccaaagtgtacgaagtcccgatttccccggctgtgacaacagggtataaacaagatttcgagaattccgccagcggctggctcacatcaggcgtgaagaattcatgggagcgcggaattcctcagtcaggcccgaacgccgcagcatcgggaaaaaacgtattcgcaacaaatctgacagggccgtatgaaagttcggctaatatgaatcttctcatgcctcctgtcagcgttccaaaaaatcaaaagctttatctcacatacaaatattggcgcgatattgaagaggactttgattacggcttcgtttacgtacagcctgaaggaaaaggtgaatggatcccggctgccgagtacagcggcaagacatcagaatggaaagacggacagatcgatttgtcggaatacgggggacagacgattaaggtcatgttcaaccttcaatctgacgacagcattgaaggtgacgggctgtacatcgatgatgtagcgcttgtcaaggaagtgaagagcgccggtacgaaaaaacgattgggcgttgaaaaacagccggccaaaatgaaggataagaaaacaaagaaacgaatgattgatccgaaaaaagcaaaaccggcagaagcccttcaggaaaaaaccgaaacgaaaaaagcagctcctgcggttcttccggtgcgcgctcaggtcagcgtgctggaaacgggcaaatcgacatattccaaccaggcaacaggcgcatacagcttggctcatgcacctggaacctatacgctgaaagcggaagcgtacggatatgaatcaaccgcccaaaccgtaaaaatcgagtccgacaagacaacaacggcagactttgttttaaaagaactaaaaaaagggacgctcaccggaacgataaaaaataaaaaaacgggcgaacccgtccggcatgcaaagttgtatatcgttgaagatgcagctgtaaaaccagtccagacggatgatgacggaagctattcattaacggcctatgaaggctcgtatacggtaaaggtctctgcaaacggatattacagcagcgagttttccgttgatttaaaaggcgatgtctcgaaagatatcgatctcgatcctttcatcggctatccgggggaaataggctatgatgacggaaccggggaaaacgcctgggctttctatgaatccggcaacgggctggcggttaaaatgacgcttgaaaacgggcaggaaaaagccatgctgaaaggcggtttgtttaaattctgggatacagaattccctgatccgggcggcactgattttgcagtagaggtctatgatgcttcgggtgaaaaaggctctccgggcaaaaaaatcgccggcccgttcaaggctgaagcgctccgcacaggcgaatggacgaccgttgatttaggtgacgaaggcatcatcgtcggaaaagacttttacctcgtatacgtccagaaagaggatctggccaactcacctggacttgctacagacgaagacggagaatattccggccgcaactggcagtatacggacggctcatggtcaaaagcgccatcagaccaaggcaactttatgatccgcgctttggtcgactatgaattgtcggtgcctgtgattacgtctcctaaagacggattcatcaccaaccaaaagaacgctgtcattgaagggacatcctcgccgaatacgaccgttcatctctttaacggggatgaagaagccggaacagcggaaacggcggcagacggcactttctcaaaagaaataccgttgaataaaggggaaaatgtcatcaccgcgaaatcgtcatcggcttccggaacgactgatgcttcagaaccggtccggatcgtccttgaccagaaaaagccgaagcttacaatcgacacgccggaaagcggctcaaaactcaataaagagaccgtcaccgtgaaaggaacagtatcagacgatcacttagaatctgttcatgtaaacggcaaaaaagcagctgttgacaatggcgaatattctgcaaggattatgcttgacaacggcaaaaatgaaatcaaagtaacggcatcggatgcggcaggcaacaaaacgaccaaaaaggtcacggtagatgtcaactttgaagcgccgcaaatcaccggcttgaaaccggccgaagatctcgagctcaaaacgggagaaaccgtgaaaatcgagtttgaaagcgccgctgatttggatgctgtctttgtgatcagaatgccgctgaccaatttcaaaaccgctgcccaaaacgtaacggagctgccgatcagagaagtctcaaaaggaaaatatgaaggatattggaccgctacttcaactgcaaaagcaaaaggagcggaaatcgaggtcatcgtcagagatgattacggcaatgaaacgagacaaacggcaaaaggcaagctgtatatcaatg

SEQ ID NO: 1926 - DNA, 2433 bp, Bacillus licheniformis
atgatgtttggaagattcacagaaagagcacaaaaagtattggcgcttgctcaagaagaagctctgcgtctgggccataataacattggaacagaacatattctcctcggccttgtccgcgagggagaaggaattgctgcgaaagcgctgcaggcgttaggactcagccctgacaagattcaaaaagaagttgaaagcctcatcggccgcggacaagaaatgtcacaatcgatccattacacaccgagagccaagaaagtgaccgaattggcgatggatgaagcgagaaagcttggccactcctacgttggaactgaacacatcctccttggcttaatccgcgaaggggaaggtgttgcggcaagggtgctgaataatttaggcgtcagcttaaacaaagcgagacagcaagtattgcagctgttgggcagcaatgagagcggaggcgctgcttcaggcgccaacagtagcgccaacacaccaactttagacagtcttgcccgggatctcacggcgattgcaaaagaagacagccttgatcccgtgatcggcagaagcaaagaaattcaacgcgtgattgaagtgttgagccgcagaacgaaaaataaccctgtgttaatcggggagcctggtgtcggtaagactgcgattgccgaaggcctggcccagcagatcatcaataacgaagtaccggagattttacgcgacaagcgcgtcatgacacttgatatgggaacggttgtcgccggcacgaaatatcgcggtgaatttgaagaccgcctgaaaaaagtgatggacgaaattcgtcaagcgggaaatatcatcctcttcatcgatgagctgcatactctcatcggagccggaggagcggaaggggccatcgatgcctccaatatccttaaaccgtcgctggcgcgcggagagctgcaatgcatcggggcgacaacccttgatgaataccgcaaatacattgaaaaagatgctgcactagaacggcgttttcagccgattcaggttgaccagccgtctcctgaagaaagcattcaaatattgaaagggctcagagaccgctatgaagcccatcaccgcgtatcgattacggatgaagcgatcgaagcggcagtaaagctgtcagaccgctacatttcggaccgttttctgcctgacaaggcgatcgacttaatcgatgaagccggctcaaaggttagactgcgttcattcacaacgcctcctaacttaaaagagcttgaacaaaagcttgatgaggtaaggaaagaaaaagatgccgctgttcaaagccaggaattcgaaaaagcagcgtctttacgtgatacggagcagcgcttgcgtgaacaggtcgaagaaaccaagaaaacctggaaagaaaagcaaggtcaagaaaattccgaagtgaccgtcgacgatattgcaatggttgtatcaagctggaccggagtgccggtttccaaaattgcgcagaccgaaacagacaaattgctgaacatggagagcattcttcattcccgcgttatcggccaggatgaggctgtcgttgcagttgcaaaagcagtcagacgcgcgcgtgccggcttaaaagatccaaaacgtcctatcggttcgtttattttccttggcccaacaggcgtagggaaaacggagcttgcccgtgcacttgccgagtccattttcggcgatgaagaagcaatgattcgcatcgatatgtccgagtacatggaaaaacattcaacatcaagactcgtcggttcacctcctggatatgtcggctatgatgaaggcggacagctcactgaaaaagtgagaagaaaaccgtattccgtcgtcttgcttgatgaaatcgagaaagctcacccagatgtcttcaatattttgctgcaggtgcttgaagacggccgcctgactgattcaaaagggcgcacggttgactttaggaatacgattttgatcatgacatcaaacgtcggtgcgagcgaactgagaagaaataaatacgtcgggtttaatgtccaggatgaaacccagaattataaagatatgaaagacaaagtcatgggtgaactaaaacgcgcctttagacctgaatttatcaaccggattgatgagatcatcgtcttccactctttggagaaaaaacatttgaaagatattgtatccctcatgtcagaccaattgaccaagcgtctgaaagaacaggatctttcaattgagctgactgaagcggctaaagaaaaaatcgccgatgaaggcgtggatctcgaatacggagcgcgtcctctcagaagagcaatccaaaaacacgtggaagaccggctgtcagaagagctcctaaaaggccatattcaaaaaggccagcatattgttttggatgtagaagacggagaatttgtcgtaaaaaccgaagctaaaacgaactaa

SEQ ID NO: 1927 - DNA, 2712 bp, Bacillus licheniformis
gatacaagggaattcggttaaagacatcgcccgggcagctgcaaatggagcgttccaatgtcagatttgaatttatcaatctcgttcgggccaaaaaggtgatcaagattaaaacgttccccgtccgctacatcccggtggaaattgttgaaaacgtcttgaacatcaaatggaattcagagttgatggaggttgaagaactgaggcggctggctgacggccaaaaaaagccggcgcgcaatatatccgccgatcccctcgagctcatgatcggggctaaagggagcttgaaaaaggcaatttctcaggcgaaagcggcagtcttttatcctccgcacggcttgcatatgctgctgctcgggccgacgggttcggggaaatcgctgtttgcgaatcggatctaccagttcgccgtttattctgacatattgaagcccgattccccgttcatcacattcaactgtgcagattactataacaaccctcaattattgctctctcaattgttcggacataaaaaagggtcttttacaggtgcgggtgaagacaaagcaggattagtcgagcaggcggacgggggcattctgtttatggatgaaatccatcgcctcccgccggaggggcaggaaatgctgttttatttcatagacagcggcacatacaacaggcttggtgaaacagagcataaacgaacggcaaaagtcctgtttatctgtgcgacaacagaaaatccgagctctgcattgctgaagacatttttgcggagaattccgatgaccgtacatatcccttcgctcaatgaacggtcccttggagaaagagtggagctgacaacgtttttattggggaaagaagcagagcggatcaaaaaaaacttaaatgtgcacatcgatgtctataatgcactgattcattctgcaaaattcggaaatgtcgggcagctgaaatcaaatgtacagctggtctgtgcgcacgggtttttaaataaccttgacaaagacgaggttgttgaactgaccgtccgggatcttccggacgagatcaaagaggactggatgtccagcagcaaaaatattgaacggagcaaaatgatttctgaatatgtcaacattacaacgatcatctctccgattgtggaagatgaagcaacgaaaatcgatgactcctttaacttgtatcatgtcatagaagaaaaagcgaaaatcctcaataaagaaggcttaacaaaaaagcaaatcaatcaatatatattaacggatattcatttgcacgtcagaagcttttttaatcagaaaatgcttcaaaaccacagtttactcaaattcgttgaagacgacgtgattcagatgacgaaagaattaaagggagtcgccgaacatgagcttgactgcaagttcgaccgtaaattcatctatttcctgagcatgcacatcgccgcatttttaaagcgcggaaagcagattgatgtcttaaattcgcaggaaacagatgaaatcagggaaacccatgtgaaagaatacgaggtcgcactcattttcaaagataaaattcaagcatatttcaaagtaaccgttccggaaatcgaagtcatctacttgacgatgctcattcagtcgattaaatcatggaaagaaaacaaaaggacgggcattgtcgtggccgcccatggaaacagcacggcaagctctatggttgaagtagccactgaactgctgggaagcaccccgatcgctgcggttgatatgcctttgaccgtttcaccctcggaaatcgtcagctgcctagcggagaaagtgaagcaggttgatgaaggagaaggcgttttaatgcttgtcgacatgggatcgcttgcgatgctggaaagcaggcttgaacaacaaacgggcgttaaaataaaaacgatcagcaatgttacgacatctatggtgctcgatgccgtccgcaaggtgaattatttgaatttgaatttgcacgccatctacgattcggttacaaaggatttcatcgatttatgggccgataaaccgcgggtctcaggcaaaaagaaggcgatcgtctccatttgcacaacaggcggcggaacggcgaagaagctcgaagagattttaacatcaatcgtgagcaggacatctgatgaacaaatcagcattttgacggtgccatcgatcaaattagcaagccgcatcaaagaaattgaaaaagcgtatgagattcttgccacggttggcacgaagaaccctaaaatcgatgctccgcacgtccctttagaagtattgattgaaggcgaaggggaaaaagtgattcagcaggtgattgcaaccggcgatatcccgatgagcggcggattatccggtgaaaatgtggttgtaaaggagctttgcgaagacagcctgaagaagtatcttgtctttttgaatccctatcatgtgatagacatgctgttggagtggcttcagacggttcaagacgaactgcgtatgacattcagcaacgctgtgctgatcaaagtcatcatgcataccgcttttgcttttgaaagggtgatcaaacagaacccgatcgcttttccggaggaggaagagatgaatgatcagcttgaaaacgttcttcacatcacagagaaaacattaaagccttacgaagaaaagcttggtcttgcgatcagcgaagatgaaaaaatgtttatcgcgtccatctttgctgaagagttat

SEQ ID NO: 1928 - DNA, 1827 bp, Bacillus licheniformis
ccgaaacagaaaattgacgtatagtgactttgtttcaaacctagaaaacgggaaggttgaaaatgtctccatccagcctgtcaggggtgtgtacgaggttcgggggcagctgacgacctatgaaaaagatcagtatttcctgacccatgttcctgaaggaaaaggggcagatcaaatcattgatcaagtgaaaaaaacgaagatacaaatagaacctgcgcaagaagcaaatggatggatgacgttctttaccaccatcatcccttttgttattatcttcattcttttcttcttcctgcttaatcaggctcaaggcggcggcagccgtgttatgaactttggaaaaagcaaggcgaagctctatacagaagaaaagaaacgcgtcaaattcaaagatgtggcaggagcggatgaagaaaagcaagagcttgtggaagtcgttgatttcctcaaggatccccgcaaatttgccgagctcggtgcaagaattccgaaaggcgtgcttttggtcggacctccgggtaccggtaaaacattgctggcgaaagcatgtgccggtgaagcaggggtgcctttcttcagcatcagcggatctgacttcgttgaaatgttcgtcggggttggtgcatcacgtgttcgcgacttgtttgaaaacgccaagaaaaatgcgccgtgtctgattttcatcgatgagattgatgctgtcggacgccagcggggagcaggccttggcggaggtcacgatgaacgtgaacagacgctcaaccagcttcttgttgaaatggacggattcagcgccaatgaaggaatcatcatcatcgctgcgacaaaccgcgccgatattttagaccctgcattgctgcgcccgggacgttttgaccgtcaaattactgttgaccgcccggatgtcaaaggccgtgaagctgtacttcaagtacacgcaagaaacaagcctcttgatgaatccgtaaacctaaaagcgatcgcgatgcggacgccagggttctcgggtgcagaccttgaaaaccttttaaatgaagcggctcttgtggcggcgcgtcaagataagaaaaagatcgatatgcgagacatcgatgaagcgacagaccgcgtcatcgccggacctgcaaagaaaagcagggtgatctcgaaaaaagaacgcaatatcgtggcttatcacgaggcgggacacaccgttatcggacttgtcttggatgaggcggatatggtgcataaagtaacgattgtaccgcgcggccaagcaggcggatatgccgtcatgcttcctaaggaagaccgttatttccaaaccaaacccgaacttctcgataagattgtcggcttgcttggaggccgtgtagctgaggaaatcatcttcggcgaggtcagcacgggcgcccataatgacttccagcgcgctacaggcattgccagacgaatggtaaccgaattcggtatgtctgaaaagctcggtcctcttcaattcggacaatcgcaaggcgggcaagtattcttgggtcgagatttcaacaatgaccaaaactacagcgacgcgattgcgtatgaaatcgataaagaaatccagcgcttcattaaggaatgttatgaacgtgcaaaaacaatccttactgaaaatcgcgacaaacttgagctgatcgctcaaacattgctggaagttgaaacgctcgacgctgagcaaatcaagcatttgtctgagcacggaagacttcctgatcgaacatactctgatgatcaggagaagacagatgatgtgaaagtcaacatcaataaacgagatgacgaagagaaaaacgaggatgaaaaaga

SEQ ID NO: 1929 - DNA, 2081 bp, Bacillus licheniformis
ttgtccattttgtcaaaaaagtggggcgacaattcccctacacttgcatttcatttttacaaaaaaacaaatggttttatgtgaacactgctataaagatctgactcacccttctatgttttcgggaaatcacttttttggcgggggaggttctttcttcagccagccatcacaagcgcagacgcaaaccgttgccaaaaaaggcttgctcgatgaacttgccgtcaatttaacaaatgcagcaaagaccggcttgatcgatccggtgatcggccgcaatgatgaagtagcccgtgtgatcgagatcttaaaccgcagaaataaaaacaatccggtcttaatcggtgaaccgggcgtcggtaaaacagccgtcgctgaaggacttgctctcaaaatcgccgaaggcgatgttccaaataaattgaaaaacaaagagctctacctgcttgatgtcgcttccctcgtggcaaacaccggcatcagagggcaatttgaagaaagaatgaaacagctgatgaaagagctgaaagaacgcaaaaacgcaatcttgtttattgacgaaattcaccttcttgtcggggccggctctgcagaaggctccatggatgcgggcaacattttaaaacctgcacttgccagaggcgagctgcaagttatcggcgctacgacgttgaaggaatatcgccaaattgaaaaagatgcggcgttagagcggcgctttcagccgatcatggtgcacgaaccgacaattgagcaggccgcagcgattttaaacgggctcaaggaaaaatacgaagcatatcacgatgtgacttacacggatgaagcgatcaaagcctgcgtcattctgtcaagccgctatattcaggaccgccatcttcccgataaggcgatcgaccttttggatgaagccggttcaaaagcgaacttgaaaatcgacacggtcagcggtgaacaagcttcccaacgcctgcaagaaatcgaagcggaaaaagccaaagcgcttcaagaagaaaactacgagcttgcagcaaaactccgcgacgaagaagaagcgctgcataaaaaaatggaaagccatgaggaagaaaaacgggcaacagttgaagcggaagacattcaagcgatcatcgaacaaaaaaccggcattccggtcggcaagcttcagcacgacgatcagaagaaaatgaaagagcttgaagcacacctttcaagccgcgtgatcggtcaaaaagaagcggtgaaaaaagtggcaaaagccgtcagaagaagccgcgccggcctgaaatcaaaaaacaggcctgtcggttcattcctgttcgtcggcccgacaggtgtcggtaaaacagaactttctaaaaggcttgcggaagaactgttcggcacgaaggatgccatcatccgcctcgatatgagcgaatacatggaaaaacacgccgtatcaaagctgatcggttcgcctcctggatatgtcggccacgaagaagccggacagcttaccgaaaaagtccggaggaacccgtacagcatcgttttgctcgatgaaatcgaaaaagcccatcccgatgtccagcacatgttcctgcaaatcatggaagacggacgtctgacagacagccaagggcggacggtcagctttaaagataccgtcattattatgacaagcaatgccggtgtatctgaaaagcggacaaccgtcggttttaaccgggaagagcaagtaatgggcgaacaatcaatgatcgattcattaagcggctactttaagccggaattcctgaacagatttgacagcatcatcgaattccagccgctcgaaaaagaagatctggtcaagatcgccgccctcttgctgaaagagcttgaagaaacgttaaaagagcaaaacatgacgctcgaagtttcagatgaggcaaaagaaaaaatcgctgaaatcggataccatccggcctttggcgcccgcccattaagaagaaccattcaaacagcggtcgaagatcaaatgaccgatctgctgcttgaagaagaacacatcaaaggttttgcggttatcgttgaaaacgatgaaatccgggtgaaaa

SEQ ID NO: 1930 - DNA, 1654 bp, Bacillus licheniformis
ttgagctggacgagcattgcactttttgtacaactatttttcgggatcatcatcggattatatttttggaatttgctcaaaaatcaaagaacccaaaaggttacgatagacagagagtccaaaaaagagatggaacagctccggaaaatgagatcaatccatttatcagaacctttatcggaaaaggtgaggccgacggcttttaaagacatcgtcggccaggaggacggcattaaagcgctgaaagccgccctttgcggaccgaatccgcagcatgtcattatttacggccctccaggtgtgggaaaaacggcagctgcaaggcttgtccttgaagaagcgaaaaagaacaagcgctcaccgttccaggaacattccgcctttgtcgagcttgacgcgacaacggcccgtttcgacgagcggggaatcgccgacccgttgatcggttcggtccacgatccgatttatcagggcgccggagcgatggggcaggccggaattccccagccaaagcagggagccgtcacgcatgcacacggtggagtattattcatcgatgaaatcggagagcttcatccgattcaaatgaataaaatgctgaaggtgctcgaagatcggaaagtttttttggaaagcgcctattacagtgaagaaaacacgcaaatccccaagcatattcacgacatttttcaaaacgggctgccggcggatttcagactgatcggcgcgacgacaaggatgcctgatgaaatcccgcctgccattcggtcgagatgtttggaagtgttcttccgcgaccttgaaaagcacgaattaaaaacggtcgccaaaaaagcggcagataagattcaaaagaaagtcgcagaggaaggactcgacctgttgacgcggtatgcgagaaacggccgcgaagtcgtcaatatgatgcaaatcgccgccggaatggctttgactgaagagcgcgacgaggtgacggttgaagatatcgaatgggtgatccattcgagccagctgacaccgaaatacgaacaaaaaatcgcctctaaaccgcaggtcggcatcgtcaacggacttgccgtccacgggcctaacagcggttcgctgctcgaaattgaggtcacagtcaatcaggcggctgataaaggatcgattaatatcacaggcattgcagaagaagagaatatcggcaaccagtcaaaatcgatccgccggaaaagcatggcgaaaggatcggtcgaaaacgtcatgactgtattgcggacaatgggagtcaaagcttcggattatgatattcacgtgaatttccccggcggtatcccggttgacggaccatctgcagggattgcaatggcggcgggcatattctccgctattcataagattccgatagaccatactgtcgccatgacgggtgaaatcagcctgaacggccgggtaaagccgatcggcggcgtgattccgaaaatcaaagcggccaagcatgcgggggcaaaaacagtcattattccgcacgaaaatgttcagtcgattttaaagcggatagaaggcatacatatcgttcccgtcaaaaccttgcaggaagtactcgacctcgtattggtcaaccctccttcagaaatgcccgacggcgttcaaatgaaaagagaatccgttt

SEQ ID NO: 1931 - DNA, 1632 bp, Bacillus licheniformis
atgatgaaagaaatcaaatgcgaatgcggccatgtgaatccggcgggtaccgttttgtgtgaatcgtgcggaaagccgctggtcaaacaggatgccaaactccttgacatgcggtatgacggaagtgcgagacgctctcaaacctataataaaacgatcgtagataaaatatggaatttcttttcgtctgtaaaggtcggcgtctggctgatcgtcattacgctgacagcatccgcttttggaacgatatttccgcaggaaatgttcctgccgccgggtgcgcaggctgatacatactacagcgaacaatacgggcttctcggacaaatctattatgctctcggttttcacaatctctacggttcatggtggtttattattctggttgcctcaatcggcatttcgcttgtcatctgcagccttgaccgggtcgttcctttgtacagggccctgaaaaaccagggcgtcacgcgaaatccgaactttatggagaggcagcgcctattcagccggacggaagcggacatgtctgaggacacaaaatcgcaaatcatcggtaagctgaagaaaaaacgataccgcgtcaaggaagaaaacggcaacctatttgccgaaaaaggccgtttttcaaggtggggcccatatgttaaccatatcggactgattatattcctcatcggggtcatgctcagatttgtcccgggcatgtatgtcgacgaaaccctttggatcagggaaggggaaacggtgccaattccgggaactgacggccattactatttgaaaaacaaccggtttataaaagaaatgtacgacagtgaaaaagaaaaagaagtattttcagaggcgatcaccaaagctggtgacgggactgtcgcaaaaacatatcaaaccgatgttgaactgtatgaaagaaaaaatgacagcctgccgggcgaagcgcctgaattgaagaaagtgaaaaacggcaagatcaaggtcaatgacccgttgaaattcggttcatatgcactctatcagctgacatacaaggaaggcgagctcgacaaaatggtgtttcagctgattgaaaaagacagcgggaaatccttcggcaaagtggcaatcgacctcttggagccgaaaccggaatatgatcttggtaacggttacaaagttcatatagcaagctacctgccggacttttattttaacaaagacggggaaccgagcacgaaaacgaggaatccgaacaatccggcatttgtattccagatcaccgcaccggataagcctaaaggagaaaaaagtttcgtggcgattcaggaaacaatcgaaggttctgacgacaataaatacaaaatgaagtttgaccatgtcgaaacgaagaatctctcaggcctcacaattagaaaagatttgactttgtgggtgctcatggtcggcggtgccatctttatgatcggcgtcattcaggggatgtactggcaccatagaaggatctggctcagaacgctggacgggcatgtgctcgtcgccggacatacgaacaaaaactggtacgggctgaagcaggacttgaaggccgcgctcgcggatacggggatatccgaaccggccgatcaaaaagaactgtcaaaggaaaaaaaataa

SEQ ID NO: 1932 - DNA, 1369 bp, Bacillus licheniformis
atggcagatgaaacgaaacgaaacatcccgctcctccctttaagaggtttactcgtctatccgacgatggttttgcaccttgacgtcgggcgtgaaaagtcggttcaggcacttgaacaggcgatgatgaatgaccatatgatctttttggcaacgcaaaaggacatatccatagacgaaccggatgaagacgagatttttacattcggaacctatacgaaaatcaagcagatgctcaagctgccgaacggaacaatccgcgttttggtggaggggttgcagcgcgcccgcattcttgagtaccatgacttagatgaatatacgtctgtaaaaatcgagcgaatcgatgaagagactgaaaaagatgttgaagatgaagcactcatgcgcacattgcttgaccacttcgatcaatacataaagatttcgaaaaaaatatcggcggaaacatttgccgctgtgacagatattgaagagccgggaagaatggccgatattgtcgcctcccacctcccgctcaagctgaaagacaagcaggaagtgctggaaacgatcgatgtcaaagccagattgaacaaagtaatcgacctgattcacaatgaaaaagaagtccttgagattgaaaagaagatcgggcagcgcgtcaagcgttcaatggaaagaacacaaaaggagtattacctgcgcgagcagatgaaagccatccaaaaagaacttggcgataaagaaggaaaaacgggtgaggtccaaaagctgactgaaaaaatcgagcaggccggaatgcctgacaatgtgaaagaaaccgcgcttaaagagctgaaccggtacgaaaaaattccgtccagctcagctgaaagctctgtcatccgcaattatatcgaatggcttatttctctcccatggaacgatgcaacagaagacaggctggatttaaagctcgccagtcaaattctcgatgaagaacaccacggccttgaaaaagtgaaggagcgggttctcgaatatttggctgtccagaagctgacccgctcgttaaaaggaccgatcttatgcttggccggccctccgggtgttggaaaaacctctctggcgaaatcgatcgccaaatcgctcggacgcaaattcgtccgcatttcccttggcggcgtgagggatgaatctgaaatccgcggtcaccgccgcacatatgtaggcgccatgccgggccgtatcattcaggggatgaaaaaagcaggcaagaacaatcccgtattccttttggacgagattgacaaaatggcgtcggatttcaggggagatcccgcttcagcgatgctggaagtgctcgatcctgaacaaaaccatacgttcagcgaccattatatgaaga

SEQ ID NO: 1933 - DNA, 1397 bp, Bacillus licheniformis
ttgagaaaaagtatcgtgcgctattttgttatggcttttattctattatttgcgttatccacattcctcaccggagtgcaggcaacttccgttcccgataaaaagtcgcctgagcttgagaaagctgaaatctacggtgatattgatgtgacgtctgataaacagacgacggttatcgtggaactgaaagaaaagtcgcttgccgaagcaaaagcggacggagaaaaacaaacgaaggcttctctaaaaacagctcgaagcaaagcgctgaaaacacttaaaaaagcgaaagtaaaccgcgaatacgaccgtgtattttcgggcttttctatgaaactgccggccagtgaaattccaaagctgctcgccgtcaaggaagttaaagcggtttatccaaacgcaacttacaaacctgacagcgtaaaaggaaaagacgtgacacttgcagcagacgccatttatccacagatggataaaagtgccccgttcatcggagcggatcaggcatggaaatcgggctataccggtaaaggcattaaggtagccgttattgatacgggcgtggattacacccatcccgacttaaagaataatttcggcccatataagggctatgactttgtggataatgattatgatccacaggaaacaccgacaggcgacccgcgcggcggagcgactgatcacggcactcatgttgcaggaacaatcgccgcgaacggacagattaaaggcgtggcgcctgaagcaacgcttcttgcttaccgcgtgctcggccccggcggctcaggcacaaccgagaatgtgattgcgggcattgaaaaagccgttgcagacggagcaaaagtgatgaacctctcattgggaaattcgctgaacagccctgattatgcaacaagcatcgcactggactgggcgatggctgaaggggttgtcgccgttacgtcaaacggtaacagcggaccggaaaactggacggtcggctcgccgggaacatcaagggttgcgatttccgtcggcgcatcacagcttccgtataatgagtattcggtgacgcttccttcgtattcatcagcaaaggtgatgggataccaagaggaaaaggatcttgaagcattgaacggtcaagaggtggaactcgttgaagccggcctcggacaagctgacgatttctcaggcaaagatgtgaaaggaaaagttgcggttatccagagaggcgtcataccatttgttgataaggctgaaaatgccaaaaacgccggcgctatcggagccgtgatttacaataatgcaacaggggaaatcgaggcaaacgtcatgggggatggccgtaccgaccgtcaaattgtcaaaagaagagggcgaaaagcttgttcaacagatcaaagaagggaaac

SEQ ID NO: 1934 - DNA, 1329 bp, Bacillus licheniformis
atgttcggttcctacatggttcaaatggtaaggtccaacgcccataagctggaccggccgctgagagaaagcgtgctgaaactctataaaccttttaaatggacgccttgctttttacacggttttttcgaaaaaatattaatgaaaaacaaaaaaataccagtcattattgaatttgaaaaagactgtcagcataaaggctatcaattagtcaatgaaatgatcggcagcaaaagaagaaacaaaatcaagcatcgcttctccaacgttagctgctgcagcgctgaagtcaccccttcttctttgcaatcgcttctatctgagtgcggcgacattcgcaaaatttatttaaatcgcaaagtaaaagcgctcctcgacgtagcggttgaatcaagccatgccaaagaagtggtcagaaacaatcagacgctgacaggcaaaggagtgacagtcgctgtcattgatacgggcgtataccctcacgaagatcttgaaggcaggatcagggcttttcaagactttatcaaccagagaacagaaccctatgatgacaatgggcacggcacacactgcgccggtgatgcttgcggaaacggagcggcctcatcgggtcagtaccgcggacctgctcctgaagcagaacttgtcggtgtaaaagtattggacaaaatgggatccggatcgctcgaaaccgtcattcaaggcgtagattggtgcattcaattcaataaggaaaatcctgatgatccgatcgacattatttcaatgtcattgggtgcagaagccttgcgctacgagaatgaagaagaagatccagtcgttaaagctgttcatgcagcatgggacgcaggcattgttgtatgtgcggcagccggcaactccggtcctgatgcgcaaacgattgccagcccgggtgtcagcagcaagattattacagtcggagccttggatgacagggatacagtcagccgggaggatgacgatgtcgcctcttattcaagcagagggccgacaatctatggtcaagtcaaaccggacttgctggtaccgggcacaaatattacgtcgcttcgttcacccggatcttttctcgataagctgcaaaaaacaaacagagtcggcacaaaatatatgacattgtccggaacctcgatggctacgccgatctgcgcaggaattgccgcacttatccttcagcaagccccgggcacagaacctgatgaagtcaaacagctgctaatggacggtaccgatttatggaaagatcgcgatccaaatgtttacggtgcagggtacatcaacgcagaacaatcggtgccgcaagactaa

SEQ ID NO: 1935 - DNA, 1971 bp, Bacillus licheniformis
  misc_feature (1)...(1971): n = A,T,C or G
tgcaaaaactgaacaaaggaaaagagctgtcttccctttactataaagcagctccattcatcagcgcaaaaatgctctttaacaaatcgatgagagacagtgtctacaaagacctggtgcagctgaagccgctgtttgcagatgtcgctaaaaacggacaagtgagcgcatactcgattacgaatgatgatcaaaaagcgatcagtcgcctgtacgaaacagctcgcgcgtccgttcccgagccgttgaaaaaacagctggatcaagtcgcgaaagacatcggcatcgaacaattaacaggcagcaaagtatcggctgtgcttgaaaaagcggggatggcgacagcttcatcaagcgcgcccgaaaaccgttacatcgtaaaattgaaagaaggcaaaaaaccgggatctttcaaatctaaagcccaatcatccggcgtccaggcattagagcccctcggtaaaagcaaaacggcatttaaagatatgtacgttgtggaaatgaaggaaagccgttcttccggattcaaagcggcggcaaagcaatatcaggcggcagcctccaagatcgccaagatgcctgaagtggaattcgtcgaacaggttcagcaatatgaagcactgtcaagagacacccaatatccatatcaatggtcgctcaaaaataacggcaaaaaccgtgctgcgaatgctgacatacaatttgaacagcttcagaagctgatgaaaggcaaaaagctgaaagatacagtaatcgccgtcgttgacacaggcgttgatcatacccttgcggatttaagcggcagcgtcaaaaaagacgaaggctataactatgtcggccgcacggcggatgcgatggatgacaatggccacggcacacacgtgtcaggcatcattgcagccgcgcaagacaaccatttttcgatggcgggaatcaatgcttatgccaaaattctgcctgtcaaagtgctggattcttcaggcagtggagatacggaacagattgcaaacggcatcatctatgccgccgaccacggtgcaaaagtcatcaatttaagtcttggcgggccatacagccgggtgatggaatatgcgcttaaatatgcggcttctaaaaatgtgacgatcgttgccgccaccggaaatgacggagtatcggagatttcctaccctgcatcttcgaaatatacgctttcagtcggggcgaccaataatctcgatcttgtctcggactactccaattatggaaaaggtctcgatatggtggcgccgggaaccgatattccaagcctcgttccggacgggaatgtcacttatatgagcggaacatcgatggcggcgccgcacgtggcagctgcagcaggacttcttttgtcacagaatccgtccttgaaaccaaagcaaatcgcaagcctattgaccgagacgacagcagatgtggcatttgaagagcaggataatccaaacccggattatgacctggatatagaaccggctgcacaaattcccggatatgacttcgtctccgggtggggaaggctgaatgtttttcatgcagccagcgtttttgagctgaacatgaaggttcatcccgttttaaaccgccatacggcagtgacaggcacagccaaaagcggtgtgacggtcaaaatcttgcgagggaagcaagtattggggacgggcacggccggaaaatcaggcgcgttttcagtgaaaattccggcccagaaggcggggcaagttcttcatgtcgcggcatcgggccatcaggcggaaacctcgctcagaaccgtcgtggaaaaagcgccgaaaaacccgtccgtcaaacgcatcacgaacaaagatactgccgtaacgggtagaacggcagccggctacacgatcaaagtgaaaaacgcgtncaaaaaagtgatcgcgcaaggcanagcggatgcatccgtgagcgttaaagtgaaaatcaacaagcaaaaag

SEQ ID NO: 1936 - DNA, 1065 bp, Bacillus licheniformis
gaaatcaaccttgctgcttcaagtatctgcccagctcgctgattcaaaagaaaatgtcctgtacatctcaggcgaagaatcggtcaagcagacaaagctgagagcagaccgtctaggtatcaacagtcccactcttcacgttttatctgaaaccgatatggagtatattacgtcttctatagaagagatgaacccatcattcgtagtggttgattcgattcaaaccgtttaccaaagtgatatcacatccgctccgggcagcgtctcccaggtcagggaatgcaccgctgagctgatgagaattgcaaaaacgaaagggattccaatatttatcgtcgggcatgtcacaaaagaaggttcgattgccggaccgagacttctggaacatatggtcgacaccgtcctttactttgaaggtgagcggcatcatacatttcggattttaagagccgtcaaaaaccggtttggatcaacgaatgaaatgggaatctttgaaatgagggaagagggcctgacagaggtgctgaatccgtcagaaatctttctcgaagagcgctcggcgggagcggccggatcgagtgtcgtggcctcaatggaaggcacgaggccagtcttagtagagattcaggcgctgatttcccccacgagctttgggaatccgcgccggatggcaaccgggattgatcataaccgcgtctcattgctaatggcagttttagaaaaaagggttggactgctgctgcaaaatcaagacgcctatttaaaagtcgccggaggcgtcaagctggacgagccagcgattgacctcgccgttgcagtgagcatcgcctcaagcttcagagacaccccgcctcatccgacggattgttttatcggagaagtcggattgacaggggaggtccgcagagtatcaaggatagaacagagggtgcaggaagcggcgaagcttggttttaaaagaatgattattccttctgcaaatgtagaaggatggacaaagccgaaaggaatcgaagtcgtcggcgttgaaaatgtagctgaggcccttcgagcttcattaggagg

SEQ ID NO: 1937 - DNA, 999 bp, Bacillus licheniformis
atgcgtgaagacacaaaagtatatgatatcacaattatcgggggcggccctgtcggcttgtttaccgcattttacggcggaatgcggcaagcgagcgtcaaaattattgaaagcctgccgcaactcggcggtcagctgtccgctttgtatcccgaaaaatacatatacgatgtagccgggttccctaaaatccgcgctcaggagctggtcgacaatttaaaagagcaaatggcgaaattcgatcagaccgtttgtttggaacaagccgtcgaaagcgttgaaaaacaagcagacggtattttcaaactcgtcaccaacaaagaaatccactattctaaaacggtgattattacagccggaaacggagcattccagccgagaaagctcgagcttgaatctgcggcacaattcgagaatgcaaaccttcattactttatagatgatctgaatcaatttgcgggcaagcgcgttgcggtattgggcggcggcgactccgccgtcgactgggcgctcatgctggaaccgatcgcaaaagaggtgtcaattattcatcgccgcgataaattccgcgcacacgagcacagcgtcgaaaacttgcgcaattctaaagtcaatgtattgacaccgtttgttccgaccgagctgatcggcagcgagcgaatcgaacagatcgtcattgaggaagtgaaaggcgagagaaaagaaatcatcgatgtcgacgatgtgatcgtcaacttcggttttgtttcatctctcggaccaatcaaaaactgggggcttgaaatcgagaaaaattcgatcgtcgtcaagtccacaatggaaacgaacatcgagggattctatgcagccggcgatatctgcacatatgaagggaaagtcaagctgattgcgagcggatttggtgaagcgccgaccgctgtcaacaatgcaaaagcttatatggatcctaaagcgcgtgtgcagccgctgcactctacaagcatgtttgaaaacaaataa

SEQ ID NO: 1938 - DNA, 1485 bp, Bacillus licheniformis
aaaagccattattccgcacgttcatgtgcgctgcactcatcggttcacttctcgctccggttgctgtgcaggctgatacaggcacggcagcgaagacaaaggaacaaagcaaaatatctagcgctctttataaacgttttgagaaagaaggtaaagtgacctttttaattaaaatgaaaagccaggcgaaccttcagcaagcggcaaccgcggctgaaaaacgggcgaaagcaagcgttatgaccgtgaaaaaagcaaaagagatcaaacgctcggcagtgctgacttccctgcgtacaaaagctgaaagaacacaaaaagatttgaaatcgtttttggaaaaagaagagaaaaaaggaacagctaagaaagtggaatctttctatattgtaaacggcatcgccgtgacggcgacaaaagatgttatggaaaaagcggcttcatttcctgaggttgaaaaggtgctgcccaatcaaaaaatcaagctgggcaataccgaaaaacctacagtagaatcgaaaacaaccgcggatcgcacccctgcttccaacattgagcaggttcatgcgccggatgtctggaaaaagcgctataaaggcaaaggagccgtcgtcgcttcaattgacaccggcgtagagtgggatcatccggcgttgaaaacaaagtacagaggctacaacccttctaaaccgaacagtccagacaatgagttcaactggtttgatgcggtaagcaataagaaaacgccatatgatgagttgggccacggcacacatgtgacaggcacgatggtcggctcagaagccggcggcaaaaaccagatcggtgtcgcgccgacggcgaaatggatagctgtcaaggccttttcagaggacggcggagatgaaaaatcccttttggctgcaggagaatggattttggccccgaaagatgcgaaaggaaaagcgcaccctgaaaaggctcccgatgtcgtcaacaactcttgggcaggggaacgcggactcgatgaatggtatttggatattgtcaaagcttggcgggcagctgatatcttccctgcatttgcagcgggcaatgtcagcgaattcgaaccgggcggaccgggttcagttgaaaacccgtccaactatccgcaatctttcgcgattggcgcagttgacagctcaaacgcgttagccgacttttcattgcaagggccttcgccatatgacgaaatcaagcccgatatttctgcacctggcgtcagcatccgctctgcttatccgggacataagtatgctgcaatgaacgggacatcgatggcgaccccgcatgtatccggcatcgtcgccttaatgagggaagccaatccggacctcacagtcgatgaaatcgagcgcatcctgctgaaaacggcgacgcctctgactgacaaaacgtttaaaaaatccccgaacaacggctacggatacggcttggtcaacgctttaaaagcttttgacgcag

SEQ ID NO: 1939 - DNA, 1172 bp, Bacillus licheniformis
ttgctgaaggattatgattttctgaaacttatttttcaaggaattatagatgaaatcgatatcggcttgcatgtcgtcgatgaaaacggcacatctgttgtctataacaaaaagatgagccagattgaagggatggatgtcggcgatgtgctcggcaaaaacgtgctggacgtgtttacgtttgccagccagcatgacagcaccctcctgcaggcgctgcatcacgggaaaacgaacaaaaacgtcaaacagacttactttaataacaaaggacaggaaattacgaccgtcaatcatacattccccattatggaaaacgggaatacgaaaggagcggtcgagattgccaaagatgtcacaaagcttgaacgcctgatcagagaaaatatgaacaaaacagaaagcacaaagtatacgtttgacagcctgatcggcgtcagtccggcgttcaaggaagtcattgaacatgcaaagcgggcgacccggacctcttcctccattctaatcgttggcgacaccggaaccggaaaagaactgttcgcccaaagtatacataacggaagccagcgctcaacgggcccattcatctcgcaaaactgtgcagccctcccggaaagccttgtcgaaggcctattattcggcacggtcaaaggcgcattcacgggagccgtggatcgtccgggtcttttcgaacaagctgacggcggaacactgctccttgacgaaatcaattctttggacttcagattgcaggcaaagcttttgcgcgcgattcaagaaaaaacgatcaggcggatcggcgcttcaaaggatactccgatcgacgtcaggatcatcgcgacgatgaacgaagatccagtcgacgctgtcagcggccagaggctgcgaaaagatttgtattacaggctgagcgtcgtcaccttgtttattcctccattaaaagaccggaaggaagatattatgccgctcacgcagcattttatcgacaaatacaacgcattgttccaaatggaggtcaagggttttgaagaagaggtgcggcggttcctgctttcatacgattggccgggaaacgtcagggagcttgaacatttaattgaaggcgccatgaatttgatgtcctacgaagacaaaatcgagctgacgcaccttccattgcaatacaggacgaa

SEQ ID NO: 1940 - DNA, 955 bp, Bacillus licheniformis
gtgttggaaagggctgttacttataaaaacaacggacaaatcaatatcatattgaacggtcaaaagcaggttttggccaattcagaggctgaagccgaatatcaggccgcactgcaaaaaaatgaagccaaacacagcattctgaaagaaattgaaagggaaatgaacacgctggtcggaatggaggaaatgaagcgcaatatcaaggaaatctacgcctggattttcgttaataaaaagcgcgaagaacaaggccttaaggccggaaaacaggcgcttcacatgatgttcaaaggaaatccgggaaccggaaaaacgaccgtcgccaggctgatcggcaggcttttttacgaaatgaatgttctctcaaaaggccatctgatcgaggcggagcgcgccgatctcgtcggtgagtacatcggccatacggcgcaaaaaacgagggatttaatcaaaaaagcgatgggcggaatcctgttcatcgatgaagcctattcccttgccagaggcggagagaaagacttcggcaaggaggcaatcgatacattggtcaaacatatggaggataagcgcaacgaattcattttaatcctcgccggatattcgcgggaaatggatcattttctttcattaaacccgggccttcagtcaaggtttccgatcagcatcgattttcccgattactcagtcagccagctgatggacattgcaaaacggatgatggcggaaagggaatatcagttcagccctgaggctgaatggaagctgaaagaccatctgatggccgtcaaaagtacggtcagccccgcgaagttcagcaatggccgtttcgtccgcaacctgatcgaaaaatccatccggtcgcaggcgatgagactgctgatgggagactgctacttaaagaatgacttgataaccatcaaaagccaggatctcgacttgaaggaagacgcgc

SEQ ID NO: 1941 - DNA, 963 bp, Bacillus licheniformis
ttccggacacgcgccggtcagcaatctctttgaatttacaactgctttcagcatgatgctcgtcctggcgttcatcatcatctactttatttacaagctgtccgcattgggactgtttacgcttcccgttgtcctgcttttgatcgcatatgccagcatgtttccgaccgatatcacaccgctgattccgtcgcttcaaagcaactggctgtatattcatgtcacgactgcagccctcgggcaggcgattctcgccatcagctttgtcgccggcgtgatctttctgctcaagcatgtggatcattcaaagccgggcaaaaaaacgttctggctcgaatgtgtcatgtttatgcttgtgacaacgctcgcgtttatccttgtgacgacctcattccgcattgggggctatgaggcgcagtttaagtggattgataaagacaaccaggaagacgtcatgatttacgagcttcccgctcttatcggcccgaataaaggagaacttttaacggaggagagaatggagccgcttgtcaatgtgccgcccattttttcaggccggaagctgaataccgttctctggtcgtttggaaccggcgccttgctttacggtgtcatcaggctgatcatcagaaaacgcatcagtcagcttcttcagccgctcgtgaaaaatgtgaaccttgaccttgtcgatgaaatcggctatcgctccgtttcgatcggctttccggtttttacgcttggcgcgcttattttcgcgatgatatgggcacagctggcgtggagcagattctggggctgggatccgaaagaagtctgggcgctgattacatttttgttttatgcagcttatctgcatctcaggctttcgagaggatggcacggcgaaaaatcggcgtggctcgccgtcatcggttttgccattattatgtttaatcttatctttgtaaaccttgtgatcgccgg

SEQ ID NO: 1942 - DNA, 1358 bp, Bacillus licheniformis
atggattttagacgcgatgacgaacaaaaacatgcaaatgaagagcagtttcacgaagaagcgcagacgccgcaaacggcaggttctgaggagcagcagtcagaacagccggcaaaggagcccgagctgattttaaagaaggatacagacgatcagtcagatcttacgaataaagaaaccgctgcagccctggaagatgccagggaaacgagagcggcaaaagaaaagcggcgcaaggcttcgtggctgagcccgattttgggcgggatcatcggaggcggcttggtgcttggaatctccccgtatctgccgggcgatcatccgagcgaaactgccggaaccggacagacagagccaaagcagtcgcagaatttcaccacaaaacctgtcacgaacgcagataacgtacctgatatggtggaagatttggagcctgcgatcgtcggagtttcaaatattcaaacgagcttcggcttctctgaagacgacgtggaggagagcggcacgggatcaggcgtcatctttaagaaagacggcggcaaggcctacattatcacaaacaaccatgtcgttgaaggcgcctcgaaggtgaccatctccttatacaacggaaagaccgcggatgccaagattatcggcagcgacgctttgactgatctggctgttttagagatcagcagcaaaggcgttgataaggttgcaagtttcggagactccgcaaaactgcgcgccggcgaaaaagtaattgcgatcgggaaccctctcggccttcaattttcaagaacggttacagaaggcatcatcagcggtgtcaaccggacgattgaagtctcaacatctgaagggaattgggatatgaacgtccttcagacagatgcggcgatcaaccctggaaacagcggcgggcctctgattaacagcagcgggcaggtcatcggcatcaacagcctgaagatcagccaaagcggtgttgaatcgcttggcttcgcgattccgagcaacgatgttcagccgatcgttgacgagcttttggaaaaagggaaagtggaacggcctttcctcggcgtgcaaatgatcgatatgcagcaggtgcctgaacagtaccagcaaaatacgctcggcctattcggagaccagcttaataaaggcgtgtacatcgataaagtatcgccgaaatcgcctgcggcagacgcgggtatgaaagccggcgacgtcatcaccaaaatgaacggcaaaaacgtcgaaaccacctcagacctcagaaaaattctttatacagaagcaaaagcaggagatactgtcacatttgaggtgctgagaaacggaaagcaaacaacaatgaaagcaaaacttgcgaa

SEQ ID NO: 1943 - DNA, 897 bp, Bacillus licheniformis
aggttgcgccgaagctggaagtgcatttgagcacacagcagtccctttcaaactggaaagccgttcagttctggaaggaagaaggccttgagcgggttgtgctcgcacgtgaaacgagcgcacttgaaatcagggaaatgaaagaaaaagtggatattgaaatcgaaacgtttattcacggtgcgatgtgtatcgcttattccggccgctgcgtgctcagcaaccatatgacggcaagggactccaaccgcggaggctgctgccagtcatgccgctgggactatgatttgtatcagacggacgggacgaatgcactgccgctatatgaagaaggcgatgctccatttgcgatgagcccgaaagatctgaagctggtcgaatcgataccgcaaatgattgaaatgggcatcgacagcctgaaaatcgaaggccggatgaaatcgatccactacattgcgacagtcgtcagtgtgtacagaaaagtgatcgatgcttattgcgctgatcctgaaaacttcgtcatcaaagaagaatggctgaaagaactggacaaatgcgccaatagagacacggcgcctgctttctttgaaggaacgccaggatatgaagagcagatgttcggcgtccacggcaaaaagacaacatacgactttgtcggacttgtccttgactatgatgaagagacaaaaatggtcacgctccagcagcggaacttctttaaatccggagatgaagtcgaatttttcggtccggaaatcgaaaatttcacatgcaaaattgacacgatttgggacgaaaaaggcaatgtgcttgacgcagcccgccatcccctgcagatcgtcaaatttagagtggacaacaagatttatcctagcaacatgatgagaaaggggcagt

SEQ ID NO: 1944 - DNA, 1212 bp, Bacillus licheniformis
tatagtggagtttaatcatgatgaggaaaaattcgttcgggaaaagccggtgagaagttggagaagctttttgttttcaagcctggtcggcgccgtcatcggcgctcttttaacagtgtttgccttgccgtatctctcgcagcagggatggctgccgtataatctgcaagtcatcgaagcgcgcggcggccaaggagcacagcagggcgggacggtccgcaatgtatccgtcaacgtgaataatgaagtcacgcaaatggtctctaaggtttctgattctgttgtcggcgttatcaacatccaaaagacaggtgtatgggatggtgacagcgaagcgggaacaggctcgggcgttatttataaaaaggacggcaacacatcccacattgtgacaaaccaccatgtcattgaaggggcgtcccaaatagaaatcagcctgaatgacggaacacggattccggcaaaactgatcggcagcgataagctgatggatctggccgtcctgcaagtcaacagcaacaaaataaaagcagctgccgaatttggagattctgataaagtgaagacaggcgagcctgtcatcgcgattggaaacccgctcggcctgcagttttcaggctctgttacacaaggaatcatctcaggaaccgaacgcgctgtgccggtcgattccaacggagacggacagccggactggaacgccgaagtactgcagacggatgctgccattaacccgggtaacagcggaggcgggctgtttaatattgatggaaaagtcatcggcattaattcgatgaaaatcgctgaatcagccgtcgaaggcatcggtctgagcattccggccaaccttgccattccggttatcgaagatttggaaacgtacggtgaagtgagacggccgtatctcggaattgagatgaaatcacttggcgatatcgcaagctaccactggcaggaaacgcttaaactgccgaaaaacgtaacatcaggcgtagttgtgatgggtgttcagccggtatctcctgcaggcagagccggtctgaaagagctcgatgtcatcgtcgaatttaacggtgaccgtgtttacgatatcgttgatctgcgtaaaaagctttacaccaaaaacgtcggcgacaaggtaaaaatcaaatacctgcggggcggaaaagaaaagacaacagaagtaaagctgacccgatcccaattaggaag

SEQ ID NO: 1945 - DNA, 961 bp, Bacillus licheniformis
atgaaagaagaaaaagtgatcattatcggcggcggcccctgcgggctttcagcagctattcacatgcaagagatcggaatagatgcactcgtcattgagaaaggaaacatcgtcaacagcatttatcaatatcctactcaccaaacctttttcagctcaagcgaaaaactggagattggcgatgtggcttttattactgaaaatcacaagccggtcagaaatcaggcgctttcttattacagggaagtcgccaaacgaaaaaatctacggatcaacgcgtttgagaaagttcaatccgtaacaaaaacagagaataaccaatttatcgtggaaacatcaaaggacacgtatttgtcttctttttgcattgtcgcaacgggatattatgacaatccgaactatatgaatgtaccgggagaagaccttccaaaagtatttcattattttaaagaggctcatccgtactttgataaagatgttgcagttatcgggggcaaaaactcaagcgtcgacgcggcaatggagctcgttaaggcgggcgcaagagtgaccgtattgtacagagggaacgaatattcctccagcatcaaaccgtggatccttccggaattcctttcgcttgtcaagcacggaaaaatcagaatggaattccgggcggtcgtcaaagaaattacggaagacgagctgattttttctgtcgacggaaaagaaaccaggatcaaaaatgattttgtatttgccatgaccggctatcatccagatcatagctttcttcaaaaaatgggagtcaaaatcgacgcagagtcgggccgtcctttctttaatgaagaaacgatggagacgaacgaagaaggcatctttatcgccggcgttattgcggccgggaacaacgcaaatgaaatctttattgaaaacggccgttttcacggcggcttaatcgcagctgaaattgctaaacgga

SEQ ID NO: 1946 - DNA, 757 bp, Bacillus licheniformis
atgtttaaattcaacgaggaaaaaggacaattgaaatgctcgttttgcggtaaaacacaagatcaggtacgcaagcttgtcgccggaccaggcgtatatatatgtgacgagtgcatcgaactttgcactgaaattgtagaagaggaactcggctctgaagaagaagtggagttcaaagatgttccgaagccaaaggaaatccgcgagattcttgatgaatacgtcatcggccaggaccaggcaaaaaaatcccttgccgtggccgtctacaatcattacaagcggatcaattcgaacagcaaagtcgacgacgtcgagctgtcaaaaagtaacatttccatgatcggaccgactggaagcggaaaaacgcttcttgctcaaacgcttgcccgcatcctgaatgtgccgttcgccattgcggatgccacgtcgcttactgaagcaggctatgtcggtgaagatgtggagaacattttgcttaagctgatccaggcagctgactacgatgttgaaaaagcggaaaaaggcattatctacatcgatgaaatcgataaagtggccagaaagtccgagaacccttcgattacacgcgatgtatcaggcgaaggcgttcagcaggcattgcttaaaattcttgaaggtacggttgccagcgttcctccacaaggcggaagaaagcatcctcatcaagagttcatccaaattgacacaaccaacatcctgttcatttgcggcggaggttttgacggaatcgagc

SEQ ID NO: 1947 - DNA, 783 bp, Bacillus licheniformis
aagcgatgctcgaagacatctctatcctgacaggcgccgaagtgatcacagaagatttaggtcttgaccttaaatcaactcaaatcaatcaattgggacgcgcttctaaagttgttgttacaaaagaaaacacaacaattgttgaaggtgcgggagatacagagcaaatcgcggcacgcgtcaaccaaatccgcgctcaagttgaagaaacaacttctgagttcgataaagaaaaattacaagaacgccttgctaagcttgcaggcggcgtagctgtcatcaaagtcggagctgcgactgaaacagaattgaaagaacgcaagcttcgcatcgaagacgccctgaactctactcgcgctgcggtagaagaaggaatcgtatccggcggtggtacagctcttgtcaatgtttacaataaagtagctgcccttgaagctgaaggcgacgaactgactggtatcaacatcgttcttcgcgctcttgaagaaccaatccgtcaaatcgcgcacaacgcgggtcttgaaggatctgtcatcgttgagcgcctgaaaaatgaagaaatcggcgtcggctacaacgctgcaacaggcgaatgggtgaacatgatcgacaaaggtatcgttgaccctacaaaagtaacacgctcagctctgcaaaacgcagcatctgtagcggctatgttcctgacaactgaagcagttgttgccgacaaaccggaagaaaacaaaggcggcgcaggaatgcctgacatgggcggcatgggcggcatgggcggcatgatgt

SEQ ID NO: 1948 - DNA, 831 bp, Bacillus licheniformis
atgacagacacattgttagcaaggcttaacgaagttacaatcgtgttgtacgcgttcaccgttctcttttattttatagactttttacagcacaaccggaaggcgggaaaagcggccttctggttgctttctattgtctggattctccagacggtataccttttttatttcatgcagtacacagatcagtttcctgttttgaataatgcgcaggggctttatttttacgcgtgggtgctcgtcacgctgtctctcgttttgacgaagcttttgaaagtggaatttctcgtttttttcaccaatctcatcggcttctcaatggcggcgatccacacatttactccaacggctcagcagtcggcggagctttcgggcaggctcgtgtccgagctcttgatcatccacattacaatggcgattctttcgtatggagcattttcattgtcctttgtcttttccgtgctgtatctttttcagtatcgcttattgaaaaagaagaagtgggggaaatggctcttgagaatcgaagatttgtcaaaacttgatcatatggcttatgtcctcaatatcatcggcgttcccatgcttctgctgagcctgattctggggattatctggtcgtatgtatcgcttgaaaccctgtattgggccgatccgaaagtgctcggatcgatcgtgctgctttttttatacggatactatttatttatcaggattgtcaaagagctgcagggaaggatcgcggccatgtggaatgccgcgtcttttcttgttcttttaatcaatttctttttgctcggcagcttttcgcagtttcattggtttagttag

SEQ ID NO: 1949 - DNA, 1353 bp, Bacillus licheniformis
ggttattgacagcgggatttccccccatgaggagctgtcgatcgccggcggtgcatcgatggtcggctataccgcttcataccgtgacgataatggccacggaacccatgttgccggaatcatcggagcgaagcataacggacgggggatcgacggcatcgcgcccggcgcgcagctgtatgccgtaaaagcgctggaccggaatggtgcgggggatctgaaaggtatcttacaaggcatcgattggtcgatccaacacggaatcgatatcatcaatatgagcctcgtcgtttcaggcgacagtcaagttctccacgatgcggtagataaagcatacaaacggggaatcattttagtcggagcgagcggaaatgccggaaacggaaaatccgtttattacccggccgcctacagcagcgtcattgccgtctcggcaaccaatgaaaaaaatcagatcgcctcatttaccaacacccggagcgccgtatagtattccgctccgagcacatctattatcaatacatcgggcaatcgcggatatgcaatcggaagctgcactgcacaagggacacccgacgtcacctgcgtgatcgcacttatgaaacagctgcacccaaccgcttcaaatgctgagctgcgcaagaaaatgcagttttatacaagcgatttgggcgctcccggtcgtgatcatttgttcggctaccgattaatccgcttcaaagaggtcacacagccattggaaaaagcgcaaaaagccgtcggacaagcggaaaagacaaagaaaaaagcggacattcaaaccgcacaaaaagcgatcgaaccgctccctgcagacgcagataaacccgctttgaaaaagagactcaatactgttaaagagcagcttaaaaaaacagccgaaagcaaagtgaaactcgctgagaagcaaaaaaagaaaaccaatgccgactccgcccaaaaagcggtcaacgaactcgacagcggcactttcaaaacgaatttgcaaaaacggatcaacgcggtccgttcaagcctcttgaagaccgcaaagcaggccgttgccaaagctgaaaaagcggcaacagactcaaacctcggcaaagcgcaaaaagcgatcaatgagcttcccgccggaaaagacaaatcaaatctgcaaaaaaggctgaacaccgcgaaaaagcaagcagctgcagcctataataaaaaagtttctgcagcaaaggccaaagtcaaaacggccgaacaaaagagaacgaaaaaaacaaaatcagcagcgcaatcagcagtaggcaagctgaaagcatccgccgaaaaaacgaagctgcaaaaacggatcaatgccattaagctgaa

SEQ ID NO: 1950 - DNA, 909 bp, Bacillus licheniformis
aaaagccgctgactcctaggcagatcgtcgaaaggcttgatcaatacatcgtcggccagctcgatgcgaaaaaagcggtcgccgtggcattgaggaaccgctacagaagaagtcttcttgatgaaaaactgcgcgaagaaatcgttccgaaaaacatattgatgatgggcccgacaggtgtgggaaaaaccgagattgcaagacgaatcgcgaaactcgtcggcgctccgttcgtcaaaatcgaagcgacgaagttcacggaagtcggttatgtgggcagagatgtggagtcgatggtcagggatcttgtggaaacgtcagtccgcctcgtcaaagaggaaaaaatgaacgaagtgaaaggcatcgctgaagaaaacgcaaataaacgcctcgtccgcctgcttgtaccgggaagaaaaaaacagacaggtgcgaaaaatccttttgaaatgctgtttggcggaaatcaggatcaagaaactggtgaagcggaaaagcaagaagacgcggatatcgaaaacaaccgaaaacggattgcgcatcagcttgctctcggcgaacttgaagaccattatgtcaccgttgaggtggaggagcagcagccgtccatgtttgatatgctccaaggctcgggtatggaacagatgggcatgaacatgcaggatgcgctcagcagcctgatgccgaaaaagaaaaagcgccgcaagcttacggtcagggaagcgcgaaaagtgctgacgaatgaagaagcggcaaagctcatcgatatggacgaagctgcccaggaagctgtccagagagccgaacagtcgggaatcatctttatcgatgagatcgataaaatcgccaaaaagagcggtgcttcttcatcggcagacgtctcaagagaaggcgtgcagcgcgatatct

SEQ ID NO: 1951 - DNA, 1563 bp, Bacillus licheniformis
gaaaagaagtagcgaattatttcagggcccgctttccgttcctgtatatttctacatgggaagaagaacgtgtcatacatcaactgagtcatattgtttcggatacagaattgattagaacaccaagaaccttatttgtttggagtttaaccaaagggtttgaaagcaatggaatgcctccatcagccgaaacaaaagacccgttaaaggctttggcgttcattgaaaaatatgatcagccagcagtctttatattgaaggatttttatgtttatttgggtgcaaataatcgcccccctgaataccgtttgattcgtaaaatgaaagatcttgtctctgtattggaaaagagtcttgtttccaaaaatgttgtgcttgtggcgccaacattaacgcttcctcctgaattggaaaaggacatcacaattgtagagtttcaattgcccagctttgcagaaattaaagaaacgctcaagaaaatgatcgaaatgaatcaagggcaaaatcgggcaatcgttagcttgactgaggacgaagaagaacgcctagtaaaagcagcactgggattaactttaaaagaagcagaaaatgcgtttgcactggcgctagtaagcaaagggcgtctagattcggatagcgttgatcaaattctttttgaaaagcagcaaatcattaaaaaaaccggcgtattagagtttattaaaagtgaaccaaatatccaggatgtaggtggattggaaaatatcaaacgttggttgaataaaagaaacaagtcatggatggactccgctcaggactatgggctgccatcccctaagggtcttctattaacgggggttcccggctgcggaaaaagcttaattgctaaagctgtcagctctatgtggaagcttcctcttttaaaattggacatgggaaaaatattcagcggcattgtcggaagcagtgaagaaaatatgagaaacgctttatctacggcagaggccatttctccgtctattttgtgggtcgatgagattgaaaaaggattggggaatagcggaacagctggagacggggggacttcgaagagagtgcttgggaatttcttaacctggatgcaggaaaaatcaaagcctgtatttgtgatagcaactgcaaataatatagacgctcttccgcccgaattcttaaggaaaggacgttttgatgagatattttttgttgatctgccaacgaaaaaagaaagaaaagaaatctttcgcatccatcttgaaaagaggctaacaaacccgaaagctgccgggaatttttcaatagaaccacctgtcttggacaagcttgcagaactgacggaatcatttattggtgctgaaatcgaacaagtcgtaatttctgcattatttgaagccttttctgaaaatcgaagcttaacggttgaggatcttgagaaagtgattaagcagactgttcctttggctgttacgcaatcagagcaaattcttgcaattcgggaatgggcaagtcttcgggctgtatcggctgcccgtcaggaagatctgaaggaataccaatctattcagc

SEQ ID NO: 1952 - DNA, 1821 bp, Bacillus licheniformis
tttattgccaaaaggaagtctttttaagggagctgatatccaatgcgagcgatgccatcgataaaatctactacaaagcgctgacagatgattcactgacatttaacaaagacgattactacataaaaatctccgcagataaagaaaacagaacgctgaccattgcggacaccggaatcggcatgacgaaagaagagcttgaagagcatcttggaacgattgccaagagcggctcgcttgcgtttaaacaagaaaacgaattaaaagacgggcacgatattatcggccagttcggcgtcggtttctacgccgcttttatggttgcggacaccgtcaccgtcattacaaaagcccatggcagcgatgaagcgcatcaatgggaatcagccggagccgacggctatacaatcgaaccggctgcgaaagaatcagccggaaccgatgtcattctgaagctgaaagagaatacagacgatgaaaactatgatgaatacctggatgttcatcgcttaaaagcgatcatcaaaacatactctgatttcatccgctacccgatcaagatggatgtcgcggtcaacaagccgaaagaaggcgccgaaaatgaatttgaagaagtccaggaagaacagacggtcaacagcatggtgccgatttggagaaaaaacaaaagcgaactgaaagatgaagattatgaggcgttttataaggaaaagcattacggttttgacaagcctctcgcgcacatccatacaagcgtagacggcgcggtgagataccatgcgattttattcattcctgaaaatattccgttcaactactacacgaaggaattcgagaagggtctggaactgtattcgaacggtgtgctgatcatggaaaagtgtccggatctgctgcctgaccatttcagctttgtcaaaggaatggttgattcagaagatttatcgctcaacatttcgagggagatgctccagcatgacaggcagctgaagctgattgccaaaaacatcagcaaaaaaatcaagaatgagctgaagagcttgctgaaaaatgacagagaaaaatacgagtctttttatcaatcgtttggcagacagcttaaattcggggtatacaatgattttggagcccataaagatctgttgaaagacctgctgcttttctattcatcaaaagagaaaaagctggtcacccttgaggaatatgtgtccagaatgcctgaagatcaaaaatacatttattatgcatcaggcgactcgtatgaccgaatagaaaagcttcctcaaaccgaggctggtttcgggaaaaagggtgtgaaatcctctgtttcaccgaggatatcgatgagtccgccatacaaatgctggcgaattatcaagagaaagaatttcaagtcggtatcaagcggcgacctgggaatcgaaaacgatgacgagcaaaaccgatctgacggggatgacagccaatacaaagacctgtttgaagagatgaaaaagactctggatggaaaagtgaaaagcgtgagggcgtcaaaacggctgaagactcactccgtatgccttgccgctgacggagaagtcaccatcgagatggagaaaatcttaaacgcaatgcctgacaatcagcatgtaaaggctgataaagtattggaaatcaatacaaaccacgaagtcttcaaaacattgcagaatgcttttgacaacgacaaggataaattcaaactgtacaccggcctcctgtacaaccaggcgctgctgatagaaggcttgccaattgaagaccccgtcgaatttacgaacgatatatgcaaagtaatggcat

SEQ ID NO: 1953 - DNA, 666 bp, Bacillus licheniformis
agcttgtcggacttgaagccggtgctgaaaaagacgttgaagtgacattcccagaggaataccacgcggaagagcttgcgggcaaacctgcggtattcaaagtgaaaattcacgaaatcaaagcgaaggagcttcctgagcttgatgacgagtttgcgaaagatgtcgacgaggaagttggaacgcttgccgagctgactgaaaaaacgaaaaaacgtctcgaagaagcaaaggaaaacgaagcggacgctaaacttcgcgaagagcttgtcttgaaagcagctgaaaacgctgaggctgacattcctcaagcgatgatcgacacagagcttgaccgcatgatgaaagaattcgaacagcgtctgcaaatgcagggcatgaaccttgagctttacttccaattctcaggacaggatgaaaacgcgctgaaagagcaaatgaaagaggatgctgaaaaacgcgtgaaatccaacctgacactggaagcgatcgccaaagcggaaaaccttcaagtcactgacgaagaagtcgaagaagagctttctaaaatggctgaagcatacaacatgcctgttgaaaacatcaaacaagcaatcggttctacagacggaatgaaagaggacttaaaagttcgcaaagcaattgattttcttgtagaaaaccgtt

SEQ ID NO: 1954 - DNA, 666 bp, Bacillus licheniformis
caaaaccgggaacaagccggaaacatgttcacactgcggcggatcaggccagctgaacatggagcagtcaacaccgttcggaaaagttgtcaacagaagagtatgtcattactgtaatggaacgggtaagcaaatcaagcacaaatgttcaacttgcggcggcacaggaaaagtgaaaaaacgcaagaaaatcaatgtcaccatcccggcgggtgtggacgacggccagcagcttcgagtagccggacagggcgaaccggggatcaacggcggtccgtcaggtgacttattcgtcgttttccgcgtccaagagcacgaatttttcgagcgcgatggagacgatatttactgcgaaatgccgctgacatttgcacaggctgcccttggagatgaaatcgaagtgcctactcttcacggaaaagtaaaattaaaagtgccggcgggcacccagacgggcaccaagttccgcttaaaaggaaaaggcgttgccaacgtgcgcgggtacggacaaggcgatcagcacatcgttgtccgcgtcgtgacaccgacgaatttaacagaaaaccagaaaaatattctccgcgaatttgcagaagtgagcggaaatatgccggatgaacaggaaatgagttttttcgataaagtaaagcgcgcctttaaaggcga

SEQ ID NO: 1955 - DNA, 730 bp, Bacillus licheniformis
atggctaagccgattcccgtacttgaaattttcggtccgacggttcagggagaggggatggtcatcggccaaaagacgatgtttgtcagaacagccggctgtgactattcgtgcagctggtgcgattcagcttttacctgggacggttcggcgaaaaaagacatcaaatggatgaccgcggaagaagtgtacgaatctcttaaagacatcggcggaaacgcattctcgcacgttacgatttcaggaggcaacccggcgcttttaaaacagctggacggactgatttcccttttaaaagaaaacggtatacggacagcgcttgagacgcaaggaacgttttatcaagactggtttaccggaatcgatgatttaacaatttcgccaaagccgccgagctccaatatgaaaaccgattttaacaggcttgatcatattgttgacaggctgaaggaacacggccgggcggctgcggcaagtttgaaggtcgtcattttcacggcggacgaccttcaatttgcaaaacaagttcaccagcgttatcccgatatcccgttttttcttcaggtcggaaatgatgacgttcatacagaagaccaagagcggctcgtcgaacggctgctccaaaaatatgaacagctggtagaagcggtcacgcgcgaccctgaattgaaccgcgtccgcgttctcccgcagctccacaccctgatctggggaaacaaacggggtgttt

SEQ ID NO: 1956 - DNA, 762 bp, Bacillus licheniformis
ggtgatcgtcttttactttttgatcaaaaagcatgaaaaacgttggtggttttatgcctggtgcatgacggttccggttacgctgtttttatttttccttcagccggttgtcatcgatcctttatacaatgacttttatccgctgaaaaataaagatctcgaacaaagcattctgaagctggccgatcaggcagatattcctgcgaatcacgtctatgaagtgaacatgtctgaaaaaacgaatgcgttaaatgcttatgtgacagggatcggcgccaataaaaggattgtgctctgggataccacgctgaacaagctggatgagccggaaattttattcattatggcgcacgaaatggggcactatgtgatgaagcatgtttacataggactcggcgggtacctgcttttatcccttgccgtcttttatgtgatcgacaagctgtacaagcggatcatcggccgctatggaaaaagcctccgcattgcgggaaaatccgatcttgccgcactcccgcttctcctgatgctgatgggggtcatctctttcgcgtcttctccatttacaaacgcagtttcgaggcatcaggaaaaagccgctgaccagtatgcgattgaactgacgaacaacagcgatgcagcggttgcgacttttcaagagctctcaaaagccgggttgagcgaggcgaacccgccgtttctcgtcaagatttttaaatacggccatccgaccataatggaacggattcaaaatattgaaca

SEQ ID NO: 1957 - DNA, 612 bp, Bacillus licheniformis
gccacatgggcactgactatacagttgaaattgaaggcaaaaagtacacgccgcaagaagtgtctgccatcatccttcagcatttgaaatcatatgctgaaagctatttgggcgaaaccgtgtctaaagccgtgatcacagttcctgcatacttcaacgatgcagagcgtcaagcgactaaagatgccggtaaaatcgccggacttgaagttgagcggatcatcaacgagccgactgcagctgcgcttgcctacggtctggataaaacggaagaagatcagacgatcctcgtctacgaccttggcggcggtacattcgacgtttccatccttgaattgggagacggcgtattcgaagttcgctctacagcgggtgacaaccgccttggaggagacgactttgaccaagtgatcatcgatcatctcgtctcagaattcaaaaaagaaaacggcatcgacctttctaaagacaaaatggcgcttcagcgcttaaaagatgctgctgagaaagcgaaaaaagacctttccggcgtatcttctacgcaaatttccctgccgtttatcacagcgggtgaagcaggtccgctgcaccttgaattgacactgacccgcg

SEQ ID NO: 1958 - DNA, 564 bp, Bacillus licheniformis
atgtctctaatcggaaaagaagtacaaccattcgcagcaaaagcttacaaaaacggtgagtttatcgatgttacacacgaagatctgaaaggccaatggagcattttctgcttctatccagcggatttctcatttgtttgcccgactgagcttgaagaccttcaaaaccactacgaagctctaaaagaactaggtgtcgaagtatactctgtttctacagatactcacttcgtacataaaggatggcatgacagctctgagaaaatcggcaaaatcacttacgcgatgatcggcgacccatctcaaacgatctcccgcaattttgaagtgctgaacgaagaagaaggtcttgctgaccgcggaacattcatcatcgatccggacggcgtcatccaagctgttgaaatcaacgcaggcggtatcggccgtgatgcgagcatcctgatcaacaaagttaaagcggctcaatacgtacgccaaaacccaggcgaagtttgcccggctaaatgggaagaaggttctgaaacactgacaccaagccttgacctagtaggcaaaatctaa

SEQ ID NO: 1959 - DNA, 1665 bp, Bacillus licheniformis
atggttcatactaaagttacggaggtgtcagtcaaaatggcagatgaaacgaaacgaaacatcccgctcctccctttaagaggtttactcgtctatccgacgatggttttgcaccttgacgtcgggcgtgaaaagtcggttcaggcacttgaacaggcgatgatgaatgaccatatgatctttttggcaacgcaaaaggacatatccatagacgaaccggatgaagacgagatttttacattcggaacctatacgaaaatcaagcagatgctcaagctgccgaacggaacaatccgcgttttggtggaggggttgcagcgcgcccgcattcttgagtaccatgacttagatgaatatacgtctgtaaaaatcgagcgaatcgatgaagagactgaaaaagatgttgaagatgaagcactcatgcgcacattgcttgaccacttcgatcaatacataaagatttcgaaaaaaatatcggcggaaacatttgccgctgtgacagatattgaagagccgggaagaatggccgatattgtcgcctcccacctcccgctcaagctgaaagacaagcaggaagtgctggaaacgatcgatgtcaaagccagattgaacaaagtaatcgacctgattcacaatgaaaaagaagtccttgagattgaaaagaagatcgggcagcgcgtcaagcgttcaatggaaagaacacaaaaggagtattacctgcgcgagcagatgaaagccatccaaaaagaacttggcgataaagaaggaaaaacgggtgaggtccaaaagctgactgaaaaaatcgagcaggccggaatgcctgacaatgtgaaagaaaccgcgcttaaagagctgaaccggtacgaaaaaattccgtccagctcagctgaaagctctgtcatccgcaattatatcgaatggcttatttctctcccatggaacgatgcaacagaagacaggctggatttaaagctcgccagtcaaattctcgatgaagaacaccacggccttgaaaaagtgaaggagcgggttctcgaatatttggctgtccagaagctgacccgctcgttaaaaggaccgatcttatgcttggccggccctccgggtgttggaaaaacctctctggcgaaatcgatcgccaaatcgctcggacgcaaattcgtccgcatttcccttggcggcgtgagggatgaatctgaaatccgcggtcaccgccgcacatatgtaggcgccatgccgggccgtatcattcaggggatgaaaaaagcaggcaagaacaatcccgtattccttttggacgagattgacaaaatggcgtcggatttcaggggagatcccgcttcagcgatgctggaagtgctcgatcctgaacaaaaccatacgttcagcgaccattatatgaagagacatttgacttatcaaaggttttgtttatcgcaaccgcgaacaaccggccacaatccccggcccgctcagagaccgcatggagatcatcacgatcgccggctatacggaagtggaaaaggtcgaaatcgtcaaagaccatctgcttccaaaacagctgaaagaacacggtttgaaaaaatccaatctgcaaatacgggagcaggctgtcctggacgtcattcgctattatacgagggaagccggcgtcagaaatcttga

SEQ ID NO: 1960 - DNA, 618 bp, Bacillus licheniformis
  misc_feature (1)...(618): n = A,T,C or G
ccaaacagcggttgacatccacgtgctccaaggtgagcgcccaatggctgccgacaacaanacgctcggacgcttccagcttacagatatcccgccggctcctcgcggcgtaccgcaaatcgaagtgtcatttgacattgataaaaacggtatcgtcaacgtcagcgcgaaagatctgggcactggcaaagagcaaaacatcacgatcaaatcttcttcaggcctttctgacgacgagatcgagcgtatggtgaaagaggctgaagaaaacgccgaagcagatgcgaagaaaaaagaagaaatcgagcttcgcaacgaagcggaccagcttgtcttcacaactgaaaaaacgctgaaagatcttgaaggcaaagccgatgaagcacaggtgaaaaaagcgaatgaagcaaaagacgcgctaaaagctgcgatcgagaaaaatgaccttgatgaaatcaaggcgaaaaaagatgagctgcaagcgatcgttcaagagctttcaatgaagctttacgaagaagccgcaaaacaggctcaggctcagcaagacggcggagctggcgctaaaaaagccgatgataatgtcgtggacgctgaatatgaagaagtaaacgacga

SEQ ID NO: 1961 - DNA, 544 bp, Bacillus licheniformis
atgtcatcttttcacgcaacgacgatatttgccgtccagcacaacggaaaaagcgcgatggcgggagacggccaggttacgttcggtcaggctgtcgtcatgaagcataccgcaagaaaggtaagaaaactcttcaacggaaaggtcattgccggttttgccggttctgttgcagacgctttcacgctctttgaaatgtttgaagcgaagcttgaagaatacaacggcaatttgcagcgggcggcagtcgagcttgcaaaagagtggcgaagcgataaagtcctcagaaagcttgaggcgatgctgatcgtcatgaatgccgacagcatgctgctcgtttccggaacaggcgaagtgattgaaccggacgacggcattttggcgatcggctcaggtggaaactacgcgcttgcagccggaagggcgctgaaacgtcatgccggcagccagcttgacgcgaaagcgattgcgagggcttcacttgaaaccgcgggcgaaatctgtgtgtatacgaacgatcagatcattgtagaagaacttgaat

SEQ ID NO: 1962 - DNA, 599 bp, Bacillus licheniformis
atgaaaaaacaacttctcgatgtagcgattattgggggaggtccagcagggttgaatgccgcccttgttcttgggcgtgcgaggaaaaatgtggcggtgatcgatgcaggccggccacgcaacgccgttactcgcaaagctcacggatttcttacccgtgacggaataagcccaagtgaatttcggcaaattgcaaaggaacagatcagtgcatatccctccgtgtcttttatagcggataaagctgtgtcgattacaaaaaccggcggtcattttcaaatgacaactgcgcaaggaaacacttttgcaagcaagaaagtgctgtttgccgtcggaatgaaggatcagccgctagatattccagggctggcagaggtttatgggaagagcgccttcgtctgcccgtactgtgatggctgggaattaagggataagcctctagtgatcattaccaagggggacgaggccattcacttcgcttctctcatatcaggatggacgaaccgttttacgatttgcacgaacggcccccatcaactgacggacgagcagtgcgaggagctcagcaggcatcgcgtccctgtattcgaagcgccgat

SEQ ID NO: 1963 - DNA, 601 bp, Bacillus licheniformis
atggctgatatcaattatattctcgctttcggtgcagggtttctatcgtttatttcgccatgctgcctgccgctttatcccgcttttttatcatatattaccggtgtcagcatgagtgaaatccattctgacaaacttatgtttcaaaaaaggagcttggtacatacggtctttttcctgatcggcttttcgatgatctttgtggcactcggctacagcacgtcgcttgtcgggtcgttttttaaggattatcatcagctcatcaggcagcttggtgcggtttttatcatctttttcggatttgtcactttgggggtttttaagcctgaatttttaatgaaagaaaggcgcctccaatttaaaaacaggcctggaggtctgctcggttccatcggaatcggaatggcatttgccgccggctggacgccctgcaccggcccgattcttgcagcggttattgcactcgccggaacgaacccgatgtcggccgtgccttatatggcgctttatgcactcggattcagcttgccgtttctgcttctgtcttttttcattacaaagatgaaatggcttcggaagcatcagctcatcatcataagat

SEQ ID NO: 1964 - DNA, 963 bp, Bacillus licheniformis
tctccgagctgatcggggaatgcgattcctttttgcaaacgaaaaacagagcgatacaatttgcagcatcttcccatccgattctgattcatggggaaacaggcacaggcaaagagctgttcgccaaagccattcattccggatcatctttcaaggatgatcccttcacacatgtaagctgcagcacgctggatgaagatgaaacggctgaagatttttttctttcagagctgaatgagcccggaaccttgtttctcgacgaagtgtggggtctatccttgcatctccagggcaggcttttggcagccattgaaaaagggatgcaaaaaagattgatcacctcttcaagcatgcctctcattgaacggattgatagcagcgaattccgcaaggacctgtactacaggctcaatgtgctcgaccttccgcttccctctcttagtgaacggcgaagcgacatcccccttctcgtgcatcattttttaaaaagcggggatcatgacatatatgtcgaaccggtcgtttggaaagctttagagcagcatgagtttgaggggaacgtcagagaactcaaaaacatgacggattatatgataaccgtctcagacggaaaaacgattcagctttacgacacaccgccctcgttaagagaacaaatcaaaaaaaagaagcctaaggacaaaaaaacggcttcggcatcacttaccttaatggaaaaagaggagtttgcgtttttgctcgatgcaatcaagcaattaaatgaaaaaggagagcctgccagccgcagggttctgtccgagctgagcaaaagcggcaagtcggagcttacaccccagcaagtgagaagcagattggattatttggaaaaaagagagtttattacaaagggccgcggaagagccgggacaaaaatcacgcttgaaggcctccgctttttaagctctttaaagcatcacattattc

SEQ ID NO: 1965 - DNA, 852 bp, Bacillus licheniformis
atgatagcaataggagcgtgaaaatgatggaatataatagagaagatcagcttgaaacaaaaaacgaactcatcgtctccgatcaaaagcccgaccaggcgataaaaaaagcagaacagcaaaagcggagactctcgtggatgacgccgattctcagcggcatcatcggaggaagcctcgttctcggcgtcacgacataccagcatagcaaagacgaaacggccaatacatccgtccagacgcaaacaaacgagacgtcgaactcatcggcttcttccactaaagcgaataccgaaaaattgtccagcaccaattcgtccgacatttctacaatggttgaaaatgtatctcccgccatcgtcggtatttcaaactatcaaaaacaaacagagagcggtatgttcggttttgaaagcaacagcagcagctcaagcgaacaagaaacaggcacaggctcaggtgtcatctataaaaaagcaaacggcaaagcatacattattacaaataaccacgttgtcgaaggcgcgtctaaactgacggtttccctgtccaacggcaaagaagtggaaggtaaattgctgggcagcgattcgttgacagaccttgccgttgttgaaatttccgctgatcacgtggaaaaagtcgcctctttcggcgattcgtcaagcttgaaagcaggcgaatcggtgatcgctattggaaacccgctcggcaaagatctgtcccgcacggtgacacaaggcatcatcagcggtgttgatcggaccgtttccgtagatacatccgcaggccaaaccgagatgaacgtcattcaaaccgacgcggccatcaaccccggcaacagcggaggcg

SEQ ID NO: 1966 - DNA, 494 bp, Bacillus licheniformis
  misc_feature (1)...(494): n = A,T,C or G
atggattatttagtgaaagccattgcatatgacggcaaagtgagggcatatgcagcgaatacaacagaaacgattcatgaagcccaaagaaggcataacacatggcctaccgcttccgccgctttaggaagaacgatgacggcggctgtcatgctcggcgccatgctgaaaggcgaagacaagctcaccgttaagattgaaggaggcggaccgatcggcgcgattgtcgctgacggaaatgcaaaaggagacgtcaggggatacgtgtccaatccgcacgttcatttcgacttaaatgaacacggcaaacttgacgtcagaagagccgtcggtacgtcaggaacgctaagcgtagtaaaagatctcggtctccgcgatttatttacaggccaggttgagatcgtttccggagaaatcggcgaggattttacttattatntcgtgtcctctgaacaggttccttcttcggtgggtgtaggggtgctcgtcaaccc

SEQ ID NO: 1967 - DNA, 533 bp, Bacillus licheniformis
atggctgaaaaacgcgaactcgccacatttgccggaggctgcttttggtgtatggtcaagccttttgacgaacagccgggcattctaaaagtcgaatccggctataccggcggccatacggaaaatccgacctatgaagaaggtgtgcagcaatacaacgggacataggggaagcggtgcaaatcacatttgatccccgatgtctttccatacgaaaaactgctggaactctactggcagcaaatcgatcccactgacagcggaggacaattcacagaccgcggagagtcttaccggacagcgattttttaccataatgacaagcagcggaaactcgctgaagaatcgaagaaaaagctcggagaaagcggcatctttaaagatccaatcgcgaccgacattctggaggccgggccattttatccggctgaggagtatcaccaggactatcataaaaagcaccctgaacgctacacacagtatcggatcggaagcggaagggaaggatttttacaacagcattgggggcgaaa

SEQ ID NO: 1968 - DNA, 682 bp, Bacillus licheniformis
gtgaagaagaaacagcagtcaccgatgaaatttgcagtgattatgacagtcgtggtcgtttttctgatcggcgcacttgtcgtaatcaacaatcaaacccaaaatgcttcgcaaacctttgatgacaagccttcaactgaaggacagccgcttctaggcaacaaagatgcggctgtaacgatcacggaattcggagattacaaatgtcccagctgcaaacagtggactgagaccgtctttccggatttgaaaaaggattacatcgataaagatcaagttaatttttcatatattaacttcgtcaatgaacagcacggcagaggctctgaattgagcgccctcgcttccgagcaggtatggaaggaagatccggattcattctggaagttccatgaggcgttgtacaaggcgcagcctgacaatgacacgatggaaaacgagtgggcgacgccggcaaaattggcggacatcacggaagccaatacgaaaatcaaacgcgataagcttgtcagcagcttaaatgacaaaacgttcgctgagcaattaaaaacggacaattcgctcatcaacaaatacggtgtagactcgacgccgacgatctttgtcaacggcgtaaaaatcgacaaaccgtttgattatgacaaaatcaaagaaacgatcgagaaagagctgaaaggccagt

SEQ ID NO: 1969 - DNA, 642 bp, Bacillus licheniformis
aattgaacttttaaaaggagcaggattgttctttttgcacccgctcttctattttatgatgattatgagtcttgcttacggctatgcccggatcaaacgtgaaagaaagacgttccatacgcgtattgaagatatttatgacgagttcaaatttacatattccaagggacttctggcaggacttgtactgtccattgtttcgttcggcttggggctgtatctcccgatgggcatgctggttttaatagcggcggtcagcgttgccgcagctttaactttcagacagagtctgctgtcagcggcatatacgcttggcgtgagcatcgtcgttggtttatgtattgaatacaccggtttcggagcgcttgacgcgtttctgccgcagctgtccctcgcgaattggtcggctgctgccgtcttgctcggacttctgttggtggcggaaggagtgcttgtctataaaacggcacatatcaaaacgtcccctgcgattgtcatgagcacaaggggtctcccgatcggacagcagattgcgggcagaacctggcttctgccgttgtttattcttattccgggacatgcgatcgaatcatctgttccgtggtggcctgttttgtcatttaacggcggctttgagctctt

SEQ ID NO: 1970 - DNA, 843 bp, Bacillus licheniformis
agctgatagaacagctggtgcagcaggggttaacgtttcatcctgaagtgctgctgaatgagaaagtcgaatcgattgcccgcaatgaagaagggttgtttgaattacatacggctgcctcaggtgtgcatctttccaagacggtcatcgttgccgtgggcggcggcatcctcaatccgcaaaagcttcagatagaaggcgcagagcgttttgaagtgtccaatctgaattatacggttaagtcactgcagcattttaaagataaaacggtcattgtatccggcggcggcaattcggctgtcgattgggccaacgaactcgaacctgtagcgaaaaaggtctacctcgcttaccgcaaagatgcgctcagcgggcatgaggcccaggtggatcagcttctgaacagctcggtgagctgcttctttcatacagagattaccaagctgatcgcttcggaagatcatgaggtgatcgaacgggtcgagctcacgaacgctcaaacaggtgaggtgatggaactgcctgtcgacgaggtggttatcaaccacggatatgaacgcgacacctcacttctggagaacagccgccttgatgttacccgagtggatgactattatattgcaggtacttccaactgccagtcttccgtgcccggtctgtatgcggcgggggatattgtgcattacgaaggcaagctgcacctgatcgccggagcgtttcaagatgcggcaaacgcggtcaacagcgccaagcgatttatcgatcccgaagcgcacaagagtgcgatggtgtcgtcgcataatgaggttttcaaagagcgcaaccgcgagcttgtcaagaaga

SEQ ID NO: 1971 - DNA, 406 bp, Bacillus licheniformis
atgaaaaataaactgctttttctgtacggcgcctggatcgtctcattaacggcgacgctaggcagcttgtacttcagcgaaatccgcaaatttattccttgcgaactgtgctggtatcagcggattatgatgtatccgctcgtgctgattctcggaattgcgacatttcagggcgatgcccgcgtgaaaaaatacgtgctgccgatggcggtgatcggcgcaggcatttccctgatgcactacatggaacaaaaaattcccggattcaacggcattaaaccgtgtgtcacaggagtgccttgctcagggcagtatatcaattggttcggtttcatcacgattccgtttctcgcccttattgcatttattttgattatcatttttatgtgctttctcaaggggaaag

SEQ ID NO: 1972 - DNA, 431 bp, Bacillus licheniformis
atgacgaacaataaagaagaacggctgaaacagctgacccggatgcaatatgaagtaacgcagaaaaacgggacggagcctccattccaaaacgagtactgggacctgcatgaagacgggatctatgtcgatatcgtttcagggaagccgctgttttcatcgcttgacaaatttgacgcacactgcggctggccaagcttcacaaaaccggtcgatgccggagaaatcgaagaaaagctggacacttcacacggcatgattcggactgaggtgagaagcaagtctgccgattcccatcttggacacgtgtttccggacggacccggaccggacggcctgcgctattgcatcaattcagccgccctccggtttgtgccgaaggacgaccttgagaaagaaggatacggcgaatatgtcaaactgtttgaacg

SEQ ID NO: 1973 - DNA, 366 bp, Bacillus licheniformis
ggaacagcggatcttcaggaaacacgaatacaatcggctatcctgcgaaatacgactctgtcatcgcagttggcgcggtagactctaacagcaacagagcttcattttccagcgtcggagcagagcttgaagtcatggctcctggcgcaggcgtgtacagcacttacccaaccagcacttatgcaacattgaacggaacgtcaatggcttctcctcatgtagcgggagcagcagctttgatcttgtcaaaacatccgaacctttcagcttcacaagtccgcaaccgtctctccagtacggcgacttatttgggaagctccttctactatggaaaaggtctgatcaatgtcgaagctgccgctcaat

SEQ ID NO: 1974 - DNA, 486 bp, Bacillus licheniformis
gcttgttcagcaaaaagtactccatgataaatacgatgtctccgacaaagaaatcgacaaaaagctgatcgagtacaaaaaatcaatgggtgaccagctcaaccagctcattgaccaaaaaggcgaagacttcgtcaaagaacagatcaaatacgaacttctcatgcaaaaagccgcaaaggataacataaaagtaaccgatgatgacgtaaaagaatattatgtcggcctgaaaggcaaaatccacttaagccacattcttgtgaaagaaaagaaaacggctgaagaagttgagaaaaagctgaaaaaaggcgaaaaattcgaagaccttgcaaaagagtattcaactgacggtacagccgaaaaagacggcgacctcggctgggtcggcaaagacgataacatggacaaggatttcgtcaaagcggcatttgctttgaaaaccggcgaaatcagcggacctgtgaaatcccaattcggctatca

SEQ ID NO: 1975 - DNA, 685 bp, Bacillus licheniformis
atgacgatacttgcgattgatacatccaatttaacgctcggagtggcattaatcaaagacggaaaagtgatagccgagcatatatcccacttaaagaaaaaccattcggtcagagccatgccggcaatcgacgaactccttaaagagtgcggtttaaagcctagtgacctgacccaaattgcagttgccaaaggcccgggttcatatacaggcgtgcggatcggcgtgacgattgccaaaacgcttgcatggtcattaaatattccggttaaaaccgtttcaagccttgaagtgcttgcggcaaacggccgttttttccaaggcttgatttgtccgttgtttgatgctaggcgcggtcaggttttttcgggcctgtccagttaaggaccggcaactcccatgaatggaggaggcccggacaatctggttgaagatggctaaaaaagctgaaagccatggatcagcaagtccttttcatagaaagcgacaccgggattcacagggaaaatgatcgaacggattctcgatgaacaagcggttattgcagaccctgccctgcagcttccaagaccttcagaattggctttaatcggagaacttaaagaggacgagccagtgcacagcattgttccaaactatattcgtctggccgaagccgaggccgtctggcttgaaaaacaaaagt

SEQ ID NO: 1976 - DNA, 473 bp, Bacillus licheniformis
atgtccatttacgatatcagcgtcaagacgattaaaggcgaggacacgacactgcggccgtataaaggcaaagtgctgctcatcgtcaacaccgcctcgaagtgcggatttacacctcaatatcagcagcttcaagacttgtatgaaacatataaagaccgggggcttgagattctcggctttcccagcaaccaattcatgaatcaggagccgggcgatgaaaaaagcattgaagaattttgcagcgtcaattacggtgtcacgtttccgatgttttcgaaggtgaatgtaaaaggggatcaaatccacccgctgttccgccacttgacgaacaaggcgaagggcatgcttggaacaaaagcggtcaaatggaatttcacaaaatttctcgtcgatcaaaccggagaaaacgttgtgcgcttttcaccgcaaaccaatccaaaggagatggaggagaccattcagaaatggct

SEQ ID NO: 1977 - DNA, 912 bp, Bacillus licheniformis
cgtcattattataggagcaggtcctgcgggaatgacggcagccgtttatacgtcaagggcgaacctgtcgactttgatggttgaaagaggcgttccgggcggacagatggccaatacggaggatgttgaaaactatccgggatttgaaagcattctgggacccgagctttcaaataaaatgtttgaacatgcgaaaaagttcggcgctgagtatgcgtacggcgatattaaagaagtcgtcgatgaaggagactataagatcgtcaaagcgggatcaaaagaatttaaagcgcgcgcggtcatcatcacagcaggcgccgaatataagaagctcggcgtacctggcgaaaaagagcttggcggccgcggcgtttcttattgtgcggtttgtgacggcgccttctttaaaaacaaagagctggtcgttgtcggaggaggagactccgctgttgaagaaggcgtgtacttaacccgtttcgcttcgaaagtaacaatcgtccatcgccgcgataagctgagagcgcaaagcattcttcaggcgcgcgcgtttgacaacgaaaaagtcgactttctctggaataagacggtcaaggaaattcatgaacaagacggaaaagtcggcaaagtgacactggtcgatacggtcacaggcgaagaagaagagttccggactgacggcgtctttatctacatcggtatgctcccgctttcagagcctttcaaaaacctcggcattacaaatgaagagggctacatcgtgacaaatgaacagatggaaacaaaagtcgaaggcatttttgctgcgggagacattcgcgagaaaacccttcgccaaatcgtaacggcaacaggggacggaagcattgccgcacagagcgttcagcactatatcgaagagctgaaagagaaaga

SEQ ID NO: 1978 - DNA, 687 bp, Bacillus licheniformis
atggctggcattcggcggcggtttcctgtcgtttatttctccttgctgcctgcctttgtatccatcatttatttcctacatcaccgggatttcggtcggcgatttgaaaaaccggcatgcaaagcatatcaaacaatcggtgatgattcacgcagcggcttttttggccggtttttctgtgattttttacatattgggtttctctgccagctcggttggtctgctgtttttgcaataccataacttaatccgcatgctgggcgggatatttttcgtcgtcatgggactgttcttactcggcgttttccggccggcttttatgatgaaggagcggcgcttttcgattagaaagggaaaaataggcctgctgaattcaatgctggtcggaatgatttttgcggcgggctggacgccgtgcatcgggcctatattcggaacgatcgcatacgcaaattttcagaaccctgattttgggagcgcattcatgatgatcaccgcatattctttaggctttgccattccttttttgctcatggcgttttttatcggaaacatcaggccgcttatgaaatattcgaatatgctcatgaagatcggaggcgcgctgatgatcgtcatcggcatcctgctttatacggacaacatgatatggattaacatctggtattcgaatttgacgaatctctt

SEQ ID NO: 1979 - DNA, 406 bp, Bacillus licheniformis
ctgcattgtttacagcaaaagtcacggcaaaaggcggaagatccggacatgtcaaatcagatgacggggttttggaccataacattgtcatgccaaatgaaaaaaaagaaggcgaatcagggacaaatcctgaacagctctttgcggcgggatacgcggcgtgcttcggcggcgcattggaacatgtcgcaaaacaaaaaggcattgacatcgattctgaggtcgaaggccatgtgagcttgctgaaggatgagagtgacggcggttttaaaatcggcgtcaagctgatcgtcacagcaggcggggtagaaaaagaaaaagcgaaagagctggtcgaagccgctcatgacttttgcccttattcaaaagcgacgagaggaaatatcgacgtcaatcttgaagtaaa

SEQ ID NO: 1980 - DNA, 434 bp, Bacillus licheniformis
atggctaaacatcatttttaccttcaggcagactggcctggaaaacgaaacgacatcggaaggattgaaagcgggaatttaaaaaccgaaatttcgataccaaaggaaatggacggcccgggggcggggacaaaccctgacgaaatgctgctcggtgccgctgcgacttgctatatcattacacttgcagcgatgatggaaagaagcggattggaaaaagagagcctgacgatggaatccgaggccgttgtcgatgtgacaggcggggtgtttacgtacgaaaaaatcattcacagacctctgatccgcctcccgaaagaagcggcgcaaaaagaggccgaacttgccgaaagactggctaaaaaagcggagacatcatgcatgatatcaagggcggttcagggcaacgtcgccattgaattagagccgaagat

SEQ ID NO: 1981 - DNA, 465 bp, Bacillus licheniformis
ttcagcgaagcgcatcagcgtgcttggcatcatcattctgctgatcgcggccggaagcatatggtggactccgcttgccgcccttgccgccggagcagcgatcgcaggaagggcctttttatcctggaagcagcggatgaacgacaattccgcccctttccatttttcaaagagagaccagggcttgatggtgctcgggattattccgaacacgccggcagccgatctcggtctcaagatcggcgaaatcatcacgaaggtcaacgggattgaagtgaaaaatgcggcggacttctacgaagcgctccaaaagaacagggctttcttcaagcttgaagtcgtcggtttaaacaatgagattcgttttgaacaaagagcttcttatgaaggggagcatcatgagctcggcatcatctttgtaaaagaagaggatgcggtgatgaagcatgccgaggcagcagcctc

SEQ ID NO: 1982 - DNA, 462 bp, Bacillus licheniformis
aacagaaatgcttgaaaaacaactaaaagaacttcaagaacgtcttgaagaaaaagaaaataaacttttacgtgttcaggcgggactttgaaaactacaaaagacgcgcacgccttgatctcgaggctgctgaaaagtaccgctcccagcgcatcatcagcgatttgctgccggcgcttgacaactttgagcgcgcacttcagatcgatcctgacaatgagcagacgaaaagcctgcttcaaggaatggaaatggtgcaccgtcaaattttggaggctcttaaaaatgaaggagttgaacagattccatcagtcggagagcaatttgacccgaacatgcaccaagctgttatgcaggttgaggatgaagcgtacgaatcaaacgcagtcgttgaggaactgcaaaaaggctataaacttaaggaccgggtgatccgtccttctatggtaaaagtcaatcaat

SEQ ID NO: 1983 - DNA, 449 bp, Bacillus licheniformis
  misc_feature (1)...(449): n = A,T,C or G
atgatgaggaaaaagagtttttggcttgggatgctgacggccttaatgctcgtgttcacgatggtcttcancgattccgcgtctgctgctcagccggcgaaaaatgttgaaaaggattatattgtcggatttaagtcgggagtgaaaaccgcatccgtcaaaaaggacatcatcaaagagagcggcggaaaagtggacaagcagtttacaatcatcaacgcggcaaaagcgaacctacacaaacaatcgcttgaggaagtcaaaaatgatccggatgtcccttatgtggaaaaggatcccctacctcatgctttgcccccaaccgtccctcaccccttccctctcattacacccttcaaaactccaacttcccccctacaccctcacccctgttaactcccccccctgcattccccaatccaagtcccacatccgtatctgacatcaat

SEQ ID NO: 1984 - DNA, 359 bp, Bacillus licheniformis
atgggaaagaaagtactgctgacaggatttgacccctttgggggagaaacagtcaatccgtcctgggaagctgtaaaacggctgaacggagaggaagcagaaggcgtctctatcgcagcggagcagattccgaccgtttttcatcattcagcggccgttttgaaaaaagcgatcgaaaagcacaaacccgatgtcgtcatttgcgcagggcaagcaggcggcagggctcatattacgccggaacgcatcgcaatcaacatcgatgatgctcgcattccggataatgaagaccgggaaccgatcgatgaacccatcgcggcagacgggcctgctgcttactggtccgcgcttccgatcaa

SEQ ID NO: 1985 - DNA, 747 bp, Bacillus licheniformis
acgtcaaagttgccttgattgacagcggactggatcttgaccatccggacttaaaagcgtccgtcaatacaaatggcggctggaattacattgacggcaagcctgtatccggagatccgacaggacacggaacacaaacagccgggatgatcaatatcattgcgccagatgtgacgataacgccttatcaagtgctggacgaaaaaggcggagacagctacaacatcatgaaggcgatggttgatgcagtcaatgacgggcatgaagtcatcaacatcagtacgggaagctatacttctcttgacagggaaggaaaagtgctgatgaaagcttatcaaagggctgcaaactacgctgcaaagcatcaggtgctggtcttctcttccgccggcaataaaggagtcaaccttgatgagatgaggaaaacggaaaacaaggtgcatttgccgagcgctttgaagcacgtcgtatcagtcggcagcaatatgaaaagcaacaatatttccccatactccaatcaagggcgggaaattgaattcacagccccgggaggatatttgggagaaacgtatgatcaggatgggatggttcgtgtgacagacctcgtactgacaacgtatccgaaagggaaggacaacaccgcattagaccagatgctaaacatcccaaagggatattccctctcatacggaacaagcttggccgccccgcaggtagctggaacagctgcactggttatatctgaat

SEQ ID NO: 1986 - DNA, 357 bp, Bacillus licheniformis
aagatctgtatgtattaggaatcgaaacaagctgtgatgagactgccgctgcgattgtcaaaaacgggacggacatcatctcaaatgtcgtagcgtcgcaaatcgagagtcataaacggtttgggggcgtcgttcccgagatcgcatcaaggcatcacgtggaacagatcacgatcgtgcttgaggaagcctttgcacaagcggacataacgtttgatgacattgatgccattgcagtaacggaaggaccggggcttgtaggcgctctattgatcggcgtgaatactgcgaaagcgctcagttttgcccggggcataccgctcgtaggcgtgcatcatattgccggtcacatctata

SEQ ID NO: 1987 - DNA, 256 bp, Bacillus licheniformis
atggcaaaagatattaagtttagcgaagaagcccgccgttcaatgctgcgcggtgtagatgcattggcggatgctgtaaaggtaactttgggacctaaaggacgcaacgtcgttcttgagaaaaaattcggttctccattaatcacaaacgacggtgtaaccatcgcgaaagaaatcgagcttgaagacgcgttcgaaaacatgggcgcaaagcttgttgctgaagttgcgagcaaaacaaacgatgttgccggtg

SEQ ID NO: 1988 - DNA, 367 bp, Bacillus licheniformis
atggatggaaatattcattcgatcgaaacattcggcaccgttgacggtccaggcatcaggtatgtcgtcttcacacaaggctgcctgatgcgctgtcaattttgccataatgctgatacttgggaaatcggaaccggaaaacaaatgacggtttccgaaatcgttcaggatgtccagcattatctcccgtttattcaatcatcgggcggaggcatcaccgtgagcggaggcgagccgcttttacaactgccgtttttaatcgagctgttcaaagcatgcaaaagcctcggcattcacacggcactcgattcgtccggcggatgctattcggctgcgccggcatttcaagagcagatcaaagaactgt

SEQ ID NO: 1989 - DNA, 252 bp, Bacillus licheniformis
aaggagcgatacgaatggcgacagaggtcgaaatgaaggaccaagtacaggaagtgctggacaaacttcgtccgtttttactccgtgacggcggtgactgtgaactcgtcgatgttgaagacggcatcgtcaagcttcgcctgctcggcgcatgcggaagctgcccaagttccaccatcacccttaaagctggaattgagcgcgcccttttagaagaagttccgggcgtcattgaagtagagcaagtatttt

SEQ ID NO: 1990 - DNA, 246 bp, Bacillus licheniformis
gcaaggtatatctcttgaattttctgacgatgctattcgtaagattgcagaagtggcttatcatgtgaaccaggacacagacaatattggggcgagaaggcttcacaccattttggaacgtcttttggaagaactgtcattcgaggctccggatgtgacgatggaagaagtggtcatcacgcctcaatatgttgaagaaaagctcggttcgatcgctaagaataaggatttaagccagtttatttt

SEQ ID NO: 1991 - DNA, 750 bp, Bacillus licheniformis
atgaacaaaaccgccaaaccaatggcagttccaaagggagccgaagtcctgctggaaacacgttttccttaccttgacaaaaagcagcgccgttcggttttagccactaccggtcttccggccggctaccctgttcttgatgatcgagaaggatggggaaggcttaatctcttttccgcggcagatgggtatggggcttttaccaaaaatgttaccgtgaccatggattccgcaaaaggcggcttccatacagccgatcgctggcgcaacgacatctccggcaccggaaagctgaccaaaaaagggacaggcgctttgaagctggaaggggataatacatattccggcggtacacggattgatcaaggaacacttgagggcggttcggagacagctttcgggagaggtgatgttgcactaaacggaggcatccttaaggaagatgcgccgggaaaactgatcatcgaaggagactacaaacaatctgctaaaggaatacttgaacttcagctcagcggcaaaaaagatcagttgaaaattaagggaaaagcaagattgaaagggacattgcgtctcaattttacggacaattacgtaccggctgacggatcggcgatcataaccttccgcaagcgtcatggatcattttcttccgtcgagaccagtggattgccaagcaagtataaagtgaagatcatctataaatccaacagtattcagttgaaagttgagcaaaaggggagaagctga

SEQ ID NO: 1992 - DNA, 378 bp, Bacillus licheniformis
atggaggaatgctccaatgacaaatacaaaacgtttcgattccgcagattttgataaagaatggatgaaacagtttgttgacgacccttttctcctctatgatgaaactttaccgattgacctttatgaaacgagcactgaatatataattgaagcagatttaagccacttgaatgtccggcatcttgacttgacgttttcaggctacgatttcaagcttgcagttaaaaccgatgagcagctttacgagaaatcgctgatgcttcctttctttttgaatgacaaacagatcgaagcggaatgcgaaaacaacattcttgcagttaaaatcaataaagaatcaagcaaagatgacatttcgctttcaatcaatattcc

SEQ ID NO: 1993 - DNA, 414 bp, Bacillus licheniformis
attaccaaaagaattacgaaaagaacaaattaaaataaagaaagaacccaagattcatcgtccgtctccgtatcattgcaagcctttttccgttatataaaaaagcgagagttaaaatttaaacaaaaccgaaaatcgcgcttgtttatcaatatagacaaatgcttcaattgcatcatgtgcagcttgtgtttcaagacgaagcgctcacagtaatcgctaaaaaagcaattgaacgtaaaacaggagcacgcggacttcgttccattatcgaaggaatcatgctcgacgtgatgtttgatctgccgtctcgcgaggatattgaaaaatgcgtgatcacaggcaaaaccgtcactgacggcgaaccgccgcgtctcattatgaaagacggcacggtcgtcaataaagacaaaa

SEQ ID NO: 1994 - DNA, 228 bp, Bacillus licheniformis
aaactgctagcggaatcgtacttcctgactccgcaaaagaaaaaccacaagagggtaaagtggttgcagccggttcaggccgtgtgttagagagcggagagcgcgttgcattagaagttaaaacaggcgaccgcatcatcttctcaaaatatgcaggtaccgaagtgaaatatgaaggtactgactacttaatcttgcgtgaaagcgacattttagctgttatcggct

SEQ ID NO: 1995 - DNA, 606 bp, Bacillus licheniformis
atttaatgaaaatacgaatccatcgttttttgccgcttactgaagcagaaggacccggtaaacgggcgtgtttatgggtgcagggatgttcggtacgctgcgaaggctgcggagtaccgtggacatggtctgacaagggtggaaaagacatcagtgtagacgacctctttaaaaagattgttgattcaaaaaaagaaaacaatattgaaggtgtaacatttcttggtggtgagccaatggatcaagcggaagcccttgcagaacttgcggataaaataaaaattgctggactttctattttgacctttagcggcagatacttggaagatataaagtcgaatccacgaaagggccagctagagttacttgaattgactgatttgttcattgatggtcctttcgaaaaagaaaatatagatttaagccggccatggacaggttcctctaatcaacgatatcattttttgactgagagatatcgttatcttgaaggtcagcttcaatcaatttcaaataaaatagaagttcggttagaacccgatggcacagtttcaatcaacggaatgattcgtcaagaacaattgcaaagtttatacgaagaattat

SEQ ID NO: 1996 - DNA, 280 bp, Bacillus licheniformis
  misc_feature (1)...(280): n = A,T,C or G
atgcggaaatggatcgcgggagcctttctcctgtatgtgctgtacggcctttttttctattggtatctctttatggccggtgaaccctccgttcccgaggcgctgaaagggacaagcgcagacccggcgacatttatgaacgaaagggaactcatgctgacggaagagtactcgaaaataaaggactttctgttttttatccggattccgtttgagtggttcttatttttaatattgttgattgccggtttatcgaagaaaatgaagaattgngcggagc

SEQ ID NO: 1997 - DNA, 352 bp, Bacillus licheniformis
  misc_feature (1)...(352): n = A,T,C or G
atgactgttgaaattggacaaaaggtgcctgatattgaactgctgggcgatcacggagaaaaagtaaagctgtcggattttgaaggaaagtatgtcgtgctctatttttacccgaaagatatgacgccgggatgcacaacggaagcgtgcgatttcagagaccgtcatgaaagctttgcggaacttgatgccgtcattatcggagtcagccccgacgatcaggcacggcatgaaaaattcaagcaaaaacacgatctgccgtttctgctgctcgtcgatgatgaaacacagctcgctgaaagctttgacgtatggaaagctgagaagactttcggcanggaatacatgggtg

SEQ ID NO: 1998 - DNA, 294 bp, Bacillus licheniformis
  misc_feature (1)...(294): n = A,T,C or G
gcttccgatcaagctcattgtaaaagagttgagaaaaaacggaatacggccntccgtctccaattcagcgggaactttcgtatgcaaccatctcttttaccagttaatgcaccgtatagaccgcacctcggcaaacatccgcggagggttcatccacattccgtttctccccgaacaaacaatcgataaacccgagccgagtctcagccttgaaacgatcgtcgaaggacttagaatagctgcggtcatctccgccctgcacgaaaaagatattcgcgaaacgggcggatcgat

SEQ ID NO: 1999 - DNA, 199 bp, Bacillus licheniformis
atgagcaaagtaatcggaatcgacttgggaacaacgaactcatgcgttgcagtgcttgaaggcggagagccgaaagtcatcccaaatccagaaggagcccgcacgactccttcagttgtcgcatttaaaaacggagaacgccaggtgggtgaagtggtgttacgccagtgcctcaacgaacgcttaaatgctattgtcg

SEQ ID NO: 2000 - DNA, 201 bp, Bacillus licheniformis
gggtgcggtcaaaacggatcacgttctgttcattgctgcaggtgcattccacatggggaagccttcagatgtaattcctgagctgcaggggcgctttccaatacgcgttgagcttcaaaagctgagcatcgatgactttgtgaaaattttaactgagcctgacaacgctcttcttaagcagtataaggctttattgaagac

SEQ ID NO: 2001 - DNA, 498 bp, Bacillus licheniformis
atgaaaaaaagaggaactgatatgtcatcagttcctccgctatcggattattttgcctttttgacttttattttgctcactttgctcgtattgccggctttatcttttgcagtgaccgctaaaacggtgtttgccttttgtttttttattttgacaaaaaacgcgccttttttatcggccttgccggttccgatcgttttctttcctgatttgacgatgatggcggcgttcgcttctgctttccccttaacggccgtgctcttgtttgtcaccggattcaccttcggcgcagacggcggggttttgtcaagcacagtgacggctgtcgctttgctgacatttccggctttatcctttgctgttacaccgatgacggttccggctttttgcctgctgattttcagcttgtattcaccttttccgttcgctttgccggaagcgatcgtctttcctttagcttttgcgctgacttgcgcgtttgcttctgtttttccctga

SEQ ID NO: 2002 - DNA, 420 bp, Bacillus licheniformis
  misc_feature (1)...(420): n = A,T,C or G
atggattttaaggaaaacgacaatcactcgctcagcaaaaaggacgaaattcaagaagctgttgaacagttgttttacaactcgcctttccacgatattttaaattcattccaaaaactcatatcagaccagcttcagaattccacgatttccatgaatatcagagaggatgatggggcgctttacgtcgatatcgccgttcctgaatcgtttcanaatggagatattatgattgaagcgaaatcacggtatcttcatatcgcctttgaggagaaaacagaaagcggcnggttcttcatcatttacaggcctgtccagaaccgttctngctccataccctggtccgtgagtaacaatgaagacgtttgtggacccgaattgtccttaccgtctcatttttcgagcaaaaaacctgaatga

SEQ ID NO: 2003 - DNA, 464 bp, Bacillus licheniformis
atgccaaagggagaagggaaggttgtttcccaaaataaaaaagcaaatcacgattatttcatagaagaaacatacgaaacaggcatcgtgcttcaaggaacggaaatcaagtccattcgcgccggtcgggtgaatttaaaggacgcgtttgccaaaattgaacgcggagaagtgttcctccacaatatgcacatcagccgtatgagcaggggaaccgctacaaccatgatccgttgcgaacgagaaagcttttgatgcaccgcaagcagatcaacaaattgatcggtttgacgaaagaacaggatattcgctcgtaccgctcaagatttatttgaagaaccgcttcgcaaaagtgctgctcggtctcggaaaaggggaaaaaaaattcgacaaacgcgaagacttgaaacgcatagacgccaaacgcgaaatcgaaatagcgttccgcgacaaggcaaaaaggc

SEQ ID NO: 2004 - DNA, 147 bp, Bacillus licheniformis
ttgggaaaacgaatataccgggcatctatagtgcaggcgatgcagctacgaaattgcatcaagccgttgtcgccgcctcgatgggtgctatggccgccgcggccataaacaatgaactgaatttggaggcttgggagcaaaacggat

SEQ ID NO: 2005 - DNA, 195 bp, Bacillus licheniformis
gatctccgaatatcgatgccgatttaacggccctcggcacgtttatcggcacgcttgcgaacgttcagaaggtggaggttcttccttatcacaagctcggcgtctacaaatgggaagcgcttggcctggattatccgttaaaaggggttgaaccgccaagtgccgacagggccgaaaatgcgtacagactgctca

SEQ ID NO: 2006 - DNA, 276 bp, Bacillus licheniformis
atgaaggtcaagccttcccgcacgctgtttggaatgtcctcaatgtctttttcattatctttcggcataatgacagtctttaagccggcacggtgtgcgccgagcgccttttccttcaagccgccgatcggaagaacgcggcctcttaacgtgatttcgccggtcatgccgacatttcgcgaaacaggtcggcccgtcagcgccgagacaagagccgtcgccattgtgatccccgcggatgggccgtccttcggaacggctccttccggcacgtga

SEQ ID NO: 2007 - DNA, 1369 bp, Bacillus licheniformis; identical to SEQ ID NO: 1932

SEQ ID NO: 2008 - DNA, 468 bp, Bacillus licheniformis
ctacacgctgtacagcgccgtgtttcaaaacacggagagtgtggcggtgggggaaaaagctcccattttttcgctggaggatgttgacggcaaccgtctcaaactggacgaactaaaaggcaaaggggtatttttaaacttttggggaacatggtgcgaaccatgcaaaagagaatttccttatatggcgaatcaatacaaggtgtttaaggataaaggggtggaaatcgtcgccgtcaatgtcggcgaatcgaacctcgccgtcagaaactttatgaaagaccacggcgtcaattttccggttgtgcttgataaagacaggcaggtccttaacgcatatgatgtcacaccgctgccgaccacgtttttgatcaaccctgacggagagattgtcaaggtcgtgacgggcaagatgacagaacggatgatccacgattatatgaatatgatcaaaccagagggatcgtc

SEQ ID NO: 2009 - DNA, 474 bp, Bacillus licheniformis
gaagaatcagtctcatttacccgctcatcctgctgttttttaccgggttattcgtatttcagccgcaggcatctgcaaaacaagcttcgccggcagtcatgcagatgaacacggtcgaaggtcagcgcgtcgtcattcccgccgaaggccagaagacgatcgttcatttttggacgacctggtgcccgccatgccgtgaagagcttccgcgattccaatcctactatgaaagcaagcaatccggcgtcaagctcgtgaccgttaatttactgaatgccgaaaagaacgaacagaaggtaaaacagtttattaaagcaaacaagctgacatttccgatcgtttttgacaaaaagggtgagatgatgaaagcatataaagtcatgacaattcctacgacttttttctttaatgaaaaaggagagctggagaaaacgtttgtcggccccattactgtagaacagatgaaggaatggg

SEQ ID NO: 2010 - DNA, 321 bp, Bacillus licheniformis
atgaaaacgatcgagacgaatgaagaattgcaaaaagttgtgaaagacgatttatccttgttgatgttttcggctgactggtgtccggactgccgttttgtagaaccttttttgcccgagcttgaagcgaactatccggaatttacattctattatgttgaccgcgacaaatttatagacacgtgcgcggagtgggatattttcggaatcccaagcttcctcgtatttaaagaaggaaacgaaatcagccgctttgtcagcaaagaccggaaaacgaaagaggaaatcgagcaatttttgaccgattcactgaataagtag

SEQ ID NO: 2011 - DNA, 336 bp, Bacillus licheniformis
atgaaagaagctgcagaactaacttcaatggtgtcaattgagaaatttataactgatcatcaattaagttttatatatatatcaagacctcaatgcacagtctgtcacgctgttctgcctcagcttagagcactgttggcccgctttccaaagatcaaattaggacatataaatgctgacatagtggaagaggttgccggcaggttttcagtcttcacagttcctgtgcttcttttgtttattgagggaaccgaatgtctacgagaagcgcgttttattcattttgaacagcttgaacagaagttaaaaagagtctatcagttgtacgaggaatag

SEQ ID NO: 2012 - DNA, 503 bp, Bacillus licheniformis
atgatgaaaaaagtgctggctgccgcgtttcttttagtcttggccggtcttgcggtttggaattttacagggcaaaaggaagccgaaatcggcattgagaaaggagacaaggcgcctgattttacgctgccgtcattaaagaatggaaacgatgtatctttgtcagactttaaagggaaaaaagtgctgttaaattttgggccacctggtgtagaccgtgtgaaaccgaaaatgcctgcaatggaagagcttcaaaatgaaaatcaggacattgccgttttagccgtcaactttacatcttccgagaaaaacgaaaagacggtcaaagcgtttgccgaaaggcacggtttacatttccccatcgtcttagaccgaacgggcatcaatgcgaaatacgagattttttcatatccgacgacatttatcattgatgaaaacggaatcattaaagatatcgtgctggggacgatgtcgaaaaagaatatggaagaaaagctgggatt

SEQ ID NO: 2013 - DNA, 295 bp, Bacillus licheniformis
atgcaagaacttcaagaaaaagagctaaaacggctagagcatgaaacttgtcttctatatgtatacacgccgttctgcggaacgtgtcagctggccggaagaatgctggaggtcgttgatgaaatgatgaaggacattcctttttataaaaacaatctcaattactccccgtcatttgccaaacagaaggaaattgaaagcgtcccgtgttttatcctttacaaaaaagggcgagtcgtgaaaaaagaatacgcttttgactccgtgtgctacttatatgatacgattaaacaaa

SEQ ID NO: 2014 - DNA, 312 bp, Bacillus licheniformis
agctttgggctccttggtgcggaccttgtaaaatgatcgcgccggtacttgaagagcttgatcaagaaatgggagacaaactgaaaatcgtaaaaatcgatgttgacgaaaaccaagaaactgccggcaaatacggcgtgatgagcatcccgactctcctcgtactaaaagacggcgaagtggtcgaaacatctgtcggctttaaaccgaaagaagcgcttgaagaactggtcaacaaacatttgttaaaatagaaacctgtgaaaaaggcaatcccaaagggatcgctttttccttacaattcatctcctt

SEQ ID NO: 2015 - DNA, 219 bp, Bacillus licheniformis
atgcccgtcatgcaaaaagcttatgaccgttttaaaggagacggttttgaaatcatcgctgtcaatgtgcgtgaatcgaaaggtgcggtaaagagctttgtcgaccgccatggcttaacttttccggtcgctttggatcaatcggctgaagtttaccgttcttgggaaatgtattatttgcctgcaagtatattcattaatcgggaagggagagcgtag

SEQ ID NO: 2016 - DNA, 2488 bp, Bacillus licheniformis
atgaaatggcacgagatgggacaaaccgaattgttaaatataacaaaaacgtccatcgacaaaggtctaacagaaaaagaggccggaaagcggctggaaagacacggaacaaacgaacttcaggaaggggaaaaaacatcggcggtcgcattgtttttttctcaattcaaagatttcatggttcttgttttgcttgcggccacgttgatttcgggtttcctcggcgaatacattgacgccatcgcgatcatcgcgatcatctttgttaacggcattctcggattctttcaggagaggcgggcggaaaggtcgctcgaggctttgaaagaactgtcagctcctcaagtggctgtgctccgggaggggaattgggtgaaaattccttccaaagagcttgtcccgggagatgttgtccgttttgcaagcggagacagaatcggcgccgatctcagacttgtcgagacaaagagccttgaaatagaagaatcggcccttacaggtgaatcgctccccgtgtccaaacaggcagatgcttttcaggcgtcagatgtatcgctgggcgatctgaagaatatggctttcatgggaacgcttgtcacaagggggagcggaatcggcgtcgtcatcggtacgggtatgaactctgcgatggggaaaatcgccgatatgcttgaatctgccgggaatacggcgaccccgctgcaaagaaggcttgaagagctcggcaaaattttgattgtcgccgctttgttcctgacactgcttgtcgttgctgccggcgtcattcaggggcatgatttatacagcatgtttttagcgggagtttcccttgccgtcgctgccatacctgaagggctgcctgccattgtcacggtcgctctgtctctcggcgtgcagcggatgatcaggcaaaagtcgatcgtcaggaagctgcccgcggttgagacgctcggctgcgcgtccattatttgctccgataaaaccgggacgatgacgcagaacaaaatgacggtcacccatgtctggtcaggcgggaagatatggaacgtgtcagggatcggctatgagcctgaaggctctttcagcatgaacgggcgcgatgtgcaagcaaagcatcataaaccgctccagcaggtactattgttcggcgcattatgcaattcatcttcgattatcgaaaaagacggggagtttcgtcttgatggcgatcccaccgaaggggctttgctgacggcggctcgaaaagcaggctttacggacaaatatgttgatgaacattttaaaatcatcgaggagtttccgtttgattcaacgcggaaaatgatgtctgtcattgtggaagacaagagcggcaagcgctttgtcattacaaagggcgcgccggatgtattgatgaagcgttcgtcgcatacgctgacagaagaaaagcgagaaatcttcacaaaggaaaggctcgctgaaacaagcgcggcgctggaaactcttgcgtcacaggcgctgagaacgattgccgtcgcgtataaaccgatcaaagatacagaaaatcccccgctcgaaaaagcggagtcaggcttaactttcatcgggctgttagggatgatcaatccgccgcaacccgatgtgaaaacagcgattaaagaatgccgggaagcggggatcaaaacggtcatgatcaccggggaccatgtgataacggcgacggcgattgcaaaagatctcggattgctgcctccgcgcggaaaggtcatggacggccagatgctgaacgaactctcgcaggaagaattggcggaaattgttgacgatgtttacgtatttgcaagggtgtcgcccgaacataagctgaagatcgtgaccgcctaccaggaaaacggccacatcgtcgccatgacgggagacggagtcaatgatgcccctgcgattaaacaggcggatatcggcatatcgatggggattacgggaacggatgtcgccaaggaggcgtcctcactcatccttgtcgatgataattttgcaacgattaaatcggccatcaaggaaggacgcaatatctatgaaaatattagaaagttcatcagatacttgctcgcatccaatgtcggcgaaattttggtcatgctgtttgcaatgctgctcgctctgccgctgccgcttgtcccgatacagattctgtgggtcaaccttgtaacggacggcctgcctgccatggcgctcggcatggatcagcctgaggacgatgtgatgcagagaaagccgcggagtccgaaagaaggcgtgtttgcaagggggctcggctggaaggtcgtatcgcgcggattcttaatcggaatcgcgacactcggggcgtttatgttcatttataaccgcaatccagaagcgcttgagtatgcacagacggttgcatttgcaacgctcgtccttgcgcagctgatccacgtgttcgactgccgaagcgagcggtccatctttgaccgcaatccgtttgaaa

SEQ ID NO: 2017 - DNA, 2403 bp, Bacillus licheniformis
aaaaagaagccaccctccaaatctctggcatgacctgcgccgcctgtgcggcgcggatcgagaaagggttgaaaaggcttgacggcgttcaggactcaaatgtgaacttggcgctggaaaaatcaaaaatcgtttatgatccggggcaaatcgaagtcggacagctggctgagaaagtcgaatcgctcggctatcaagttcctgcggaaaaagccgaatttgcggtttccggcatgacgtgtgcggcttgcgccaaccgggttgaaaagcgcctcaacaagctgtctggcgtcaaaagcgccgccgtcaactttgccattgagactgcgacagtcgactatcatgctggcgcggtttcgccggaggagatgatcgaagccgttgaaaagctcggctacaagctcgagctgaaaaaagaccgaactgcggacggtcgggcggaacaaagagaaaaagatattcagcgtcaaaccggcaaatttattttttcagccattttgtcttttccgctgctctgggcaatggtcagccatttcaaattcacgtcatttatatggctgccggggatgttcatggatccctgggttcagttcgcgttggccacaccggttcagtttatcgtcgggaagcagttttacactggggcttataaagcgctgcggaacaaaagtgccaacatggatgtgctggtcgctctcggcacgtctgccgcctatttctacagcttgtatttaagcattgaaagcctcggtacaaaccggcatccggacggcctttactatgaaacaagcgccatcctcttaactttgatcattttaggaaagctgtttgaagcgaaagcgaaagggcgttcatccgaagcgatcaaaaagctgatggggctgcaggcaaagacagcgaccgtcgtcaggaacggcgaagagatgaccgtgccgattgaaaacgttttggcaggcgacatcatgtatgtgaagcccggtgaaaaagtaccggcagacggggagattgtcgaaggtcgttcagcgctggatgaatcgatgatcaccggtgaaagcatccctgttgacaaaacggttggagatccggttatcggcgctacaatcaataaaaatggatttttaaaagtcagagcagaaaaagtaggcaaagatactgcgctggcgcagattataaaagttgtggaagaggcgcaaggttcaaaggcgccgattcaacggctcgcagaccggatttccggggtttttgtgccgattgtcgtggcgatcgcggccatcacatttttcatctggtatttggcggtcagccccggcgaattcggcacggcgctggagaagctgattgcggtgcttgtgatcgcatgtccgtgtgcgctcggcttggcaacgccgacatcgatcatggccggatctggccgcgcggctgaattcggaatcttattcaaaggcggcgaacatttggagacggctcaccgcttggagacgatcgtgcttgacaagacggggacggtcacaaatgggaagcctcagctgacagatgtgcgccctgaaccatggatcgatgaaacatcgtttctcaagcttatcggtgctgcagaaaaaagctctgaacacccgcttgctgaagccattgtcgaaggcatcaaagagaaagggatagaacccgcctcagcagacagctttgaagcgatacccggctatggtatcgaagccgcagtcaatgaaaagcggattttgatcggtacaagacgtctgatggaaaaccgtgatattgacattcaagatgcgaacggcgaaatggaagagctcgaaacacaaggaaagacggcgatgcttgccgccgtcgacggtcggtttgccgggctgatcgccgtcgccgatacgattaaagacacgtcgaaggcagcggtgaaaaggctgcatgatatggggctggaagtcgtcatgatcaccggggacaatcggcggacggcagaagcgattgctgctgaagccggcattcaccacgtcatcgccgaagttctgccggaaggaaaagcggatgaggtgaagaaaatccaggcaaaaggcaaaaaagtcgcgatggtcggcgacggcatcaacgatgcgccggcattggcggcggccgatacaggtatggcgatcggaacagggactgacgtcgccatggaagccgccgacgtcaccttgatccgcggcgatttaaacagcatcgccgatgcgatcctcatgagcagattgaccatcaaaaacattaaacaaaatcttttctgggcgtttgcctacaacagcatcggcattccgttcgcggctgtcgggcttttggctccgtggatcgcaggtgccgcgatggcgttcagttcggtctcagtcgttctgaatgcactcaggctgcaaaaggtgaagc

SEQ ID NO: 2018 - DNA, 1196 bp, Bacillus licheniformis
atggggaacgaaatattaaaagcgcctgaaggcccgccgagcgatgtagaacgtattaagaaagaaagcgattatttgcgcggcaccctgaaggaatcgatgctcgagccgctttcagccgggatttcagatgacgacaaccgtctgatgaagcaccacggcagctatttgcaggatgaccgcgatctccgcaatgagcggcaaaagcagaagcttgagcctgcgtatcagttcatgctgcgcgtccggatgccgggcggtgtggcgacgcctgagcagtggcttgtcatggatgagcttgcccggaaatacggaaacggaacattgaagctgacaactcgggaaacattccaaatgcacggcattttaaaatggaacatgaaaaaaacgattcagtcgatccattcagccatgctagataccattgcagcatgcggcgatgttaaccggaacgtcatgtgcacttccaatccgtatcagtcagaaatccatcgagaagtgtatgaatggtcgaaaaaactgagtgatgacctgctgccgcgcacacgtgcgtatcatgaaatctggcttgatgaggaaaaagtggccggcacgcctgatgcggatgaagtcgaaccgatgtacggaccgctgtatctgccgcggaaattcaaaatcggcatcgccgttccgccgtcaaatgatatcgatgtattttctcaggatcttggttttatcgcgattgtggaggatgacaagctcatcggcttcaacgtcgcgatcggcggcggcatgggcatgacccacggggacaaagcaacgtatccgcagcttgccaaagttattggcttctgcaagcctgaacagctatacgatgtcgctgaaaaaacgattacgatccagcgggactacggaaaccgttcggtccgcaaaaatgcccgcttcaagtatacggttgaccgcctcggcttggaaacggtcaaaaacgagctggaaaaccgtctcggctggagcctcgctgaagcaaagccttatcatttcgagcataacggcgaccgctacggctgggtaaagggcgtaaaaggaagatggcactttacaatgtttgttgagggcggccgtgtcactgattatgatgattacaagctgatgaccggcttaagggaaatcgccaaagttcataccggcgatatccgcctcacagccaaccaaaactt

SEQ ID NO: 2019 - DNA, 1453 bp, Bacillus licheniformis
atgacacatgaaggaccgctggaggaatggatgaaaaaactgagcgaggaaagcctcaaggacaatacgtttgaccgccgccgctttattcaaggggccggcaaaatagccgggctttcgctcggacttgcgatcgcgcaatcgatgggggcaatggaagtcaatgcagcaccgaggttctccgaatatccgtttacacttggcgttgcatcgggagatccgctttctgacagcgtcgtattgtggacaaggctggcgcccgatccgctaaacgggggcgggatgccaaatgaagctgtatccgtgaaatgggagctcgcagaagacgaacgcttccgccgtgtcgtcaaacggggaaccgaaaaagcaacacctcaccttgcacattcggtacatgccgaggtatccgggctgaaaccgaatcatgtatactattaccgctttaaatgcggcaaccagctgagtcctgtcggcaagacaaagacgcttccggcgcccggggcagatgttgctaaattcacattcgcttttgcttcatgccagcagtacgaacacggctattataccgcctatcagcatatggcaaaggaaaagctcgatcttgtttttcatctcggcgactatatttatgagtacggtccgaatgaatatgtttcgaaaacaggaaatgtcagaacacacagcggtcctgaaatcatgtcactgctcgattaccgaaaccgtcatgcccaataccgttcagatgcaaacctgaaagctgcgcatgccgccttcccgtgggttgtcacatgggacgaccatgaagtggagaacaactatgcgaatgtcatcccggaaaaaggccagtcagttgaagcgtttattaaacggcgcgccgccgcataccaagcttattacgagcatatgccgctccgccgccaatccttgccgaacggtcctgatatgcaattgtaccggaatttttcctacggcaatttagctgacattagcgtgctggatacccgtcagtatcgcgatgaccaggctaacggcgatggcaataagccgccttctgatgaatcgaatgatccgaagcggacgctgcttggagcggagcaggaggcttggctgtttgacaatttgagtcgctccgaggcgcactggaacattatcgcacagcagattttctttgcgcagtggaactttgggacaagcgcggcgctgatttacagcatggattcgtagggcggatatcccgctcaacgcaagcgagtgatcgggttcatcaaatctcaaaaactggacaacatcgtcgtccttaccggtgatgtgcatgccagctgggcaaataatctgggcgttgattttgacaatcccgaaatcgggacatctttggcgtggagttcgtcgggacgtcgattacatcgggaggaaacggcgctgataaaagagcggatacggataagattttatc

SEQ ID NO: 2020 - DNA, 1851 bp, Bacillus licheniformis
tgaaaattggaggcagcacggggaattgatagctgcgcttttgtcgggtttgttgattcttgcaggctggctgttgtccggcaatgaaacattgtccgttgttctgtttattttagctttttgtatcggcggctttgctaaagcgaaagaaggtatacaagaaacgctgtcggaaaaaacgctgaatgttgaactcttgatgatttttgcggcggtcgggtctgcgctgatcggctactgggctgaaggggccgtgttaatttttatcttttctctcagcggagcgcttgaaacgtatacattaaataaaagcaaacgcgatttgacttcactgatgaaattggagccggaggaagccgttttgcttgaaaaagaaggaacaagaaccgtggcggcagccgatcttcaggcgggcgacctcattcttgtgaagcctggagaacgcattgcggcagacggagaaatcgaaaccggaaaaacgagtatcgacgaatcggctctaacgggcgaatccatcccagccgaaaaaacactcggagacgcggtttttgcgggtacggtcaatttgagcggatcgctcacggtccgtgtcacaaaggcaaatgaagattcgttgttcaaaaagatcattcggctcgttgagtctgcgcaaaacagcgtttcaccgtcgcaggcgttcattgagcgatttgaaaatatttacgttaaaggggttttgcttgctgtcggactgctgctctttctgccgcattttttgcttggctggagctggagcgagacattttacagagcgatggtgttcatggtcgtcgcttcgccgtgcgcccttgtcgcttcaatcatgcctgccgcgctgtcgctgatatcaaatggcgcaagaaacggcctgcttgtcaaaggcagcgtctttcttgaaaagcttggcaacagcaaaatcgttgcattggataaaacgggaacgattacgaacggaaagcccggcgtggaggatatgcttttagctgcagatatcgaggagcgcgaatgcttggaggctgctgctgcgattgagaagcagtcaggccatccgcttgccaaagcgattgtcgagtatgcagaagcaaaaggcatcaagccggccgcgaatgtgtcgattgaggagacgtcagggtttggcgttcaggctcgatacaatggagagacatggctgatcggcaaagccggatttgtcggggaagaggcagccgggcaatttctcacggcggctgttcaggagcttgccaagcatgggaaaaacaattgtgttcatgaaaaaaggcgaagaaatcgcggggtgttttgcattaaaagaccaaatcagaccggaagcaaaagcggtggtcgaagagctgaacgcgctttgcgttcagacggcgatgctgacaggggaccagcctgaaaccgcagtgggcatctctctttgaagctgggcttgaaaatcgtacattcagaatgccttcctgacagaaaagtagaggaagcgaaaaagctgcacaaaacatacagaacactcgttatggcgggagacagaatcaatgatgcaccggtcctagccgccgttgatgtggggcatccagtgcggggaggaacagatgtcgcactgtaaacagctgacgtctctgtactgaaacacgaattgactggactgaccaaaatgattcgggtctcccggagatggatacgatcattaaacaaaacgtcattttctcgcttgctgtgactctgtcttttaatctgcagcaactttcttcaaattcttgatctgccgctcggtgtcatcgggcatgaaggcagcacgctgcttgtgattttaaacggtctcagactgctgaa

SEQ ID NO: 2021 - DNA, 1604 bp, Bacillus licheniformis
atgttacgattttcaggcagatttgaaggatacagccttaagcggtttcaaaaagatattgtagcaggaatggtcgttggagtcgtcgcgattccgcttggcatggcttttgctatagcctcgggggtgaaaccggaacacggtctttacacagtgattgtcgccggtattttgatttcgcttctcggcgggtcgaaataccagattggcggaccgacaggggcctttgtcccgatcctgttcgctattgtgctccaatacggatttgagaatctgctgattgccggttttatggccggagtgattctggtcatattagggctgctaaaactcggcaagatcatcaaatttattccgcggccggtgatcatcggatttacggccggaatcgcggtgattattttcaccggagaaatcgccaagtttttaggcttgagaaatgtcgagaagcatgagagtttttatatgaatatgagagaggttgtcatcaacctgaatacgctcagcttttacagcattttgacggctgtcgtatcgctcttctttgtgctgtttacgccaaaggttctgccgaaagtgccgggagcgctcgcaggcttgcttgtatcaacggtcatggccacgatgctgtttcccgaacaggtggtgacgatcggatcagcttacggcgaaattccgcgcagcttgccgagctttcaatttcctgagttgtcattggaaaaaatcatttacctgatgcctcccgctcttgcgattgcaatgctcggaggaatcgaatcgctgctttccgcgatggtggcagacaatatgaaggggacaaggcatgacagcaataaagaacttgtcggccaaggaattgcgaacatcgccgcaccgctgttcggcggtattccggcgacaggtgcgattgcccgtacggcgaccaatattaaaacgggcgctgcttctccgatttcaggtatcgtacacggtgtgttcgttttattggttctgcttttgtttgcgccatacgcttcccttatcccgcttgcaagcatgtcgccgattttgatggtggttgcttggaatatgagtgagcggaaagagtttataaatattttgaaaattagaaattcagactctgccgtgcttgtcgtcacatttcttttaaccgtttggcaggatcttgtgtttggggtggcggccgggatcctgctggcgatcatcacctttatcgccagaatgagcaagtcgttccgcattaaaaaagatgtgtctgaatcgatcgtccagtcggcagctgcagcggaagaaaagcattttcaacgctctgtcagcatctattcggttgaaggcccgctgtttttcggctcatcgaattcattggaggattcaattttggacaaaggccacccgccaaaactcctcatcctgctgatgaataaagtagactacatggactcttccgcagaaggcagcctgatgacgatcgtcaaccgtgtccaccagcaaaacgggaaagtgatgatcgtgggtcttcagcagcagccgcgtgagcttcttcataaaacagggctgtttcataagatcggcaaaaagcattttgtcgacaggcctgaacaaat

SEQ ID NO: 2022 - DNA, 2037 bp, Bacillus licheniformis
acagcaaggatcaacaactcgaacagtaccggtctgacaacaggggcaaaaaaatgacgacgaaccaaggtttgcgcgtatctgaagacgagcactccttaaaagcaggcgtgcgcggtccgacgctgatggaggactttcatttccgtgaaaaaatgacccattttgaccatgaacggattccggagcgagtcgttcatgcgagggggtttggcgcgcatggctattttcaggtttacgagccgatgacggagtatacgaaagcaaagtttcttcaagatccgtcagtgaaaacaccggtgtttgtcaggttctcgactgtcgccggttccaggggctcgggtgacactgtacgcgatgtcagaggatttgcgacaaagttttatacagaagaagggaactatgatcttgtcggcaacaacatccccgttttcttcattcaggatgccatcaagttccctgacctggtgcacgcctttaaaccggaaccgaacaacgaaatgccgcaggcttctacggcgcacgatacgttttgggactttgtcgccaacaatgaagaaacggcccacatgatcatgtgagcaatgtctgacagggcgattccgcgaagctacaggatgatggaaggcttcggcgttcatacgttcaggtttgtaaacgaagaaggcaaggcgcactttgttaaatttcactggaagcccgtcctcggcgtccattcgctcgtctgggacgaagcgcagacaatcgccggaaaagatcccgactatcaccgccgcgatctgtgggaagcgatcgaaagaggcgatgaagtggagtatgagctcggcgtgcaaatgattgacgaagaagacgagttcaagtttgacttcgatatccttgacccgacaaagctttggccggaagaaatcgtccctgtcaaaatcatcggcaaaatgacgctgaatcgaaaccaggataacgtttttgcggaaaccgaacaggccgctttccatccgggccatgttgtgccggggatcgatttcacaaacgatccgctattgcaaggccggctcttttcttatacggacacacagctgatccgattgggaggtccgaactttcacgaaattccaatcaaccgcccggtctgtccgttccataacaaccagtatgacggctatcacaggatgacgattaacaaagggcctgtcgcttatcataaaaattcgcttcaaaacaacgatccggcgcctgcttcagaagaagaaggcggatatgtgcactacgaggaaaaagtcgagggcaaaaaaatccgccagcgcagcgaaagctttaacgaccactattcgcaagcgaagctgttttggaacagcatgtcccccgttgaaaaagaacatatcatttcggcgttccgctttgaagtcggaaaggtcaaaagcaaggacgtccgccgccaagtcgttcatatgtttaaccgggttgacggggagcttgccaagcaaatcgctgcgggtgtaggcgtagagccccctgaaaaagacgaaggctccaacgtgacgttcaaatcccctgcgctcagccaggagaatacggtgaaactgccgcagacaaggacagtcgccattttagcagaacaaggttttgatgatgaagacttgagccgtgtgttgaaagaattcaaaaaagccggcatcattccggacatcgtcagctcggcactcggagtaatcgaaggggccggcggcacagaaattgaagtcggaaacactttgcagacggtcgattctgtgctgtacgatgccgtttatattccgggcggccaagaaagcatagaacgcctgaaattgcataaagccgcatcggattttgtcaatgaagcattcggacattataaagcggtcggagccgcaggcgaaggggtcgatctcctgctgtccgccgccggggcccacgcggcttcacagccgggcattatcacctctcgtggtgataagaacaaagacgacttcggcaaaaagctggtcgaagcgatcagcgggcaccgccattgggataggc

SEQ ID NO: 2023 - DNA, 1989 bp, Bacillus licheniformis
ttggcaacggccaaagggcatgcatcggcatgcagttcgcccttcatgaagcgacgcttgtgctcggcatgattcttcagtactttgatcttgaagatcatgcaaactaccaattgaagatcaaagaatcgctgacattaaaaccggatggtttcacaatccgggtgaggccgaggaaaaaagaagcatgacggcgatgccgggcgctcagcctgaagagaacggacggcatgaacaacggccttccgcaccggcagcggaaaatacgcacggaacccctcttcttgtgctctacggttcaaatctcggcacagccgaagagattgcgaaggagcttgctgaagaagcgcgtgagcaagggtttcacagccggacggcggagcttgatcaatacgcaggcgccatcccggcagaaggggctgttatcattgtgacggcttcctataacggaaacccgcccgattgcgcaaaggaatttgtcaattggcttgagcatgatcagacagacgatttgcgtggtgtcaaatatgcggtattcggctgcggtaaccgcagctgggccagcacctaccagcggattccgcgcctgattgacagcgtattggaaaaaaaaggcgcccaaaggctgcacaagcttggagaaggggatgcaggcgatgattttgaaggacagtttgagtcatggaaatatgatctgtggccgcttttaagaaccgaattttcattggccgaacccgagccgaatcaaacagaaacagacaggcaagccttatctgtcgagttcgtaaacgcacctgcggcttcgccgctggctaaagcttatcaggtgttcacagcgaagatatcggcaaaccgagaactgcagtgtgaaaagagcgggagaagcacaaggcatattgaaatatcgcttcctgaaggcgccgcatatcaggagggagaccatctcggtgtgctaccgcaaaacagcgaagtgctgattggccgcgtttttcagcggtttgggctgaacggaaatgaacaaattctgattagcggccggaatcaagcatcacatttgcctttggagaggcccgttcatgtcaaagacctttttcaacattgcgtcgagctccaggaaccggccacaagggcccagatacgcgagctggcggctcatactgtttgtccgcctcatcagcgcgagcttgaagacctgctgaaagatgacgtctataaggatcaagtgttgaataagcggctgacaatgcttgacctgcttgagcaatacccggcctgtgaactgccgttcgcccgttttctggcgcttcttcctccgctaaaaccgaggtactattcgatttccagttcgccgcagcttaacccgcggcaaacaagcatcaccgtctctgtcgtaagtggcccggcgttgagcggccgcgggcattataagggagttgcatcgaactatctcgccggccttgagccgggagacgcgatttcgtgtttcatcagagagcctcagtcaggcttccggcttcccgaagatcctgaaacaccggtgatcatggtcgggccgggcaccggaatcgccccttaccgcggatttcttcaggcgcgccgcatccagcgcgatgccggtgtgaagctcggtgaagcgcatttgtacttcggctgccgccgtccgaacgaagattttctgtatcgagacgagttggagcaagcggaaaaggacggaatcgtccatctgcatacagcgttttcccggcttgagggccggccgaaaacatatgtgcaagatttgctcagagaggatgcagccttgctgattcacttgttgaacgaaggcggccgcctgtatgtgtgcggagacggaagccgcatggctccagctgttgaacaagctttgtgcgaggcgtatcgcatagtacagggtgcgagtcgggaagagtcgcaaagctggctgtccgcacttttagaagaagggcgctatgcaaaggatgtatgggacgg

SEQ ID NO: 2024 - DNA, 1422 bp, Bacillus licheniformis
ttgttaaacatttaaatagcgaatggttttctaatgtacggggggatatcctttcgggtatcgtcgtagcgcttgctctcattcctgaagccatagcgttctccatcattgcgggtgtagacccgatggtaggtttgtacgcatctttttgtatcgccgttgtcatttcctttacgggcggccgtccggcgatgatatcagccgcgaccggggcgatggctcttttgatgggaactttggtcagagatcacgggcttgattatttatttgctgctacgattttaacgggaatcatccaattaatatttggggtgctgaagattgcgcgctttatgaaatttattccgcggtcggttatggtaggtttcgtaaatgcgctggccattttaatctttatggcgcaggttcctcattttgttggagtttcgaatatgacgtatgttgtggccggtattacgttgttgattatctatgttcttccccgctttacaaaagccgttccatctgcacttgttgccattattgcgatgactgtatttgccattttcggtcattttgatctgcgcactgtcggtgatttgggagaaatgaagcaatcattgcctgcctttatgattcccaatattcctttcaattttgagacattggccattattttgccaacagcctttgcgctttccatcgttggcttgcttgagtcattattaacctcttctattgttgatgatatgacggatacggaaagcgacaaaaacagggaaagccgctgtcagggcatcgccaacattgtcgccggttttttcggaggcatggcgggatgcgcgatgatcggccagtctgtgatcaatgtaaaatcaggaggaagaggccgcttgtccacctttgttgccggtgtcttcttaatgtttttaatcatggtgctgggcgactgggtcgtacaaattccgatggcagctttggctggcgtgatgattatggtatcgatcgggacgtttgactggtcttcgtttagcatgttaagaaaggtgccgctgacggattccattgtcatgattgtaaccgtcgttaccgttgtggccacccacgatttatcaaaaggggttttcgccggcgtgattttaagcgcaatcttcttcgtagcgaaaatctccaaactaaaaattgaagaaaagtcagaagaaaacgcggtcaagtacatcatcaaaggacaagttttctttgcatcggttcaagatttcgtaaactcctttaaaacgggagagcaaacgaaaaaggtcattcttgatttttctgaggcccatatatgggatgattccgctgtggcggctatcgataaagtcgttttgaaaatgaaagagcaaggaatagatgttgacttgattggattaaatgaatccagctggaagctggtcgaaaaattag

SEQ ID NO: 2025 - DNA, 1542 bp, Bacillus licheniformis
aagagccgaaggtcaaaaacgtgatcatgatggtcatggatgggacaagctcttctgcaacaactttggcacgctggtataaaggcgaaccgctcgcaatggaccagatcgtcagcggcggtgtccggacgtattcggcagaatcggcgatcactgattctgcacctgcagcaactgcgatggcaacgggacgaaaatcaaattcttcctatatcggtgtgctgccttcaaaagtgaatacaccaggagtcgagaaggtccgtgaaaaagatcattaccggcctgtagcaaacgtgctggaaggcgcaaaacagaaggggaaagcaaccggcatcattgcaacatctgaaattcagcatgccacgcctgccggctattccggccatcataaagaccgcaataattttgaagtgctcggtgaacagcaggtttatcaaaacatggatgttgtccttggcggaggaaaagaatcgcttcagccgggtacaaaggataaaagccgcaaagacggtgaagaccttgtaaaagtgctcaaagataaaaagtacgatttcgttgaaacgaaagatcaactcctcaagtcaaaatcgaaaaaaatctggggcgccttctcacagcgcgatctcgcgtatgacatggaccgccgcgcaacgcatccagagcagccgactattgcagagatgacgaaaaaatcgattcagacgctttctaaagacaaggacggtttctttttattcgtggaaggaagcaagcctgactgggcagcgcatcaaaacgatccgatcggcatgatcagcgatgtattggcgtttgataacgcggtgaaagaagcgcttgatttcgctaaaaaagataaacatacaatggttattgccgtctcagaccatggcaacagcggcatctccatcggcaacagcaacacgacgaaaggctatgacacaacaccggtatcagcctatgtcgatccgctgaaaaaagctaaaatgacggtggaaggcgcaactggcaaattaaaagacgacttatcgaatatcgaagaagcggcgaagctttacggacttgatgatttaacgccggcagagaaggaacagctgaaaagcgtgaaaaacaaaaaagaagcggcttcattatttaccaagctgctcagcaaccgggccaacatcggattcacaacaggcggtcatacgggtgaagacgtcttcctgtattcgtatggtccagaaaagccgcagggtctcgtcgaaaacaccgatatcgccaaaacgatggcaaaggcaatgggcttcaacttagacaaattaacaaacgaattatttatcgaagcaaaacaggcatttaaaaaagccggagccagcgtaacgatcgatcaaaaagatccggctaacccagttcttgtcgcagcgcgcaaaaaagcaaaagccgaaatgcctgtgaacaaaaacattatcagaatcaacgggaaggaatacgaactagacagcgtgattgttgaaagcaatggatccttctacgtgcctaaagaagcagttcagctattcaaaa

SEQ ID NO: 2026 - DNA, 1296 bp, Bacillus licheniformis
ttagtccgccgcaaacgctggctcttagtttcttgattatcattgcgatcggggcttgtttattgaagctgcctggcgcctccactacttatatctcatgggtggatgctttatttacggccacctcggcaactacggtaactggccttgttgttgtagatacaggggcagattttacagttttcggacaaaccgttattatgtgcctgattcaaatcggcgggctcggcttaatgacgtttgccgtcctcgtcgtcatgatgatcggcaaaaaaatcggcttgcagcagcggattcttgttcaagaagcatttaaccagacttctttaggcgggcttgtccgcttggtcaagcacctgtttattttcacgattgtcatagaatttgtggcgtttctgatcctttcgatcagatgggttcctgaatatggtttgcaaaaaggcttgtttcatagtttgtttaacacgatttcagcctttaacaatgcgggattttccctgtggcctgacaacttgtctcaatatgtcggcgatccgattgtcaaccttgtcatcacaggccttttcattacagggggaatcggctttaccgttctgctggatttatggacaaagcgaaacttccggaaattatcgctgcattccaagctcatgatcgttggaacattgatcatcaatacgacagccgcgttgctgattttcattttagaatactcgaatccgggtacgctcggcggactgcctttggccgacaaaatgtggggcgcttacttccaaggcgtgacaccgagaactgccggattcaatacgcttgatatcgcccagatgacaacgccgtccctcctgttaatcatcgttttgatgtttatcggagccggaagtgcgtcaacgggaagcggaattaaactgacaacgtatatcgtgatgatcttggcgacgatcacctttttaagggggaaaagcgagacggttgtgttcaaaagggcgattaagatgaaaaccattttaagagctttagccatcattgtgatcagttttttattcgtgcttttcgcattatttatattgacgatcacagagaatgccccatttttgaaaatcgtctttgaagtattttccgctttcggaacagtcggcctgtcgatgggactgacacctgatttaacggccgcaggcaaagcggttatcatgatgatgatgtttatcggccgcgtcgggcctctgactatggcgtttacgctggccaagccgaagaaggcgccgatccgccatcctgaagatgaagtgattacaggct

SEQ ID NO: 2027 - DNA, 1332 bp, Bacillus licheniformis
agcagtttattttattagcggccttattgctgattatcggtgtactgacaacgaaattttcgactaggctcggagtgcccgcccttgtattgttcttgattgtcgggatgatcatggggagcgatggtctcggaattatttattttaataatcccgagcttgcccagctgattggaattatcgcacttgtcgtcatcctttttgaaggcggtttgcaaacaaagtggtcttcggtcaaagcggtcgccgttccttcattgtcgctcgcgacgattggcgttttgctgaccacctgcgtggttgcggttgccgccaagctgatttttaatgtttcttggatggagggctttttattcggagcgattgtcggctctacagacgcagccgcgattttcgccgtattgaaaggccagaatattagagacagattgagctccactctagaagcagagtcgggtacaaatgatccgatggcgatgtttttgactttatcgctcatccagctgctgacggctgaccattcatcttatttcatgcttgttatttcatttttctggcagatgggaatgggacttttgctcggatatttactcgggcggttcgccagctttgccatcaataaaatcaacttggattcgagcggactttatccgatcttcgctcttgcttttgcgcttcttacctacagtcttacagatgtcatcggggcgagcggcttactggccgtctacattgccgcgcttgtcatcggaaatcaagatttgacttaccgacattccattttcaggtttaatgaaggctttgcctggatgatgcagattttgatgtttatcattctcggattattggtttttcctgcccaatttttatccttcgatattattttcaagggcttcttgctttccctgattttaatttttatcgcccggccggttgccgtttttctgtcgaccatcaaaatgggctttaattttaacgaaaaaatcttcttatcatgggccggattaaaaggggcagtcccgatcgttcttgcaacatttccgatgacgatggggcttgaaaacagccaattgatctttaatgtcgtattcttcgtcgttttaacatcggctttgatccaagggtcaaccatatcggtcttcgcagaaaaattgaaattgaacggaccgcagaaagtagaagcgccgcattcgctggagcttgtttccatcggcaaggcgaacgccgaaattatcgaatttgaagtcgatgaccaagcagccattaccaggcagatgctgaaagacatcagctttccaaaagatgccctgatcaatgcgatcatccgagaat

SEQ ID NO: 2028 - DNA, 1197 bp, Bacillus licheniformis
atgatgacaaagcataaagcggacagaagcttgaagtcgctgcttgaaattctattcgtttcaaccaggcttggattgacatcattcggaggtccgatcgcacatttaggatattttcatgccgaatatgtccgtaaaagaaaatggatggacgaaaaaaactatgccgatctggtcgctttatgccagtttctgcccggtcctgccagcagccaggtggggatcggaatcggcgtgatgagagccggcgtcctcggcggaatctcagcgttcatcgggtttactcttccatctgtcatagcgcttgtattatttgccatggttctgcaaggcttcgatattggaacagccggctggattcatggactgaaaatcgtcgccgtcgccgtagtcgcccatgccgttatggggatggcgcaaaagctgacacctgataaaaggcgcaaagcgattgcgctgtttgctctggtcgccactcttctctggcagacggcttttacacaggtcggagtcatcctgctcgccgctttcgccggatatcttatctataaagagcaagttgaaacggatgattccgtcatgcagtttcctgtgtcgcgccggtttgcagcggtctgtctcagcttgtttttcgggcttctcattttgctgccggtgctcagggaaatgacatcttccggctggattgccatgtttgacagcttttacaggtcgggttctttggtcttcggaggagggcatgttgtcctgccattattagaacgggaatttgtaccggcgggatggttaagtgaagaggcatttttggccggatatggagccgcacaagctgttccggggcctttgtttacattcgctgcatatcttggtgcggtgatcagcggctggcaaggcggattgctcgccacagcggcgatttttctgccggcgttcctgctgattctggggacgctgcccttctgggatacgctgcgccgcaatcctaaagtaaaaggcgctttaatgggagtgaatgcagctgttgtggggatattgatttccgcgttttatcacccgatctggaccagctccgtattggcgccgatcgattttgcattcgctgcggttttgttcagcctgcttgtctactggaagctctcgccgtggatcatcgttgcagccggtgctgtcggcggtgcgatgttgcagctgttgtaa

SEQ ID NO: 2029 - DNA, 1440 bp, Bacillus licheniformis
agcgcaaatcggaatggtaatgaaccttgacaaatgcatcggctgccatacatgcagcgtcacatgcaaaaacacttggacaaaccgttccggtgcagaatatatgtacttcaacaacgtcgaaacaaaaccgggcatcggctaccctaaacaatgggagaaccaggataaatacaaaggcggctgggagctgaaaaaaggcaagctccagcttaaatcaggcgccaaagcaacgcggctcatgaatttattctacaacccgtatcagccgacgatcgatgactactatgaaccttggaactatgattatgaaacgctgacaaacagtccggagaaaaaacatcagcctgttgcaaggccgaagtcttccattacgggagacttcatgaaccttgaatggggtccgaactgggaagacgatcttgccggcggccacattacaggcctccaagatccaaacgtcaaaaaaatggaagaatccatcaaaaccgaatttgaagacgtctttatgatgtatctgccaaggatatgcgaacactgcatcaatccttcctgcgtctcctcctgtccgtcgggagcgatgtacaaacgcgaggaagacggcatcgttctcgtcgatcaaaatgcgtgccgctcatggagacactgtgtatcatcatgtccttataaaaaagtgtatttcaactggcagactaacaaggcggaaaaatgcacattgtgcttccctcgtcttgaagcaggactgccgacaatctgctctgagacatgcgtcggcagaatccgctatctcggagtcatgctttatgacgcagaaaaagtcgaagaagcggcttcagccgaaaatgaaaaagatttgtatcactcacagctggagattttccttgacccgaatgatcccgctgttgcagaagaagcaaaagctcaaggcattccgctggagtggattgaagcagcgcaaaaatctccgatctacaaaatgatcatcgattggaaaatcgctctgccgctgcatcctgaataccggacattgccgatggtatggtatattcctccgctcagtccgattatgaatatgtttgaaggaaaaggaacagcccaatcagctgaagatatcttccctgctattgatgaaatgcggattccgatcgaatatttggccaatttgctgactgccggtgatacacaccatattagaacgacattaaagaaaatgtctgtgatgcgtatgcacatgcgggcgacccaaacgaacaaacagatcgattcatctctgattcaagataccggattgactgaagagcagattgaagacatgtaccgtctgcttgcaatcgccaaatacgatgaccggttcgtcattcctcaaacccatcgcgaagaagtcgcggatctatacatggaacaaggaagctgcggattatcgtttgccggaggacccgg

SEQ ID NO: 2030 - DNA, 1218 bp, Bacillus licheniformis
ctactttttcggtagggtatttaaaaagcggccttttgtcgaagtgctgtcaaaaggcacgatccagatcggcacaagggcgatatttacgctgatcatcgtactcgtggcgctttccgagtcgctcggtgcagaaaacattctcggcgcgtttttagccggggtgcttgtttcgctgctttcgccgaacaaagagctcgttcagcagcttgattcattcggctacgggttcctcatcccgatcttctttgtcatgacaggcgtcaaattggacatttggtcgctgtttggcaatccgaaaattttagtgatgatcccgcttctgtttgtggctctgttaatcagcaaagtcgttccggtgctgtttttgaaaaagtggtatgacatgaaaaccgtgctggcttccggttttctcctgacttccacgctttctctggtgatcgcggcgacaacgatcggcgagcgcatcggcatcattgacgcgcagatgtccggcgcgctgattttggtggctgtcattacatgcatcatcacaccgaccggctttaaaaaattaatgccgaaaacggaaagcgaaaaagagaaaaagacgatcacctttatcggcgcgaatcaaatgacgctgccggtcacgcttgaactttctccagaagattatcacgtcagaatcctgcatgtccggcaggaaaagaaggaagaaaagctggcggatccggtgtttgacgttgaagttttgccagattatgaatacgaaacgcttcaatcattcggcgttttccaaacggatatactcgtcgtggcgacaggcagcgaagagcgcaatacagggatcgccctttatgcgaaggagcagaaagtcgcgagaattatcgccagcgcagattccccagacgccgaatcgaggctgaaagaaaacggaattgatacattctccattctgctttccacgaaaacgctgctgcgcgcgcttatcgaggcgcctggcgttatgaaacttttgacgaaccaggatgcgtcgctgtatcagatcaatatgagcaatgagcgatttgacggcgtcctgttaagggagtttccgtttacgggagatgtcatcttcgtccggattttccgcggggttgacagcatcgtgccccatggggatacaaggctgcaaatgggtgacaggctgatcgccaccggttcgcgcgaatatattgcggaattgaaaaaaacgct

SEQ ID NO: 2031 - DNA, 1056 bp, Bacillus licheniformis
atgagccgttttttcttttggatgatggctgcgggtgttccactttctgtcgcagggagccttctgcattggccgcaggttttattgttcatcatatactgcctgacgatcatcgcgcttgcaagctatatgggaagagccaccgaaagccttgcgatcattgcgggaccgaggatcggaggccttttaaatgcgacgttcggaaacgccgttgagctgatcatttcgattttcgcgttgcgggaaggactgatcggaattgtgctcgcatcgctgacaggatctgtcttgggcaaccttctcctggtcgccgggctttcgtttttcatcgggggcctgaaatataagcgccaggaattcaacgtgtatgatgcgagacacaattcaggtctgctcatgttcgcggtgattgtcgctttcgttatccctgaagtgttttcagctgaaatgacagagccgaggaagctgtcgatgagcgtcggcatcagcatcatcatgattttgctttacctggctgcactttatttcaagcttgtcagccaccgcggggtttaccagacgaatcaaaatgagcaggaagaatcgcatgaagagccggaatggtcgggaaagcgcgcaacattgatcttatttttggcaactgttgccgtcgcctacatttccgagcacctcgtccatacgtttgatacggtggccgaacaattcggctggtcggagcttttcatcggggtcatcattgtcgcgatcgtcggaaacgcggcagagcatgcttccgccgtcattatggcctataaggacaaaatggatgtcgcggttgaaattgcgatcggatcaacgcttcagatcgcgatgtttgtcgcccctgttcttgtcatcagctctttgttttttccaacgagcatgccgctcgtctttaccttgccggagctggtcgccatggcttccgccgtccttttgatgatcatcatttccaacgacggggacacgaactggtttgaaggcgcgacattgctggccgcttatatcatcatgggaatcggttttttccttctttaa

SEQ ID NO: 2032 - DNA, 1668 bp, Bacillus licheniformis
tttaggtttaaatatgatcgatgtcgcaggacagcgcggcgtcttcattgatcatcaaaaaatgtctgatgcgctaggtgttccggtaattcctgtgattgcccgcagcggcaaaggatgtgatgaactgagcaggcatttgctttttgaaaaggaaaagagggcggagccgctcgtcatcaattacggaagcgcagtggaagaagcgattggccggatcgaatcgatcatacccgaactccccggcgttttaaagcgctggatggcccttcaatatttggaaggcaactcgaaaatgaaagaacagctggaggacgcggccgacagcgaaagattaaaggaaatttacgaggagaccgaaaaacgccttcatcaggagcattccgtaagatcgctgcatcagcatatttacaatgagagatcgcgatggattgaccgcatcttgtcaacttctgtgcaatatcagtcagagcgaaaactgacgctgactgaacgcgtggatcagatcgtaacgcatcaggtgcttggcatcccgatttttttgttgttcatgtatctcatgttcatgctgacgtttgattggtttggcgttccattgtctgatgcactggacggtttcatcgggggaccgctgacggaatggacggcctcggcgctgtcggcaatgggagccagcccgtttatcgaggcgcttattctcgatgggattattgccggtgtcggcggtgtgctcgtgttcgtcccgcagatctttatcctgtttttcttcatttcggtgcttgaagattcaggatatatggcgcgtgtggccatggtgatggaccgcctgatggaggcgatcggtttaaacggcaaagcctttattccgctgattatcggcttcggctgcaatgttcccggcgtcatggctgcgcggactgtagagcagcctaaggaaagactcttgacgattatgctgacgccatttatgtcctgttcggcaaggctgccggtttatgctctgtttgcaggggcttttttcgcggcccaccaggctttcgtcgtcctttccttgtatgtgctgggcatcgccgcagcgctggtgctggcgaagtttttatcctcatccaagctcaaagaagaaaagtcgttcttcgtgattgaactgccgccgtaccgtttgcctcaagcgcgtacattgtggcgggcaacatgggagaagggcaaaggcttcgtccgcaaagccggcacttacatttttggcgggtctgtcctcatttggcttctgtcgtatacgggacccggcggaacggacgttgcgatggatgacagttttttagcgatgatcgggggagtgctcgcaccgctattgctgccgctgggattcggcacatggcaggcagcggcatcactattaaccggttttctcgcgaaggaagttgtcgttgcttcgatgagcatcatctattttgtacccgaagcccagctgcaaggcatgatggctgaacaatttacaccgttggccgcttacggatttatggctttcgtgcttttatacgtaccatgcctcgcgacagtagcggtgattaaaaaagaaacaaactcgaaaaagtggatgttcttgtccattgtttacggactggccattgcatatgcgatcgcgttcctgatttatcagggcggacgact

SEQ ID NO: 2033 - DNA, 942 bp, Bacillus licheniformis
aagggggaagaagaatggatcagcattcaaacgagcagaaatctgacatggagactgatgatacgttaacaaaccggcagggccacccgatcacaaacaatcagaatatcagaaccgtgggcaaccgggggccatcaacattggagaactatgatttcctggagaagatcagccactttgacagggagagggttccagagcgggtcgtccatgccaggggagccggagcgcacggctattttgaagcttatgggacagcaggcgatgagccggtctcaaagtatacgagagcaaagctttttcaggaaaaaggcaagagaaccccggtgtttgtccgtttttcgacggtgactcacgggatatcctcaccggaaacgctgcgggatccccgcggatttgcggtcaagttctacactgaagacggtaactgggatctggtcggaaacaacttgaagatcttctttatccgcgatgcggtaaagtttccggatttaatccatgcatttaagccggacccggttacgaatttgcaggatggcgaaagaatctttgacttcatttccaacacgcctgaagcgatgcatatgatcacatttttgttttcgccttggggtattccggcgaactaccggcagatgcaggggtccggggtgaacacgtacaaatgggtgaatcaagaaggggaagccgtgcttgtgaaatatcactgggaaccgaagcagggcataaaaaacttgacgcaaaaagaggcggaagaaattcaggcgaagaatttcaatcacgccacacaggatttatatgaagcgattgagcgcggagattatcccgagtgggagctgttcgttcaaatcatgagcgatgatgagcatcctgagctcgattttgacccgcttgacgacacgaagctgtggcctgaagatcaatttccttggctgcctgtcg

SEQ ID NO: 2034 - DNA, 1317 bp, Bacillus licheniformis
cgtgaagtttaaacagatacaattaagcccgtcccaactgctcgtgctagtgtttttatttttcatcatattaggaacccttttattgaagctgccggcagcaacgcccaagcctataggctggattgatacgctttttacatcgacctcggcgatgactgttaccggtctggccgtcgttgatacaggcacggattatacgatgtttggtcagcttattattctcgttctcatccagctcgggggactcggcatcatgtcttttgcggtgctcatttttatcatgctcgggaaaaaaatcggcctgaaagaacggctgttgattcagcagtcgcttaatcagacttctttaggcgggattattaaactgatcaagagtttgtttatttactccttcgcgattgaaatgctggccatgctgatacttgctgtcaaatggattcctgaatacggtctcgcccgcggcatctactacagcctgttccatgcggtttcctcctttaacaatgcgggattttccatatggccggacagtttaatgcggtatgaaggcgatccgctcgtcaacctggtgatcagttttttgttcatcgtcggcgggataggatttactgtattgtccgatttatggcataagcggagctttaaaaagttgagccttcattcgaaattgatgatatacggtacgtttatcgtcaatttggcagccatgatccttatttttctgcttgagtatcaaaatcaaaaaacgctgggaatgcttccgctagctgaaaaactttggggcgcctattttcaggctgtgaccccgagaacagcaggatttaacacgacagacatcggaagcctgcgcgaaagcacgatcacgcttttgctccttcttatgtttgtcggagcggggagcgcatcgaccggcggaggaatcaagctgacgacgtttcttgtcattcttctgtcggttatcacttttttaaagggcaaaaaacatatttcaatagccaaaaaaacgctgaaagaccaattgatcctccggtcgctcgctatttcaacaatcagcgtgctgttgattttaacggccatctttattttaaatatgacagaacctataccgtttttggcgattttgtttgaagtcgtttcagctttcggcacggtcggcctgtcaatggggattacggccgacctgtcccctatcgggaagatgctgattgttttcattatgtttctcggaaaactcgggccgctcacattggcgttttccctggccagacctgaaaaggaaaacatccgctattcaagcgaagatattttgactgg

SEQ ID NO: 2035 - DNA, 1622 bp, Bacillus licheniformis
atgaaaagagcaacactctgggcagttctggctgttctttgtaccattctgctgccaaaagccgcttttgctcacgcttatatcgtacaatcaactcctgctgaaaatcaggagctgaaaaaagcgcctgaagaaattaagatcgaattcaatgaagcgattcagaacgggtttcattcgataacggtcagaaattcgtcgggtgaacgggtagattccggcaaaacggaaatcgacccccaaaacgcaaagatcatgaccgtcaagctgaaaccgaagttaaaggatgatatctactcggccgaatggagagccgtatccgcagacggtcatcctgtatcaggcacgatcccttttagtatcggaaacattcaaggcgggctgccgaaagatcagcaaaatcaagcatcaggcctgccggcagccgatatcgtcattgaacgcgtccttttgtataccggtttctccctgttcatgggagccgctctttttcagctcgtctggcaccgacctgaaaacggctggccgggtgacaaaaagcgccgtctgaagcggatcacgaatgtggcgctcttattgacaggggctgccatcatcattcagctgccactgcaaacaaaaacaaacgcaggcgtttcctggatcggggcttttcagccttcgcttttaaaagaaacgcttctgaatacgacgggcggaacgctgtggctgatcaacatcgccatcatcgccttgcttgttttctcttcgaatagaaaaggcctgaagagcgcgatcttgagcctgttcctttttgccggactattgttcgtcaaatcgctcgacggccatgccgcttcgacgagcgcaggctatatgacaatcgcgatgaacttcatccatctgaatgccgcttccatttggactggcggactcgcgatgtttgtgctgtttttcggaaaagactggctgaagcctgacaaaagtttgatatgggaaaccattcggcgcttctcgccatgggcgctcgcttcagcagggctactcatattctcgggccttttcaacagctttttcattgttcatacactggataacctgttcgggacggcttacggaaaagcgctccttgtgaaatcggcgctcgtccttctcatgatcggactcggggcatttcactattttcgttttagaaaagcgccgaaacagcagggcggccgttcgatgaaagctgaatgggcggtcgggcttctcattctgctgaccacggcggttttcaccaatattccaagtccgcccgcgccgctgccgcagcctttcagtgagacgaagcagctgacggaaggaaatacgctgtcactccgaatcagcccaaacatgccgggctcaaatacgtttgaagtcaccgtcagaaacagaaaaggagacgtcgtcaaagatatccaaaaaattgaattaaccgttgagaaaaccgggcttttcggggatgacaaggaaagcacgttcagcctcagcaaaaataaagacggtgttttccaaacgaaaaatttaaatttaagcgaagacggcatctggaagatccgcgttcacggattaacggcgtcatttgaggaaatcagaacagttttcaatgcaaaaattaa

SEQ ID NO: 2036 - DNA, 1065 bp, Bacillus licheniformis
atggaacttgccgccattttatttagcatgttttttgcgatgaatatcggagcgagcggtgcagctgcttcaatggggatcgcctatggatctgaagctgtcaaaaagaagtttcacgccctcctgatctgtgcagcgggcgttctctcgggcgctgtcatcggcggaggaaacgtcgtgaaaacgatcagttcaggcatcattcccgaacgggtgatttcgcttgaaatcgtctgcattattatcggatcagcggcgctgtcgctctttatcgcaaatgtactcggcattccgctttcgacaagtgaagtgacagtcggatctgttgtcggagtaggtgtcgcataccaggttttgtatgtcaaatctttgcttgtcatcgtctcattttgggtcattgtaccaatcgtcgcttttgcatttacatttgcgatggcaaaaatcatgaaaaaaacgatcaaacgtccagcctcgggaaaaaaagcaaaggttttggcggtcattctattgatcacagggttttttgaagccttctcagcgggcatgaacaatgtcgcaaacgctgtcggacctctggtggcggcgcatgttttgacagtcggggaaggaacgctctacggcgggctgtttgtcgcgctgggcgcccttttactgggcaggcgcgttcttgaaacaaacggcaaaaagattacgaggttttcaaaaggagagggaatcatcctttccggaacgggggccgggcttgtcattaccagttcaattttcggtttaccggttccgcttgcgcaagtcacatcatcttctattatagggatgggaatggcaaaaaacggcggcaacgtctttcataaacaagtggtcaaaacgatgctgaaagtatgggtcgtctcgccgttcctttcattaagcctatcttatatgctggtcagccttttattaaaaggagactactacgctcttattgttgtcacaagcgttctgctggcatctgtcggaacgatcagcctgatgagagcggtcaaaaaagagcacagctccgtccatgaacaaggcggaggaatttaa

SEQ ID NO: 2037 - DNA, 966 bp, Bacillus licheniformis
caacccggctcagcctgtttccaaagaagtgaccattttattcggatcgcagacaggaaatgcacagggacttgccgaaaacgcggctaagacgcttacagaacggggatttcaagtcaccgtctcttcaatgagcgattttaagccgaaccaattgaagaaactaaaaaaccttctcatcgtcgtcagcacgcacggtgaaggggatccgccggacaacgcgctgtcattccatgagtttctccatggaagacgggctccgaagctcgatgatctccgttattctgtgctggctcttggcgacacgtcgtatgaatttttctgccagaccggaaaagagttcgaccagcggcttggtgagcttggaggcacaaggctccatccgcgcgtcgactgcgatctcgattatgatgagccggctgcagcatggcttgacggtgtcatctcaagcttaaacgaaggacaggaacagggcgcaagcgccgcacctgctcaaacggcagctccgcaagccgcgggaggagtaacagtatattcgagaaaaaatccgttcagagcggaagtgctggaaaatttgaatttaaacggccgcggatcaaataaagaaacgcgccatcttgaattatcgcttgaaggctcaggtttgacttatgaacctggcgacgcgctcggcatctttccggaaaatgaccctgaactcgtcgatatgctgctgaaagagctgaaatgggatccgaatgctgccgttgctgttgatcaaggggaaaacctttctttgaaagaagcgttgacttcttactatgaaattacggtgctgacaaagaaattcattcagcaggcggcagaaatcattgaaaatgaaaagctgcgcgagcttgccgctccggaaaatgcggatcaattaaaagcgtatatcgctggccgcgacctgattgattttgtgcgggatttcggtccgatcgcagc

SEQ ID NO: 2038 - DNA, 917 bp, Bacillus licheniformis
atggatcttttatttgtattaaccatattgattgtcatctttgctttggcatttgactttatcaacggctttcatgatacggcaaatgcgatcgccacctcggtatcgacaaaagcgttaaaaccaaggcatgccattattatggccgctgtcatgaacttcgccggcgccatgacgttcacaggcgtagccaaaacaattacaagcgacatcgccgaccctttcaagcttgaaaacggatcggtcgtgatccttgccgctcttatcgccggcattacatggaacctagtgacctggtatttcgggattcccagcagctcatcccatgcgatcatcggagcgattgccggagctgtcatcgcatcggaaggatttgccgcgattaaataccacggatttattaaaattattgaagcacttatattatcgcccattttggcgtttgttttaggatatttgatctacagcatcgtcaaagtcatttttaagaacagcaatctggcaaaaacgaataagcggtttcggcgcgttcaaatcgcgacagctgccattcagtcctatacgcacggcacgaacgatgcacagaaagcgatgggtatcattacgatggctttaatcgcgggtaacttgcacagtacaaccgacatcccgttctgggtgcagtttgcatgcgccatggccatgggactcggaacatctgtcggcggctggaaaatcatcaaaaccgtcggcggaaaaatcatgaagatccgtcccgtcaacggtgtctctgcagatttgacgggagccctcatcatctttggcgcgacgatcgtccatttgcctgtcagcacgacacacgtcatttcttcatccattttaggcgtgggcgcttcccaccgggtgaaaggcgtaaactggggcaccgcaaagcggat

SEQ ID NO: 2039 - DNA, 1011 bp, Bacillus licheniformis
tgatttcctctttaatgccccacattaagcaggacatcgccctgacagacagcgaggtctcccttgttacggccattccggtcatactcgggtcgcttctcaggattccgctgggctactacacgaacagatttggagcaagaattacattcatgatcagctttttgctgcttctgttcccggttttttggatcagcacagccgattcgctgttcgacttgatccttggcggcttcttcctcggcatcggcggagcggtcttttccatcggggtcacatcactgccgaaatactaccctaaagaaaagcacgggtttgtcaatgggatctacggcgctgggaacgtcggtacagcgattactacgtttgccgctcctgttgtcgcaaaaaccgccgggtgggaaaatacggtgcggatgtacatcgtgttagtcgccgtattcgctttattgaactttatccttggagatcgaaaagaaacaaaagttacggtatctgtaacagagcaaatgaaggcagtctaccgaaatcagacattatggtttttaagcttgttttacttcattacattcggatctttcgtcgcgtttacgatttatcttccgaactttcttgttaatcacttcgggcttgatcccgtcgattcagggctgagaaccgccggatttatcgctgtcgccacttttctgaggcctgtcggcggctggctggcagacaaattcaacccgctgaagctgttgatgtatgtatttgccggctgcaccttgtcagggattttattggccttttcgccgagcctcggactgtacgggtttggggtattaaccgttgccgtgtgcgccggactcggaaacgggatcatctttaagctcgtgccgctttatttttcaaatcaggccggcatcgttaatgggatcgtatcaccgatgggcggcttgggaggatttttccgcctctgattcctgtcagccgtttttcaggctacccgtccttgtgcgatccggtttcttg

SEQ ID NO: 2040 - DNA, 930 bp, Bacillus licheniformis
agacgatcgcggcagcgtgttttgtactattattgatcgcagcattgacagcatgcggcaatcaaacagagagcaaagattcttcttctaaatcaaaaagcgaagaaacgattacatacaaggctgaaaacggaacggttaaagtgccgaagcatccgaagcgggtggttgtcatggctgacgattatttcggctatttcaagacactcggtctcaatgtagtgggcgcccctgacagggttttcaagaatccttatttcaaggggaaaaccgatggtgtgacaaacataggtgaaggaaattctgctgaaaaggttattcaattaaaaccggacttgattgtcgtatggacgacccaaggcgctgatatcgaaaagctggaaaaaatcgctccgacggtcgcgttgaaatatgacagtctgaatagcactgaacggctgaaggatttcgcaaaaatgacaggcactgaagatcaagcggagaaatggctggctgaatgggacaaaaaagttgcggcggccaaatcaaaagttcaaaaagctgtcgggaacaaaacggtttccattatgcaaactaacggtaaagaaatctttgtattcggcgatcaattcggaaggggaggaagcattgtttaccaagatctcggcttaaaggcgacaaagctgacaaaggaaaaagcaatcgacgaaggcccgggctacacgagcatttccttagaaaagctgcctgatttcgctggagattatatatttataggaccttgggaatcaagcggagacgacagcgccgtgcttaatacatccatttggaagaaccttggggcggtcaaaaaccaacatgtctataaaatcgaccctgtcggcttctatttttccgatccgatttcattagagggccagctcgaatttattacagaaaacttaacaaaat

SEQ ID NO: 2041 - DNA, 1011 bp, Bacillus licheniformis
  misc_feature (1)...(1011): n = A,T,C or G
aagcgatccatgtgatgaataaaatggacaacgacgaccttgccgcgctcttcgaggaaatggaccctgagctgaaagaccagcttctatccaacatggaagcggaagaatccgaagcgggccgagttttgatgaactacccgcctgaaacagctttattaattatgacaaaccgctatgtctggattccgcagcattacacggtaaaagaagcgggcgtcaagctgaaaagctgtgcggaaatcgcggagtccatcaactattgatacgtcatcaacgaacaaaaacagcttgtcggggttatctcataccgtgatctcattttggcagatcccgatgagaaggttcacgaattaatgtttacaagggtcatatcggcggacgctcttcaagatcaggaagaagtcacaaggctcatcgagcggtacgactttctggcgattcccgttgtagaaaaaaatcatgagcttgtcgggatcgtaacggttgatgacattatcgacatcgtcatccaggaagcgaatgaagactatgaaaaattcgcagcatcaggtaaggcgatcacgtttgatacaaaatcgtatgtcgccgcataccgccgtctgccgtggctgatcttgcttttgttcatcggtttgatctctggcagcatcatgagctattttgaagacacgctgcagcaggttgtcgcattggccttttttatgccgatgatcgcgggaatgacgggtaacactggaacacagtccctcgctgtcgtcatcagagggctgtcaaaagaagagctcaataaaaaaacgattttccgcttgattttccgggagcttagagccgggattattattggcatcgngtgtgcgatcgtgattacgggaatcgcgatagtatggcaggggaatctgctgctcggatttgnggtngggacttntntttttgccactctgatcatccgcacgatggcgggaactatcgtgccgatcatcctttacagctgctattgtcaccctgcga

SEQ ID NO: 2042 - DNA, 1140 bp, Bacillus licheniformis
tgctgtttttcttaaagagcaaaaaatttcagaacatcggacaaattctgtttggatttggtgcgcttttctacggcttggaattaatgagcagcgggatgaagccgctccggacggttgaagcttttcatgatttaacagtcagcatgagtgcgaatcctattctcggcgtgctcgtcggcacccttttcaccgttctcgtccaaagctcaagtgcaacgatcgggatcctgcaagggctgtttgccgattcattaatagatctaaacggcgctctgcctgtattattcggagacaatatcggtacgacgattaccgctgtactggcatctcttggcgcctcagtggcagccaaacgggccgcggccgttcacgtattgttcaacctgattggaacagcgattttcctgatcttgctgaagccgttcacagctttgattttaatgcttcaatcctctttagggctggaccctaagatggtgattgcgtttgcccacgggatctttaatacgtcgaatacgctgattcagcttccgtttgtcggcatattggctttgatcgttacgaagctgattccaggcaaagattcggttgtggactataaagcaacacatcttgatccgctgttcattcagcagtctccttcaattgcgctgggacaggcgaaagaagaagtattgcgcatgggtgaatttgcggtaaagggacttgaggaaacaaaagagttttttaatacaaaacaggcaaaacatgcgcaaagcgcttttcaaatagaagatgcgatcaacaatttggacaggaagataaccgattacttgatcgaattgtccgccactacgctttctgaacaagaatctgaagaacatcatatgttaatggatactgtcagagacattgaaagaatcggcgatcactttgaaaacttggttgagcttggtgagtaccagcaatccaacagggtgaaaatttccgaagcggcaatggctgatttaacggaaatgcttgacctgaccatttccactgttaaggagtccatcaccgctcttggggaaaataacgaagatgccgcaagacgcgtagtcgaaaaagaaaatcagattgataaaatggaacgcaagcttcgcaaaaagcacattcttt

SEQ ID NO: 2043 - DNA, 830 bp, Bacillus licheniformis
atgcagatgggggatacagtatttatgttcttttgcgctttgctcgtgtggctgatgacgccgggcatcgctttattttacggaggccttgtaaggagcaaaaatgtgctcagcaccgttatgcacagtttatcttcaattgccatcgtttctatcatatggattttgttcggctattcactcgctttcgctcccggaaacccattgatcgggggtttggattggatcggactgcacggtgtcggttttgaacccaatgccgattattcggagacgatcccgcatacgctttatatgatgttccaattgacatttgccgtcctgacgactgcgattatttccggaagctttgcggagcgcatgcgctttccggcctttattcttttctcggtgctctgggcggttttcgtttattcgcctgtcgcccactgggtatggggcggaggctggcttgacgagctgggagctattgattttgccggcggaaacgtcgttcacatttcttccggggtagccggtctggtcgttgcgattgttctcggcaagcggaaaaatatgagcgacaccgcccctcacaacctccttctgaccctgctcggggcgactttgatctggttcggatggttcggtttcaatgtcggaagcgcgctgacgatcgatgaagtcgccatgaccgcttttatcaacacgaatacggctgcggccgcggggctgatcggctggattttggcagaatggctgattaataagaagccgacgatgctcggcgccgtctcgggagcgattgcgggactcgtcgcgattacgcctggcgcaggttttgtcacgcc

SEQ ID NO: 2044 - DNA, 957 bp, Bacillus licheniformis
atgagaaaaatatcaatatttctatttattctccttctcgcgcttggcgcagcgggatgcgggaacagcaaagaaaaggctggcggcgatggcaagagcacagcgtcagctgagaagagcatcgagtacctcgatcatacatacaaggtgaagatcccggccgaacaaatcgtcattacgggaagcgtggaatcgatggaagatgccaagcttctggatgttcacccagccggtgccatttccttctccggaaagttcccggatctgtttaagagcattactgacaaagcaaccgctgtcggcgaaaaaatggagccgaacctggagaaaatccttgagctgaaaccggatgtcatcctggcttcaacgaaatttcctgataaagtggtgaaaaaactggataacatcgcgacgacgattcctgtttcccatgtttcttcaaactggaaagacaatttaaagctgctggctgaactgacaggcaaagaagataaagcgaagcagattatttcggattatgaagccgacctcaaggaagctaaaacaaagcttgagaaaacggcaaaagatacaaaagcgctcgttgtcagaatcagaaaaggcaatatctttatctatccggaagacgtattcttcaattccacattatacggtgagctcggcttcacagctccaaaagaagtcaaggcggcaaaagcccaggagttggtttctttagaaaaactgagtgaaatgaatccggactatatgtttgtccaattctcagacgatgagaatgccgacaatccgaatgcgctgaaagatctggagaaaaatccaatttggaaaagcatttctgcagtgaaaaatgaccgtgtatttgtcaatgctgtagacccgcttgcgcagggcggaacggcatggagcaaggttgaatttttaaaggctgcagctgagaaattggcgcagaacaaatag

SEQ ID NO: 2045 - DNA, 960 bp, Bacillus licheniformis
atgattaaacattttgcgatgacaaaggacggacggcttttatccgacaacaaagcagaaaggctgacagatcaagatattgagtggttttggaccgatttcgatcagccttcggaagaagaagtctccttgctcaaaagccattttcactttcaccctttatcggtcgaagactgcgtacatcgcttgcagcgtcccaagctcgatcaatacgaagattatctttttttcgtcatacatgcgttgaatcaaaagactttggcgtctgaagaagttgatttattcgttggaaaggatttcatcgttacatttcattttcatcactcagacggcattgaaaaagtaagaagacagctttcggaaaacagcgagttgtggaaaaacggaccgggccacatcgcctatatggtcatggatacgcttgtggacgaatatttcccgattctttacaaaatagaagaccgcctcaatgaaattgccgaaagcgacagcaggaaaacgtatggaacgctgatgaacgaggtgtttgatatccgtggcgaccttttaaagctgaggaaaacaatcattccgatgcgggatttgctttaccggattttaaacattgaaatttcaaaagaaaaccgcgaacgaaaagcgtattacagcgacatttacgaccatctcttgaagctggccgaaatcgtcgaaaacaaccgtgacatgacagccgatttgagggacagctaccagacgctcaactccaaccggatgaacgccattatgatgacgctgacgatcgtctcaacgatttttattccgctcaccttcattgccggagtgtacggcatgaactttgacaacatgcctgaactgcattggcgctacggctattttttcatcctcggaataatggcagccgttgtcgccggcatgatcttctggttccggcataaaggatggtttgacattttcaagtaa

SEQ ID NO: 2046 - DNA, 987 bp, Bacillus licheniformis
aacagcggcgaacactgtctttaataataaagaaaaaagtaaccgagatcgaaccgcacgtcaacgcgacgctgaaggaagggacaaaacaggccccaccagaaagcgacggacggtttaaaaaaacggttgcaaggcttgctgcaggaaccgttctcggtgcggcgggctttctgcttcccggcggcaccgcagccgagtggcttctttttttcctagcttacctcatcatcggcggcgatgtcgtattaagggccgtcaaaaacatctttcgcggccgggtttttgatgagcactttttaatgacgatcgccactctgggggcatttattattcagcagtatcccgagggtgtggcggttatgctgttctatcaaataagcgagctgttccagggagccgcggtcacccgctcccggaagtcgatcagcgatttgatggacatccgtcccgactatgccaatcttcaaaccgaaggcggaacggtcaaagtgtctcccgatgaggtcaaagccggcgatatcatcatcgtcaagccgggagagaaagtgccgcttgacggcaaagtgcgggcaggcaaatcgcttgtcgatacgtccgcattaaccggagaatccgttccgagagaagccgctcccggaacagaggtgctgagcggatttgtcaacaaaaacggcgtgcttgaagtggaagtggacaaagaatacagtgaatcaaccgtttcaaagattcttgacctcgttcagaatgccagcagcagaaaagcgaaaacagagaattttatcaccaaattcgccaagtattacacgcctttcgttgtgataatcgcgcttcttctcgcttttgtcccgccgctgattatttcaggcgccctgctgtcagattgggtgtaccgcgcccttgtctttttggtcatttcttgtccgtgcgcgcctcgtcgttccattccgctcggctttttcggcggcatcggagcggcgtcaaagc

SEQ ID NO: 2047 - DNA, 809 bp, Bacillus licheniformis
  misc_feature (1)...(809): n = A,T,C or G
atgttttttcatattaaagaactacagtatcacgcaaagcctgataaacccgatccattatttgcgaaaaagctgcaagagatacttggaggacagttcggggaaatatcagtagctctgcagtatcttttccaaggatggagtgtcaggggcaatggcaagtacaaagatctgctgatggatacaggagctgaagagcttgcccatatcgagatgctggcgacgatgatcgcaaggcttttggacggtgcgccggtcggtgatcttgaaaaagcggcaaaagatcctgtgatcggtgccattctgggagggatgaatccgcagcatgccatcgtatcaggattaggggcgatgccggccgacagtgtgggaaaccgctggaccgccgattatattatcgcaagcggaaatttgcttgccgactttcgggcaaatttaaacgcggaatcacaggggcgcctgcaggccgtccgcctttatgaagagacgacggaccgcggtgttaaagatatgctctcctggctgattgcaagggatacgatgcatcaaaaccagtggcttgcagccatcaaagaactggaagcgaaagaaaatgtcgtcgtcccaagtacgtttccgcgcaatctggaaaaaagggaagtctcccatgtattatntaaattttcaagaagcaacgagagcgctgcangcagatgggcgaagggaccgagcatggatggagaaggcgtttttcagtacgttgagcatcctcagccccttgcgaaaaaaccggtgttaagacctgcgcctccatatattcatgatacgcc

SEQ ID NO: 2048 - DNA, 901 bp, Bacillus licheniformis
ttgaaattggcggatttgaggaagagcggacacgcgccttccttgttgtcatcttttttatatttcgatgtcagctttatgatttgggtgttgctgggggcgcttggtgtttatgttacggctgattttgatttatcgccttcacaggtcggattgattgtcgccatacctactttggccggatcgtttttccggattgcgctcggcattttaaccgaccgtttcggaccgaaaaagacggctgttggcggaatgctggtgacgatgattccgttgttatggggatggcagttcggttcatcggtcgccgagctgtatatcatcggaattttactcggtgtggcaggcgcaagcttttccgcttcccttcctatggcgagccgctggtatccgccgcacttgcaaggtcttgccatggggatcgccggggcgggaaacagcggaacactgcttgctacgctattcggccctcgccttgcggagcaagtgggctggaacggcgtcatgggactggcgctgattcctttaaccctcgtgttattcagctatttccttatggctaaagaacctccgaatcagccggctcctaaaccgctcaaagactattttgccgttttcaaagaaagggacacttggtatttttgccttctctacagcgtgacattcgggggttttgtcggcctgtccaactttttaagctacttttttgcatcccagtatgccgttccggcggtaagagccggcgaatttgtcacgcttgtcgttgcatccggaagctgcctccgccctgtcggcggattgattgccgataaaatcggcggcgtgcgtttgcttcaattcctctttatcggagtggctctgtgcatgttctcggtcagtatgctcccgtctctaggcgttg

SEQ ID NO: 2049 - DNA, 780 bp, Bacillus licheniformis
atgagcgctgtaacagctgtaaagccagaagatgtataccagatcaacgacttgaatttatggtacggcgaacatcacgcattaaagaacattaacttgacaatacccgagtacgaaattaccgccatcattggaccgtcagggtgcggaaagtcgacattcattaaaacgctgaatctcatgatcaatatggttccgaatgtcaaaatgaccggagagatcagctacaacggaacgaacgtactcaacagcaaagtcgaccttgtcgagttacggaaaaaagtcggcatggtgtttcaaaaaggaaacccgtttccccagtcgatctttgataatgtcgcatacggaccaagaatccatggattgaaaaacaaaaaagaactgaatgagagagtggaaaaggcgcttgtggatgtagcgctgtgggatgaagtgaaagaccgtcttcattcccaggcgctcggactttccggggggcagcagcagcgcctctgcatcgcaagggcgctggccaccaatcctgacgttctcttgatggatgaaccgacatccgcccttgatcccgtttcaactttgaaaatcgaagagctgatgctcaagctgaaagagaaatatacaattgccatcgtcacgcacaacatgcagcaggcctcgagaatttccgatcaaacggcgtttttcctgatgggcgagctgattgagtgcaatgatacggtcaaaatgttttcaagtcctgacgatcatcggacgaaagattatataacaggccggttcggatga

SEQ ID NO: 2050 - DNA, 834 bp, Bacillus licheniformis
ttttctgaaaataccctgccgcattagcgggaataagagaaagagacaatcacttaggaggaattacaaaatggatgcagcattattacttgaatatggttgggttcttctcatcctagtcgggctggaaggcattttggccgcggacaatgccctcgtcatggcggtcatggttaaacacttgcctgaaaaagacagaaaaaaagcgctcttctacgggttggccggcgcgtttgtgatgaggttcggcgctttgtttgcgatctctttccttgtcaatgtctggcagttgcaggcgatcggcgccgtttatctgctttacatttccgtccatcatattttgaaaacccacgttttcaaaaaggacgaaaaagtgaaggagacgaagcaaagcggtttttggccgacggttatcaaagttgaactggcagacatcgcttttgccgtcgactcgattttagctgcggttgcgctggctgtcacacttccggcgacaaacctgccgcaaatcggcgggcttgacggcggacagttcatggtaattttagccggcgggatcatcggattgattattatgcgctttgctgcaagtcaatttgtgaacttgttaaagaaacgtccgagcctggaaacggctgcttttctgattgtcggctgggttggtgtgaaactgacgctctatacgctcgcacacccgcaaatcaatatcgtctctgaacattttattcattcaggtacttggaagttcatcttctgggcggtgctgatcgccattgcgctcgggggatggtttatgacaaatccgaacaaacacgagaataaagctgctgagga

SEQ ID NO: 2051 - DNA, 793 bp, Bacillus licheniformis
atgatggacaatatcattatcggcaaatacgtacccgggaaatcggtcattcatcggctcgatccgcgtacaaagctgttaaccattttcctttttgtctttatcgtttttttcgcgaataatacggaaacatatgcattgctcggcctgtttacggttgcagccgccgctttgtcaggcgttccggtgcgattccttataaaaggaatgaagccggtgttctggattgtgctgtttacgtttctgcttcatatttttatgacaagggaaggaccggttctcgccgatctcggcctgtttaaaatttatgaacaggggcttgttcaagggatttttatttctctgcgctttgtttacctcatcatgatcacaacgattttaacattgacgacgactccaatcgaagtgaccgatggtttggagcatttgctcggtccgtttaaaaaattgaagcttcccgtccatgaactcgctctcatgatgtccatctccctcagatttataccgactttgatcgaagagacggataagatcatgaaagcgcaaatggcaagaggcgtcgattttgcgaacggcccggtcaaagaacgcgtcaaagcgatcgttcctctccttgtcccgctttttgtcagtgcctttaaaagagctgaagagcttgcaaccgcgatggaggcgcgaggatacaggggaggagaaggccgtacaaaatacaggcagctgacatggaaatggaaggatacttccgtgctcctcattttagctgttcttggcgttttgctaattttattgcgga

SEQ ID NO: 2052 - DNA, 838 bp, Bacillus licheniformis
ttgaacagagatgcttacaaagaaaaaatatcgtcatgggccaaagacctgaaagaccagatgaaagatgatccttctttagaaagccatttagaaaaactttttcaatcattggatgatcctcgtgcgaccgaacaggaatggtatgagcaggcagaagccgtgtatcaagccatctcccgcagtgatgcgtctcaagcaggccggcagccattcagaacagtgccgatcggaggccatcgcctgccaagcctgccctactcgtattcagcccttgagccctatatttcaaaagaaattatgtttcttcatcatacaaaacatcaccaaagctatgtcgacggtttgaacagagctgaaaaagaactgcagaaagcgaggcaaaccaaacagtttgacctcgttaaccattgggaaagagagctcgccttccacggagccgggcactatttgcatacgatattttggtacgcgatgcacccaaaaggaaaaagacggccgacaggcgaattgctggagatgatcaaccgttcattcggcagctattcggcctttaaagaacacttttccgaagcggcgaaaaaagtggaaggcgtcggctgggcgatcctcgtctgggcgccgcgttcgcaccgcttggaaattctgatcgcagaaaaacatcagctgatgagccaatgggatgtgatccccctgctcccgctcgatgtatgggagcacgcatattaccttcaatataaaaatgaaaaggcaaaatacgtcgataattggtggaatgtcgttgactggagagagcctgaaaggcgatttgcgtcagcaaagcgcgttttatgggagc

SEQ ID NO: 2053 - DNA, 1407 bp, Bacillus licheniformis
atacaacgactaaactgaccggattgttattggggccgatcagttttttgctgattctcggcttgataccggaagctgagctggcttacgcgccgcgaatcgttcttgcggttacagcctggacggccgtctggtggattacggaagccgtgccgattccggcggcatcgctcttgccagtcattttgctgccgacattgggtggtttagatatggaaacgacggccaaagcatacggcgatccgattgtgtttatgtatatggggggatttatcattgcgatcgccatcgaaaaatggaatcttcataaacggatggctttgcacattttaaagcggatcggggctgaaagccaccggatcgtgcttggcgtgatggcggcgactgcgtttttatcgatgtggatttcgaatgctgccaccgctttgatgatgcttcccgtagcgctagcagtcattaaagaagtgcaggaaaaagaaattttaaaaggcgaatcgctgcagaagttcagcaaaagcattttgctggctgtcgcgtatgcggcgtcgatcggcggacttgccacattggtcggttccgttccgaacgcggtgtttgccgcgatgtccaagcagatgctcaatcacgaaattatgttttttgaatggtttttattcgggttcccggtttccattctgtttcttgccattttatatgtttatttaacgaaaataaaatttaaagtgagcgcttttcaaggaaaaaagcctgattttatcgatcatgatttaaaggcgcttggcgcaatgacgagggaggaaaaatcggtttttaccgtttttttattaaccgcatgtttgtggatgttcaaatttatccttccgtttcaaatatcagatacgtcgatcgcgattttcggagcggttctgctgtttttaattccgagtacaaaggatgaacggattttggaatggaaggatatgcagtcgctgccatggggactgcttctattgtttggaggcggcttgtcgcttgcggccggtttttcggcgaccaatctgacagcatggatcggcggcaagctcaagctgttggaaggccacccttacttatttgtcctgattattttgacggctgcgattttatttatgactgaaatcatgtctaataccgctgtcgccaatatggtgattccgatgacgatcggccttggcgccgcgcttcaggtcgagccgtacgggctgatggcggcagctgcgcttgcttcatcgtgcgccttcatgcttccgatctccaccccgccgaatgcggccgtcttcagctccaatctgctgacgataaaggatatggtcagggcgggcttttggctcaatatcgcaggtgtcttcttgattgtgatcagcgcatatttttggcttccggccgtct

SEQ ID NO: 2054 - DNA, 804 bp, Bacillus licheniformis
caaacatccgaaaccaaaagttgacttccttcatgaggcttttttaaaggagcagcaggccgaaaaaaggcgggtccgcttttttcaaatcgcgattttcatcgttttcttttcgctgtgggaaaccgcaagccgtctggcatggatcgatccgctgatcttcagctctccttcagccgtctgggcgcttttcctcgaaaaaatgggagacggatcattgccgggacatatcggtgtaaccgtatttgaaaccatcctcggctttctggccggaacattgcttggaacttttctagccgccctcttatggtggttcccgaggctctccaaaatattagatccgtatcttgtcgtcttaaatgcgatgccgaaagtggcgctgggtcccattctcatcgttgcgatcggccccagcttgacgagcattattgcaatgggcgccatcatcagcgttatcattacgactatcgtcgtctatacgtcctttcaagaaattgatgaaaactatttaaaagtgatgaaaacattcggcgctacgaaacgcgagattttcaaagaagtcattttgcccgcttccattccgacgatcatatctacactgaaggtcaatgtcggcttgagctgggtcggtgtcatcgtaggagaatttttagtatcggctcaaggcctcggctatatgatcatctacggctttcaagtctttaatttcaacctcgtcatgctgagcctcctgatcatcgccgtcttcgcaacattgatgtatcaaggtgtcgagctgttggaaagaaagtggatgaaaggcag

SEQ ID NO: 2055 - DNA, 834 bp, Bacillus licheniformis
  misc_feature (1)...(834): n = A,T,C or G
acgccggtgtattggtaaaccgcgtcaatgaagcatacgatgttcaacatatcgcacatgaaattgagcttgatgtaatggctttttcagatttggagctgatcggaatcggtgcgtacagcccgctccaaggctttatgacagagaaagactatctgtccgttttcgaaaatatgagactatcaagcggcgaagtatggacgcttccgatcactctgcctgttgacgagcaaaaagctttaagcttaaaagcgggtgacaccgtccgccttacctataatggggaaacctacggcgtcattgagatcgaagatatctatacgccggacaagaaaacggaagccgtcaatatctataaaaccgacgaactcgaacatccgggcgtcaaaaaattgtttgaccgcggcagcgtttatgtgggcgggccgatcacgctcattaagcggagtgtaaaacaattcccggcgcacacattcgaacctcttgaaacaagaaaaaaattcgcggaactcggctggaaaacgatcgtcggattccagacgagaaatccggttcacagagcgcacgaatacattcaaaaaacggcgctcgagacggtagacggccttttcctcaatccgctcgtcggggaaacaaaatcagacgatattccggctgatgtccgcatggaaagctatcaggtgctgcttgacggctactatccgaaagaccgcgtcttcctcggcgtttttgccggcggcgatgcgctatgcggggccgaaggaagcgatcttccatgcccttgtgagaaagaactacggatgcacgcactntatcgtcggaagagaccatgcc

SEQ ID NO: 2056 - DNA, 885 bp, Bacillus licheniformis
ctttttctcaaagcatgagcatgctgagaaaaggcctgatttcactaacatttgaaaaaatcgaaaagcggctgctgtttttcacggatcatccggtgaaagcttttttggtcagtattatatttacggggattttgcaaagcagctcggcatttatggtgatcgtcatagggtttgtctcagtaggcgctctttcatttaaacgttcgattccgctcattttagggacaaacatcgggtccactttcacaacggaatttttggcggtgaagctggaatttttgatttttgcccttttggccgcaggtgcagctcttttcattgccggaaaatccccttttcggcaagtcggcgtaagcatgatcggcttgggggttatttttttctgtatcagcggtttcagccggcttgccgtgccgttgtcacagctagactcgggcgcttatatcgtgcagcttgccgaagattcatcgctttacgctttgttcatcggcaccgttttgaccgcgatgattcattccagttcggcgtgtgtcggcatcctgatgagctttatggatcaaggtgtcgtcggattgaccgaagcgatgagcgttgttcttggctccaacatcgggacatgcattacggccgtgatggcatccttcaaaggcggagctgcagccaggcaaacagcttatgcccatgttctgtttaatgtcattggtgtagcagctgtataccctctgctctcatcaatcacaggctttatctccggactgtccgaaagccccgcccagcagattgcccatttcagcctgctgttcaacgtcgtcacgtccctattgtttttgccgctctcaaatctgtttcattcgctgatcatgtttcttattccaaacaaaa

SEQ ID NO: 2057 - DNA, 770 bp, Bacillus licheniformis
gtggttctgcagcttgagcatgcttcactaaaacgaaacggagagtggatattaaaggatattgattggacggtggaaaagggggagcactgggcgttatacggattgaacggagccggcaaaaccgcactgctcaatatgctgtgcgcttattattttccgacaataggaaaagtcaccgtgttagggcgcgaattcggaaaaacggagcttggcgagaagcttcggcgaaaaatcggccttgtttcagccgccctgcagcagaagctttatcctgaagacagtgcatttgaaattgttttaagcggcgccttcgcttcgatcggcctttatgaatcgccttcacagtctgtcagagagaaagcggtcgccctcttggaggaattcggctccatccgctatgcggacaggagatatgaaacgctctcccagggagaaaagcaaaaggtgctgatcgcaagggccttgatggccgatcctgagctgctgattctcgacgaacctgtcaccggtctagattttatcgcgagggagcaggtgctggatacggttgaacaaattgccaagaaagacagtgcgccgtccatgctttacgttactcaccatgcagaagaaattctccccgctttcagccaaaccctgctgttaaaaaaaggggaagtgtttgcgttgggaaagacaagagagatgatgtccggcgaggttctgtccgaatttttcgatatgcccgtccaggcggtatggacggaagatcggccgtacttgtccaa

SEQ ID NO: 2058 - DNA, 614 bp, Bacillus licheniformis
atgttgaaaagaaaaaaagacaagttttccgtgcttttgacggaaattgcaaaaaatttagatgaaacagctgagtattttgttaactataaagtgacgaatcagacaacccttaaagaattcgcggataccttaaaagagtatgagacaaaaggagataactatgtacatacgatgattaaggagctgaacaaagcatttatcacgccgattgaacgcgaagacatccttcagcttacaaacagcctcgatgatgtactcgacggcatcgagcacttttcagccatgatggaaatattctcgatcacatcttcagatgagcatattgacaaattcagcggctatatcagagaatgcgcaaaagaaattctggtgacgatcgaattgctggcggaaaatcgcctgaaagaaattcagccgcacgccattaaaattaaagaatacgaacataactgcgataacctgcaccgcaaatcgctgaaaaatcttttcggtaaagagacagatccgattaaagtgatccagtacagagaaatctatgagacgcttgaagaaatcgcagattcatgccaaagtgtagcaaacaatttagaaaccatcataatgaaaaatgc

SEQ ID NO: 2059 - DNA, 734 bp, Bacillus licheniformis
atggaacggtatgatgaattaaaaaaaggtgaaaccggggcatgggtcagcatcatcgcttaccttgtactgtcggctgttaaattggccgtcgggcttgcatttcactccgaagccctcagagccgacggactgaacaatacaaccgatattatcgcctcattagcggtgctgatcggcctcaggatttcgcagaagccgcctgatgaagaccatccgtacggacatttccgcgctgagacgatcgcctcgatgatcgcttcatttatcatgatggtggtcggtcttgaagtgctgtacagctcgggcgaaatgctgtttaatccgaaggaaacgacaccggacatgattgcggcctggacggctgcaggcagcgccgtcgtgatgtttttggttttcctctacaataaaaggctggcaaaaaaggtgaacagccatgccctctatgcagccgccgccgataataaatcagatgcctatgtcagcatcggaacattcgcaggcatctttgcttcgcaatttaaccttgcatgggtcgatacggcagccgcgtttatcattggattaatcatctgcaaaacggcttgggggatttttaaagaggcggcccattccttgacggacggattcgatattaaacatatttcaacctataaagaaacgatccggaaagttcccggcgtcggcaacatcaaagatgtaaaagcgcgttatttgggcagcgccatccacgt

SEQ ID NO: 2060 - DNA, 678 bp, Bacillus licheniformis
tgtgcggctcgctggtcgtgctggaggggcttttatctgcggataacgccctcgttctcgccgtcatggtgaagcaccttccggaaaaacaacgcaaaaaagcgttgacatacggtttaatcggggcctacttctttagatttctattcattggactcggtatgatcctgattaaattctggtggatcaaactgctcggagccgcatatctggcatggctcgtcatcaagcacttcttcatcggtgagggcgatgatgaagcaaacgccatcaaaaaagacagctggatggtacgcgttttcggggtcttctgggcgactgtcatttcggtagagctcatggaccttgcattttcggtcgacagcatcctggcggcatttgccgtatctgaaaaggtatgggtgcttctgatcggcggcatgctcggcatcttgatgatgagaaccgttgcgaaattcttcttgacgctgattgacaaagtgcctgaacttgaaacaacggcctttgttttaatcggaatcatcgcactgaaaatggctgcgagtgtatggcatattgaaatgccgcacagcgtcttctttatcattctgattattgcttttgccgcaacatttatcattcactatatgaacaagcaaaaagctgtaaaagagcaaacggcggcttcaaaggaagaat

SEQ ID NO: 2061 - DNA, 944 bp, Bacillus licheniformis
ttgaaaaaactatctttattgattatggcattgataaccgttcttgtcgtagccgcctgcggaaacaaagctgctgacacagatgcaaaatcttcctctaaaaaagaaaccgtcacaattaaacacaacagcgacacaacagatgtaccgaaaaacccgaaaaaagtcgttgtcttcaattttggaatgcttgacacgcttgatgagcttggcttaagcgaccgcgttgtcggccttccgaaacaaacccttccgtcttacttgaaaaaatataaagacagcaaatttgaaagcgtcggcggactaaaagagccagattttgaaaaaattgctgagcttgagcctgatttgatcatcatcgaaggcagacagtctgaacagtatgacgagtttaaaaagatcgctccgacgatcgacattgagcttgaccagaagaactacatgaacagttttaaagaaaataccgaaaacattggaaaaatcttcggcaaagaagatgctgtcaaagaagcccttgcgaaaatcgatgaaaaagtagagaaagccaacaagctggcgaaagaaaaaggcggcaaaggattggtcgtcttaacgagcgataagcaaatcagcgcgtatggaagcggctcaagattcggcttgatccacgatgtgctcggcgttgaacctgtcgataaaaacatcgaggtttcccttcacggccaaagcgtctcttcagaatatatctctgaaaagaatcctgattacctgtttgtcatcgaccgaagcgctgccatcggcgaaaaaggaacagcaaaagaagtcatcgaaaatgaaattgtaaaatcaacaaaggcctataaaaacggccatatcacataccttgatccaggctactggtacctgtcaggcggaggccttgaatccgtatctgaaatggtgaaagaagtcgaaaatggattgaa

SEQ ID NO: 2062 - DNA, 669 bp, Bacillus licheniformis
ttctgcctgatgaaggatcgattaaagtaggcggtatcaagctgacggaagagacggtctgggatgtccgaaaaaaggtcggcatggtgtttcaaaatccggataaccaatttgtcgggacaaccgtccgcgatgatgtggcttttggtttagaaaacagcggagttccaagagaagacatggtggaaagggtggattgggccgttcaacaggtgaacatgcaagaatttctcgatcaagagccgcaccatctctcgggaggacaaaagcagcgtgttgcgattgcgggagtgcttgctgcccggcctgacatcatgattctcgacgaagcgacttccatgctcgacccgatggggcgggaagaagtgctggatacggtcagaaggctgaaagaccaaggaatggttacggtcatttcgattacccatgacttaaacgaagccgcgaaggccgaccggatcatcgtcatgaacagcggtagaaaatttgccgaaggcacgccgcaggaagtctttcgtctgaatcaagatctgattaaaatcgggcttgatttgccattttcttttcagctcacccaaatgctgaaggaaagcggtctggctctgaaaggcgatcatctgacacaagaaggattggtgaatgagctatggacattgaaatcaaagatgt

SEQ ID NO: 2063 - DNA, 711 bp, Bacillus licheniformis
tatacgaggcaaaggattttctgctcaccaaaaagcgtaaattctctttcagcctgtttactaaattgacatcagtaacttttttccttttagtaattggaggtgcgatcggcatatttgccatggaagcgcgctttgctttttcagggaaatcgtggcacgaggtatttttcttttctctgtttcagtcgacgacgaccaggagcggcggactcgcgacgatcgatatcagccaattcacgcatacgaccattttgtttatgtgtatgcttatgtttatcggcgcttcgccaagctctgtcggagggggcatccggacaacgacctttgccttaaacctgttggccctgttccacttcgcgaggggaaataaatcggtgaaggttttcaaaagggaactgcaccaagcggacttgatgaaatcattgattgtaacgctgatggcggttattcttgttttcgtctcgacactcattttgacagtgacagaaaagcattctttgcttgaactgctgtttgaagtgtgttcggccttcggtacgacgggcttgtcgatgggcatcaccccagatttgagcacgattggcaaaagcgtcatcatccttctgatgttcattggccgaatcggcattgtcacgctgctttatttattcggcagaaaagaaatcgaagcgaattaccattacccgaaggaaaggatcattatcggat

SEQ ID NO: 2064 - DNA, 650 bp, Bacillus licheniformis
atgaaaaaagaatttgcagtaattggactcggccggttcggcggcagcatttgcaaagcattgagtgaagaagggcttgaagtaatggcgatcgacagagatgaagatcgcgtaaacgaatacgccaaaattgcaacacatgctgtgataggagacactacagacgaatctgtgctgaaaaaccttggactgcgcaattttgaccatgtcattgtagcgatcggggagaacattcaagcgagcattttgacaacgctgatcttaaaagagcttggtgtgaaaatgattaccgtaaaagctcaaaacgattatcatgaaaaagtattatccaaaatcggagcggaccggatcgttcacccggagcgtgaaatgggaaaaaggatcgcccacaacatcgtctccaacaatgtgcttgattatctggaactttctgatgaacacagccttgtcgaaatcgcagcgaacggcaaactggccggaaatacactgcttgaccttgatatccgggccagatacggaattaatattgttgcgatcaagcggggaaaggaagtcatcgtatctccgcttgccactgaagaaattcagaaagacgatattttaatcgtcatcggctcaaatcctgacattgagagatttgaaaaaaaagt

SEQ ID NO: 2065 - DNA, 660 bp, Bacillus licheniformis
ctggtacaggcctttcccaagtggctgaaggcacagtccaaatcggaaactccgatgtctttgccgaagaaaaagaaggcattcctgccaaagaacttaccgatcatcaagttgcggttgtcggaatggcagctgccgttaaccctgaagtaggcatcgatgacatttcgttagaagatctcaaaaaggtattcacaggtaaaatcaaaaactggaaagaactaggcgggaaagatcaaaagatcacccttgtcaaccgtcctgattcttcaggaacccgcgcgacttttgtcaaatatgcacttgatggagagactccagctgaaggaatcacggaagattcttcaaacacagtgaaaaagttaatcgctgaaacgcctggtgcaatcggatatcttgcgttctcgtatatcaaggatgatactgtcactccgctttcaatcgacggcgttaagccgacagccgaaaatgtacaaaaaggcaaattcccgatctgggcttaccagcattcttatacgaaaggcgaacctgaaggcttggcgaaagaattcctcgactatttgatgagcgatgacattcaaaaatccatcgtgacggagcagggctacattccagtaacagacatggaagtaaaacgcgacgcggatggaaagcaaactg

SEQ ID NO: 2066 - DNA, 801 bp, Bacillus licheniformis
aaaaagttgtggttcttgaattgggatttattgatgcgctccttgatgcgggtattaagcctgtcggaattgcggacgacggcaaacctaagtttattaacgagaaggtcaggggaaaaatcaaagggtatacttcagtcggttcgcgcgcccagccaagctttgaaaaaattgcttctttaaagcccgatttaattattgccgattcgagcaggcacagcggcgtctatgataagctgtcgaaaattgcgccgacaatcgcgctcaaaaacttgaatgccgattatcaggacacgcttgatgcatctcttacgattgcgaaagccgtcggcaaagaaagcgcaatggagaaaaaattggctgaacataaacaaaagctggatgaattgaaacagaaattcggcagccggaaacagagcattcttctgctcgggaacacaaatgaagaaatcaccgtgcgcgatgaaaactttttcacgtctcagcttctgacgaaaatcggctatacatacggtgtcggagacagcggcaaaggcgatgccgaaaacggtgaatccgtcaatattaaaatgacgctcgaacagctgcttgagaaagatcccgacgttattgtcctgatgacgggagaaaaagataaagtcgatgaagacgggaaaagaccgatcgaaaaagatcctctttggaaaaagctcagcgcagtcaaaaacggcaaggtttatgaagccgacagattcgcctggtcgctccgacgcagcattgacggagcagatgagctgatggatgaaatcgatcagcatcttc

SEQ ID NO: 2067 - DNA, 804 bp, Bacillus licheniformis
aaaaaaggcgcagaaagctggctgcctacggccagaacacgatcggacagctgataccgcttcacctcattccttacgccgcttccctgcatccgaagtggacatcatattactataagcattacgcggcagatattccggtccatctgagcgcataccgctttcacgagccgtgggaagaaaacctgcggacattgtcatcggctgacccggagctcattatcagcatggacagcgtgtctcacgaggaacgggaacagctccagtcgatcgcggatgtcttctttttgccttcacaggaacaatggaggaggcattttatgctgaccgcatcccatttggacgaagaagcggaggctcacaaatggctgctgtcttaccagcgtctcaccgagaccgcgaaagaggcgctttatccgatctgcggacgccgaagctttttgtttttgcgcttgcataaacacgagatttatctggcgcataaccgttctgttcaagatgtatttttcggcgaccttggctttgaatcggctgtgtcgctggaagaaccgactgaccgggccgtgtcgatcgaaacaatcgcagcctatcagccggatatcattatgattttcatttttaaagagccggagacgctggcattctacagggagcttcagcagtcggctgcttggcaggatttgaaagcggtgcggcatcaccgggtgtatcaggtgaattctgatccttggcgggaatattccgcatgcagccatgaacgaatcatccgccaggcggttcggctgctgtccggaaaaaatccat

SEQ ID NO: 2068 - DNA, 708 bp, Bacillus licheniformis
ccatattaagcccgatatgaaaggcgttaagcaaatcggactcgaaggcgaaccgaatatcgaagcgattgccgagctgaagcctgatttaatcatcgggaataaaatgagacatgaaaaaatctacgacaagcttgaaaaaattgctccgactgtcttctctgaaacgctgcgcggcgaatggaaagacaacttctccctctacgcgaaagcggtaaacaaagaggaaaagggcaaagaagttttagaagatttcgataaaaaagtcagcgaattaagcgacaagctcggcgaccagaaaaagaaacgggtgtcggtaatcagatttatggccggccaatcaaggatttactataaagattctttcccgggaattatcctggatcagctcggattcaagtatccggaaaaacaggaaaaactgtttgagaaacaagacgacaaatttgtttttatgacggaaaataaagaatcgatccctgatatggacggagatgtcctgttctatttcacatataaacctgccgaaagcaaaaaagaagctgaaacatggcaaaacgattggacaagcgatccgctgtggaaaaaattgaacgctgtaaaaaccggaaacgcccatgaagtcgacgatgcgatctggacgacggccggcggcgtaaaagcagcgtatctgttccttgatgacatcgaaaaatactttttaaaatc

SEQ ID NO: 2069 - DNA, 570 bp, Bacillus licheniformis
atgtggctttatgagaaaaaactgcagtatcctgttagggtgagagaatgcaatccgagacttgccaaatttttgattgagcaatacggcggagcggacggcgaattggctgcggcgcttcgctatttgaaccagcgctacagcatacccgataaagtcgtcggactgctgacggacatcggtacggaagagtttgctcaccttgaaatgattgccacgatggtatataaattaacaaaagacgcgacgcccgagcagatgaaggaagccgggctcggcgatcattacgcagaccatgacaaagccctgttttatcataacgctgccggcgttccgttcaccgctacatacatccaggcaaaaggcgatccgattgccgatttatatgaagatatagcggctgaagaaaaagcgagggctacgtatcaatggctgattgacatgtcggatgatccggatttaaatgacgggctggcgtttttacgggaaagggaaatcgttcattcacagcgcttccgcgaagctgtcgaaattttgaaggaagagcgcgaccgtaaaaaagtgttttaa

SEQ ID NO: 2070 - DNA, 903 bp, Bacillus licheniformis
agcaaacattagcaattgcggcggcattgattctgattctcgccgccggctgctcctcgaaaagcagcagcgaagaaaacggaaagctgaaggtcgtcaccacctactccattctttatgacatcgtcaaacaagtcggaggggatcacatcgatttatacagcattgtacctgtcggaacagacccgcatgaatacgatccgcttcctaaagacgtgcaaaaaacgacggacgccgatgtcgtcttttacaacggattgaatttggagacagggaacggctggtttaacaagctgctggaaacagctgaaaaagacggtgatgacgcccctgtctacaagctgagcaaaggggtcaagccaaagcatctcaccgctaagggaaaagaaacggaagaagatccccatgcatggctcgacattgaaaacgggattcaatatgcaaagaacgcaagagacgcgctgatcaaaaacgatcccgaccataaagaagactacgagaaaaacgcggaagcctatatcggcaagctgcaaaagcttcatgatgaagcggtgaaccgctttaaagatataccgaaagagcgccgcgtccttgtgacaagcgaaggggcttttaaatatttcgcttcggcctacggcgtcgacgcgcagtatatttgggaaatcaacaccgaaaatgaaggaactcccggtcagatgaaaaaaatcgtcgacacagtgaagaaaaaggacgtcccggccttattcgtggagacaagcgttgacccgcggagcatggaaagcctttcagccgaaacgggcgtgccgattaaagcaaaagtcttcaccgattcgatcggaaagcccggtgaagcgggagattcctattataagatgatgaaagaaaaccttgaccggatccatc

SEQ ID NO: 2071 - DNA, 978 bp, Bacillus licheniformis
gatgggaatagcatatggcgcaggcgccgtcaggaaaaggcaggcggccttgtggatcagcggaattggcgtatttctgggcgccatgataggcggaggagaggttgtgaaaacaatcggttcaggcatcattcccgcgtctattctcaatgtgcatattgtcgtgattatccttggatcatccgcgatttcgctgtttatcgcgaacatcgccgggattcctctttcaaccagcgaggtgacggtcggctcgattgtcggggtcggcgtcgcgtttcaggcggtatttaccgataagcttttggtgatcgtcatgtattggctgatcattccgattgccgcattttttctcgcttttttaattggacaattgctgaaaaagactgaggcgaagctgcggtggctcaaacagcaaaaatgggcgcggctgcttactgcgctggtgattttaaccgggtttttagaagctttttcggcgggaatgaacaatgtcgccaattccgttggacctctcgttggagcaggcctcttgtcagtcggcagcggaacgtttcttggagggctgttcgtggctatcggggccatttgccttggaagccgagtcattgagacgaacggaaaaaaaatcaccgagttttcgcttttgcaagggtcctgtgtttcagggctcggtgcgtccctggtcatcggcgcttcgctattcggcattcccgtgccgcaaactcagattacgacttgcagcatcatcgggatcggcctttctgaaaagggaagggcaatttttcgtaaaagcgtcattttgaagttaatgaaagtatgggttgtgtcaccggttttttcacttgtcatttcctacagtctcgtgaaaatctttctcgattttgatttatattcagtggcagttgttttatgtgtttttcttgccactttaggatctataagccttatgaaacatgccaggcagaaacaatcagatgt

SEQ ID NO: 2072 - DNA, 943 bp, Bacillus licheniformis
atgagagtttttcagggagagggctggacatggtatcagcttggccctcacgaaaaaacaacagcacaagggctgatccagcccgatcattggccggaatgccgaaactggtttcaaggcgttccctcggccaacatcaattgccttgatatcaatgctgccgttcaaggcaaggaagcgatctacggttcatatatttacgaccaggaagcggaagttcaacaaaaccggacagcatttcatttttacttaacgaaagactattttttcacaatgaatttagatatctcgcaatttgaagaggcaaacagaaggccgatcgatcaacacttaaagcgatgcaaagacgcccctgaagtgttcctggtcctgctgggcgaactgatgagaatgtatttgaaggaacttgagcactttgaagttcaccttggaaaagtaaggtggggatttcatcatgacaacaataaaagcatcattgaactgattcataagcggcgtcacgaactcctggtcataagaagtttaattttatcgatgaaaaaggttgcaatgggccttaaagaaacttttttaaccaaatcgtttgacgaaatcgaacagcgcaggacgttttacgaaatcgacagaggcatgtcattgatcaaagagtatgcgaatgaaatcaattatttgcttcattccgaggaagtggtgacatcccacagaggcaatgaaatttttaaagcgctgacgatttttacgacgatctttacgccgatgacggctttcggcgccctgtggggaatgaacttcgaagtcatgcctgaactctctttaaagtacggctatttattttcgcttattttaatcgccgtttcgaccgcccttgtgtattggtatttgaaaaagaaaggctggaccggcgatttattgagggataaaaaacgatatatgaaaaggaagg

SEQ ID NO: 2073 - DNA, 736 bp, Bacillus licheniformis
atggtcagtcacgatttgtccaaacactcgcaaatatcaaaagaagcccaagatgcactggatggaaaaagcaaaggcttcaaaaggctgctcccttttttgggtccggcgtttatcgcggctatagcctatattgatccaggcaatttcgccacaaatatcgcggctggttcgaaatacggctacttgcttttatgggtaatccttttttcaaatattatggctttgctgattcagtcattgtcagccaaactgggaattgcaacgggtaaaaacctgcccgaagtcgcccgggaagaattccccaaaccggtctccatcggcttgtggattcagggagagcttgtcgtgatcgcgacggacttggccgaatttatcggagctgctctcgggctctacttgctgttcggcataccgatgcttgaagcatcgattattgctgccgccggatctttcgccattttggaactgcaaaggcgcggcgtcagaccgcttgaagcggcgataacaggaatgcttttcatcgtcgtgatcgcatttgcctttcaaacgttttttgcaaaacctgatatcggatcggttttggagggcatgtttgtcccccgcttcgatggtgctgacaggcatcctgctggcggcgggaatcttgggagcgacggtgatgccgcatgccatctatcttcattccgctctcacacagcgaagagtggtcggaaaaaacggaagcggaaaagaa

SEQ ID NO: 2074 - DNA, 594 bp, Bacillus licheniformis
ttggtaaataaagatattgtctggcatgaagcgtccattacaaaacgggaatatcatgagaaaaatcaacataaaagctcaatcatttggctgacgggcttaagcggttcaggaaaatcaacgattgccaacgccgctgcgcgtgagttgtttgcacaaggctaccaggtcacggtgcttgacggcgacaacgtcaggcacgggctgaacaaggacctcgggttttccgatgaagaccggaaggaaaacatccgccggatcggcgaggttgcgaagctctttgtcgaacaggggacgatcgtcattacggcgttcatttctccttttaaagaagatcgcgggcttgtcagacagcttgtcgaggaagatgagtttcacgaagtctatgtgaaatgcgatttggcgacgtgtgaagagcgcgacccgaaaggcttgtacaaaaaagcgagaaacggagaaattccatttttcacagggatcgattcgccttatgaagagcctgaaacgcctgagcttgttcttgatacaggcgcacataaccgggaagagtgcaaaaaccagctcgtccaatacgtgaaagatcaaacgaaataa

SEQ ID NO: 2075 - DNA, 552 bp, Bacillus licheniformis
ctccgatcgttatgggaatgttcggcatcctgatgtttgtaaatctgaccggatgggggtacagcataatcggaggagcgcttgctttgacgattttcaacctgcctgtcatggtcagggtgacagaagatgcgatccgctccgtacctaaggagcaaaaagaggcttcccttgctttaggcgtgtccaaatggcacacgattaaaacggtattgattcctggcgcggtgccgtccatcatcacaggcgcgattcttgcgtcgggccgtgtatttggcgaagctgccgctttgctgtttacagccggactaaccacgccgagactgaattttgccgattggaatccgttttctgagacatcgccgctcaatattttcagaccggctgaaacgctggccgttcatatttggaatgtaaacacacaggggatcatccccgatgctgaagcgatcgcaaacggcgcatccgccgttctcgttctgtccgtcttgatctttaacctggcagcccgatggctcggctcttttattcataaaaagttaacggcaaaca

SEQ ID NO: 2076 - DNA, 1290 bp, Bacillus licheniformis
  misc_feature (1)...(1290): n = A,T,C or G
gatcaggagctgtttgcccttcagcatatctaagggatttcaccnttcagctggcgatcttctggatgncaacttcatggctcgggatgggtattaatgcggcgccgtttgtcgnaggccgcgagccgaaaagacaggggctgctgntcgacattctgtttgggcgctgatcgtccntgtcgncggaagcatggtcggcgaatggctcggagcgaaaggcttttaaggaaacaactggttcttattcggccatcaaggaatggaatatattgaactcggccgcttttggcaggtcattcttgcgctcggcatgctgatttggctgtttatcgtcttcagaggcattaagagcggcctcaagcgggagcctgataaaggcggtttgattcatctgctgttttattcttcgatcgccattccgctgttttacggtgctgcctttttctttaatcccggcactaatattacaatgtcggatttttggcggtggtggatcatccatctttgggtggaagggatttttgaagtctttgccgtcgtggtcatcggctttttgctcgtgcaaatgaacctggtgacgaaaaagtcgactgtcagaacgctctattttcaattgacgatcctgctggggagcggtgtcatcgggatcggacaccattactattacaacgggtcttccgaagtctggatcggcctcggttccgtcttctcatgcctggaagtcatcccgcttaccctgcttgtattggaagcttacgaacaatacaagatgatgaaagacggcggacatcacttcccgtataaagcaacgttctggttcctgatttcaacggcgatctggaatctggtcggcgccggggtattgggctttttgatcaacttgcctgccgtcagctattttgagcacgggcagttcttgacacccgcccacggacacggggcgatgatgggtgtgtacggcatgtttgccattgccgtctggctgtatacgctccgcaatatcgccaaaaaagaagcatggaatgataaatggctgaaaatagcctgctggtcgctgaacatcggcctgttcggaatggtgtntatcaatttgctgccggtcggttttcttcaattgaaaaaagcgtttgaagacgggtactggagctcaagggcgcctgagtttttacagcaggatgcagtgcaaacgctgctgacttggagggccgtgccggatacgatctttttagccggaatcgtgattttggttgtattcagcatcagagcattattccatctccgcaaaccgac

SEQ ID NO: 2077 - DNA, 453 bp, Bacillus licheniformis
aatctgttgaagagcttgttgcaaaccttgatgcagtaccggaaaacatccgtacagctgtccgcaacaatggcggagggcatgccaaccactcattgttctggaaacttctttctccaaacggaggaggcgctccaactggtgaattggcagaagccatcaacagcaaattcggcagcttcgatcaattcaaagaagactttgcggctgcagcagcaggccgtttcggctccggctgggcatggcttgttgtcaataacggagagcttgaaatcacaagcacgccaaaccaagattctcctctttcagaaggcaagactcctatcttaggtcttgatgtatgggagcacgcatactacctgaattatcaaaaccgccgtccagattacattaaagcattctggaacgtcgttaactgggatgaagttgcacgcctttacagcgaagcaaaat

SEQ ID NO: 2078 - DNA, 759 bp, Bacillus licheniformis
tagctgtattgacgtcggttgttttgttcgccggctgccaagcggaaaaagggggatcagccaaggggcagtctgaaaaagttcaaattacggtttccgcggctgcgagtctcaaggatgttttaacagaactttcctccgtctatgagaaagaccatccgaatgtctctataaagtttaattttggttcatcgggtgcattgcagcagcagatcgaacagggcgctccggctgatttgtttttttctgccgctgaagacaaatttaatagagtagttgatcaagggttaattgacaaaaaagactctgtcaagctggtcgaaaacagtctggtgctgatcgtgccgaaaggaaaaagtcagcatgtcaacagcttcaaggatttggcggatgacaaagtcgaaaaaattgcgatcggcaaacctgaatcagtgccagccggaaaatacgcaaaagaaacgttgacgaaccttgacgtatggtctaaagtgcaatctaaagtcgtctacagcaaagatgtaaggcaggtcctttcttatatcgaaacaggcaacgcggatgccggaatcgtttaccggacggacgccctttcatcagatcaggtcgagaccgtagagacggcgaaaagcgatctgcatacaccgattgtctatccgctcggaattgtgaaaaatacaaagcacagggaacagtctgaggaattttatcaattcctgcaaagcgaccaagccgtcaaggcgatggaaaagtacggattta

SEQ ID NO: 2079 - DNA, 681 bp, Bacillus licheniformis
tccgcaggaatttgtatcgattcttcgaaaaatcccgcctcggctttattcgatcgcatcgagcttcgctgcaaatccggatgaagtgcatttgacgatcggtgctgtccgctacaatgcgcacggcagagaccgaaaaggggtctgctcggtattatgtgccgaacgtctgcagcctggcgacaccctgcctgttttcattcagccgaataaaaactttaagctgccggagaatccggagactccgattatcatggtcggccccggcacaggcgttgcgccgtttaggtcatttatgcaggagcgcgaagaaaccggagcatcggggaaatcgtggatgttcttcggcgatcagcattttgtcactgatttcttatatcagacagaatggcaaaagtggctgagtgaaggcgtgctgacaaaaatggatgtcgcgttctcgcgggatacggaagaaaaagtatatgtacagcatcgcatgctggagcacagcaaagaattgtttgagtggcttgaagagggagcggctttctacgtttgcggcgacaagaacaacatggccaaagatgttcaaaacgcattgcttgaaattatcgaaaaagaaggcggcaaaagccgtgaggaagctgaagcctacctcgcagaaatgaaaaagcaaaaacgttatcagcgcgatgtata

SEQ ID NO: 2080 - DNA, 567 bp, Bacillus licheniformis
aaaaatggcgattttaacttccattttgaagcacaatcagtcttttgtagaggaaaaggggtacgagttttacgaaacgacgaaatttcctgagaaaaaacttgtgattttgacatgcatggacacgcgtttattagaactgctccatcatgcaatgggtttaaaaaatggagacgcaaaaatcattaagaatgcgggagccgttgtttctcacccttttggaagcgtcatgcgcagcattcttgtggctgtctatgagctgcaggctgaagaagtctgcgtgatcggccaccatgagtgcggaatggcaagcctgaacgcttcatctatccttcaaaaggccaaacagcggggtgtcgatgatggctgtctcgaactcctgcagcattcgggcatcgatttggacacatggatgacgggctttgacagcgttgaagacagcgtcagccacagtgtgaacatgatccggaaacatccgctcttgtcttcagacgttccggtgcacggattggtgattgatccaaagaccggccgtttggatgttgttgaagatggttattcacgtga

SEQ ID NO: 2081 - DNA, 568 bp, Bacillus licheniformis
atgaagcacccttaccgggaactgatcatcgcaatgacaagaacgggaatattgggctttggcggcggcccatctgttatcccgctgatccgtcatgaagccgtttctaagttcaaatggatcgatgatgatgaattcggggaaattttggcgattgccaatgcgctgcccgggccgatcgctacgaaaatgtcggcatatttaggtcataaagtaaaaggcgttcctggtgctgtcgttgctacagcagcccatatcatgccgacatgcgccgcgatggccgccttgttcgcagccgttaatgtgctcagccactcaaaaatcgtaagcggcatgatcggcgctgtcacccctgtcatcgccgtcatgctcggcatcatggcttacgaatttgggcaaaaagcattgaaaggcttcggcttgctgaccggcgtgcttttctttattcttgcgtttttgggtcttcaagtgttttccatccaccccggcatcattgtcatcctgtttttaacgtttaaattaaaaagaaaagcggcccgagaaaaggataaaggagtgtccgcttcat

SEQ ID NO: 2082 - DNA, 1458 bp, Bacillus licheniformis
atgacgacaaataaaaacaacctaacaaccagctggggcgctccagttggagacaaccaaaactcaatgacagctggttcacgcggaccgacgctgattcaggacgtccacttgctcgaaaagctcgcccacttcaatagagagcgtgtgcctgaacgggttgtgcatgcaaaaggcgccggtgcgcacggttattttgaagtcacaaatgacgtttccaaatatacaaaagccaaatttttatcagaagtcggaaaacgcacgccgttatttgtccgtttttcaactgttgccggcgaaaacggttcagccgattccgtccgcgacccgcgcggtttcgctgttaaattttatacagaggaagggaactatgatctcgttggaaacaatacacctgttttctttatccgcgatgcgattaaattccctgacttcattcatacacaaaagcgccatccggtcacacatttgaaaaacccggatgccgtatgggatttttggtcattgtctcctgaatccctgcaccaggtaaccatcctgatgtctgacaggggcatccctgcgacttaccggcacatgcacggcttcggctcccacacattcaaatgggtgaatgccgaaggagaaggcgtctggatcaaataccacttcaaaacagaacaaggcattaaaaacctgaccgaagaagtggggacaaagattgcaggtgaaaaccccgattatcacacacaggacttgtatgaggcgattgaaaaaggcgacttcccggcatggaagctgtacgttcaaataatgccgctggaggatgcggatacgtaccgttttgatccgttcgatgtgacaaaagtatggtcgcaaaaagattatccgctgattgaagtcggccgcatggttctaaaccggaatccggaaaactatttcgcagaggttgaacaagctacattctcccctggaacattggtgcccggcattgaaccgtctcccgacaaaatgcttcagggacgcctgttcgcatatgcggatgcacaccgctaccgcgtcggcgcaaaccataacagcctgccgatcaaccgtccgaaagcggaagttcataattatcaaagagacggacaaatgcgctttgattcaaacggcggcggctctgtctactatgagccgaacagcttcggaggccctcaggaaactccggaaaacaaaacaacggcttatccggtgtcaggttcggcggacagcacggcctacgaccataacgaccactatacacaggccggagatctttaccgcctcttgagcgaagaagagcggacccgccttgtcagcaatatcgtaggttcgatgaagcaggtgacaaaagacgaaattaagcttcgtcaaattcagcatttctataaagcagatccggagtacggcacacgagttgccgaaggattgggcttgtctgttccgcaggaagtttaa

SEQ ID NO: 2083 - DNA, 1026 bp, Bacillus licheniformis
tcgtcccgtagcggggcctgtagtgagcgctgcacttttatgtttgttgtttatggcgccgatcgtattggcttatcatacatcagagtgggtgcagcaatctgcgtacatatgggcggttgtccgctccaaaatgcggtcgtgggcttgccgtcatggttgttgcgcggcattgtcggggaactatggcctgttatcccttggcaattactcgtttgtatgggcgtttcctgtcgttttgtttatgtctatagcgaatgcggcagcggatgattcgggtttaaaggaccggatcgtcgattcattggacccgctgatgcggaagatcggtctgaacggccgtgatttagttccgcttttgaccggatttggctgcaatgtcgtggccgttcagcagacgcggtcatgcagcatgtgtacgagaaagcgctgtgtatcgtttatttctttcggatcagcgtgcagctaccaaatcggtgcgacgctgtcgatttttcatgctgcgggaagggagtggctgtttattccttacctcgctgttcttgttgccgcagcggccgttcataaccggatatggtatcgcatcgatcagaaatgggccgcttacttcgagcgacggcaaacgtttttgcagaagccgtcctggaaagggatcgtctttcgagtaaaagaagtgcttcagcaatttatctttcaggcgatgccgatctttctcatcatttgcctggcggcgaccgtattgaatgaactcggtgtcatccgtcttgtgacattgcttgtctcgcctgttttaagcctgttcggcgctccagaagatgcggcgcctggccttgttttttccctgatcaggaaagacggcattctcttgttcaatgaagggaatggagcgcttcttgacatgctgccgggagcaacgctctttctgctcatttacttggcatcaacctttactccatgcatggtgacggtttggacaattgccaaggaactggggatgaaaacggcggcagccattatgggaaaacg

SEQ ID NO: 2084 - DNA, 615 bp, Bacillus licheniformis
  misc_feature (1)...(615): n = A,T,C or G
gtttgaacaatatctttttgattgcaggaatcatatttatcgcttttaatttaagaccggctattacagctgtcgggccattgatcagttcgatccgctcggatatggatttgacgaacggcatggccggcttcttgacgacgctgccgctgttatcgttcgccgtcctgtccccggtcgcccctaagctcggacagaagcttggcaatgagagaaccctctgggtcggattggtcatcttattgatcggaattttgctgcgctcttacggagaatctattacattatttgcaggaaccgcattgatcggagtcggcatcgcaatctgcaatgtgctgctgcccagcctgatcaaacataaatttcctgacaaagcgggaattatgacaagtttctatacaacagccatgtcgatttttgcggcgctcgcatcagggatcagcattccgttgtcgcacggcttancgtggggatggagcgcgtcgctcatggtttgggcgggcctcgcgtttgttgcgattttgatctgggttccccagctccgctatcatgatacgggaaaccgcacggtcagcttaaaggcagacggccaaacggtctggcgctcgaaaatgc

SEQ ID NO: 2085 - DNA, 444 bp, Bacillus licheniformis
atgacgatggctgaacataacctgaaagaagcgttggaagcgttgaaggaaaccggggtgcgaattactcctcaacgtcatgccattctggaatttctcgtgaattctatgtctcatccaactgcagatgatatatataaagctctcgaagggaaatttccaaacatgagcgtagcaacggtctacaacaatttgcgggtttttaaggaatcagggctcgttaaggaattaacgtacggagattcctccagccggtttgacttcgtgacttccgagcattatcacgcaatttgcgaacgctgcgggaaaatcgtcgactttcattatcccggcctcgacgaagtggagcagcttgcttcacatgtgacaggatttaaagtcagtcaccatagactggagatatacggtttatgtcaggaatgcgacaaaaaagaaagccattaa

SEQ ID NO: 2086 - DNA, 816 bp, Bacillus licheniformis
  misc_feature (1)...(816): n = A,T,C or G
aggaagagaagccgccgagctataaaacgcctcaaaaaatcgggctgctgcttggtcctgcattgtttttcgctgtccttttgttcttttttcccgagggtctgagctatgaaggtagaatggtattggcgactactttgtgggttgcggtttggtggattacggaggctgttccgattccggctgcatcattgctgccgatcgtgctgcttccgctgacgggggcgctggaaggggcagctgtcacgtcgagctacggcgatccgatcgtctttttattcttagggggcttcttgattgcacttgcgatggaacgttggaatctccataaacggattgcgctcaatattatttctgtagtgggcacgagcacctcgaggatcgtcctcggttttatggcggccacaggatttttgtctatgtgggtctcaaatacggccgcggtgatgatgatgcttccaattggaaccgctatcattcatcangtatcagctgtcataaagtctgaaagaaaagatttagccgcagaagaggcgaaattttcaaaagcgctgatcttcagcatcgggtatgcggggacaatcggcggactcggtacgctgatcggcacgccgacgaacattattttggcgcccaatattaaaaaactgtacggagtcgcagtgtctttaagcggatggatggctcttgccgttccggtcgtcgtcattttgcttgtagcggattcgctgtacttgacgaaagtggcgcatccgatcaagatgaaggatcttccactcggaaaagattgattctcgaagaaaaaagaaagcttgg

SEQ ID NO: 2087 - DNA, 648 bp, Bacillus licheniformis
tgttcgctgcgcttgcccttttactagccgcctgcggaaatcaagctcaagctcaatctgcggagaagcacggcagcaaagattcctatactgtaaagcacgcaatgggaacagcgacaattgacggcactccgaaaaaagtcgtcgtactcacgaatgaagcgacagaagcagtgctcgcacttggcgtaaaacctgtcggcgccgttcaatcctggctgggagatccatggtatgaccatattaaagataaaatgaaaggcgtagagaacgtcggaacggaggctgcgccgaatattgaaaaaatcgcgagcctgaagcctgacttaatcatcggcaacaaaatccgccaagaagaagtatacgacaagctgaaagcaatcgcgccgaccgtatttgccgagacattgtcaggggaatggaaaaacaactttaagcttactgccgaagcgctcaataaaaaagctgaaggcgaaaaagtcatcgctgactttgacaagcgcgttgaagacattcatgaaaaactaggcgataaagtgaaacaaaaagtctctctcgtccgctttacagatgctgatacccgcatctatcacaaaggatcatttgccggaacgattttggatcagctcggttttgcaaggcctaagg

SEQ ID NO: 2088 - DNA, 816 bp, Bacillus licheniformis
  misc_feature (1)...(816): n = A,T,C or G
gctttgttccgtctggcgaatttgcatctttggcaaggcgcggcttgatgcctgaagacgcttcaatcgccgcaggcgcgccccgatttgcagattatccattcaagcttggagtggcttcaggagacccgcatcccaacgggtttgtcatctggacgaggcttgcccccgatccgcttgccgaagacggattagggggaatgcctgacaaagctgtccctgttcagtgggaagtagctgaagatgaacattttcacaaagtggtgaagcgcgggacgtcctctgcgctcgctgagcttgcccactccgttcatgttgaagtgcacggtttaaagccgggaagctattattggtacaggtttaaagcgggcagggaaatcagccggacaggccgtacaaaaaccgcgcctgccccgcacgccgacatcaaggggatgtcgttcgccctcgcctcgtgccaagcttggtaccacgggtattttacggcttaccggcatatggccgaagaccatccggacgttgtttttttcctcggagactatatttacgaatatgccattaatgctaaaaatcttttccgcgatgtgactttatccgctgcccacaacgcaaaaaccgtcaccctcagccaatacagactcagatattctctttttaagacagatccggaccttcaggccattcatgcgctggctccctgggttgtgacgatggatgaccatgaggttgaaaacaattatgccggcatccattcgcaatacaacacttttccggacgattttctccggcagcgcgcagcggcgtacnaacgatatg

SEQ ID NO: 2089 - DNA, 535 bp, Bacillus licheniformis
atgatcatcttttatctgttttgggccttctttattgcaaacttattgggctacggaggcgggccagcttcaattccgcttaattttgaagaagttgttcagcattttcactggctgtcaaaagaggaattttcaaacatgcttgcgcttgcaaatgcgctgccaggcccgatcgccacaaaaattgcagcttatgtcggctacagcgtgctcggatggcccggtgttttcattgctcttgccgcaactgtgcttccctcggccatcgcgctcgttttgctgctcaagctgatcggccgctaccgccagtcgcaggtcgtcaaaggaatgaccttgtcggttcagccggttatagccgtgatgatgcttcttttaacatgggaaatcagcggcgacgcgatccattcgatcggcatggttcaatcacttgtcatcgcgctgatctctttagtcgccttgacgaagttccgcgtccatccggctttcctgatcgtggcggccttcgcttacggcgggcttgtcattccgctgctgt

SEQ ID NO: 2090 - DNA, 519 bp, Bacillus licheniformis
gtgcgatctccgctttgaaaaaagcgggtattaaaaaaacggtgatgctgacgggcgacgcgaaagacaccggtgaggcggtcggcgaacagctgtccattgatgaagtgcatgcggagctacttccgcagcacaaggtggaccgtattgaaacattagataagcaaaaacttccaaaagaaaagctgctttttgcaggagacggcatcaacgatacgccggtcttggcgagagcggatatcggggttgccatgggaggcctcggttctgatgcggcagtcgaagcggctgatattgtgatcatgacggatcagccttcaaaaattgcggaagccatcagcattgccaagcggacgaggacgattgtctggcagaatattatttttgcactcggcgttaaaggagtttttctcatcctgggtgcttttggcatcgcgacgatgtgggaagccgtcttttcagacgtcggtgttacccttctggctgttttaaatgcgatgagggtattaaaagtgaaag

SEQ ID NO: 2091 - DNA, 544 bp, Bacillus licheniformis
atggttcaaaaaatagagaaactgtccgcgaaagagcggctgatcagctccaagcataatcgcaaaatggatgaaatccgcgggaggattttggttgcgtcgtgcgcctttatcatgatggcggcagcgatttcgatcacaatttttctcggaaataaggggttgcaatcttttctggccaatggtgtaagtccaattgagttcttaaccagtctagattggaatccaacgaacgaaaaccctgaatacggagcacttccgtttatactcggatcttttgcagtgacccttcttgcatctttgattgctgcaccgctaggaataggaggtgcgattttcatgacggaaatcgcgccatcatggggcagaaaagtgctgcagccggttgtcgaattgcttgttggcattccttccgtccgttatggattcataggccttacagtgttagtgccgttcatttcacagtttaagtcaagcggatcgggccacagcctttctggcgggaacgatcgtacctggctcgtcatgattttgccgacggtcc

SEQ ID NO: 2092 - DNA, 717 bp, Bacillus licheniformis
ccctgatccttgatgaaatcggatttttcgagtgggccgccctgcacatggccaaggcagctaaaggaaacggcattcggatgtttgtctatgtcaccctgctgggagccgtagtagccgcgctgtttgccaatgacggagctgctttaattttgacgccgattgtgcttgccatggtacgcgcgttaaattttcaagaaaagctcgtttttccttttattatcgcaagcggatttatcgcggatacaacatcgctgccgcttgttgtcagcaaccttgtcaatattgtctcagcagactttttcaacatcggatttatcgaatatgcaacaagaatgattgttccaaacctgttttcgcttattgcaagcatcatcgtgctttttttgtttttcagaaaaagcattccgcggcattatgacatgacaaatgtaaaacagtcagcggaagcgattagagacaggaaaatattccgcttgtcatggctcatattaaccgtttctgttggcccggttactttatcagcggagctgttattcgatccctggactcgatcattcgggggtcgtgatccgccgttctttttgcttaattacagggtaagaaacagtgcccgggggtggtaacgaaaataaagtggctgaaaaggaaacccctttgggcgaatcggttttttttcatgattcggtatgtttgtttatggggtttaccgggttt

SEQ ID NO: 2093 - DNA, 534 bp, Bacillus licheniformis
ttcagccaacccaaacattgtccatgcccatttcacaagcccaacaaagaaaaagttcacgaactgatcgaccgtttggctttgttgcggcaaacattttacaagcgtccgccgcagttcgatcgcctgcgtcgcattgccgacgtccgggttggcgatgaccgaagcggaccggtatttgccgaagctgattgacaaaattgatgaaattgttgaagaaaacggcttgaagaatgaagaaattaccatccgcatgacagggtgcccgaacgctgcgcccgccatgcgctcggcgaaatcggcttcatcggaaaaggccccgggcaagtacaatatgtatctcggcgccgcttttgacggcagccgtctgagcaaaatgtaccgggaaaacatcggcgaagaagaaattttaaaagaacttcgcaatattcttccgcgctatgcgaaagaacgcaatgaaggagaacgtttcggagatttcgtcatccgcgccggaattgttaaagaaacgacggacggaacgaattttcatga

SEQ ID NO: 2094 - DNA, 396 bp, Bacillus licheniformis
  misc_feature (1)...(396): n = A,T,C or G
atggttacattatatacatccccaagctgcacgtcttgcagaaaggcgcgcgcatggctagaagaacatgatattccgtttacggaaagaaatattttttcagagcctttatcaattgatgaaataaaagagattttacgaatgacggaggacggaacagacgaaattatttcaactcgttccaaagtgttccaaaagctgaacgtcaaccttgaaacaatgccgcttcaagagctgtaccagctcatcaatgaacatccgggccttttgcgccgtccgatcatcattgacgaaaagcgcctgcaggttggatacaacgaagacgaaatccgccgcttcctgccgcgcaaagtgcgcacattccagcttcgtgaagcgcagcgtcttgcaaantaa

SEQ ID NO: 2095 - DNA, 942 bp, Bacillus licheniformis
gcctatatatgtccgcatcgcaatcattatccttttattgatcctccttttcggtcagctgatcaccttcgtcgagccgcagcagttttcaaatgtttttgaaggcatatggtgggccctgatcaccgtgtcctcagtcggatacggcgattttgtccctaaaacagcgctcggcaaaatcgtcggcatgctcctgattttaataggggcagcgtttgtcacggcctattttgcaacgatggcgacggccgctttcagcaagcagcagcgctacgccgaaggcaaggtgaactacagaggcaaggggcatatgatcctgatcggctggaacgagaaatccaacaagctgatgaggacgctccaggccgccgattcaaacaaaacgatcgtcctcattgatgaaacgctaaaggaaggtcccctgatggaaaacattcatttcatcagaggacacgcagcggatgatgccacactgcaaaaagcgaatatcgaagaggctgaaatcgtctttataaccgccgatcagcataaaagcgaaatatctgcagacatgcagtcggtcttaacattgctggccgttaaaggcttgaacccgtcggtgtattgcgttgtagaaatcttgacggaaaagcagaaaaaaaatgccgagcgcgccggagccaaccaaatcatcagtacggcggaccttttaaaaacggcgatgctgcagcattttctcattaaagaccagcttcctgatccgctttttacggaagcggatattcatttcaaagtccatcgggttccgcttccgaagacgatggagggcgcgtcttttcaagaagtgatccgccattttatgaaggaagacattttcatcatcggtgtccaccaaaaagacgggcctgtgctgtctccttctttttcgtacaagctacagccgacggaccagctgctgtccct

SEQ ID NO: 2096 - DNA, 507 bp, Bacillus licheniformis
ggaaaacattttattatacattggctgcgcttcgtaaaaaaatgcgctggcccactgtgatcaagctgtggatgttcagctatgcaggaaatttaatgggcgccgtttttttcgcaggcctcatctttgcgaccggcttatttaaagatccttcttccaccggctttattctcagcgtggcggagcataaaatgaatacgccggtgaccgaattgttctttaaagcgattctgtgtaactggcttgtctgccttgcgtttttcgttccgatggcgcaaaaaggggacggagcgaaaatgttctctatgatgctgattgactttactttctttatttgcggttatgaacacagcatcgcgaacatggccacttttgccgtctctctggtcaccgagcatccggagaccatttcgattgcaggcgcaatccataacctaattccggtaacactcgggaacctgatcggaggcacgtatatgatgggcttcatgtaccactatgccaaca

SEQ ID NO: 2097 - DNA, 654 bp, Bacillus licheniformis
acggatgcagaaatcttacgccgttttcgggctcggccagttcggcggcagccttgtgaaagccttccacgcaaaaggggcggaagtcttaggcatcgacaaatcagaagaaaaagtaaacgaatattctacttatgcaacctacaccatttgcgccaacgccgttgatgaaaagaccttgaaacaaatcgggatacgcaacattgaccacgcatttgtatcatttggcgatgacattgaagcaagcattctgacctcgcttttgctgattgaaatgggcgtccccaaagtatggacgaaagcacaaaatgactatcaccaaaaagttctccataaaatcggcgtccatcgtatcattcatcctgaaaaagatatggccaagcggatagccagccatatcacgtcggaaaagatgatcgattttgtcgagctgtcgccaaactacagcatcgtcgaaattgtggccactaaaaagctggacaaaagaagcctgggggatatcgacgtacgcgccaacttcggctgcaatatcgtcggcataaaaagggacgggcatttcatcatcgcaccgagcgctgatgacatgatatatgaaaacgatattttgattgtgatcgggcaaaataaagatattgagacctttgaaaaaaaggg

SEQ ID NO: 2098 - DNA, 387 bp, Bacillus licheniformis
atgtctaccagcagcattgtcgttctcttgatttgcgccgcgctcatcatctacgcggtcgcttcatacatctatcagcagcgcattatgaaaaccttgacagaagaagaattccgggcaggctatcgcaaagcgcagctcatcgatgtgcgcgagccgaatgagtatgaaggcggccacattttgggtgcgagaaacattccgctttcacagcttaagcaaagaaaaagcgaaatccggcctgacaaaccggtttacctgtactgccaaaacaacgtcagaagcggaagggccgcccaaacgctccgcaaacacggctgtaaggagatttacaacctgaaaggcgggttcaaaaaatggggcggaaaaattaaaacgaaaaattaa

SEQ ID NO: 2099 - DNA, 495 bp, Bacillus licheniformis
accagatgaaaacgccttttgaacgcctggcgatctatgatgtcaacgctgtgattaaagaaggaagctatgtcgccgtaatcggccatacaggatcgggaaaatcgactttgcttcagcacctgaacgggcttttaaaaccgacaaaaggacagatacgcctcggcgaggacgttcttgaagcaggcaaaaagaataaacatctaaaagctttgcggaaaaaggtcggcattgtctttcagtttcctgaacatcagctgtttgaagaaacaattttaaaggatatcgcattcggtccgatcaactttggcatgagccgggaaaaggcggaagaaaaagcgagggaaatgctgaagctggtaggtttgggtgcagagctgtccgacaggtctccgtttgaactaagcggagggcaaatgcgccgcgtggccattgcgggagtgctggcgatggagcctgaggttcttgtcctcgatgaaccgacggcagggcttg

SEQ ID NO: 2100 - DNA, 915 bp, Bacillus licheniformis
ccttttactcgctttcgctgtatttctttcaggctgtcaaagcggccagaaacaggctgcatcagagaaaaatgaagagaaaacaagagtggtgaaaaccatcaacggaaatgtcactgtaccggctaatccgaagcgcgtcgtgacgattggctatgcgggaaccatgcttgcattcgggatcaagccgcttggagaaacgggaaagtacctcggaagtccttatattaaagatcaagtttcaggaataaaggatatcgggggaaaagacggtttttcagtatctgtggaaaaagttcttgaacttaaacccgatttaatcgtatcgatgacgaacgattcaaaagaatatgaaaagctgtcaaaaatcgctcccactgtcgtctatccgttcggcacatttaaagatgcacgcgatgaaatgaaaacgtttggcaagctgctcggcaaggaaaaggaagctcgggagtggacgaaaacgtttaatcaaaaaatgaaagccgcccgcgcgaaaattaaagatgcatctgtaaaaggtgaaacgttctctttaatcggcgcatatgcaaaatctttatatgtctacggggcatacgggtatcggggcggagaagcgatctatacgcagctgggactgacgccgcctgaatctgttaaaaaggatgccattgatacagctgacggatataaagccatatctttcgaggtcctgccgaaatatgccggagactacatatttgtcgacgaatcatacaacggaaagcttgatcaggacaatccggtttgggcatcgcttgacgcggtgaaaaaaggcaaggtctttttcctcgatccggacagattttggccgtatgatccaaacgctgttcaggcacaggccgaagaaatcgccgacatgatttccaagaaagcgaa

SEQ ID NO: 2101 - DNA, 582 bp, Bacillus licheniformis
tacattacatattgctcgcatgtatgtccgtttgtttggcagctgcatgcacacagcaaaaagaaatcgagcaaaaaaatgccgaacaggaacataaagaaacttttgaaacgatgacacagccattaaaagtaccgctgatcaaacgcgacgggacggagaccggttttatagaagtgtatgaatctgctgcagaaggccttgatattagagtgagcgcccatgatctgccgccgggcatgcttgcttttcatattcatgaaacgggcgtttgcaaaaagcctgattttgaaagtgcgggtgctcatttcaatcctgatcaaaaggagcacggctttaacaatccaaaagggccgcatgccggtgatttgccgaatattgaagtcggagcagacggcaaagtcgacgtcatcgtcaatgcgccggcagtcaccctcgatcagaaaagcaggttcagtctgctggatcatgacggaagtgcttttattattcacgagcatcaggatgacgatttgacaaatccatcaggtaactccggagcccggatggtttgcggagcgctgacgaacagcggaaaaaagt

SEQ ID NO: 2102 - DNA, 350 bp, Bacillus licheniformis
atggctttggatttttactggtatccgaaatgcgggacatgccgcaaagcgaaaaaatggctcgaagaccacggaaaagaaatcaatgggatacatatcgcagaacagccgccgagcaaggaaaaactgaaagagctctacgagaaaagcgggcttgaattgaagaagtttttcaacacgagcggccaaaaataccgcgaactcggcctgaaagacaagctgcaaagcatgtctgaagatgagcagctggaactgcttgcatcagacggtatgctgatcaaacgcccaattacgacagacggcagtaaagtaacggtcggttttaaagaagatcagtttaagacatactg

SEQ ID NO: 2103 - DNA, 525 bp, Bacillus licheniformis
atttccgttatttttatttcgcttgcggacggattcaatacgggatctgttcagctatttattcggcagcgtcagcgctgtttcacgggaagacatgctggtgatcgtcggcatttccgcagccgttttgatcgtggtgttttccctttttaaagagctgtttcttctgtcgtttgatgaagagcatgcaaaagcttcagggatttccgcaaagtggattcattttatttttattttgatcgttgcgcttgttatcgccgcctcaatgagaatcgtcggtacgcttctcgtttcagcgctgatgacgctccctgtcgctgcgagcatgcgcattgccaaaggatttaagcaggcgattttcttatcgatcctgttcggtgaactttccgtcatcgtcggccttgtgcttgcctatcatctcgatcttgcaccggggggaacgatcgtgatgctgtcgatctttatcctgatactgtgcatcagttataataaagtcaaaaggaggattcgccgtgaacgtacagg

SEQ ID NO: 2104 - DNA, 414 bp, Bacillus licheniformis
atattgtaacgagctgcaaccttctggccgacctgcgcgcaaatgtcaacgctgaatcgcaaggcagactgcaagtcgcacggctgtacgaaatgacggatgacagaggcgtacaagatatgctcggttttcttttggcaagagatacgatgcaccaaaaccagtggattgccgcgatcaaagagctggaagaaaaagaaggcgtcatcgtgcccggtaccgttccgccagaatatgaaaaagaagaagtttcgcactctttatacaatttttcggatggagaagaaagcgcacagtttgagtggctgatagggaaggcgccggacggagcggaatttcactatgagagcggccctgtcgcatatggagaaaaaccggtcttgaagcccgctccaaaacgaagccacaatacac

SEQ ID NO: 2105 - DNA, 957 bp, Bacillus licheniformis
  misc_feature (1)...(957): n = A,T,C or G
atgatgctgtttatcctcgcttcatgcggcggacaaaagaccgaaaagatccgtctggcggaagtgacccgttccgttttctatacgcctttatatatcgccttatctgaaggtttttttaaagaagaaggccttgatgttgaactgaaaacgacctggggcggagataaaacgatgactgcccttctgtcaaacggcgccgatattgcgcttgtcggctcggaaacgtcaatatacgtaaatgcncagggcgcaagcgatccggtgattaattttgcacagcttacccagacggacggaaccttcctcgtctccaggaacgattcggggcatttcagctgggatgatttgaaagacaaaacgttccttggccagcgcaaaggcggaatgccgcagatggcaggcgaatttgtcctcaaacagaaaggcatcgatcctaaaaaggatgtggatctgatccaaacgattgatttcgcgaatatcgcaaacagctttgcatctggtacaggtgattatgttcaattatttgaaccccaggcatccatttttgaaagagaaggcatcggccgcattgtcgcctccttcggaaaagaatcgggccgaatcccatatacaacttttatggccaaacaaagctatttaacgaaaaacaaagaagcggtcgaaaagttcacccgcgcggtttacaaagcgcagcagtgggttgagacgcactctgcaaaagaagcagccgaaagcattcaagattattttaaagataccgagctttcaatcattgcatcttcaatcgaacggtataaacaacaacagtcttttgctcttgatcctgttttggatgaaaaagaatggaaccagcttcaaaccatcatggatgaagccggcgagctgccgaagcgcacccctcatcaaaagctggtcaatacaaagatcgccgaaaaggtcacaaaaaattactag

SEQ ID NO: 2106 - DNA, 954 bp, Bacillus licheniformis
atgacgatttcgggatttatctttgatattgcccatgaaagaaagctattcttctattatcagaacccgagaaaaaacaaaggggaacggagggatcgtgaattgtcagtattaaaaagccctgaatgggtatacaaacgattaatggaaaaaacggaccaaacagttattgtcgacgtgaggtttcatttgacaaaaccggacgaaggccgaaaagcgtatacgaaaggccatgtgcccggagccgttttcattgatttaaaagaagatctgtcgcgcaacccggaagagcacggcggcagacacccgcttcaagaccctgaccttctggccgcgaagcttggaaaaatcggcattgaccggcaaacagatgtcgttgtttatgatgacagcggcggcatgtttgcagcgcgcttttggtggcagcttcactatctcgggcatgacagcgtctatatcatggatgggggactgtccaactggatcaaagcgggctacgaggtgaacgccgaggatcctcgtcctagcgagcgcgaatttaagccggcgctcagagaaaacgaactgctcgatgccaaagaagtactgaagcgaatcggcagagaaggctccattctgatcgatgcgcgcgatccttcaagatacaccggggaaaccgagcctctcgatcatcgggccggccatattcccggcgctaaaaactttttttggaaaggcaatctaaccgaaggcggattatggaaaagcaaagaacagctcagacagcattacgctgctttggacccgggcagtgaaatcgtcgtctattgcggatcgggcgtatcagcctgcccgaatgtactcggcttaaaagaagccggatttgaaaatgtgaagctgtatgccggcagctggagcgattggatcagctacccagaccatccgatctccactggagccgaggacgatatttga

SEQ ID NO: 2107 - DNA, 324 bp, Bacillus licheniformis
gctatacccatagggagcagacatcgtttccgcgactcggcacagttattggtttctgcaagccggaacagctttactatgtcgctgaaaaaacgactacgatccctcgggactacggaaaccgttcggtccgcaaaaatgcccgcttcaagtatacggttgaccgcctcggcttggaaacgggcaaaaacgaactggaaaaccgtctcggctggagcctcgctgaagcatagccttatcatttcgagcataacggcgaccgctacggctgggtaaagggcgtacaacgaagatggcactttacaatgtctgtggaaggcgggc

SEQ ID NO: 2108 - DNA, 648 bp, Bacillus licheniformis
tatccccaattgaaatttccatccaagtatcagccgcagcgggcatcatcgccgttttgcttggaactgctgcagcgaggctcctggcgaacagaaactttaaaggcaagtccattatcgagacggtgatgatgctgccgctcgttctgccgccgaccgttgtcggattttttttaattgtgatcttcggaaggcagagcgtgatcggacgcttgattgaaaacgtgtttcaagcgccggttatttttacctggtgggcagctgtgatcgccgcggcggttgtcgcgttcccgttaatgtatcagtctgcaaaatccggatttctggctgtcgaccgcgacatcgaggatgcagcgagggttgacggagcaaacgaatggagggtgttcctctttgtcaccgttccccttgcatccaatggaatcatgacggggattgtgctcagctttgcgagggcgcttggcgagtttggcgcaacgctgatgtttgcgggcattatcccgggggtgacgcagacggtgccgacggcgatatacttggcgatcgattcgggcaatatgacgctggcatggatgtgggtcgcctctatcgcgatcatctcgtttttgatgctgttttttgtgcagttcaagcaaaaatagccgtatg

SEQ ID NO: 2109 - DNA, 933 bp, Bacillus licheniformis
atgaccggtctcatctatccggttgtcggccattggacttggggggaaggctggctgtacgacctcggatttgtcgattttgccggatcttcaatcgttcacttgacaggcgctgcgggcgcagttgcggctgtcatgtttctcgggccgcggatcggaaaatatacaaacggcaaggtcaacgccattccagggcacagcattccgctgggcgctctcggcgtctttatcctgtggttcggctggtttgggttcaacggcggaagcacgcttgcggctgatcccgccgccgtcccgcacgtcatcaccacaacccttttagcggcatcgggcggagtcgtcagctcggcgctgttcacttatttccgctacggcaggatcgatccttccctgacgctgaacggcgcgctaggcggccttgtcggaattaccgcgggcgcggacggcgtttcatttacaggctcgatattgatcggattcatcgccggtgtcattttagttgtcggcgttcagtttatcgaccaggtgctgaagcttgacgatcccgtcggcgcccttgccgttcacggtatttgcggtgtttgggggacgcttgcagtcgggcttttcaatacatcgagcggtctcttttacggaggaggagccgcacagcttggcattcaagccgtcggcattttgtcgatcgcggcctggaccctcgctgccacatacgctgtcgccgcggcaatgaaagccctcgctccgatcagggtatcaaaagaggaggaaatttccggactagattatgccgaacacggttcttccgcgtacgagtataaagaaagctacatcgatcaggacgatgttgacgtaagctccgctttcggaacggatcttgtctcacggctcaacaatttaaagcctggaccttcttccaaaactgaacaggtgtga

SEQ ID NO: 2110 - DNA, 405 bp, Bacillus licheniformis
  misc_feature (1)...(405): n = A,T,C or G
tcacggctttgatcggtccgtcaggctgcggaaaatcgacttttttaagaagcatcaaccggatgaacgatctgattccatcagccagaacatccggagaaatacggtatgaagggcttaacatccttgattccaatatcaatgtcgtcaatctgagaagggagatcggcatggtatttcagaagccgaacccctttccaaaatcgatttacagcaacattacccacgcattaaaatatgcgggcgaacggcggaaatccgtgcttgatgagatcgtggaagaaagcttgacgaaagccgcgctgtgggatgaagtgaaagacaggctgcatgagtcggctctttcgctgtcaggcgggcagcagcagcgtctctgcatcgcccggacgctcgcgatgaagcccn

SEQ ID NO: 2111 - DNA, 396 bp, Bacillus licheniformis
catttcacggacggagatatcggacatatcagtcgatcaggcagaacggtataggggattcgctcggaggaacgatttctctcagacgggcgcttgatgatccgtatatgttagggaacgtcattatgcagtcaccttatgtagaccgccatgttctcgataaagtgaaacagtccgattccctgcagcttatttcaatttgccaccaaatcggcgagaaggaaaccgccgtcaaaacgaccgatgatcaaattttggatttcacaggtccaaatgagcaattaaaagagttgcttgaatcgaagcagacaaatcgcgatttcaaagcttttgacggggatcacaaatggacgtactggcagccgctcatcacccccgctttaaaaaaaatgctgt

SEQ ID NO: 2112 - DNA, 280 bp, Bacillus licheniformis
ttgttcaagcatacgaaagtgctgcagtaccctgccaaacctgaaagacccgaccctgtcttcgcaaagaaaatgcaggagatactcggcggccagtacggagaaatatctgtggcgatgcaatacctttttcaagggtggaatacgcggggaaatgaaaagtataaagatttgctgatggatacggcggcagaagaaatcggacacgtcgaaatgattgcgacgatgattgcacggctgcttgaagacgctccggtttacgagcaggaaaaagcagcag

SEQ ID NO: 2113 - DNA, 467 bp, Bacillus licheniformis
atggcattacaaatattgttgaactttattcttgcgttgtgctggatgtttctgaacaatgactacaccgctgccgggtttgtcatcggttatgtgatcggattattctcgctctttctgatgaggcgttttttccgccgccgcttttacttgattaacatttgggcgatcgtcagactgctgtttatttttattaaagagctcgtgctggcaaacgtcagcgtattaaagacgatcttgtcaccgcggttaaaaaataagcccggcattttcgccttcaagacagatcttaaagcggactgggaaatcacgacgttggcaaacctgattacgctgacaccgggcacattggtcgtcgatatctccgatgaccgttcgattctttatattcatgcggtcgatatcgatgatgccgagaaagccatcagtgatatccgaatttcgtttgaagaggccattaaggaggt

SEQ ID NO: 2114 - DNA, 334 bp, Bacillus licheniformis
ttgagttggctcctcgtaattgctgcgggttttttggaagtggtgtgggcctcaggtcttaaacatgcggattcattcgtcgattggctgatgatctttgtactgatcgcggtaagctttattatgctgatacgatcttacaggaacattccgatggcgtcggcttataccgtatttgtcgggatcggaacggccggcacatatgtgacgggtatttttatgggcgagaccttttcaggagggcaaatattctttttgatcgtgctgttgggaggcattattggcatgaagatgtttacaaaagagaacaatgcccagtcaggaggtgatgaat

SEQ ID NO: 2115 - DNA, 316 bp, Bacillus licheniformis
atgccatggatgtttttagtgatttccggaatcgaagaggttattgccgccatcgctatgaaatatgtagacggcacaagaaaaaaatggccgattatcgtcatggtgttggggtttggcttgtcttttttctgcctttcaaaagcaatgcagatgctatcagccggtgttgcatatgccgtatggaccggaatcggcagcatcggcattacggcagtcagtttattttggtttaaggagcgtattcgtgctccgcagctcatctcgcttggctttattataatcggggtgatcggcctgcgccttacatcatctt

SEQ ID NO: 2116 - DNA, 597 bp, Bacillus licheniformis
tcggatgcagtaacctttccgtccgtttttatcatcgtcctgaaacagtcttggaccgggtctcgctgtcgattgagcagggagaaaaagtgctgatactcgggccgagcggaagcggaaaatcgacgctgttgtccgtgctttccggcatcattcctgaacatatcgaagctgaagtcacaggcgaggtcaaccgcagaaagagcgccggcgttatgtttcaggatccggattcgcagttttgcatgcttcatgttgatgaggaaatcgcgtttagccttgaaaatcgatccgttccgccaaaagatatggaccgcatcatctcggagctgatggagctggtcggtttaaagatagataagaaaacgccgatcgaaaccttgtcaggcggtatgaagcagaggctggcattagcgtgcctgctcgctttggagcctgaagtgctgttttttgatgagccgacggcgcagctggacccggccagccggcaagacatctttgccttgctccgcgacgtttcccgaaaaagcggacagacgatggtgttcgtcgaacacgtgctggacggctgtatcgagtggatggaccgagtcatct

SEQ ID NO: 2117 - DNA, 681 bp, Bacillus licheniformis
ttttctgcaagttcaggatgtcacacatacttacttttcattgaaggaaaaaacagcggcgctggaaaacgtcagcattgaagtcgaaaaaggcgaatttgtttcgtttctcggcccaagcggatgcggcaaaacaacgcttttatcgatcatcgccggcatcgtttcccccacggaaggacgcgtcttggttgaagggcgcacacctgatggaaaggatcggcacatcggttatatgctccagcaggattatttatttccctggaaaaccattgaggaaaacgtcttaatcggtttgcacatttccaaaaaactaggcccggaaacgaaggaaaccgctctcggcctgctgaaaaaattcgggctttacgaggttgaaaaaaagtatccaaaagagctctcgggcggcatgaggcaaagggcggcgcttgcccgcactctcgctgtcgaccccgatatccttctgcttgatgaacctttttcagcccttgactatcagacaaaattgaacctcgaagatttagtgttcaacacgttaaagacgtatcaaaaaacagcggtgctcgtgacccatgatatcggtgaagcgatagcgatgagcgaccggattctgctattttcaaagcagccgggcactatccataaaacatttgccgttcctgaaccgatcaggaagctgac

SEQ ID NO: 2118 - DNA, 799 bp, Bacillus licheniformis
  misc_feature (1)...(799): n = A,T,C or G
atgacaaaatcgtctatttcaggcggtcaggccgtatttcaaaaatacgcgctgatggtctatggaacgattttggggcacggatcttatatggggcctgattacacggccgaagccctgaaaatctatacggaagggatgcaggattttaaggcggaggcacaatacggcaagcgctttaaacaactttcagatgaaaagcagtccaccatccggaatcacgtcatccgcgaaatgagaaaaaaccgttatgatcgcccatcagatacattgaagctgacagacgcgcaggtctacggcttgcatcaagtgcgcgatcattaccgcaaagtctttacaaaaggagacggctgggggcttgagcccggtttaattaaagaaagccacatgcctgaacgcaacagggcgtgggtcgacagcgaagaccaaatcacgcaggtctccgattttatcttttggacggcatggctttccagtacattaaggccgggcgacgacattacgtacacgaacaactggccgtatgatgaagatgcgggcaacacgatgtcattcgccgccgtttggtggagcggcgcaagcgttaccatcctcattttatttgtcggcattattttattcgtgttttaccgttacaagcttggaatgaaagaggcttaccaggaaaggggcgttttccggtatttgatctggataaacagncgctcaccgcttcacaggttaaaaccggaaaaatnttcnccgttgtgtcgctgctggttttttgtcaagcgatgttcgggggctttgctcgccactc

SEQ ID NO: 2119 - DNA, 307 bp, Bacillus licheniformis
atggaacacgatatactgatgtcgttccttgtgatcatcggaatcgatctcatacttggcggcgacaacgctgttgtgattgcaatggcaagccgtcatttgcctccccggcaaaggcaaaaagcgatcatcatcggcacattgatcgccatcatgatgagaatcgcgctaaccatggcagcagtatacctgctgccggttccttatctgcaatttatcggaggaatcttccttttgtacttaggatatcagcttctgattgagaaaaaagatgcccagcatgtcaaaggcgggacatctttattta

SEQ ID NO: 2120 - DNA, 315 bp, Bacillus licheniformis
atggaatggatctgcctcatcgccgccggtatactggaaatgcttggcgtgacgatgatgaaccagtttcataaagacaagcgggtgagatggatctttttgttgatcatcgggtttgccgcttcttttttcttgctttcccttgcgatggagacgctgccgatgggaaccgcgtacgcagtgtggacagggatcggcacggtcggaggtgcgcttgtcggcatcctgttttacggagagccgaaagacggaaaacgcatctttttcatcgcgctcattttgggatctgccgtcgggctgaaacttattagctag

SEQ ID NO: 2121 - DNA, 285 bp, Bacillus licheniformis
ttttcggaaacccgaatacggggaagacgtcattgtttaatgcgctgacaggctcctatgagtatgtcggaaactggagcggggtgactgttgagaaaaaggtggggctgctccgtcataaacaaggaatgatagtcgatctccccggtgtttatacattgagtccgctgtcccgcgatgaaggggttgtcacagacttcctgctcaatgattcattttcagatatattgaatattgtcgatgcatcacagttaaagcggaacttgcacttaaccgtgcagctcc

SEQ ID NO: 2122 - DNA, 771 bp, Bacillus licheniformis
atggtcagtcacgatttgtccaaacactcgcaaatatcaaaagaagcccaagatgcactggatggaaaaagcaaaggcttcaaaaggctgctcccttttttgggtccggcgtttatcgcggctatagcctatattgatccaggcaatttcgccacaaatatcgcggctggttcgaaatacggctacttgcttttatgggtaatccttttttcaaatattatggctttgctgattcagtcattgtcagccaaactgggaattgcaacgggtaaaaacctgcccgaagtcgcccgggaagaattccccaaaccggtctccatcggcttgtggattcagggagagcttgtcgtgatcgcgacggacttggccgaatttatcggagctgctctcgggctctacttgctgttcggcataccgatgcttgaagcatcgattattgctgccgccggatctttcgccattttggaactgcaaaggcgcggcgtcagaccgcttgaagcggcgataacaggaatgcttttcatcgtcgtgatcgcatttgcctttcaaacgttttttgcaaaacctgatatcggatcggttttggagggcatgtttgtcccccgcttcgatggtgctgacaggcatcctgctggcggcgggaatcttgggagcgacggtgatgccgcatgccatctatcttcattccgctctcacacagcgaagagtggtcggaaaaaacggaagcggaaaagaaaaagatattccgctttgagttcatcgacattttga

SEQ ID NO: 2123 - DNA, 615 bp, Bacillus licheniformis
aagaaacaatggttctgctcgtcttcgggtttgccgcgtttatgtgggtgacgagaacgtttttatgggatgacaaaataccgggtattgacgatacaatgattgcgatattcgccgcttcattgctcttcttgatcccttcgctcaataaagggggcagggtattggactggtcggtatcaaaggacttgccgtgggggattctccttttattcggaggaggcttggcgctcgcaacaggttttaaagaaacgggtctggcggagtggatcggcggaaggctgacggtattggatggatttaactttgtggttattgtcatcatctcaacggcattggtgctgtttttgacggagattacgtcgaatacggctacggcgaccatgattctgcctgtactggcctcgctcgctttagcgctgaatgttcatccgtacgcattaatggtgcctgctgcaatggcggcaaactgcgccttcatgctgccggtcggcacgccgccgaatgcaattattttcgcatcgggcaaattgaagatcagcgaaatggttcgaaccggctttgtcattaatattttcacgctaattttaatcgtcggagctgtgttctacattc

SEQ ID NO: 2124 - DNA, 414 bp, Bacillus licheniformis
gcaggaagcaatggcgcagcttaaacggaaaggcattcgaatgacaccgcagcggctggctatctaccattattttctagccaacaggaaccaccccacaatagctgaaattcaacaatcattgagggagatatatcctgccgtcagtacagcgacgatatacaacaccatccgctattttaaacaagagggccttataaaagaaatggggtttaccgatccgcttcgttttgatttggctctagaggaacatgatcatgtcatatgcgaagtatgcgggaagatcgtcgattttcattgtccgcaactagagaaagtaaaagacattgcggcacggctgaccggatttaaagtgacacatcaccgattggaactgtacggcatctgcaacgattgccaggcgaaaagaaaata

SEQ ID NO: 2125 - DNA, 450 bp, Bacillus licheniformis
  misc_feature (1)...(450): n = A,T,C or G
ctcaaatcggaccggcgacacaggtcntggagttgagtacagcacagaccagtgggacggctttcccgcttgccgcgacaggctttttnccgcatacaaggcatacggcatccaaaaaccccgttgactgacaggggatatccacagacatgccgccgccgacttaaaagcggacttcgatgatgcggggtcagcgacaatcggaaccgagctgatcacaacttcgatatcttcggacgctgacggcagcgagaccgattctttggcgccgatctggctcggaaacccgcatgtcaaactgtacaatgcacagcgcggctatgttcgctgccgcttgacgccccggcagctcgaagccgactttcaggttcttccttatatcacacgtcccggcgctccagcctcaacttatgccaagttcgccgttgaagcaggacgccccgggctcca

SEQ ID NO: 2126 - DNA, 322 bp, Bacillus licheniformis
atgagatggggcagtgtcatacttgcagccttgtttgaaattggctgggtcatggggctgaaacacgccgattcggcacttgaatggatctgcacggcggccgccgtcgtgatgagcttctatatactggtgaaagcgggggagaagctgccggtcggaaccgtgtatgccgtatttaccggtctcgggacggcgggaacggtcgtctgcgaaatcgccttgttcaatgagccggcaaatatcgccaagcttgctctgatcggtgttttgctatgcggcgtgatcggtttgaagcttgtaacaaatgaagagaaaggggagg

SEQ ID NO: 2127 - DNA, 337 bp, Bacillus licheniformis
atgaaaggcatgatctttttggcggctgccattttgtccgaagtattcggaagcacgatgctgaagctgtcagaaggctttagcgcccccctgcccgcagccggcgtgataatcggttttgcggcttcttttacatttctgagcttttcattaaaaacactgcctttatcagcggcttatgcgacttgggccggcaccggaacggccttgacagctgcaatcgggcattttatatttcaggagccatttaatctcaaaactcttattgggcttactttgatcatcggcggcgtctttctgctcaattcaaagcgcaccgaagcagcggatcaaaagg

SEQ ID NO: 2128 - DNA, 405 bp, Bacillus licheniformis
ggaagacgagcagctcgtccctttattaaaaaagcggggtttacgaattacagctcagcgcgtcctgattttaaaaacgattgcttctttgggcggccatccatcggcggaagacattcaccgggaattgccgtacatgagtctcccgacaatctacagcaacttgaaactatttgtgaagctcggcattttaaaagagctgtctcacggagacgcaaaaagcaaatatgaactgtttacatcacagcattatcatgtcatttgtaaatcatgcgggaagatcgctgatctggactatcctcacctcaaagaggtagagcatgcggcagcacaattgacgaactttaaagtgaactcgcattttctaggaatctatggaatctgtacaacatgccaagaacagca

SEQ ID NO: 2129 - DNA, 1005 bp, Bacillus licheniformis
  misc_feature (1)...(1005): n = A,T,C or G
atgtcggaggaatgtctgagcggcaagttgatatgtgggttgcagacattcttagcgattcatagaaactcattcaaaaggcatagacaaacacctattgttcttatcgttcataaggtagctcaggagaggagcgatcttatgttttttcatattaaagaactacagtatcacgcaaagcctgataaacccgatccattatttgcgaaaaagctgcaagagatacttggaggacagttcggggaaatatcagtagctctgcagtatcttttccaaggatggagtgtcaggggcaatggcaagtacaaagatctgctgatggatacaggagctgaagagcttgcccatatcgagatgctggcgacgatgatcgcaaggcttttggacggtgcgccggtcggtgatcttgaaaaagcggcaaaagatcctgtgatcggtgccattctgggagggatgaatccgcagcatgccatcgtatcaggattaggggcgatgccggccgacagtgtgggaaaccgctggaccgccgattatattatcgcaagcggaaatttgcttgccgactttcgggcaaatttaaacgcggaatcacaggggcgcctgcaggccgtccgcctttatgaagagacgacggaccgcggtgttaaagatatgctctcctggctgattgcaagggatacgatgcatcaaaaccagtggcttgcagccatcaaagaactggaagcgaaagaaaatgtcgtcgtcccaagtacgtttccgcgcaatctggaaaaaagggaagtctcccatgtattatntaaattttcaagaagcaacgagagcgctgcangcagatgggcgaagggaccgagcatggatggagaaggcgtttttcagtacgttgagcatcctcagccccttgcgaaaaaaccggtgttaagacctgcgcctccatatattcatgatacgccgccatcagttattcaacatcaccgggatgatgtactgcctccgaatctttattga

SEQ ID NO: 2130 - DNA, 323 bp, Bacillus licheniformis
atggagattttaatgtcttttattgtaggaattctgttcatggcggcgacttatctgctgctttccaaaagccttttgagggtgattatcggaactgccgttctcagccatggcgtccatctgcttttgctgacgatgggagggttaaaaaaaggagcgccccccattttgaatgaagagtcgacaacctatgtcgatcctctccctcaggcgttgattttaacggcgatcgtcattgctttcggggttacctcgtttctcctggtcatggctttccgcgcctatcaagagctgaaaatggatgatatggatcaaatgagggg

SEQ ID NO: 2131 - DNA, 417 bp, Bacillus licheniformis
tcagacgaatgatgtgatcctgcaaaccgttacaaagattgcatcctttatcattctgctcttttctttccatctgttttttgccggccataataacccgggcggcggttttatcggcggattgatgacggcgtcttcgcttgtccttctgctgctcgcctatgatttaaaaacggtgcagaacatcttgcccgtcaactttatctatgtggcggccgtcggcttattcatttccgtttccaccggaatcggctcatttttgttcggcgctcagtttctttcccacgcgtttgattactttaaccttccgctcttggggaaaacggagcttgccaccgcggtattgtttgatatcggggtttatctcgtagtggtcggcgtgaccatgaccattattcagacgattggggagagaga

SEQ ID NO: 2132 - DNA, 457 bp, Bacillus licheniformis
atggaagaaaacaaaaaaatactcatgattatcggaatggagaaacagcttgaacagaccatctgccgggcagcaaatattcagccggaggacgccctcgttttaaaaagcgtcttccctgatatttcacagccctacggtgatttcatgagggatatcatcacccttgtccaccggaacaaagcggaagaaatctggattgtccgcgacaaatacgaaccatcggcagatgaagatatttctgaccttttaaatagagacaaagatttaaaagatagaatgcaaactttagagtaccttttccaaaactgcagtccggaatttacgcaaggcagcattgatgaatggctgtcaccgagcgaaaacgtggccgaaggtgtacaaaaaagcgtcgccgccatccgcaggcacccgttaatccctttgcacgtcaaagtgaaaggatttctaatcgata

SEQ ID NO: 2133 - DNA, 186 bp, Bacillus licheniformis
cgcgttgggcggcttgggaggatttttcccgcctctcatcctgtcaagcgtttttcaggcaaccggccattatgcgatcggattcatggcgctgtcagaagcggctcttgcaagctttgtgatcgtggtctggatgtattttcaggaagtgaacaaaacatcgtccaaaacgaaggccaaccattt

SEQ ID NO: 2134 - DNA, 624 bp, Bacillus licheniformis
atgtcgattgaacaagtgaaagatttgcaggggaaagagcaaattgtggatacccgctcctcccgggaatttgctgaagggcacctcaaaggcacgatcaacattccattcaacaaggggtttacaaactgggcaggctggctcatcgactacaatcgtcctgtgtacttaatcgcgaatccggcagaagtgaacgaactcctggaagcgctgcgctccgtaggcattgacaacgcggcagggtttatcgatcgtgacaaaatcttggcagacggtgctttttcacttgaatcgtacgctgagatcacaccacgtgagatcgcaaaattagtggaagacggctttgtgcaagtgcttgatgttcgcaatctgactgaatggcaggaaggtcacattccgaatgcgcaacacatcatgctgggaacgctcccagaacggctcgatgaaattagaaaagactgtccgattcttgtgcaatgccattccggagcccgatctgcaataggagccagcatcctgcaagctaacggtagtttcaaacaagtattgagtttaagcggcggcattgtccaatggcagaaagacgggcttgcaatttcaaccccttgcagcgaattaaaatga

SEQ ID NO: 2135 - DNA, 594 bp, Bacillus licheniformis
atgaaagcggcaggcatctggcagcccaaactgtaccccgcagtatgggaagatgttaccacacaagatgatcatccgctcgccgtcaagctctcttctacattgaaaatgaaagaggaggaagcgaaaaacaggccgtcagcagacagggacatattgatccgcacagaggacgcggcgatcggctatcggaaaaagatcgttgccgacggcatcaacctggagattccaagaggggaatggatttccgtcatcggcgggaacggcagcggaaagagtacgtttttaaaaagtctgatcaggcttgaagcggtcaaaaaagggcgcatttatctggagggccgggagctgaagaaatggtccgatcgtacgctttacgagaaggccggctttgtctttcaaaaccccgagcttcaatttattcgggacacggtgtttgacgagatcgcgttcggagcgagacagcggagctggccggaggagcaggtcgaaaggaaaacggctgaattgctgcaggaattcggacttgatggtcatcaaataagcgcatccctttacattaagccttgggcagaaacggcgtttaagcgttga

SEQ ID NO: 2136 - DNA, 176 bp, Bacillus licheniformis
atgacgacagtcttagccactttgatttttctgctgacgctcacgctcgtgatttggcagccgaaaaatctatccatcggctggtcggcctgcggaggagcggtgctggctttaattgccggagtcgtcaattttcaggatgtattagacgtaacgggaatcgtatggaatgcgac

SEQ ID NO: 2137 - DNA, 210 bp, Bacillus licheniformis
atgatccctgaagccgtccacattaaaatgggggatatccctgaaaaactcgacgtctttcaaaaagatcagccttatatttttgtgtgccgatcaggcaaacgaagcgaaaatgtctgcctctatttgcaggataaaggctttgatgtcaccaacatggtcggcggcatgctcgaatggaccggaaacacgaagccgaaaacaaaataa

SEQ ID NO: 2138 - DNA, 320 bp, Bacillus licheniformis
atgatcgaagccgctaaattgcttatcgccgttttgatccttcttggcgcactgatatcgttagccgcttcctttggaacgcttaggctgcctgacttatactcaagaatccacgccgcttcaaaaggagcgacactggggatcatcagcgtgctgctcggcgtattcttttacttctggtttctgcacggcttcattacggcaaaagtgctgctcggtatcgtctttgtatttctgacgtctcctgtaggcgcgcacctgatcgcaagagccgcgtataatacaggcgttaaaatggaaaagaaaaccgtacaggacga

SEQ ID NO: 2139 - DNA, 269 bp, Bacillus licheniformis
atggctcattctcacggacatacaggacacagccaccatggcagccgatcagcaaatcaaaaagcgctgttcatcagcttcggtttaatttttacttttatgatgattgaagtgataggcggaatattgacgaacagcctctctttgctgtcagatgcgggacatatgctcagcgacgctgcggcgcttggcttcagcctcgtggcatttaaaaatggcgaaagggccgcacgcgcgagcaaaacatatcgctacaggcgctttgaaat

SEQ ID NO: 2140 - DNA, 141 bp, Bacillus licheniformis
gcgggagcgctcccgtctttttcgaagccggctatattccgcaaagcaaatggaggtcaatcggcttcatcttgtcgattgttcatattgtgacatggcttgctgtcggagggttatggtggaaattactgggcatatggt

SEQ ID NO: 2141 - DNA, 146 bp, Bacillus licheniformis
ttggctatgaaaacaggagtcattcaggagaaaaagctttcttcggaagagctcggcgaggaaatggagcttctcgtctatgtggcgtcctccttctcgccgctttacaaatatcatgtgatcatcgcacaggatggacatgacta

SEQ ID NO: 2142 - DNA, 210 bp, Bacillus licheniformis
atggaacaaaaaacactgaaagtcgaaggcatgtcttgcaaccactgtgttcaggcagtagaaggaaacgtcggaaagcttggcggagtggagtctgtcaaagtgaatttaaacgagggcaaagtcgaagtatcgtttgattcaggcaaagtctcgctgaaggagatcatcgatacgatcgaagaccaggggtatgatgttgcaggctga

SEQ ID NO: 2143 - DNA, 285 bp, Bacillus licheniformis
actgaaggaaaaaggatataaatatacaagcaaacgggaggatatgcttcagctgtttagtgattcagataaatatttaacggcgaaaaatgtcctttccgctttaaatgatgattatccggggctaagctttgatacaatctacaggaatttgtcgctgtttgaagaactcggcattttggaaacgactgagctttccggtgaaaagctgttccgttttaaatgttcttctgctcaccaccaccaccattttatttgcatggtgtgcggcaaaacgaaagaaat

SEQ ID NO: 2144 - DNA, 165 bp, Bacillus licheniformis
tgaattgatcgaaacggtacggctgaaaggaacggagaaacagtacccgcacgagctgtacggcggaatctcgcagcggatcgcgattgccagggctttggtcagggagcctgagattttgctgcttgatgaacccttcaggtgccttggacgcctttacgagca

SEQ ID NO: 2145 - DNA, 244 bp, Bacillus licheniformis
atgatgatggtgattgtggctgatggcttgaacatcatgcccgtaaaattgagacaagtcttgatctgtcatggactcaaactcttctgtattgccgtgaaaatgaagatgcttattcatgcaggcaacgtgtggactttatcggaaaccgtgccgacatcatgggtgacaagaatgagcgtaatgctttttcacgattcaatttctccagcagctgtaaaacccttcaactgttttttaaagg

SEQ ID NO: 2146 - DNA, 736 bp, Bacillus licheniformis; identical to SEQ ID NO: 2073

SEQ ID NO: 2147 - DNA, 568 bp, Bacillus licheniformis; identical to SEQ ID NO: 2081

SEQ ID NO: 2148 - DNA, 1005 bp, Bacillus licheniformis
atgcattcaaagcaaatgacccgcatcattatgatcgccgctccgtttgccatactgctgtctgtttttctgtcggtatgttacggtgcaaaacagcttgagcccgaggtgattttttcggcgctgctgcattttgatccaggcaacacagatcatcaaatcatttggcattcccgtcttccgcgcgctgtcggcgctcttttaatcggagcggcgctggcggtgtccggtgcgcttatgcagggtgtcacccgaaattacttggcttccccgtcgattatgggcgtttccgacgggtcagcgtttgtgatcacgctgttgatggtggtgattccgggttcatcctctctggagatgatgggctattcgtttatcggatcagccgtcggcgccggccttgtcttcggcctcgcctcggtgattccaaacggttttatgccggttcaacttgccataatcgggacggtaacaagcatgctgctcagcagtctgtctgcggcgatatcgatttactttcaaatttcccaggacgtcagcttctggtacagcgcgaggctgcatcaattgaatcccgagctgctgaagtatgccgtgccgttttttgtgatcggcatcattctggcgctctctctcagcaaaaaagtgacagctttatcattgggcgatgacatttccgaaagcctcggccagaaaaagcaggccgtcaaatggacagcgatggcagcggtcgtcgttctgacaggctgctctgtcgccatggcgggaaaaattgcttttgtcggactggtcgtgccgcatattacgcgttttctcgtcggatcggattacagccggctgatcccgtgctcctgcgttctcggcggcgtttttttgacgctggccgatcttctcagccggctgatcaactatccgtttgagacaccgattgaagtcgttacttcggtgatcggcgttcctttcttcctttatttgatcaagagaaaaggaggggagcagcgtgcctaa

SEQ ID NO: 2149 - DNA, 954 bp, Bacillus licheniformis
atgaaattacgatacttattgctaatgctcatcattctttcattcagctcgatattcatcggcgttaaggagctttcgcctcttgaccttttccgctttaatgaggacgaaattcaaacgctttacataagcagaatcccgcgcttgatcagcatcgtgcttgcgggaatgagcttgagcatctgcgggctgatcatgcagcagctgacgcgcaataaatttgtttcaccaaccaccgctggaacgatggattgggctcggctcggcgtgatcattgcgatcgtgcttttttcgtctgcagggatagtagtcaaaatactgtttgcctttgtttttgcactgtttggcagctttttgttcgtcaaaattttggacagaatcaagttcaaagatgcgattttcatccctctcgtcggaatgatgctcgggagcgttgtcagcgccatctctactttcatggcttatcagtacaatattattcaaaacgtcaatgcatggtttgaagggaatttttcgctcgtcatgaaggggaggtatgagctcttatttctgagtataccgctcgttatcattgcctatctgttcgccaataaattcacgttggccgggatgggggagtcattttccatcaatcttggtttgaaatacaagcgggtggtcaatatcgggctgatcatcgtatctattatttcgtccgtcgtcatcctgacgatcggcacgcttccctttttgggattgatcatcccgaacatcgtgtccatttacaggggagatcatttgaaaaacagcctgcctcacacggcggttctcggagccgttttcgtcttgttttgcgatatagcgggacgtctcgtcatttacccgtacgaaatttcggttggtttgatggtcggcatcatcgggagcggcgtttttctttacttgcttttaaggagaaaagcctatgcgtcataa

SEQ ID NO: 2150 - DNA, 812 bp, Bacillus licheniformis
atgagtgccatttcaacagaaacgttaagcttaggttatggagaaacaatcattattgatgagttaaacttaacgatcccaaaaggtgaaatcaccgtatttatcggcagcaacggctgcggtaagtcgactctccttcggtctctcgcacgtttgatgaagccaaagggcggttcggtgctcctcgaaggcagctccatcgccaagcttccgacgaaagaagtggcaaaggagctggccattcttcctcaaggcccttcggctccggaaggcttgaccgttctccagctcgttaagcaggggcggtatccttaccaaaactggctgaagcaatggtcagcagaagatgaagaggccgtgcaaagggctttgaaagcgacaagaatggaagaactggctgagcgtacagtcgattccttgtcaggaggccagcggcagcgcgcttggatcgcgatgacgctcgcccaggaaacggatatcattttactggatgaaccgacgacatacttggatatgacgcatcaaatcgaaattctggacctattgtttgaattaaatgaacacgaaaagcgcacgatcgtgatggtgctgcacgatttgaacctcgcctgccgctacgcccatcacctcgtcgcgattaaagataaaaagatatatgccgaaggccggcctgaatccattatcaactgcaagcttgtacaggacgtttttgaaatggactgcgaagtgacgaaagatccgcttttcggcacgccgcactgcattccgtacggaaaaggaagatgcatcgtccagcaggtggttcagtccca

SEQ ID NO: 2151 - DNA, 993 bp, Bacillus licheniformis
cagaaaagcgctgttttcattcgtgatcctattggtgttgacggcttgtgcagtcatcctcagcgccggcatcggcgaacgttttatttctccgggcgccgtcgcgaaaacgtttttgggcatgggggatccgggcgatgacctgatcatcatgtccttcaggatgccgcggattttggttgctctgtttgccggaatctgtctggcggcagccggatcgatcctccagggtctgatccgcaatccgctcgcttcgccggatattatcggtgtgaccggcggggcttcagtcgccgttgtcttgtttttaatgctgttttccaataaaaataatgcgcttacggtcagcatcagctggctcccggtcgccgcttttatcggcgcggctctcgccggaatgctcgtttattttctttcatataaaaacggctcttcaactttcaggctcgttttgatcggaatcggattttcgatgcttgcccagtcgctgacgacattgtttatgataaaaggaccgatatacagaatgtcccaggcgaacgtctggattaccggatcagtatatggctccaactggcaggatgtgaacgttttattgccggctgcgcttgtccttttgctgatatcggcagccgccgccagaaacgtcaatatccagacgctcggcgaagaactggcgacaggagcgggcagctcggttcagcgaaaccgctttttgctcctgcttctgagcactgcttttgccggaatcgccgttgcttttgccggaactgtcggttttgtcggtttgatggccccgcatatcgcaagaaggcttgtcggatcgtcattcggcgccctcttgccggttgccgcgctgatcggaggattgctcgtgctgattgccgacatcatcggccgcacgcttttttctcccgttgaagtgcctgccggtgtgtttaccgccgcgatcggcgccccttactttatctacttgctgtataaaagcagaaa

SEQ ID NO: 2152 - DNA, 984 bp, Bacillus licheniformis
atgctgtttttattgtgctgattctcacaatctgttatctcagcataacagtaggatcgtttgccgtacatccggctgagctgttatcaacattgcttcacatcaacccgaatgagcaatacgccattctcctgtttgagctgcgtcttccaaggattgtgacggcggcactcgtgggtcttgggctcggcattgccggttccgtcatccaggcgatgacaaggaacggactggccgacccgggaatcctggggattaatgcaggtgcgggggcggcgatcgtcggctacatgctgatctttcaaggccagaccgaaacgacaagcctgctcgctgcaatggggatgccattcttcggcttgatcgggggcattttggctgcaatattcatttttatctttgcctggcacgccggcaacttggattcgggcaggattattctcgttggaatcgcgattaattcagggttcagcgctgtttcgctttacctgtcattgaagatgaatccgaatgaccacgaaatggccatggtttggaaaaacggaagcatctggtcggcgaattggacgtatattcaagcggcactgccgtggctgcttgttcttattccatttctgctgatgaagtccggcctgctcgataccattcgctttcatgaagatacggtgaagagtctcggcgtatccgcgaatattgaaaaggtggtgctgctcacggcttgtgtcggcattatcagcgcctgtgtggctatttcggggagcatggcatttgtcggcctgattgctccgcacatctcgcggaggctcgccggcgtcctgcaccgccactcattgctgttaagcggattgatcgggatgtttctcgtattgtgcgccgattttgccggaaagctgctgttccagccgtccgaggtgcctgcgggtatcattctcgccattttcggtgtgccgtacttcttatttttacttttcaaacaaaaaaaga

SEQ ID NO: 2153 - DNA, 1014 bp, Bacillus licheniformis
atgctcaagaaaaacaacagacgggcgggtgcggtgatgctcgtcatggccgtgctgacggccgccgtgtttttattaagcatgaacatgggagaaatccgcatcgacccgcttgctacattgagaacactgttcggctttggaacgccgcaggatgaacttgtattatttgaattccgtctgccgcgcatgatcctcgccatgctgatcggtgcaggggttgctgtctccggagccgtctggcaggggatatcccggaatgacctggccgatccggggatattgggcatcaatacgggagcgggttttgccgttgtgctgttcatcttctattttcagggagacgttggcaacctgcaaaaaggattcgttttttccctgccgatattcgcatttttgggagcctgctttgcagtcgtttccatctatttgctggcgtggaaaaaaggcttgaatcccattcgcctcgttttggtcggcatcggagtgaatgcggcgttttcggcggccatcttaatgctgcagcttaaaatggacccaaatgactttatgcaggcggctgtttggctgtcagggaatatatggagttcgaactggagctttgtctcggccgtgctgccctggattgtcgtgctgattccttttatcctctataaagcgcgctatttaaacgtgctgaatctcggtgatcagctcgcaacagggctcggaacggcagttgaaaaagagcggcgcacactgcttctgtcggcagccgcgctgagcggcgcgtgtgtagcggctggaggaaacattacgtttctcggtctcgtggctccgcatattgccagaagacttgtcgggccgaagcatcagcttttaatcccggcttccgcgttgaccggagcattgctctttttgctggcggacttaattggaagaatgatactggcgccttcggaaattcccgtagggcttgtcattgccgctttaggcgcaccgtattttatctatttgcttatgaaaacaaattaa

SEQ ID NO: 2154 - DNA, 791 bp, Bacillus licheniformis
gtgtctctttcaacaaacaacctggggatcggctacggcgaacagatgattgtcgaaaacttaaacctccacataccaaaaggaaaagtgacgaccatgatcggtccgaacgggtgcggcaaatcaaccatattaaaaacgatggcgcgcatacagcgttcgcgaacgggcgccgtttatttaaacggcaaagcgatccaccaaatgtcgacgaaggatgtagccaaacagatggcgattcttccgcagacgcctgaggcgccaggcggtttgaccgtatatgagctcgtttcttacggccgttttcctcatcaaaagggaatgggcaggctttcggccgatgaccgccgcatggttgaatggtctctccaagtgacaggaatgttgcctttttatgaccggccgatcgaagccctttctggaggacagcgccagcgcgtctggattgcgatggcccttgcccaagaaacggagctcttgctccttgacgaaccgacaacctatttggacttggcgcaccagcttgaaattctgcaactgctggaaaagctcaatcaagaagaaggccgaacgattttgatggtcattcacgacctcaaccatgccgcccgcttcgctcatcatatggtggcgctgaaccggggtgcgattgtcaaagagggcgcccctcatgaagtcatgacatcagaagtattaaaaaaggtgtttcagattgatgctgaaattatattagacccgcgcacaggaaaaccggtgtgcctgacttacgatctattgaaaaaagaagagga

SEQ ID NO: 2155 - DNA, 1251 bp, Bacillus licheniformis
tgtccggcggatatggaaaaacggatgtcttacaggatatcagttttgctgtaaagccgggtgaatttttaggaattcttggtccgaacggcagcggaaaaaccactttgctgaaaatgttgtcgggaacaattgccccccgaagcggcgaggtgctgcttgaatgccgttcagtcggggagtacaaaacgaaggagctcgctcgcaaaatggcggtccttcctcaaaaaacggagcaggccttttcctttacggtggaggaaacggtacagtttggccgctacgcgtatcaagcaggcctttttcggcagctgacggcggaagaccatgatatcgtgaagagggtgatgaagcagacagacacgcttcgcttcgcccaaaaatccatccatgagctgagcggcggagagcagcagcgggtgtatttagcgcaggcacttgcccaggaacccgaatatttgctgcttgatgaaccgacgagttttctcgatttgtcatttcaaaagagtctgcttgatttaatgaaacaagaaacggctgcatccaaactcgcagtggtcggggtgtttcatgatgtgaatattgcgagtttatactgtgaccgtctgctcctattaaaagatggaaaagcagaagttcttgaccgcccggaagcagctctttctgctgggcgcatcggacgagtgtatgatacggacatcactggactggaccatcctcagcgttcaaatccgcagtttacaattatggcgaaaaacatcccgcggaaaaccgagcccctctttttaaaagagcgaattgaacaatatttgccgcacggcatcgcatttttggcagaccgcccgctgcggcttctgtcctcagaaaggggctttgcttggagacgaaaacttattttcgacagcggaaataactctggatggccgcatggctcgtcagcttttgaacaggaaacgctgtttatccaacatgatgctgaattggctgactgccatattgtgtcggaaagcggtgatctttgcatcgtcggtatgaaagacacgatggggcgtttgatcatgtgggtgttagttgacggctgtttgcaggatggtcaatttgtgaaggcgataagcgctgcggcatttgccgcagcccagcatcatgttccgtgtagtgatgtccttgtagcggccactcaatccggccggtcagcggatcaaaccgcttttttgacacaaattcaaaataaaacagccgcttgtgtgaaag

SEQ ID NO: 2156 - DNA, 951 bp, Bacillus licheniformis
tcatttttgtttttcttttgcttgcgagttttgcgctttctgtttcaatcggttcgtcaatgattgcactgtccgatatttgggcggctgtttttgcgtacgacggttcaaaattgcacgcgattattcagtccatccgaattccgcgcgcattgaccgccgcattaatcggcgcgaatctaggggctgcgggcgcgctgatgcaggcggtgacaagaaatgcgctcgcatctccgagcatcttcggaatcaatgcaggggcctcgcttgctgtcgtatgtttgacggtgatgtttcctgcgcttgcagctccccagacagcgatgggagccgcatttgccggcggtgcagcggccgcgctgatcgtgtacgcggttgcctcagtattcagcgaacatgacagggatatcagctttgccttgattggcgttgtcattcaggcgattcttgcttcgatgacgcaaatgctgcttatctttcatgaagagtcgacggaaacgctattgttttggctttccggttctttagcggggagctcatgggataagcttcatttattggttccggtgagcattgcgggtttgttgacggctttggccttagggagggcggcttccgtcatgagtctcggagatgaagtttctcatgggctgggacaaaaagtatggctcagcagattgctaatcgccttcactgttgtcgcattggcgggagtgtccgtttccgccgccggtccgattggtttcatcggtttgatggttcctcatatgatccggtatctcatcggtgctgactaccgggcggtgattccgtattcggcattgcttggagccgttcttttgctgtttgccgatattttgtcccgctttgtctattttccgtaccaaacgcctgtcggagttgtcacggcaatgattgggacgccgttttttatctatttggcgagaagac

SEQ ID NO: 2157 - DNA, 828 bp, Bacillus licheniformis
aacagaaaatgcttgtactcatcgtgatagcagcagtctgcatcgggctgtttctgttctacggtttgccgtctgtatgggaatatgcgcttccgcggaggtttgccaaggtttttgcgatcatcattgtcggtacagcgattgcgtattcgtcgatgattttccaaacgatcacaaacaacagaattttgacgccgagcatcctcggactcgattctctctatgttctgctgcaaaccgggattattttctttttcggtgcagccaaactcgctgaccttggcaaaaacggcaattttctattgtctaccggtttgatggtctgcttttcatttgtgctgtttttcctgatgttccgccgcgggggaaggcacatcttcctgctgctgctcgttggaatcgtgttcggcacattgttcagaagcctgtcatcctttatgcagatgctgatcgatccgaacgagttccaagtcgttcaaaacaagatgtttgccagcttcaacaatttgaatacggacattttagtgcttgcttcgctcgtcattctggcgattctcgtttacgcttggcggtttaatccgtactttgacgtgatttcgctcggcagggatcaagccgtcaacctcggaatcgattacgaccggacggtgaagaaaatgctgatcgtcgtcgccgttctcgtttccgtgtctactgccctcgtgggtccgatcacatttttggggcttctcgtcgtcaatgtggcccgggaggtatttaaaacgtataagcacagcgtcctgattcccggagcggttttgttcagcatcattgcgcttgtcggaggcc

SEQ ID NO: 2158 - DNA, 900 bp, Bacillus licheniformis
gaaagacgaaaaggcggcgcggacaatcggcggttgttctctgtgcgctattcgcctgtttgtttgtgctcattgtactcaatttggcgatcggcgatgaaaacatcggactgtgggacgtattgaaatcgctggcaggacaaggcgatgcgggagtccgctttttggtgatggaatttcgaatgccgcgaatcctcctcgctgtgcttgccggaggggcgctttcgatcgcgggtgtagtcgctcaatttctgatgaaaaatccgctggccgcccctgacacgcttgggattacaggaggagcgggattgggcgctgtgatcgttacggtcttgttttcacagcaaagtccgcttctgctgacaggcgccgccttttcaggaagcgttttagctgcgatcctcgtctatttattggcttatcgaaatgggatctctcctgtgcggctggctcttgtcgggatagcggtcaatgctttctgccattcgggcattcagctgttaatctcaagggggagcccgaatgtcaacagcgcattaatttggctgaacggaagtctgtggggaagaggctggcaggatgtattgcctcttttcatatggtgctgtctggtgattcctccgatatggcttgcggcaaaaccgctcgatatcatcaaatcaggggacgggattgccgtcggcctcggcatccggcttgaaagaacaaggtttctgctgcttgccggtgcggttttgctgacagctgctgctgtgaccgctgtgggaacgatcggttttatcgggctgatggcgcctcatatcgcaagaaagctcgcaggggctgaaacgaagatcttgattcccgttgcagctctcgtcggcggcatcgtccttttgatagccgatcccgccgggaaag

SEQ ID NO: 2159 - DNA, 453 bp, Bacillus licheniformis
ggctgctcgggagcgtatcgatgaggggctggggctatgtcgcgttgtttctgcccttttttgctgcgggcgctgccgcgcttttgatcagcgggagggaactgaatgtgatgacttatggcgaggaaaaagcgaggctgctcggcgtgaatgtgaagcggagtaaatatatcgttctgttggcgggagctattttaaccggcagtgcggttgctgtgtctggaaccattggttttgtcggcctcgtcattccgcattttatccggcttctgtcgattacggatcaccgtcatcttctgccgctctcgatgctgaacggcgcttcgttcctcgtgctgtcagatcttttgtcgagaaccattatcgagccgtccgagctgccgatcggcattattaccgcattgataggggcacctgttttcggctttatattaattcggcgctaccggggag

SEQ ID NO: 2160 - DNA, 498 bp, Bacillus licheniformis
tccgctcggagctgtatttgtcctggccggcggaatcatgctgctgctttttggcgccgcattatcgattgcgctcggtgcggctgatataaagcttggaacggtttgggacgccatttttcattttgacgcgaaaaatacggcccatcaaattattcaggaactcagactgccaaggacggtaagtgcggctcttgtgggcgcctgcctggcggtttccggagccgtgatgcaggggatgacgcgaaatcctcttgcgtcgccggaaattatgagcgtcacgcacgggtcagctttcgcaattgctgttgcgtttgctttttttccaggaacctcatcgatcgggctgatgatctggtcatttgccggtgccgctcttggagcggggcttgtttttggaatcggaatgttttcaaaaggcggtcttacgcctgtaaagctggctttggccggtacggctgtcggcacgttcctgagcgctctttctacgagcatcgc

SEQ ID NO: 2161 - DNA, 222 bp, Bacillus licheniformis
gatcggctttatcggcattgtcatcccgcattttgctaaatttatcgtcgggcacgaccatcgctgggttcttccgtactgcgccgtgcttggagccatcctgctcgttaccgcagacattggcgcaaggtacctgatcatgcctgaagaagtacctgtcggcgtcatgacagccatcattgggacacccatttttgtctatatcgcgagaagggggttcca

SEQ ID NO: 2162 - DNA, 343 bp, Bacillus licheniformis
  misc_feature (1)...(343): n = A,T,C or G
atgatagaagtacgagatatcatgaaacaattcggagagcagaccgttgttcatcccacgactttaacgatacnaaaaggaatgatcacgtccttcatcggaccgaacggagcgggaaaaancacgcttttgtccatcatcancaagctgatcggcattgacgccggaaaaatgctgattgaccgcaaaaaaatcggcgcttacnaaagccatgatttaaccaaaaaaatcagcattttaagcagtccaaccagaatcacattcaggcttgactgtcagggagctcctcagcttccggcaggtttcccntatccccaggaaaagtctccaaaanaagactggg

SEQ ID NO: 2163 - DNA, 627 bp, Bacillus licheniformis
ggggaaagggggagaaaacaacaaaacgcgccccagatccatcaccagccaggccgagcgcgcatgctcaccgtttttagtgtgctattgcgcccaaacaagatgggcgactcacaccagctatgattcagcccctcccatcagcattttccagcagtcccaccagatcaacatcaggcttactgtcagggagctcgtcagcttcggcaggtttccttattcacagggcaggctctcgaaacaggactgggcatatgtcgatgaagcgattgattacatgaagctgagagacattgagcataaacaccttgatcagttaagcggcggccagtgccagcgcgctttcatcgcgatggtcattgctcaggataccgactatatattgcttgacgaaccattgaataatctcgatatgaaacactcagtagagattatgaagctcttgaaagaccttgtcgaaaatcgcggaaaaacgatcgttattgtcattcatgacattaatttcgcctcggtttattccgacagaatcgcagccctgaaaaacgggcggattgtaaaagaggggccggcggaagacattatccaaacgccggtgctgaaagacatctatgatatggacattccgat

SEQ ID NO: 2164 - DNA, 176 bp, Bacillus licheniformis
tttggtatgccggaggtgtcgccggcacgaaatggctcagcattcagttgttgattccggcggcagcgctcggtttggcggtcgtttttgtcatcgcccgttccatcacggttctaagcctgggtgaggagctggcgaaagggctcggtcaatatacgaagacggttaaagcgatc

SEQ ID NO: 2165 - DNA, 321 bp, Bacillus licheniformis
atggtgaacaagaacttaacaaaggtgtttgtttcgaagatcggggatttgccgaatcagcttgggaagacagtgttcatcaaggacaaggaaatcgcggtattcaagctttcaaacggcagcgtccgcgcgattgaaaaccgctgcccccacaaagggggcgtgcttgccgaaggaatggtaagcggcgaattcgtcttctgtccgatgcacgactggaagatcagccttgaagacggcaaagtccaagagcctgacacggggtgtgtgcagacatacgaaacggtcgttgaaggcgaagatttgtatatcgtttattaa

SEQ ID NO: 2166 - DNA, 6465 bp, Bacillus licheniformis
tcaacagagttaaacgcgaatcgccggaactctcgctttggaatggatacggacctactgaaaatacaacattttcgacgtgttttttcatcgatcaagcatatgagagaacgatcccgattggaaagccgatcggaaattcaaccgcctatatcgttgatgaacacggcgcgcttcagccgatcggcgtgcccggcgagctgtgtgtcggcggagacggggtggcccgcggctacttgaaccagcctgagctgacagatgaaaagtttgtcggcgatccttttgccgaagggaagcggatgtaccgcacgggcgacttggcaaaatggcttcccgacgggaatatcgaatttctcgggcggatcgatcatcaagtgaaggttcgcggcttccggatcgaattaggcgaggttgaagcggctttggcccgccttgagggaatttcagaagcggctgctgtcattcgggaaaacaataccggagaaaccgagatttgcgcctactacactgcagttggcgcgaggccggccgcacagctgcggacagagctgtcccggtcgcttccggagtatatgattccggctcatttgatcgaactcgacagcatgccgctgacagccaacggaaaggttgacaaacggcagctgccggctcctatcgctgaagagactgacagattcgaagcgccgaaaaatgaaacggagaaaattctggcggcaatctgggaagagattctcggcatcaagcagccgggaatcgatgacaacttcttttccatcggcggacactcgctgaaggcgatgatgctgacagccaaaatacaagagcagctccaaaaagaagtgccgatcaaagtattgtttgaaaaaccgacgatcagagagctggccgaatttcttcaaggggaaacgaaagagaaaaccgctccgattgcgccggcgccgtcccgtgcgaattatccggtgtcatccgcccaacggcgcatgtacatcctcaatcagctcgaagaagcaagcacgagctacaatgtgccggcggttctgcttctggaaggcgaattggataaggagcgtctggaagacgcgtttcgggccttgatcagccgccatgaaacattgcggacatcgttcgaattaatcgatggagaaatcgttcaaaccatccatcaagacgcagtttttcacctgacggaatcagtggcggatgaagcggaagccgaagcggcgatcagagggtttatccggccgtttcagctgaataaggcgccgctcgtccgggcggaactcgtaaagcttgaagaaaagcgccatctgctgatgatcgatatgcaccacattattacggacggaagctccaccggcatattgattcgcgacctggccagcttctaccacggtgaagaggcgcctgctcctaagctccactataaggatttcgctgtgtggcaaaacgggccggagcatcaggagaaattgaaagaacaggaacagtattggctcgatattttcaaaggcgagctgcctgttctcgatctgccgtacgattttccgcggccttcaaaacgcagctttgaaggcgaccgtgtcgtctttggaatcaatcgaaaactgacggcagacgttcaaaagctgctttctgaagccgatgcgacactttatatgttcctgttggccgcgtttaatattttgctgtccaagtatgcgtctcaggaagatttaatcgtcggatcgcctgtggccggcagaacccatccggatctgcacaacattccgggcatgtttgtcaatacgctggcgctccggaatcgtcccgaaggggaaaaaacgtttaaggaatttttgcaggaagtcaaagagacaagtcttcagggctttgccaagcaggactatccgcttgaagaactgattgaaaaactgccattgccgcgggatacaagccggaatccgctgttcagcgtctttttcaacatgcagaacatggaaatcccgacgctgaaactcggagatttgcagatttcgtcttactcggtgcgccatcgcacagcgaagtttgatctgtcgcttgaggccgtggagcatgatggggaaatcggtttgagctttgactatgccgtatccttatttaaagaagaaacgatcaggcgctggagcggccacttcttaaatgtgattaaaacaatctgcgaaaatcccggcattaagctccgggacatcgaactgctttcagacaaagagcgcggacttctcctggaagaagtgaggcgcagccgggcagaacgcctagaggagcggccgtttcatgtacggtttgaagaaaaggcggccgaaatgcctgatcagccggctgttgtctgcggggaaacaatcctcacataccgcgggctagatgaaagagcaaatcaaattgcaaatgtgctgcgaagtgaaggcatcggaaaagacgacgttgtcggcattatgctggatcgttctgcagaggtcgccgcggcaattctcggcgtaatgaaatcagggggcgcttttttgccgattgatccggaaatgccgacgagcaggattcaatatatgctggaagacagcaaagcccgctggctcttaacagaacattcccatcaagctgctctcgcagattggtataacgggagattgatagatgtgagaaacgacacgctgatggcaagcaaaaaacgaccgcatctaatccatgacggggcgagtctggcgtacatcatctatacatccggaacgacgggtcagccgaaaggcgttcagctggaacaccgcaatctggcaaactatgtttcctggtttatcagtgaggcgcgcctgtcagcttcggataaaacgatgcttttgtcttcctatgcgttcgatctcggctacacgagccttttcccggtgctgctcgccggaggagagctccatatcgtccggaaagaaacgtatacagaaccggagacatttattcattatatcggtgaacaagggatcacatatatcaagctgacgccgtcgctgttccatacggtcgttcagccgcaaagcttcgctttggcaaaggggcttcagtcattgagactgattgtactagggggagaaaaaatcaatccgaaagatgtcgaacggttccattcccgctatccggacacccggttcatcaatcattacgggccgacggaaacgacgatcggtgccatcgctaaaccggtcgaaccgggcatgatccggcaattcgccgagcgcccgacgattggacggccgatttcgggcgccggagcactggtattggacgcttcccgccggcttgttcccgcgggagcggcaggcgagctgtatattacgggaagcgggcttgcaagaggatatgtgaacaaccgggaacttacggctgcgaagtttatcgaaaatccttacacaccgggcacattcatgtaccggacgggggatctcgtccgccgtcttccgaatggggagattgaatttttagggcggacggatgatcaggtgaaaatccgcggctacagaatcgaattgaaagaaattgaagaggccttcattggacttgaacatatagagagagcggtcgttctttcatttacggctgactcagggctagacgaactgtgcgcttatattcaagcgaaacgacagctgccggtttccgaaatgagagagcgtctttctgagcggcttccgtcgtacatgatcccgtcatatttcgtaacggtggataaaatgccgcttgcggcgaacggaaaagtggaccgcagcgcgctgccggagccgcaaggtctaagtggtcaaagcgattcatatagagcgccgtcaaccgaatttgaaaaagccctctgcggcatttgggaggaggtgcttggcgttcggccggtcggacttgacgacaatttcttcgatcttggcggacattcattaaaaggaatgatgctgacagcggaaatccaatccaagctcggaaaaaaagtaccgttaaaaacgttgttcgattgtccgacagccggcttgctcgcccgcagtatcgaagccgatggacaggcagaacaaagcgggattcagcctgccgaaaaacgcgactggtatcccgtttcatccgctcagcaacggatgtatgccctccatcatattgaaaagaacggaacgggctacaacatgccgtctgttctcatgctggaaggcgtacttgatacggatcgcttaagacgggcattcgcagacttggtgaaccgccatgaatcattgcggaccgcattcgttgaaatcgatggccgcaccgttcaaattgtgcatgaaaaagcggacattgacttaaaggttattcatattcatgaagaggacgcagaagcacagatcaaccgctttatcagaccatttgatctcagcaccgctccgctgatcagagccgagctgctctccatcagctctgcgcgccatctgcttttgattgatacgcatcatattattgcggacggcgtttccagaagccttttcgtcaaagaaattgcacagctttataaaggcgcttcgctccctgaaccgaagctgcattataaagattatgcggtgtggcagcaacaacctgaccagcaagaaaacattcggaaacaggaagacttctggctccggcagtttaaggaaaccgttccggaactcagccttccgctcgactttccgcgtcctcctgtccaaagctttgccggggaccgggttcactttaaagtatcaaaaggcaccgcccttaaaatccgccgtttgatggcgaaaacgaacacgacgctgaatattgtaatgctcgccgtttttaatctgtttttaagccgtcttgccggccaaaaggatattgtcgtcggctcagcggcagcgggcagaacgaatgctgatttgaaagacgtgccggggatgttcgtcaactcgttggcgctgaaaaaccatgtacctgatcaagcatcattcagcgggtttttggaagaggtgaaaaacaacagcctcgcagccctcgaccatcaggactatccgtttgaagagctgattgccaagcttgatttgccgcgcgatatgagccggaatccgctgttcaatgtcatgctgacaacggaagatcctgataaagaaacgctcgatttagacggtctgataatcaagccgtatgagacttcacatgccgctgccaagttcgacctgacactgggggcttttgaaaaagatgatgaaatcggtcttcagttcgaatatgcaacagatttatttaaaaaacaaacgattgaacgctggagcggatatttgcttaacctgctcgaagcgattgccgaaaacccggatgcaagcctttcagacctttcgcttctggatgaagccgataaacggcggatcttgtacgaatggaacgaaacagttctcgacgtgccgcagaacaaaacagtccatgagctgttcgaagcgcaagtcctccgcacgcctgaccgcggggcagcggtgtacaacggcgtgcagtggacgtacaaagagctgaatgcgcgcgccaaccgtctggcccggctgctgatcgaaaaaggggccggccctgaacagcgggttgggatcatggtgaagccttcgctggaaatggcggccggcgtgctcgcgattttgaaagcgggagcggcctatgtaccgatcgaccccggctatccggccgagcggatcggatacgtactgaaagacagcggtgcagaactgcttctgacgcaaagcggattaacgatgccggacgcatttaccggagaagtgatcgatttgaatagagaagcctccattctggccggcgagctttatcccgaggatgacatcaatccaagcgcagaggctcagtctgacaacctggcatacttgatttacacatcgggcacgacaggccagccgaaaggcgtcatggtcgaacatcaatcgctcgtgaacttgtgctattggcataacgatgcattcacggtcaccgaacaggacaaaagcgcgaaatatgccggcttcggctttgacgcttccgtctgggagatgttcccgtactggatcgccggagcggagcttcatatcatcgatgaagcgatccggatggacattacgcgtttgaatgaatatttcgaagagaacgggattacgatcacgttcctgccgacacagttgtgcgaacagttcatggagctcgacaaccagtcgctgcgcgtgctgcttactggcggagacaagctgaagcggatcgaaaaacggaactacacgctcgtcaacaactatgggccgacggaaaacacagtcgttgcgacgagcacagcaatcgatcctgatgaaggcatgctttcgatcggaaagccgattgccaatacgcgggcgtatgtgcttggacaaaacaacgaagttcagcctgtcggcgtcgctggcgagctgtgcatcgccggccgcgggcttgcgcgcggctatctgaaca

SEQ ID NO: 2167 - DNA, 3471 bp, Bacillus licheniformis
ctgatggcgtcgaaggggaattgtatattgcaggagacggagtcgggcgaggctatttgaacttgcctgacatgaccagagacaggttcttgaaagacccgtttgtatccggaggtctcatgtatcgaacaggggatactgcacgttggcttcctgacggtacagttgattttatcggccgaagagacgatcaagtgaaaatccgcggcttccggatcgagcttggcgagatagagtcggtgctgcaaggagcccctgctgtcgaaaaagcagttgtcctcgcgcggcatgaaaccggcggcagccttgaggtttgcgcttatgtcgttccgaaacaaggcggaaagattcacattcagggactgagggagcacttatccaaacacctgcctgattatatgatcccttcctgctttgtcgagcttaatgaaataccgctgacggcaagcggaaaagtcgaccggaaagcgctgcttcgccatgaggtgtctgtcagcgggactgcagaatatgcggcgccgagaaatgaatgtgaagaaaaaatggtgggtatatggcaggaagtgctcggagctgaacaagtcggaatccacgaccagttttttgatctgggcggccactctctcaaagcgatgaccatgctggcaaaaattcataaagctttcggagtcgaagttccgttgcaagtcctatttgaaaagccgacagtagcggcgctgagcggctttgtttctgaagccgagaaagacggattcgcggtaattgaaccggcgccggaaagtgacgattatcctctttcattggcgcagcagcgaatctatatcgtcagccagctggagggtgtcggctacaatatgccggccgcggcgatgcttgaaggcactcttgactctgggcgccttgaagctgcttttcaaaaactgattgataggcatgaggcgctgcgtacttcgtttacagttgtggatggcgagccgaggcagaccgttcatcaaagggttcagttcaagattgagaaggttaaggcggaaggcaagccgatcgaacaaatcgcgaaatcatttgtccgccgctttgatctcgccaaagctccgctgatgagagcgggtctcgtcagccttgcagacggcagacatctgctgttgttcgatatgcatcatctcgtatctgacggcgtgtcgatttcgatcatattgaatgaactggccgcgctgtataacggggaggaattgccggagctgcgtttgcattacaaagattatgccttctggcaaagggcgcaggcacaagaaggctttcaaaaagaagaggcctattgggaaagcatgtttgccggcgagcttcccgtactgcagctgatgacggacgagccgaggccgcctgttcaaagctttgaaggagacagggtatccgcagtcctgccaaaagacctgaaagaaaaattagccgtgctggcagagcaaaacggcgcgacattgtacatggtcatgctgtctgcgtacaacatgcttcttgcaaagtactccgggcaggaagatgtgatcgtcgggacgccggcggccggccgcagacattccgatctggaaggaatcatcggcatgtttgtcaatacgctggcgatccgttcaaaagtggacccgggcagaacgttcgcagacttcctgaatgatgtaaagaaaacggtaatcgatgcttttgagcatcaggattatccgtttgagcggcttgcggagaagtttggcgcatcgcgcgatttaagccgtcatcccatctttgacacgatgtttattttgcagaatgcatgggaagacattccgctgctcggcgatttgcacctctcgatttatgaaacgaacttcaatattgcaaaattcgacttgacgctgcaggcaaaagaagagcagggagaattgatactcgatttggattacagcacgaagctgtttaaaaaagatacggctgaaaggatgctgaaagcatacttgaaccttctggaggacatggcggctgatccgatgctcaggatcggcgagtacagccttttgacagaagaagaaacgaatcgccagctcgtcgcgttcaaccccgcgacaagcgattatccgcgggagaaaacgatcgttcagctattcgaggaacaggctgcagaaagaggcggttatcccgccctgcaatttgaagacaaagtatggtcatatgatgagctcaatcggaaagcgaaccaattggcaaggcgcctccgcgaaagtggcgtgcaagccggcacgacggcggccattcttacggccaggtcggctgaaatggtcatcggcattctcgctgtgctgaaagccggcggggcttatgtgccgatcgatcccgatcatccggaaaagcgtgtgcaacatttcttcaaggacagcggagcggcggttcttttaacgcaaaaggcgatgaagccgctcgctgaggcggcggaatttggcggcgacatcctatttgttgaggatgaaaacctttatatgggagatgcgtctgatttgcgccttccgatttctccggaagcaatggcaaatctaacgtacacatctggaacgacagggacgccgaagggcaatatggtctctcaccggaatattttgcgtactgtaaaaaacgcgaattacttggaagtgatggaatccgatatcgttctttcgatttcaaattatgtgttcgacgcctttatgtttgatgtgttcggttcattgctgaacggcgccaagctggtgatagctccaaaagacacgattcttgatatgagccggctcgcacatgtactcgaaaaagaaaagattacgattttaatgatcacgaccgcattattcaatctgctgacagacatgcggccggacagtttgaagggactccgcagggttctgttcggcggcgaacgtgcatctgtcgatcatgtcagaagagccctgaagacagttggcagagggcggctgcttcatatgtacggtccgtctgagagcacggtctttacaacctaccatccagtcaatgaagtgccggacgatgcgcaggctataccgatcggaaagcctgtcagcaatacggaggttctgattcttgattcattcggcaatgtacagccggcaggggttgcgggagaattatgcgtcggcggagacggccttgtccgcggctattttaaccgccctgaactgacggctgaaaagtttacggcgcatccgttcaaaaccggcgaaaagatttaccggacgggtgatatggcgagatggcttgccgacggatgcctcgaatttatcggtcggattgatcatcaggtcaaaattcgcggacagagaatcgagctgggcgaaatcgagcatcatctcctaacgcatgacatggttcaggaagccgctgttcttgctgttgacaccggggcgggagatcaaatgatctgtgcatactttacggctgataggagctttcgagccaaga

SEQ ID NO: 2168 - DNA, 3234 bp, Bacillus licheniformis
tcgaagcggttgccgaaaccccggatgcaagtctttcagacctttcgcttctggatgaagcggaaaaacggcggatcgtccaaaagtggaatgagacgaagctcgctgtgccgcaggacaaaacggtccatgagctgttcgaagcgcaagtcctccgcactcctgaccgcggggcagcggtgtacaacggcgtgaagtggacgtacaaagagctgaacgcgcgcgccaaccgtctggcccgcctgctgattgaaaaaggagccggtcctgagcagcgggtcggaatcatggtgaagccttcgctggaaatggcggccggcgtacttgcgattttgaaagcgggagcggcctatgtaccgatcgatcccggctatccggccgagcggatcggatacgtactgaaagacagcggtgcagaactgcttctgacgcaaacaaacttagccgtacctgaagaattcagcggtgaaacgcttcttctcgattcgatgctgagcgaagaaatcacaaatgatgatgaagtgaacccgcaggcaggtacacagccaaacaacctggcatacttgatttacacatcgggcacgacaggccagccgaaaggcgtcatggtcgaacatcaatcgctcgtgaacttgtgctattggcataacgatgcattcgcggtcaccgaacaggacaaaagcgcgaaatatgccggcttcggctttgacgcttccgtctgggagatgttcccgtactggatcgccggagcggagcttcatatcattgatgaagcgatccggatggacattacgcgtttgaatgaatatttcgaagagaacggaataacgatcacgttcctgccgacacagctgtgcgaacagttcatggagctcgacaaccagtcgctgcgcgtgctgcttacgggcggagacaagctgaagcggatcgaaaaacggaactacacgctcgtcaacaactatgggccgacggaaaacacagtcgttgcgacgagcacagcaatcgatcctgatgaaggcatgctttcgatcggaaagccgattgctaatacgcgggcgtatgtgcttggacaaaacaacgaagttcagcctgtcggcgtcgctggcgagctgtgcatcgccggccgcgggcttgcgcgcggctatctgaacaagccggaggaaacggcgaagcgttttacggaagacccgtttgtgccgggcgagcgcatgtaccggacaggggatgcggtcaaatggctggaagacgggcggcttgagtacatcggccggatcgaccagcaggtgaaaatccgcggcttccggatcgagctttctgaaattgaagtccagctcgcgcggctctctgaagttcaggaagcagtcgtcaccgacatcgaagacgcctacggcaacaaagcgctgtgcggctatgtcgttgcggacgaacagcttgatacagaaagcctcgcccgtaagctggggcagacgcttccggactacatggtaccggcgtattgggtgcagcttgatgagcttccggttacggcgaacggaaaagtcgaccgaagggcgctgcctcagcctgacgtcgaagcgcagacagccgaatacaaagcgccgcgcacagaaacggaacagctgttggcggacatttggcaggatgttctcggcatagaccgaatcggagtcacggacaatttcttcgcgctcggcggggactcgatcaaaggaattcaaatggcaagccgccttcagcagcacggttggaagctggagatgaaggacttgtttcagcacccgacgatcggggagctcagtgcttatgttcaagcggctgacgatcagccgatcgatcagaaccctgtcgaaggcgaagtcacactgacgccgatccagcgctggttctttgagcgcaaatttacgaacgagcatcattggaaccaatcagttatgcttcacgccccttcagggtttgacccggaagcggcaggcaaggctttaaccaagatgatcgaacaccatgatgcacttcgcatggtttatcagcgaaatggagacgggattgttcagtacaacagagggctggaagaaacagcggttcgtcctgaagtcatccgcttcaatgaatcgggtgctgaacttgaagctgccgtgttaaaggaatcaaaccggattcaaagcagtatcaatttaaccgaaggcccgcttttgaaagcggcgatctttgagacggatcaaggcgatcatcttctcatcgtcattcatcatctcgttgtggacggaatttcatggagaatcctccttgaggatttcgccgccgggtacgcccaagctgaaaaaggggagccgatcattcttcaagaaaagacgcactcttttgctgaatatgcggctcgcctgaaagaatacgcaaggtcaaaagctttcgcgaaagaaatcggctattggcaggaagtcgagaaggcggagacggcatcgctccctaaagatgatgaagcagaggacaaacggatgcaccatacgaaaacggctgagttttctctctcgaaagaagaaacagaacagttgatgacaaaagttcatgaagcatataacacggaaatgaacgacattttgcttacggcgttgggcttggcgctgaaagagtggaccgggcaggaagactttatcatctgcttggagggacacggccgggaggacatcatggaaggcttgaatatttcccggacggtcggctggtttacaagccagttcccggcgctgattcaactgcgccattccgaagatatcggctatcaaatcaaacagatcaaagaagagttgcgccacattccgaataaaggaatcggctatggcatttatcgctatttgaccgaagaaggcaaaaaggcgcagccgatcaagcatgatatcagctttaactatttgggccagtttgcagagatggcggattcgggtctgttcacgagatcagctttgccgtccggcgatccgctcagcccggaaacggaaaaaccgaatgcgctagacatcgtcggctatatcgaaaacggcattttgacaatgtcaattgcctatcattcactcgaatacaaagaaagcaccgtcgccgctgtcgccgcaagctttaaaacttatttgctgcaattgatcgatcattgcttagagctggatggaggcgaactgaccccgagcgatcttggagatgacgaactaacgcttgaagaattagataaactgatggaaattttct

SEQ ID NO: 2169 - DNA, 8268 bp, Bacillus licheniformis
atgtaccgcacgggcgacttggcaaaatggcttcccgacgggaatatcgaatttctcgggcggatcgatcatcaagtgaaggttcgcggcttccggatcgaattaggcgaggttgaagcggctttggcccgccttgagggaatttcagaagcggctgctgtcattcgggaaaacaataccggagaaaccgagatttgcgcctactacactgcagttggcgcgaggccggccgcacagctgcggacagagctgtcccggtcgcttccggagtatatgattccggctcatttgatcgaactcgacagcatgccgctgacagccaacggaaaggttgacaaacggcagctgccggctcctatcgctgaagagactgacagattcgaagcgccgaaaaatgaaacggagaaaattctggcggcaatctgggaagagattctcggcatcaagcagccgggaatcgatgacaacttcttttccatcggcggacactcgctgaaggcgatgatgctgacagccaaaatacaagagcagctccaaaaagaagtgccgatcaaagtattgtttgaaaaaccgacgatcagagagctggccgaatttcttcaaggggaaacgaaagagaaaaccgctccgattgcgccggcgccgtcccgtgcgaattatccggtgtcatccgcccaacggcgcatgtacatcctcaatcagctcgaagaagcaagcacgagctacaatgtgccggcggttctgcttctggaaggcgaattggataaggagcgtctggaagacgcgtttcgggccttgatcagccgccatgaaacattgcggacatcgttcgaattaatcgatggagaaatcgttcaaaccatccatcaagacgcagtttttcacctgacggaatcagtggcggatgaagcggaagccgaagcggcgatcagagggtttatccggccgtttcagctgaataaggcgccgctcgtccgggcggaactcgtaaagcttgaagaaaagcgccatctgctgatgatcgatatgcaccacattattacggacggaagctccaccggcatattgattcgcgacctggccagcttctaccacggtgaagaggcgcctgctcctaagctccactataaggatttcgctgtgtggcaaaacgggccggagcatcaggagaaattgaaagaacaggaacagtattggctcgatattttcaaaggcgagctgcctgttctcgatctgccgtacgattttccgcggccttcaaaacgcagctttgaaggcgaccgtgtcgtctttggaatcaatcgaaaactgacggcagacgttcaaaagctgctttctgaagccgatgcgacactttatatgttcctgttggccgcgtttaatattttgctgtccaagtatgcgtctcaggaagatttaatcgtcggatcgcctgtggccggcagaacccatccggatctgcacaacattccgggcatgtttgtcaatacgctggcgctccggaatcgtcccgaaggggaaaaaacgtttaaggaatttttgcaggaagtcaaagagacaagtcttcagggctttgccaagcaggactatccgcttgaagaactgattgaaaaactgccattgccgcgggatacaagccggaatccgctgttcagcgtctttttcaacatgcagaacatggaaatcccgacgctgaaactcggagatttgcagatttcgtcttactcggtgcgccatcgcacagcgaagtttgatctgtcgcttgaggccgtggagcatgatggggaaatcggtttgagctttgactatgccgtatccttatttaaagaagaaacgatcaggcgctggagcggccacttcttaaatgtgattaaaacaatctgcgaaaatcccggcattaagctccgggacatcgaactgctttcagacaaagagcgcggacttctcctggaagaagtgaggcgcagccgggcagaacgcctagaggagcggccgtttcatgtacggtttgaagaaaaggcggccgaaatgcctgatcagccggctgttgtctgcggggaaacaatcctcacataccgcgggctagatgaaagagcaaatcaaattgcaaatgtgctgcgaagtgaaggcatcggaaaagacgacgttgtcggcattatgctggatcgttctgcagaggtcgccgcggcaattctcggcgtaatgaaatcagggggcgcttttttgccgattgatccggaaatgccgacgagcaggattcaatatatgctggaagacagcaaagcccgctggctcttaacagaacattcccatcaagctgctctcgcagattggtataacgggagattgatagatgtgagaaacgacacgctgatggcaagcaaaaaacgaccgcatctaatccatgacggggcgagtctggcgtacatcatctatacatccggaacgacgggtcagccgaaaggcgttcagctggaacaccgcaatctggcaaactatgtttcctggtttatcagtgaggcgcgcctgtcagcttcggataaaacgatgcttttgtcttcctatgcgttcgatctcggctacacgagccttttcccggtgctgctcgccggaggagagctccatatcgtccggaaagaaacgtatacagaaccggagacatttattcattatatcggtgaacaagggatcacatatatcaagctgacgccgtcgctgttccatacggtcgttcagccgcaaagcttcgctttggcaaaggggcttcagtcattgagactgattgtactagggggagaaaaaatcaatccgaaagatgtcgaacggttccattcccgctatccggacacccggttcatcaatcattacgggccgacggaaacgacgatcggtgccatcgctaaaccggtcgaaccgggcatgatccggcaattcgccgagcgcccgacgattggacggccgatttcgggcgccggagcactggtattggacgcttcccgccggcttgttcccgcgggagcggcaggcgagctgtatattacgggaagcgggcttgcaagaggatatgtgaacaaccgggaacttacggctgcgaagtttatcgaaaatccttacacaccgggcacattcatgtaccggacgggggatctcgtccgccgtcttccgaatggggagattgaatttttagggcggacggatgatcaggtgaaaatccgcggctacagaatcgaattgaaagaaattgaagaggccttcattggacttgaacatatagagagagcggtcgttctttcatttacggctgactcagggctagacgaactgtgcgcttatattcaagcgaaacgacagctgccggtttccgaaatgagagagcgtctttctgagcggcttccgtcgtacatgatcccgtcatatttcgtaacggtggataaaatgccgcttgcggcgaacggaaaagtggaccgcagcgcgctgccggagccgcaaggtctaagtggtcaaagcgattcatatagagcgccgtcaaccgaatttgaaaaagccctctgcggcatttgggaggaggtgcttggcgttcggccggtcggacttgacgacaatttcttcgatcttggcggacattcattaaaaggaatgatgctgacagcggaaatccaatccaagctcggaaaaaaagtaccgttaaaaacgttgttcgattgtccgacagccggcttgctcgcccgcagtatcgaagccgatggacaggcagaacaaagcgggattcagcctgccgaaaaacgcgactggtatcccgtttcatccgctcagcaacggatgtatgccctccatcatattgaaaagaacggaacgggctacaacatgccgtctgttctcatgctggaaggcgtacttgatacggatcgcttaagacgggcattcgcagacttggtgaaccgccatgaatcattgcggaccgcattcgttgaaatcgatggccgcaccgttcaaattgtgcatgaaaaagcggacattgacttaaaggttattcatattcatgaagaggacgcagaagcacagatcaaccgctttatcagaccatttgatctcagcaccgctccgctgatcagagccgagctgctctccatcagctctgcgcgccatctgcttttgattgatacgcatcatattattgcggacggcgtttccagaagccttttcgtcaaagaaattgcacagctttataaaggcgcttcgctccctgaaccgaagctgcattataaagattatgcggtgtggcagcaacaacctgaccagcaagaaaacattcggaaacaggaagacttctggctccggcagtttaaggaaaccgttccggaactcagccttccgctcgactttccgcgtcctcctgtccaaagctttgccggggaccgggttcactttaaagtatcaaaaggcaccgcccttaaaatccgccgtttgatggcgaaaacgaacacgacgctgaatattgtaatgctcgccgtttttaatctgtttttaagccgtcttgccggccaaaaggatattgtcgtcggctcagcggcagcgggcagaacgaatgctgatttgaaagacgtgccggggatgttcgtcaactcgttggcgctgaaaaaccatgtacctgatcaagcatcattcagcgggtttttggaagaggtgaaaaacaacagcctcgcagccctcgaccatcaggactatccgtttgaagagctgattgccaagcttgatttgccgcgcgatatgagccggaatccgctgttcaatgtcatgctgacaacggaagatcctgataaagaaacgctcgatttagacggtctgataatcaagccgtatgagacttcacatgccgctgccaagttcgacctgacactgggggcttttgaaaaagatgatgaaatcggtcttcagttcgaatatgcaacagatttatttaaaaaacaaacgattgaacgctggagcggatatttgcttaacctgctcgaagcgattgccgaaaacccggatgcaagcctttcagacctttcgcttctggatgaagccgataaacggcggatcttgtacgaatggaacgaaacagttctcgacgtgccgcagaacaaaacagtccatgagctgttcgaagcgcaagtcctccgcacgcctgaccgcggggcagcggtgtacaacggcgtgcagtggacgtacaaagagctgaatgcgcgcgccaaccgtctggcccggctgctgatcgaaaaaggggccggccctgaacagcgggttgggatcatggtgaagccttcgctggaaatggcggccggcgtgctcgcgattttgaaagcgggagcggcctatgtaccgatcgaccccggctatccggccgagcggatcggatacgtactgaaagacagcggtgcagaactgcttctgacgcaaagcggattaacgatgccggacgcatttaccggagaagtgatcgatttgaatagagaagcctccattctggccggcgagctttatcccgaggatgacatcaatccaagcgcagaggctcagtctgacaacctggcatacttgatttacacatcgggcacgacaggccagccgaaaggcgtcatggtcgaacatcaatcgctcgtgaacttgtgctattggcataacgatgcattcacggtcaccgaacaggacaaaagcgcgaaatatgccggcttcggctttgacgcttccgtctgggagatgttcccgtactggatcgccggagcggagcttcatatcatcgatgaagcgatccggatggacattacgcgtttgaatgaatatttcgaagagaacgggattacgatcacgttcctgccgacacagttgtgcgaacagttcatggagctcgacaaccagtcgctgcgcgtgctgcttactggcggagacaagctgaagcggatcgaaaaacggaactacacgctcgtcaacaactatgggccgacggaaaacacagtcgttgcgacgagcacagcaatcgatcctgatgaaggcatgctttcgatcggaaagccgattgccaatacgcgggcgtatgtgcttggacaaaacaacgaagttcagcctgtcggcgtcgctggcgagctgtgcatcgccggccgcgggcttgcgcgcggctatctgaacaagccggaggaaacggcgaagcgttttacggaagacccgtttgtgccgggcgagcgcatgtaccggacaggggatgcggtcaaatggctggaagacgggcggcttgagtacatcggccggatcgaccagcaggtgaaaatccgcggcttccggatcgagctttctgaaattgaagtccagctcgcgcggctctctgaagttcaggaagcagtcgtcaccgacatcgaagacgcctacggcaacaaagcgctgtgcggctatgtcgttgcggacgaacagcttgatacagaaagcctcgcccgtaagctggggcagacgcttccggactacatggtaccggcgtattgggtgcagcttgatgagcttccggttacggcgaacggaaaagtcgaccgaagggcgctgcctcagcctgacgtcgaagcgcagacagctgaatacaaagcgccgcgcacagaaacggaacagctgttggcagacatttggcaggatgttctcggcatagaccgaatcggagtcacggacaatttcttcgcgctcggcggggactcgatcaaaggaattcaaatggcaagccggcttcagcagcacgggtggaagctggagatgaaggacttgtttcagcacccgacgatcggggagctcagttcttatgttcaagccgctgacgctaaaccgatcgatcaaggccctgtcgaaggcgaagtcacactgacgccgatccagcgctggttcttcgaacggaaatttacgaacgagcatcactggaatcagtcggtcatgcttcacgccccttcagggtttgacccggagctcgtcgaacagacattggcggcattgacagagcatcatgatgcacttcgcatggtgtatcaaaagaataacggccgcctcattcaatataaccgcgggccggatgaccgttcgttcgcctttcgagtggttgacctgcgatatgtcaccgacattgaaacggaaatagccgctcaagcaaaccgccttcaggcaagccttgatcttgaaaacgggccgcttgtaaaggctgaacagtatcagactgcggaaggcgaccatttgctgatcgtcattcaccatttggtgatcgacggcgtgtcatggcggattctgctggaagactttgcatcaggctattcgcaggccgcacagcagcatgatgttgttttccctgataaaaccaattcgtttaaagactgggccgaagcgcttgaggcttatgcgcaaaccgaacgcttccttaaaacggccgattattggcgcagacttgaacaagagcgtatttgtgagctgccgaaagatcgtgctgccgcagaaagaaaagcggaaaacacctctgctgttaagtttgaattaagcgaagcggagactcgtctgctgctgacgaaagtgcatgagccgtatggaacggatatcaacgatatcctgctttccgctctcagcctgacgatcagggaatggacgaacggctccaatatttgcatcaatatggaaggccacggcagggaggaaatcattccagggatgaacatttcgagaacgacggggtggtttaccgcacaatatccagttgttttaaaaagccaagcagcggcagggttgcctgagaccattaaaaacgtcaaagaaaccctccggcgcattcctgacaaaggaatcggctacggcatccttcgctacttaacagaccggaaaaaagccggtgcaattttctcgatcaagcctgacatcagctttaactacctgggacagatcgacagggaggtgcagaccggcttctttgggccttctccttatgatatgggaagacaggtctctgaaaggtctgaagcactctatgcactgagcttcagcggcatcatcagcaaggaaaaattcatcttgtcatgttcattcaatacagaggaatatgacaggcagaccatacaggagctcatggacagattcaaagctttcctgacagcattgatcgaccattgtacagctaaagaagaacgcgaatttacaccgagtgatttttctgccggcgatcttgagatggaagaaatgggcgacctgtttgacgttcttgaagaaaacttgaaataa

SEQ ID NO: 2170 - DNA, 2691 bp, Bacillus licheniformis
agtggaagacagcctcctgacgaagcttgaaggccttgaaggcgtagcttccgttcagctttccggtcagcaggttgaagaagtcgaattttcatttaaaaaagacaaattgaagcaatacgggcttgacgaggatacagtcaagcaagtgattcaaggatctgatgtgacgactccgcttgggttgtacacattcggcaaagaagaaaaatcggtcgtcgtcagcggcgatatcgacacaattaaagacttgaaaaatatgagaattccagcggcgtctgccggaggcgcaagcgcgcaagccggagcgcaaagtgcgcaggcggcccagggggcgcaggctcaagccggggcacagagcgccggacaagctcagcaaagcgcgggagtcccgacggttaagctgtctgacatcgcaacgattaaagatgtcaaaaaagccgaatccatttcacgaaccaatggcaaagacagcatcggcatcagcgtcattaaagcaaacgacgccaataccgtcgaggtagccgacaacgtaaaagctgaactcgaacaattcaaaaaagaccacaaaggcttcaaatacagctcgacatacgatcaggccgaaccgatcaccgagtcggtcgagacgatgctgagcaaagcgattttcggagcgatctttgcggttgtgatcattctcttattcctaagggatattaaatcaacattaatctcggtcatttcgattccattgtcattgttaatcgcactgctcgtcctgaaccagcttgatatcacgctgaatatcatgacgctcggcgccatgacagtcgccatcggacgggttgtcgacgactcgatcgtcgtcatcgaaaacatttaccgccgcatgaggctgaaagatgagccgctgcgcggaaaagcgctcgtgcgcgaagcgacgaaggaaatgttcatgccgatcatgtcatcaacgatcgtgacaatcgcggtattcctgccgctcgcacttgtcggcggtcaaatcggcgaattgttcatgccgtttgctttaacgattgtattcgcgctcgctgcatccctcttgatcgcgatcacgctcgtgccgatgcttgcgcacaccctcttcaaaaaatcattgacaggcgcgccggtaaaggcgaaagaacacaagcctggggtactggccaacttctacaaaaaagtgttgaattggtcgctcagccataaatggatcacatcgatcatcgcggttctgatgctggtcggaagcttgttcctcgtgccgctgatcggagcgagctacttgcctgccacaaaagaaaaaatggtgcagatcacgtacacccctgaaccgggagaaacgaaaaaagaagcggaaaaggaagcgcaaaaagctgaagaaatcctattggaccgcaaacacgtcgatacggttcagtatacgttaggagcgggaaatccgctgatgggcggaagttcaaacggcgcgttgttctatatcaaatatgaggaagacacgcctgattttgatcaagaaaaggacagcgtcttaaaagacattcagaagcaatccaaacgcggagaatggaaaactcaggatttcagctcctcaggcaacaacaatgagttaacgtattatgtgtacggggattctgaaaaagagattaaaggcactgtaaaagagatcgaaaagataatgaaagaccaaaaagacctgaaaaacgtaagctcaggcctgtccagcacatatgacgaatatacatttgtcgctgaccaggagaaattaagcaaactcgggttaacggcatcacagatttctcaggcgctcatgaaagaaacatcgcaggcgccgcttacaaccgtgaaaaaagacgggaaagatcttgatgttacgattaaaacagaagaagaaacatataaaagcgtcaaagatttagaagacaaaaaaatcacaactccgaccggccaggaagtgaaaatcggcgatgtcgcgaaagtgaaggaaggcacgacatccgacacaatttcgaaacgggacggcaaaatctatgccgatgtcacggcggaagtcacatcagacaacgtcacggccgtatcagtcgacgtacagaaaaacatcgacaagatcgacctgcctgacaacgtcacaatcgataccggcggcgtatccgctgatatcgaagattcctttacaaaactcggactcgcaatgcttgcggcggttgcgatcgtctacctcgtgcttgtgattacattcggcggagcactggcgccatttgcgatcctgttctcgctgccgtttaccgtcatcggcgccttggtgggactttacgtatcaggagaaacaatcagcttgaacgcaatgatcggaatgctgatgctgatcggtatcgtcgtcacaaacgcgattgtcctaatcgaccgcgtcatccataaggaagcggaagggctctcaacgagagaagcactcctggaagccggctctacaaggctccgtccgatcctgatgacggccatcgccacaatcggcgccctgattccattggcgctcggatttgaaggcggcagccaggtcatttcaaaagggctcggcgtcaccgttatcggcggtctgatcagttcaacgctcctcacccttctgatcgtaccgatcgtatacgaagtactggcgaaattccgccggaaaaaaccgggtatggaagaaga

SEQ ID NO: 2171 - DNA, 7158 bp, Bacillus licheniformis
atgcctgaatgtcaacataaccgaaagccattatcaggagcgcaagccgggatttggtttgctcagcagcttgatccggaaaatccgatctacaatacagctgaatacgttgaaattaaaggcccgcttgatcaggagcttttcgaaaaagcgctgcgccatgtcattaaagaagctgaatcatttcatgccagatttggagaagatcaagacggaccatggcaagagatcgttccgtcaacagattttccgctacattacattgatgtcagctcagaaaccgatccggaacaggcggctaaaagctggatgatggatgaccttgcccgtccggttgatctgactcgcggcccgctttttacagaagcgctttttaaagcggcgcaagatcattacttctggtatcagcgaactcaccatatcgcaacagacgggttcagctttacattgatcgccgagcggctgtcaaaaatatataccgcattgatgcagaacaaatcgatcgaccagagcggagcctttggctccctcgatttgattctcgcggaggaaacggcttaccgtgcatcagaacagtatcaggaagatcggcgattttggcttgggcgtttcagcgatgaaccggaggtggtcagccttgccgaaagggcgccgcgtacctcttcaagttttcttcgcaggtctgaacacctgccaagtgaggatgctgatcgtcttctgtctgccgcgagcagaatgggggcaacttggcacgaaaccgtgatggcagcagcagcaatatatgttcaccgtctgacaggggcaaatgacgtcgttctcgggatgccgatgatgtgccgcctcgggtcagccgctcttcatattccgggaatggtcatgaatctcctcccgcttcgaattggcatgcagccgcaaatgagcataggagagctagtcaagcaaatctcgggtgagatgatgaagctgcggcgccatcagcattaccgccacgaagaattgcgccgggatctcaagctgcttggcgaaaaccagcggctgttcggtccgcagcttaatttgatgccttttgagaaccgcttgaattttgccggctgtcaaggcatcgtgcataatcttgccacgggacctgtggacgatttgtcaatcaacatttacggccgtccggacggtggcgggctaaaagtaaacatggatgcaaaccctgctgtttatcatgcggatgaacttgaagatcacggcaatcgttttcttactcttctgaaaacgattgccgtttgcgaacaaactcagccggtggggacgttggacattcttctccctgaagaacgcgctcaaatattgattgaatggaatcaaacagaacacgggcttcccaaagagagtcttccgcagcgatttgaaaggatggcaaaggagtgtcctgaatctccggcagtcgtttgcaatgataaggttctcacttattccgaattaaatcaaaaggctaatcaactggctcacttgctgatcgatcagggggcgaaacccgagacatttattgccttggcgttgccgcggtcagcggaaatggttgtcagcatgctcgccgttctcaaagctggagcggcttatttacctatagatcccgattatccggctgacaggatcgagtatatgctcaacgatgcacagccgctgcttgttatgaccagcaaggaagcgcaagacacgatcggttcgcaaatgccgaagttaatcctcgatgaacaaactgttatggagaaaatgtccggctgttctgaagaaaatcccggcgaacagcattccggcaaccagccggcatatatgatttatacgtcgggatcaaccggcagacctaaaggcgtggtcgtacaagctgaaagcttattcaattttttgctgtcaatgcaggacatgttcgcgcttaatcaagatgaccggctgctggccgtcactacaattgcattcgacatctcagcactcgaaatttatttgccgctgatcagcggatcagcagtcgttcttgccgagaaggaaacggtacaagatccgtccgaattggccaaaatgattgaaacatacgaaattacaataatgcaggctacaccgaccctctggcatgcattggcctcgagcgccccggaaaagctcaaaggtcttcgtgcgcttgtcggcggcgaagctttgcaatccagcctggcccggcaattgcagcagctcgcgtgttctttaacgaacctttatggaccgacggaaacaacaatttggtctacagccgctgcgctggaaggcaactgtacggaacctccgggaatcggctgtgcgatttggaatacgcagctttatgtcctggacgccggattacagccagtgcctccgggaacggctggagaactttatgtggcaggaacaggggtagcgcgcggctacttgaaccgacatgctctcacggctgagcgctttattgcgaatccatacgggccgcctggatcgcggatgtaccggacaggcgacatcgtgcgctggcgcgaagacgggtcgcttgattatatcggccgtgcagaccatcaagtcaaaattcgggggttccgaattgaaatgggagaaatagaagcggtgcttgcaaatcatccggttgttaaacaagctgctgctatcgttcgtgaagaccagcccggtgacccgcgtttattcgcgtatgccgttcccgcttcgggagaaagccttgatcctgccgagcttcgccgcttcgttggtgagacactgcccgactatatgattccgtctgcatttgtcatacttgatgaactgccgcttacgccgaacggaaagcttgaccgcaaatccctgccggctccggcggtgagtatgcatacaggcggacgcgagccgaggactccgcaagaggaaattttgtgtgatttatttgctgaggtgctgggggtgccgcgagtcagtattgatgacagcttttttgacctcggcggacattcccttctggcaggcaggctcgtcggccgcattcgggaaatgctcggcgtcgaactcggaatcggccgtttattcgatgagcccacagccgccggacttgccaaacagcttgatcaggcgcagagcgcccgtccggcattgcgcaaaagagagcgccgcaaggagattccgctgtccttcgcacagcggcgcctatggtttttgcactgtttggaaggaccgagcccgacctataatattccggttgtcgttcatttaactggagatttggaccaaaaggcgctggcagctgctctgggtgatgtggcaacaagacatgagccgcttcgaacaattttcccggatcagcaagggacaacacaccagctgatattggaagaggatcaatcgcgtcccgaactcactgtatcccatgtcagcgaacatgagttggaaaaagtcctggctgaggccgtccggcaccgttaccatttagaaaaggagcctccgtttcgcgcccagctattcgtactcggaccggacaaatttgtgcttcttctgcttttgcaccatatgatcggcgacggctggtctttaatgccgctgacccgtgatttggaaaccgcctataatgcgcgtctgcaaggtgaggcacctgtttgggagccgctttctatacaatatgccgactatgccgtatggcaggaatatctgcttggcagtgagaacaatccggacagtctgattgccaaacagctcgaatattggtcgaaggcattggaacatctgcctgatcagctggagcttccgactgatcacccgcgtccgtcggaatctagctacagaagcggtacgattgatctcagcattgacgaacagctgcacggccgcctgttcgatttgtcccgcagcaccggagtcagcatgtttatgattttgcagtcggctcttgccgcactactgacacggctcggagcaggccatgatattccgctcggcagcccgatagcgggaagaaacgatgatgctttaggcgaaattgtcggattgtttgttaatacgcttgtgcttcgaacagatacatcgggtaatccgagttttcgggagcttctgaacagagtcagaaaagtaaaccttgcagcgtatgagcatcaggaccttccgttcgagcgtcttgttgaagtgcttaatccgcgcaggtcaagagcgagacatccgctgttccaaattatgcttgcctttcaaaatacgcctgaacctgagcttgacctttccggcctcaagtcagacattgaaattcgcagcgtcggagcagccaagtttgatttgacgattgagcttcgcgaacatcgaaaagcggacggaacacccgcaggtatcggcggatttcttgaatacagcacagatttatttgagcgaaatacggttcaaacattggcagaacggcttgtcaggctgctggattcagcagcagacgaccctgatcagccgatcgaaaaactcgatattctccttccggccgaacgggaaaacatgctggctgattggagcaaatcgtccaacagcataccttgttcatctttgcccgttttgtttgaaaagcaggcggcaaaggatccggaagctgttgcggttatatgtgaaaataatgcgctcacatacggcgagcttaataaacgcgctaaccggcttgctcatctcctgatcgccaaaggggtcggccccgaacaatttgctgccctggcgctgccaagatctttggatatggttgtcggattgcttgcagtgctgaaggctggcgcggcatatgtgcccctagatccggactacccggcggaaaggatagcgtttatgttgaatgatgcccatcctgtctgcatcgtaacgagttcagcggtagaatcaaatctttctgttcccggatctgttgaaaggattgtactcgatgatccttgtatacaagaggaactgaaaggatgcgctgctgcgaatccgtgtgatgccgaccgcaccgcgcctttgctgcctcttcacccggcgtatgtcatttacacatccggttcgaccggcaagccgaaaggagtcgttgttccgcatcaaaatgtcgtgcggctgttcggagcgactgaccaatggttccatttcggcgctgacgatgtttggacgatgtttcattcttacgcatttgacttttcggtatgggaaatttggggagcacttctcaatgggggccggcttatcgtggtgcctcatacaatcagccgctcgccggccgaatttctcaatcttctcgttcgcgagggagtgactgtgctcaatcagactccttcagcattttatcaattgatgcaggctgaccgggacaatgctgagacaggaaagctcctttccttgcgctttatcatttttggaggggaagcgctcgagctgaagaggcttgaagattggtatgaacgccatccggatcatttcccgcggctgattaatatgtatggaattacagaaacgacggtgcatgtcagctatatttctctcgatcagcagactgcggcacttcaagcgaacagcctgatcggccaggggattcccgatttaggtgtatatgtgcttgatgagtatcttgaaccggtgcccccgggcgtcaccggagagatgtatgtgtccgggggcggtctcgcacggggttacttgggcagacccgatttgacagcagaccgctttgtcgctgatccgtttggtccgccgggaacccggatgtaccgcaccggcgatcttgcccgcaggcgccaggacggctctctggattatatggggcgggccgaccagcagatcaagatccgcggcttcagaatcgaactcggcgagatagaagcggtgcttgtccgccatcatagagtgaatcaagccgctgtggtcgtaagggaaggccagcccggggacaagcgtctgatcgcctacgttgtcccggcgtctgaagaagaaaccgatccggctgagctgcgacggtttgccgcaggcactctgccggagtacatggtgccttccgcatttgtaaaaatttcagagctgccattgactccaaatggcaaacttgaccgaaaagcgctgcctgagcctgactttgccgcggctgttaaagggcggggcccaagaacaccgcaggaagaaatcctgtgcgatcttttttcagaaatcctcaatgcgccgagagtcggtattgatgacggattcttcgaacttggcgggcattctcttctcgccgtacagctgatgagccgcattcgtgaagcgctcggagtcgaactcggcatcggcgacctgcttgaagcgcctacagtcagcggacttgctgaacggcttgaatccggcggcaggcaaagtgcgctggatgtaatgcttccgctgagaaccggaggcagtcaagatcccctgttctgtgtgcacccggccggaggcctcagctggtgttatgccggtttaatgacggcactcggcaaggaatacccgatatacggccttcaagcccgcgggatcgcaaggcaggaagagctacctgatacgctcgacgacatggctgctgattatattcggcacattcgtacgattcagccaacaggcccttatcgtctgctcggctggtccctcggaggcaatgttgttcatgcgatcgcaactcagctgcaggaacaaggggaagacatatcgcttcttgtcatgcttgatgcttacccgaatcacttccttccaattaaagatgcgcctgatgagcaggaagcattgattgccctcttggcattgggaggatacgacccggacagccttgacggggcaccgctgaacctttccagtgcgatcgatattctgcgccgcgacggcagtgcgcttgccagcctggacgaggctgcgatcttgaacttaaaggagacgtatgtgaattccgtccggattttaagcgaatataagccccgcgtctttcatggcgatattctgtttttcaaatcaaccgtgataccggaatggtttgatccgatcgatccggagtcatggctaccttatttgaacggaaacattgatattcatgatatggattgccggcataaagatttgtgccagccggagccgctggccgaaatcggacgtcgggtttcggaaaagctggacgacttgaaaaaagatacggataagtag

SEQ ID NO: 2172 - DNA, 1791 bp, Bacillus licheniformis
aggcgaaaaaacaaacgttgatgaaccggtttttttatacttcagaccaaatcattgaaaagccttttaactgggcgcagatgtggaggctgcttaaatatttaaagccctaccgaaaaaatttgctgccgctgtcgtttttaacggtcatgatctcggcggcgatccggctggcggtgccgattttgatcggcgtctatgcgctcgaccaagcgatcgcaggccgggatatgaatcttcttgtgattctgatctccgtcatcagtgggttgtatcttgtcaattatgttagcaatgtgctgagaatccgctggatgaacaagcttggccagcatgtcatatatgatctcagacagcatttgtttacgcatgttcagcggctgtcgcaccgctttttcgacgagcgttcggcaggttcaatccttgtccggatcatgaatgacatcaattctttgcaggaactgtttacgagcggagtcatcaatttattgatggatattttgcttctttttggaattgtcgtcattctgttctcgctcagtcctgagctgaccatcgccattatggtgacgctgcctgtgatgttcttcatttctactaatctcagaaggaaaatccggcgatcctggcaaaaggtgcgcttaaagcagtccaagctgaattcccatttgaacgaaagcattcaaggcatccgggtcactcaggcatttactcaggaaaaagagaatatgatgtattttgaaggcgtcaacagtgagaactttgaagcctggcgggaagcgacgaaaaaaaatgcgactttccgtccgcttgtagaaatgacaaacgctgtcgggacggccattttaatctggtacggctcaagcttgatcatcaatgaaacgatcacgatcggtgtatttgtatcgttcgccttctatctcggaatgttctgggagccgatttcaaggctcggccaagtctacaaccagctgttgatggggatggcttcgtcagagcggatctttgaatttctggatgaaaagccgagcgttgcagacaaggaagatgcggtcaaaataaaagaattaaaaggccggatcgaatttgaacaggtggaattttcttatgacgggaaccgcaaggcgctgcacagcatttcatttgagatacctgcgggatcatcgcttgcgcttgtcggacatacaggatcagggaagacgacgatcgcaaatctgatcagcaggttttacgatgcaacaggcggggctgtcaaagtggacggtataccgattaccgatatctcgctttccgatcttcgttcgcaaatcagcatcgtgctgcaggacacgtttattttttccggaacgattatggaaaatattcgttttggccgtccgaacgccgccgatgaagaagtgatcgaagcagcaaaagctgtcggagccgattcgtttatttcagcgcttccgaatggatacgccacagaagtggaagaacgcggcaatgtattatcggcaggtgagcggcagctcatttcatttgcgagggcgcttctggcagatcctcgtattctaatccttgatgaagcaaccgcaagcattgacacagaaacggaagtcaaaatccaggctgccttgaaaacactgctccatggcagaacggctattatgatcgctcacaggctttcaacgataagggatgcggataaaatcctggttcttgaccacggccggaaaatagaagaaggaaatcaccaggaattgatcgggaaacgtggaatgtattatgagctggtaaaagcgcagtatc

SEQ ID NO: 2173 - DNA, 1606 bp, Bacillus licheniformis
atgctgaaaggatgcacgacatggccgaaggagtttgcggataaatatcggaaggagggatgctggcgaggcgaaacttttggaaaaatgctgagggagcgggccgaaaaatacggaagccgcattgcccttacatacggagatatccatttaagctatcgtgagttagacaggagagccgattctttggctggcggtcttttaaagctggggatcaaaaaaaatgatcgcgtcgttgtccagctgccgaatatcatcgagttttttgaagtttgctttgcgctcttccggatcggagctctgcctgtttttgcgcttccatcgcatcggcatagcgagatcacgtatttttgcgagttttctgaagctgctgcctacattattcccgatcgtcacgcaaagtttgactaccgcaagctggcgagacaggtaaaggagaagctgcaagggctccgtcatgtcattgtcgccggggaaccggaggagtttgaagcgctggcaagcctttatgatcagccggcacctccgcaaaacgtctatccagaagatgtcgcctttcttcagttgtcggggggaagcacaggtctgtccaagctgatcccgaggacgcatgatgattatatatacagcttgagggtcagcgcagagatttgcaggctcgatcacaacagcgtatatcttgcggctcttccgatcgctcacaattatccgctcagctcgccgggagtgctcggtacgctgtacgcgggaggccgagtcgtccttgcatcaggaggcagcccggatgaaaccttccctctgatcgataaggagagggtaacgatcacgggactcgtaccgccgcttgcgttaatctggcttgatgctgcttcggcgcgccgggacgacttgtcaagcctccaggtctttcaagtcggcggagcgaaattcagcgccgaagctgccagacgcgtttcatcggtgtttggctgcaaactgcagcaggtttatggcatggcagaaggtctggtcaactataccagacttgatgatcctgaagacacgatcgttcacacacaaggcaggccaatgtctccgtttgacgagattaaaattgtggacgaaaaaggacgcgaacttggacccggacagacaggagagctgctgacaagaggtccatatacgattcgcggctattacaaagctgaggagcacaatgccaaagcgttcactgaagacgggttttaccgtacgggagacttggttaaagtcaattcatcaggctatttgattgttgaaggacgagctaaagaccagatcaacagaggcggtgagaaggttgccgcggaagaagtggaaaaccatctgctcgcacatccgggggtactcgatgcggcggttgtctcgatgccggatcaatttctcggcgaaagggcgtgtgcatatattatccctcgcggcgctgcaccggctcaggctgagttgcaatcgtttttgagagaaaggggccttgcagcctacaaaatacccgaccgggtagaaatggttgaagatttcccgcagacaggcgtaggaaaagtcagcaaaaaagagctgcgtgcggcgattgctgaaaaaatgtctgcag

SEQ ID NO: 2174 - DNA, 1705 bp, Bacillus licheniformis
atgggaaaagatcttttgcaatataaagggatgaaacgaatacttgcagtactcactgtcctgacatgcatgcagggcgccgccattatcatgcaggccgaatggcttgctgaagcggttacccgcctttttaacggagaacgcgtcggttcgctctttccgctgctcatcttatttaccgccgcttttttatttcgacatgctgttacccttgtcaggcaaaagctgatatttgactatgccgccgagacgggggccggcatgcggaaaaagtttttggagaagcttttccaatccggccccaggctggcgaggaaagaaggaaccggtcatgtcgtcacgctcgcgatggaaggaattgcacagttccgccgctatttggagctgtttttgccgaaaatggtcagcatggccgttataccgccggcggttgtctgttatgtcttttttaaagacacatcttccgctgcagtcttaatgattacgatgccgattttaatcacttttatgatccttcttgggtatgcggctaaaagaaaagcggacagccaatggaaaacgtatgagatgctttcaaaccattttacagattccttgcgcggcctggaaacattgaaagtgctgggcatcagccgttcacatactaagaatatatttcatgtgagcgaacggtacaggaaggcgacgatgagtacgcttaagatcgcctttctgtcatcgtttgcacttgattttttcaccatgctgtccgtagcgaccgttgctgtttttctcggtctcggtcttgttgacggcagcatctcgctggagccggctcttgccattctgattcttgcccctgagttttttctccctgtccgggaagtcggcaatgactatcatgctacattgaacggacgcgaagccggtaaagcgatcaaggcgatattggattcgccgggtttcaaggatgaggcgcctttaagtcttgagcgatggtctgacgacgatcaaatcgagttcaagcatgtagatgtgcggcatgaagatgaggaaaactgctctttatccgggatttctctttcatttaagggaaagagaaaaatcggaatcatcggggaaagcggtgccggaaaatctacgcttatcgatgtgctcggcggcttcctggaaacgaaaagcggcgttatcaaagtcgggggaaaaaagagaacgcatttgcagacggacagctggcaaaatcagctcttgtatattccgcagcatccctatatctttccggatacgctcgcagccaatatccgtttttatcatcccgccgcttctgacgaagacgttgaacaggcagcaagagctgccgggctctcggagctgattgatcagcttccaaacggcttgaaagagcggatcggtgaaggcgggagggcattaagcggtggacaggcgcagcgtacagccgttgcccgggctttccttggcaaccgtccgattattcttttagatgagcccactgctcatttggatatcgaaacagaatacgagttgaaaaaaacgatgttaaaactgtttgaagacaagctggtttttttggcaacccatcgccttcactggatgcttgatatggatgaaattatcgtgctgaaagatgggcaggtggctgaaaccggtacacatcaagaactgattgaaaagcggggcgtttattacgagctcgtgaaggcgcagt

SEQ ID NO: 2175 - DNA, 3798 bp, Bacillus licheniformis
atgcaggaagggatgctgtttcatacgctgctgcatccggggcaaggcttttatattgaacaaatcagcatgcaggtgaaaggctcttttcaaaaggatgtattggaaaaaagcatgaatgtcatcatcggcaggtatgatatattccgaaccgttttcgttcatgaaaaaatgaaacgtccggttcaagtcgttttaaaggaaaggtcatttcaggcagaagaaattgatctatcaggactttctgaagcagaacaaaatgagagaattgaagattataaacgaaaagataaagaaaaaggatttaacctctcaaaagacattccgatgagaacggcggtttttaagaaggggcaggatcgttacgaatgggtgtggagctatcatcatattctgcttgacggatggtgcttcggcattgtcgtacaggagctgttcgaagtatacaacgcgctccgtgaaaacaggccatacagcctcgggcctgtcagaccttacaaagaatatattaaatggctcgaaagccaggacaaacaaaaatcgctggtctactgggaacatcatttagccggattcgaagggcagacgacattcagcgaacagcggaaaaacccggagcaagccggcaatcagccggaagaactgctgtttacacttccaaaagaagatacagaagcgttcacacagctagcaaaagcgcatcataccacgttgagcacggcgcttcaggcggtgtggtcggtgctgctcagccgctatcagcgatcccgcgatctgatcttcggtacagttgtttcaggccgccccgctgacattcaaggtgtcgagcacatggtcggtttgtttatcaatgtcgtcccgaaacgggcgacctttggcccgcaaacgacctttacggagctggtcgctgatttgcagaagcaggcgctcgaagctgaaccgcatcaatatgtgccgctctatgaaattcaaagtcatatagcagcgccgaacttaatcgaccatattatcgtttttgaaaattacccgctgcaagaagccaataaacagcagaaagaaaaaaatctcggcttcacaatggacgagatcagcgtttttgaaaaatcgaattatgatctgaatttgcttgcttcaccgggtgaagaaatgatgctgaaacttgcatacaaccggaatatattcgaaccatctttcatcttgcggttaaaagaacagcttttgacagccattcgcgaggtcatcagagatccggagcagccgcttgacgacatttgtgtcgtttccaaaaaggaaaaagagcgacttctccatgaatttaacggtcaagtccaacggaagcaaatcggcctgacgattccccaatggtttgagcaatacgctgaagcgctcccggaaaagcccgcggtatcagcggccgggcggacgctgacatatcgggaattgaacgaaaaggcgaacaaggtcgcgcaccttttgcgcaaaaagaacgtcggccgcggcgagcccgtcgcccttttgttccgccgttcgccggaaatggtcatcgcgatactcgccgtcttaaaagcagggggcgcctatctgccgattgacccggaatatcctgaagcacggattcagtatatgctggaagacagcggggctgtttgcatgctgacacaggaagagcttgccggccgggcggcgtcgctttcttttcataagcatacgatcctgatcgacgatcctgctgtgtctgcagaaagcgggagaaacctcgaaatcgccgccgagccggacgaccttgcttatattatgtatacgtctggcacaacgggaaaaccgaaaggcaatctgacgacacatgccaatattacaagggttgtaaaagagacaaactacatcagcctttccgagaaagacaccttgctgtccctttcaaactatgcgtttgacggcttcacatttgatctgtacggcgcgctgttaaacggagcaaagctggtggtggccgatcaggcgacgattctccatatcggcaagctgacagaagcgattcagaaggaaaacatcacagtcatgtttgtgacaacggcgctgttcaacttgctggttgatgcgggaacagggtggatgaaagggattcgcaaagtcctgttcggcggagagcgctcatctgtcagccatgtcaagaaagcatttgctgccatgggaccggacaggatcatccatgtatacgggccgacggaaacgaccgtcttcgcgacgttctatccggtcaaccgtatggaagacagcgcggtttccattccgatcggcaagccgataaacgaaacgaatgcatacatcctgacggaaaataaccggcttcagccgattggagcggtgggtgaattgtgtctgagcggtacaggagtatcgcgcggctatttgaacaggccggaactgactgcggaaaaattcgcgccgcatccgtttaacagcggtgaaacgatgtacaggacgggagatctggcccgctggctgccggacggcaatatcgacttcatcgggcggatcgatgatcaagtgaaaatccgcggacaccggattgagctcggtgaaatcgaagagcagctgatgcgctgccaaggcgtaaaggaagccgttgtaaccgccaggaaaagcgggaacggggatgcggcgctcaccgcttatgtcgtcccggtgcagggaactgaggttgcaaacgaggaggttcgccgccaattggcgcggaggctaccggcttacatggtgccggctgcgtatatcatgcttgaagagctgccgcttaccgctaacggaaaagtcaaccgacgccttctccctgaagccgatggccggccgaattcaacagagcgccgtgcaccccgcaatgctacggaagaaaagcttgcagtgatttggtctgaggttctcggcagacagcagatcggaatagacgagaacttttttgaaatcgggggacattcattgaaagccatggccgtcgcctcccggatgctgaaagatctcgcaatcgatgttccggtgaatgtgttgtttgaaatgcccacaatcgagggcctcgcggcttatatcgaccaaggcggccatgtggatgaagtgaaaaaaaccgtcttcaatcaggcaagcacccgccatttgttcgctttcccgcctgtcctcggatacggcatcatgtacggcaagctggccgaacaaatgccggaatacaggattcacgcgttcgactttatagaaagcgatgaccgcgctgtgcgctatgcagaagccatctccgaccttcagcctgaagggccgctgacattgatcggctattcagccggctgcggacttgcctttgaagtggcgcaagcgctcgaaaagaacggacggaaggtcgaaaagctgctgatgatcgactcatatatgaagaacgatgtcagcgatttagaagggcggtcaattgaagccgatacggccgccttgatggaagccaacaaggacaatgaatatatgaaaatcaagacggttgccgatggcatcgctaaaaagatgacagcctattattcttactttgtcaatcttgtccatcaaggaacggtcagctcggagattcatttgatcaaatcagagcacgcaaaaccgctcccggcatggctttcgttgtggaaagaaggaacggagtcttcatatgatgaatatcaaggcgctggaagacatgatgaaatgcttgcggacggctttgttaaaagcaacgcagatctcatcagacagattttgggcgaacgtgccgctgtaatcggaggtgcatga

SEQ ID NO: 2176 - DNA, 1233 bp, Bacillus licheniformis
catgctgcttcctttttacggactgtctgttaaattcttctacggcaggctcagaaagctgacgagagaacgttcccaagcgctggccgaagtgcagggccatcttcatgaaagggttcagggaatgcctgtcatcaggagttttgcgatcgaggattatgaacaaaagcaatttgatcacgagaacgggaattttctcggtaaagcaatccgccatacggcctggaatgccaaaacctttgccgtcgtcaatacggttacagacctcgctccgctgatcatcattacggttgcaggttatcatgtgattcacgggaaccttactgtaggaacgatggtggcgtttttcggatatatcgaacgcctctacaacccgctgcgccgcctgatcaattcctcgacaacattgacgcagtcgatcgcatcaatggacaggctgtttgaatttattgatgaaccgtatgatttaaaagataagcccaatgctgtaaaagcagagcgattaaaagggattgttgaatttaaaaacgtttcctttcaatacgaaaaatcggaggaaatgattttgcaggatctttctttgaaagccgaacggggcgaaacggttgcgctcgtcgggatgagcggaggcggcaaatcgacgcttgtcagcctcattccgagattctacgatgtctcagccggaagcctggagatcgacggcatcgatgtgcgcgattatgaggcgcgaagccttagaaaccaaatcggcatggttctccaggatacgtttttattcagcgaatcggtacgcgaaaacatatcgatcgggaatcccgaagcttcgatggaagacatcattgaagcggcaaaagctgcgaatgcccatgattttattatggagctgccgcaaggctatgatacaaaggtcggagaaaggggagtcaagctgtccggaggccaaaaacagcggatatcaatcgccagggtgttcctgaagaacccgccgctcttaattttggatgaagcgacgtcagcgcttgaccttgaaagcgagcactatatccaggaagcgatggaaaagctcgcgaaagaccggacgacctttatcgttgctcacagactgtcgacgattacccacgctgacaaaatcgttgtcatcgaaaacggacgtgtcgcggaaatcggcacacatgacgaactaatgagccgcgacgggcactataagcatttattcaccattcaaaaattaaa

SEQ ID NO: 2177 - DNA, 1302 bp, Bacillus licheniformis
taacgatgggttttttgatacgctggaaactgacgcttgcttcgatcattccgcttccgctgatggccgccgccatcagcatctacgggaaaaaaattcatgagcgtttcacggaagcgcaggatgcgtttggcgctttaaatgatcaagtgctcgagtccgtgtcaggggtaagggtgatccgggcctatgtacaggagaaaaatgatgtcagccggttcaacagcatgacggctgatgtgtacaagaaaaatatgaaagtcgctttgatcgattcgctgtttgaaccgacggtgaagcttttggtcgggatcagctatttaatcggtcttggctacggcgcctatcttgttttccgcagccagctgacattgggtgaactcgtctctttcaacgtgtacctcggcatgctgatctggccgatgtttgcgatcggagagctgatcaatgtcatgcagaggggaaatgcttcgcttgacagggtaaatgaaacattggcatatgagcctgatgtgagagagcccgctgaacccgaagcagcggagccgggcgatattgtgtttgacggggtcacttttacgtatccgagctctgcgtcggaaaacctggccgatatttcatttaccgtattagaaggacagacggtcggaatcgtcggaaagacggggagcggcaaaacgacattagtcaagcagctgctgaggcagtatccgcaaggaaaaggaacgatcaccatttcgggcgtgcccattgaacgtctgccgcttgatcagctccgcagctggatcgggtatgtgccacaggaccacgtgctgttttcaaaatcagtgaaagacaatattttgttcggcggacacctcgctgaagaacgcgatttgcacgccgtcatctctgcagcacatctgaaaaaggatattgagatgctttcagacggcttggagacaatggtcggagagaagggagtcgctttatccggggggcagaaacagcggatttcaattgcgagagcgatgattgcggagccccatattttaattttggatgattcgctgtccgctgtcgacgcgaaaacggaagcggcgattattgaaaacatccgcagcagacggaaaggcaaaacgacgtttattacatcacaccggatgtcggctgtcgaacacgccgatttcattctcgtcatggaggatggaaggatcgttgagagagggacgcatcaagaactgatcggccggaaaggctggtattttgaacaatatgaagcacagcagcttccttcgggagaagaagggggcactgtagcat

SEQ ID NO: 2178 - DNA, 1791 bp, Bacillus licheniformis
aatgaatccgacgccctgctatttaaatacgtggaaacgctttgttcaggaagggcttcttgatcaggcccgcttgaacaaaagagtcatggaatcatggtaccgctgcaaaaatcgaaatgtcaatccgtatttagataaaggacagtcaattttaaaaaaggatttattcgacgctcaaaaaaagaaacactcgttattcctcgatatcgccctgccttatctacacaatatcagccgtgaattaaaagagtcggaaatgatggcgctcctgatcgatgccgacgggtacgtattaagcttggccggctgccggaggacgcttgaagaggcgaaaaaaatcaattttgtcgagggcgtgcgctggacggaaacagaagtcggcacgaacgccatcggaaccgcacttgaaatcggcgaagctgtcaccattcacgggaccgagcatttttcggtcgcttcccaccattggagctgttctgctgcaccgattcgcgatgaagacggcaccgttatgggtttaatcgatatttcctgcctcacggatagaaggcatccctttatgcttgggatggctgccactgccgcacacgccatcgaacgcgagatcagcgcacatacgaaaaaaaacgaagccgagctcatcagccattgtcttgaaaaaatcgattcggatcagccgtttatcgtctgcaatgaaaaagacaaaatcgtagccgcgagcagaccggtgcgggaacgtttttccgactggaggagaatggatgtcaatgatctgtatgagcgcgggtttgccggggggcacaagcagacaattttctccgccaaagacgggaggcccctcggtaagtcgattgcactggctgaagtgtcccgcaataaaacagctccatcactcgtatcccgtttcatctatccgggtgaaacaggaacaagccgggcgtttcagcaggcgcttcaccacatgaggcttgcggctaagacggatgcgaatgtatacatatggggggaaacaggctccggaaaggaacttgccgcgagggccattcatcaggcgagcgcacggagaaacggcccttttatcgccgtcaactgcggcgccattcctgaaagcttgatggagagcgaattgttcggctatgccgaaggcgcatttacaggagcaaagcgccgcggttcaaaagggaagtttgaacaggctcaccgcggtacgatttttctcgatgaaatcggtgagatcccttatcagatgcaagtggcgctcttaaggatcatcgaagagcggaaggtcactccgatcggcggaacccgtgaagttcccctcgacatcagaatcatcacagcaacacaccgtgatctgaaagaccttctccaaaaaggaaagatacgtgaagatctgtattaccgccttcatgtttaccccgtaaaaataccgccgctcagagagcgcaaagaggacatacctgatttgttccgccactatcaacaacaacacgagtggaaggccgagtttccgccgaattttttcaagcggcttcaggaatatcattggcctggtaacatccgtgagctctttaatacatttgaaaggctcagggttttatttccggaaggcggactgatcgatccgtcccaatacagcgcggtgctggacggactcgattggaacagcggcgcaccttctgaagaagaccggctcacattcagagaacgtgttcaaaaacaaacgatgatggaagctttgcaaaaaacgaaaggaaatgtgtccgaagcggccaagctggccggaat

SEQ ID NO: 2179 - DNA, 1330 bp, Bacillus licheniformis
atgaaaacggactttacatacggaaatgtatttaaacagctggtctatttttccggaccgatcattttagccaatcttttgcagatttcattccaattcgtcgacagcttgtgggtcggaaatctgctcggagcaaaagctcttggtgctgcggccgtctcaggaacggttttctttacggtgctgtcgttcgtattgggcgtcaacaatgcggcgctgacgattcttgcgcagcaaaaaggaaaaggggataaaaagggactggcatcatatgtaaacgcgtttgtcgttctgatgacggcgatgagcgtattgctcggggttatcggctattttttcacagagcctttgctctcgctacttcaaacgcctggcaatatgatggatttggccgtaagctatttgaggattcattttatcgggattatatttttattcggctataatttcatcagtacagtattaagagcggtcggcgacagtcaaacacctttgcgtttcgtcctgttggccgtcatcctgaacctgttcatggatccgctgtttatctcggtattcaacctcggaattgccggagcggcctatgcaaccgtcgtgtcccaagggattgcttttatttacggagtggtctatacggtgagaaagcagcttgttccattttcaaagccggcgcttccatcgctggcagagacgtccgtcattttgaagctcggagtgcctgccggcttgcaaatgatggtgatttcaggcggctcgatggcgattatgagcgttgtcaattcatttggagaaagcgtcgtgtcagggtttggcgcggtacagcggcttgacagcctgctgattctcccagcgatggccatcggcacggctgtcaacagtatggctggccaaaccttcggaagcggcgacatggagcgtacgaaaaaaatcgccaactacggcgtcatttatgtcctgctgtttatggctgccgtcagcaccgcgatatttctgacaggctatcacgcggtcaggctgtttatatcggaagccgattcagccgcattcggggaagagtatttaaaaacgattgcttttttctatccgtttatcggaattaactttgtgttgaacggtgttgtaagggcagccggagcgatgtttcaaattttggtgctgaacgtgatttctttttgggctttgcgctatccgtttacatatctattttcaaagtggcttggcgagaacggcatagcgctgggcatcggaatgagctttatgctgagcagcctgaccgcctttttatattaccgctacgggaagtggaagcacctcgttctatttgaaaaat

SEQ ID NO: 2180 - DNA, 1393 bp, Bacillus licheniformis
  misc_feature (1)...(1393): n = A,T,C or G
atgatacgccgctttttttcatactataaacctcataaacgtttgttcttcatcgatttcagcagcgcgatcgtcgttgcagtgctggagctggcttttcctctagttgttcagtggttcattgatacgctgattcccgggggagactggcttgaaatcgacgagataaacatcggcctcttactgatctacctgggcagcacaggtctgcagtacattgtcaattatctcgggcataagctgggcatcaacattgaaacagatatgcgccaggagcttttccaacatgtacagcgccaatctttccgctactttgacaatacaaaaacaggacatatcatcagccgcatcacaaatgatctgtttgatatcggagagctggcccatcacggaccggaagatttgttcatcgccgtgatgacctttttaggtgcattttggattatgctgacgattaatgtgaagcttgcattggttgcagttctgtttgtgccgttattgattatcttgatcatctattccaatatcaggatgaaccgggcttggcgccagatgtacagcgaaatcgccgatgttaatgccagggttgaggacagcgtttcaggcgttcgcgtcgttcaatcttttacgaatgagcgctttgagatatcccggtttttaaaaaacaatcaaaagttccgcaaggcgaagctgaagggctacaaaacgatggctctcacgactgccggaacctttttgatgacgcggctgatgattctggcagtgctcgtgttcggagcttggctcagtttttccgggaatatgtcctacggggaattcgtcgggtttgttctttatgtcaacgtgctgtttaagccgattgataaaatcagcgccattttggagctttatcctaaaggaatggcaggatttaagcggtttacggagttgatcgatacaaagccgcagattgtcgaccgcaaagatgcgattgatgttccggcgctggaaggaaacatcgtcttcaagaatgtgacgttcggctatgaaaaacataaacccgtcctgcgaggcatcgatctgtcaattaaagccggagaaaccgtcgcctttgtcgggccgtcgggagcgggcaaaacgacgatcagctcgctgattccgcgcttttacgatatagacggcggggccatcacaattgacggcatcgatattcgcgatatgacaaaacgctctctccgttcgcaaatcggcatcgtccagcaagatgtgtttctttttacgggaacgctccgcgaaaacattgcctacggaaaactggatgccacagatgaagaaattcagcgggccgncaaaatggcgcatttggaacagctgatcgagtcgctccccgacggttatgtaacccaggtcggcg

SEQ ID NO: 2181 - DNA, 1208 bp, Bacillus licheniformis
atgaatcaatcgctaaaaacattcagcgtgttgtcagaacaatatcacgaaaatccgtatcagtatttctcataccttcgggaatctgatcccgtccattatgaagaatcgctggacagctattttatcagccgctaccaggatgtgcgccgcgtgctccagaatcaggacgtctttacaacgatttgctgcttgccaaacgggccgagcccgtcatgcgcggacctgtgctcgcccaaatgaaaggcaaagagcacacggcaaaaaggagaatcgttctgcgccgctttatcggggaatcccttgatcacctcacaccgctcatcaaagaaaatgccaaaggcttttggccccgcacgtggagaagggcggatcgaccttgtcaatgatttcggcaaaacattcgccgtttgcgtgacgatggacattttaggtttggacaagaacgaccaccaaacggtgagaaactggcacagcggcgtcgccgatttcattaccagtttgaatcaggcgcctgaggaccgggagcattccctcaaatgcagtgaacagctcgctgagtatttgaatccgattatcgaggaaaggcgcaaaaatcccggacatgatttaatatccatcctttgcacttccgaatacgagggagtggcgatgtctgaccgggacatacgcgcgctgattctcaatatattgcttgccgccacagaaccggcggacaagacgctcgcattaatgatttatcatttgcttcatcatcccgatcagatgaatgatgtgctggaagaccgcacgcttctccctcaggcaatcgcagagacgctgcgctacaagccgccggtgcagctcatcccgcgccagctttcacaagacgcggagattggcggagtcgagctaaaagaagggacgactgtattttgcatgataggcgcggcaaatcgcgatcctgaagcgttcgaggatcccgacaagttcaacattcaccgcagcgacctggaagtcaaaagcgcattcagcggcgcagccaggcatctcgcattcggttcaggcgtccacaactgtgtaggagcggggtttgcgaagaccgaaatcgagcttgtcgcaaatatcgtccttgatcagctgaaaaatatccggctggaggaagacttcatttaccgcgagacagggctttacacacgcggacccgtctcgctcaacatccggtttga

SEQ ID NO: 2182 - DNA, 1213 bp, Bacillus licheniformis
ctgtggcaaattcaaattcacttcaatcaagcaagcattatgccaattggattccgatgaaagaaatcagctcgagtaatgaccggctgtttccgtttccgatttataaccggatcagaaagacgtctcctgtgcgttacgatgatgagcgaaaatgctttgatatcttttcttatgaagacgttcaattcgtgttaaaaaacccgaagctcttctcttcaaaacgcggcggtaatatggaaggaaaaagtatattaacaatggacccgccgagacacacaaaaatgagagccatcgttaataaagcttttacgccgaaagcggtgaaagagcttgaaccgcatatcgaagaagtgacggcttttttatttaacgaagcgaaacagaaagaattgtttgatgtggtggacgacttggctgctcctcttcccgtcattatcatcgctgaacttttaggcgttccggctgaagaccgcctcatgtttaaacattattcagacatccttgtcgcaggtgcggaagaccgctcggctgaagccgccgaacggatgtacaaacgacgtgaagaaggcaatcggtttttggcggattattttaaaaacattatcaagcagcgcaaaaaagagccaaaagacgacctgatttcgcttttactgcgggcggaagttgacggcaaatcgctgacagaagaagaactgcttcatttttgcatcattcttttggtcgcaggcaatgagacgacaaccaacttgatcgcaaacagcgtccgctatctcacagaagataaaatcacacaggaagccgtaagacaagatccgtccctcgtccctgtctttgttgaagaaatgctgcgttattatccgcccgtgcaagcgatcggccgcacggcggcagaagacgttgatatcggaggcgtgaggattgcaaagggttctacagtgatcagctgggtcgcttcagcgaatcgtgacgaacttaagtttgacgatcctgacagcttcaagcttgatcgcaaatcaaaccctcatatgagcttcggcttcggcatccatttttgcctcggcgctcccctcgcccggcttgaagcgaaagtcgcgctcgattacttgctgcggcgcgcatacatggaaagggacagctctaaggagcttgaagcgattcaaagtccgtttgttttcggcgtccgccatctccccgtacaactttcacaaaa

SEQ ID NO: 2183 - DNA, 1727 bp, Bacillus licheniformis
atgaaaacagaaaacaacaatagcatgaaaccgtttttctcaatgattctcacatccggcgtacccaggctggctttaagcgccggtttgaccgcaagcctcgtcacgactttggtcggcttgtccattccgctgttgacaagggaaatggttgacggcttttccgccaattcgatcaatctggccttatcgggaatccttgcgctcgtttttatcgttcaagcggtctgcgacgggttttagacctattttctttcttacgccgggcagaaagtggtcgcttccctgcgggagcgcatgtggttcaagctgctgcgccttcctgtccgctactttgacgaaaagacgagcggcgaaaccgtcagccgagttgtcaatgataccggcattgttgaaagcttgatttccgaccattttccgcagtttgtttccggaatcatcaccattgtcggatctgtggtcattctgctgatcatggattggaaaatgacgcttcttatgctgatctccgttccgatcacgaccttcatcatgatcccgctcggcatgaaaatgcagcgcatttccaaaacaatgcaggatgaaacagcttccttcaccggacatgtccagcagacattaagcgaaatcagattgatgaaagcatcaaacgccgagcatacagaaaaaatgaaagggttatcaggcatttcaaagctctttcaatacggcctcaaggaagctcggatattcgcgctcgtctccccgttcatgcaccttgtcattatgattgtgatcgtcgccatcatcggctacggcggcatccgcgtctctgaagggacgatgtcggcaggctcgctgatcgcctttttgctttatctgtttcaaatcattttcccgatcacatcgttcacaatgtttttcactcagctgcaaaaagcaaaaggggcaacagagcggatcatcgagattatgcattctgaagaggaagaaggccaggaagggcttgagatggacatctccaatctgccgatacatgtcgagaatgtaactttcacttacgccggtggcgagccggtcttacgcggggtatctttcgacgtcgatcccgggcagatgattgcgtttgtcggtccgagcggcggcggaaaaaccacgatgttcggcctcttggaacgattttacgaaccggactcaggagccattaacatcggggaaacaccgatcagcaagctgtcgatgaaatcgtggcgcagccagatcggctacgtatctcaagacagcccgatgatgtccggcaccatccgtgagaacttatgctacggcttggatcacgccgacagcattgatgatcaagaactgtggaaagtcgcggaaatggcgtatgccgatacatttattaaacaattccctgagcagcttgatacagaagtcggcgaacgcggcgtcaagctgtccggcggacagagacagcggatcgccatcgcccgcgccttcctgcgcgacccgaaaattttaatgatggacgaagcgacggccagcctcgacagccaatcagaagccatcgtccagcaggcgcttgcccgcctcatggaaggccgcaccaccttcgtcatcgcccaccggctatcgacaatcgtgaacgcggaccaaattatgtttatcgaaaaaggcgagattacagggcggggacggcaccatgagctgattgcttcgcatgcgctgtatcgggagtttgctgagcggca

SEQ ID NO: 2184 - DNA, 1724 bp, Bacillus licheniformis
atgatctcactcttaaaatatttaaagccctataagctgcaagtgattctcgtcgctgtttttactttgctgagcagtgtgcttgagctttatttgccgacgttgatggctgatgtcgttgatgtcggaatcgtaaacagtgatatgccatttattttgaaaaccggcggctggatgatcgcctgctcccttctggccatcatgatgactgtcggaaaagcgtttttcgcttcgaaaacagccctcggctttggaagagatatcaggcgcaaactgtttgtcaaagttgaacaccattcaatggatgaattcggaaaaatcagttctgcttctctcattacccgtaccaccaatgatgtcaagcaggtccaagatgtgctcaacatgatgctttcattgatgacgagagcgccgttaatgctggtcggcggtattgtgcttgcggtttccagagatgccaagctgtcgattatatttctggccgctctcccgatacttgcagggctgatttttctcattacaagaaaagctgtccccttattcggcgtcctgcaaaaaaagacggatcgtctcaaccttgttctcagggaaggtttgacgggcgttcgtgtcattcgcgcgtttaaccgcgttgatcaagaaaaagtccggtttcaaaaagcgaacgaagaatttcgcgatacaggcatcgccgtcaacagaatcatggcttttctattccctgtcatgatgattatgatgaatttcacgaacatcgcgattatctggttcggaggcatccgcatcgatcaaggcagcatgcaggtcgggaacttaatggctttccttcaatatgcatcgatgattctaattgcgctgatcatgcttgcgatgacattcgtgatgatcccaagggctcaggcatctgccggccgcattaatgaagtgctgttaacagagccttcgattaccgatccgaaagagccgcagaaagacagcggcttgcgcggttatgttgagtttcagaatgtgacttttcgttatgccggggccgaaaagcccgttctcgaagatatctcgttcaaggcaaagccgggtgagacgactgcgatcatcggcagcacaggagcgggaaaaacgacgattcttcaattgatcccgagatttttcgatattgaaaaaggaactgtgctagtcaacggaacagatgtcagaaagatggcgcaaaaggagcttcgcgcgaaaatcggctatgtcccgcaaaaagcttcaatattcagcgggacgattaaagacaatatccgctttggcaaagaagatgcaacagatgaagaaattctggaagcacttgaaacggcacaggctgccgagtttgtagaaggcaaggaaaacggaattgaatctgaaatcgagcaggccggagccaatctttcaggcggccagaaacagcggctttccatcgccagggcattagtcagaaaaccggaaatttatttatttgacgacagcttttcggcgcttgattacaaaacggatcaaaagctgagaaaagcgctgaagaaaacaaccgctgatgccgccgtcatcatcgttgcccaaagggtaagcacgattacggatgcggatcaaatcatcgttttaaatgaaggaaaaatagccggcatcggcactcatcaacaattgcttgctgaaaacggcatttaccaggaaatcgtcgcatcacagcaggctgaggaggaaagcgc

SEQ ID NO: 2185 - DNA, 1155 bp, Bacillus licheniformis
gagcctgaaatcggattcggatttttggagagatccatatctgttttacgatcagctgcggtccattcatcctgtatataaaggaaccgttttaaagcatccgggctggtatgtcaccggatatgaagaagcggcagcgattttgaaggaaccggcatttataaaccgcgttcctctcccagaagcttctactaaatatgaacaacttcagcgattgcagcgaaatatgatgctgtttcaaaatgagtccggccataagcggatgcggacgattgccggcaaagaattcatgccgcagaagacggcaactttccgccctgctatagaagaaaccgtccatgaattgctcgatcagcttgaaaacaagaagacggcggacatggtatcggaattcgcctttcctttggcaagccttatcattgccggcatgctcggcgtcccggaagaggaatggtaccaattcaggcaatggacggcggatctcattcaaacgatcgatttgacccgtacacgaaaggtaatggcaaaaggcggtgataccgttgccaagctgacggcttattttaaaaatttaattgaaaagcgaaaagcgcatccttctgaagacctgatcagcacattcgccggtcatgagcagcttgctgatgaagaagtgcttgcgacgtgcatcctgcttgtgattgccggacatgagacgacagtcaaccttttgacgaacgggttgtttttgctcatgacacatcctgaccagctcagtgagctgaaagaaaatccgctgctgattgagtcggccgtcgaagaatgtcttcgctatgaaagcccgacacagctgacagcgcgcaccgcgtcggaggactgcgaaatcaacgggaaaatcatcaaaaaaggagagcacttatatatccttttaggcgccgccaaccgcgatccaaagatatttcaaaacccgcatctatttgacatcacaagaaagccgaatccgcaccttgcctttggagccggtgcgcacgtatgtttaggctcggcattggcgcggctcgaagcgcaaattgccattcccgcactgttggcgcggctgcctaacttgaagcttgcttcaacagacgttccatttcgcaggctaatcggctttagatcgctggccgagctgcctgt

SEQ ID NO: 2186 - DNA, 1278 bp, Bacillus licheniformis
tgtatacgatgtcatcggcgtcggcatcgggccgtttaatctcggccttgccgcattggctgactccgtgcctgagatcaatgcgctgttttttgaacgaaacgaaagctttaactggcatcccggcatgctgattgaaggaacgacactgcaggtgccgtttttggccgacttggtgagcatggccgatgtgacaagcaaatacagctttttaaactatcttcagcagcataaccgtctttattctttttattttctggaagactttcatattccgagacaggaatacaaccactactgccgctgggtggcagaacagctcgacccgtgccgcttcgggatgaatgtcgaaagcatatcactcgttgaatcgaacccggaggcgctttttaaggtgcgggtcgcgaatcgggagaacggaggggaagcggtttattacacgaggcatattgcgcttggcattgggacgggcccgcacgttcccgatgcgctctcagacgctttggggggctcggtgttccattcagccgagtatttaaagagaaagcccggcggatttaaagggaaaagggtggccgtcgtcggctccgggcaaagcgcagccgaagtgttttatgacctggtcggtgaagatgaagcggagcatgtcagctggctcacccgctcaaaaggcttcttcccaatggaatattcgaacctcggactcgaatatttttcgcctgactatatcgattttttctatcagcttccgcagtggaaaaaagatgaattgctaacgcagcaggatcttctttataaaggaatcagcgcgaagacgatcagcgatatttatcatattctgtatgagcggacctgcggggggcggaaagcggcttttgatcttcagtccatgacagaagtcgagcagatcgaacagcgtggggaaacgctggttctatactgcacaaaccgggtgaatgaagaccggtttgagcggcaggcagatgtggtcgttctggcgacgggctataaagagaggctgccggaatgtctggcgcctgttgacagtttgattgaaaaggacgcgagcggccgctacgtgattacacgcgactacagactagtgacagctgcaaaatcaaaaaaccatatttttattcaaaacggagagctgcacacgcacggtgtcggtgcacctgacctgggactcggcgcttaccggaactcggtgatcatcaatcagctggccgggagagaagtatacaccgtcagccataaaacggtttttcagacattcgg

SEQ ID NO: 2187 - DNA, 1194 bp, Bacillus licheniformis
ctcagccgcgggaagctgagagaaaaaaaccggacgaaatcgcaaagacttcgcagattcaaagctatcagactgagtttttatatgggatttttggtattaagactgcgggaatcgaaaaagaaacgtatcaaaaatgggatcactatctgggggaactgatcggggcataccgacgcaaggaagggtttcttaacatcgtgaactctctgacaggcacgatgcagatcatatcaccaatgctgattttatggattggtgcaatgctcgtgttcgaagggaatttatcggttggggagctggtggcatttcatgctttatccacacaattctttaatacaagcagctcgatcgtccaaaccgtcaactcggtaatcttgacgacgtcttatcttcatcggatacaggatatccttcaaagcccgattgaagagacacctggaaataaagacaactccccgattaagggggagatccggcttgaacgggtttcgttccgttacagcccgcacagcgaagaagttattaaagacgtaagcctgcatatcaagcctggcgaaaaaatcgctatcgtcggacaatccgggtccggaaaaagcacgctggcaaaacttattcttggcctctatatgcctacaaaaggcagtgtgttctatgatggcgtgaatattaaaaacaaggatttaagcgctcttcgcaaacaaattggtgttgttccccaagatgtaacgctgttcaaccgcagcattaaagacaacatttctttatacagtgaagatgttgacattgagcggatacatgaagtcgcaaaaatggcgcaaatatacgatgacattcaaaatatgccgatgggctttaatacgatgatttctgaaatggggatgaatatttcgggagggcagcgccagcggattgccttggcccgtgcactgctaaaccgccccgctgtgatgctgttggatgaagcgacgagttcgctggatcatcaaaatgaaaaaaaaatcgacgcctttttaagggagctgaaatgtacaagaattgtcatcgcgcataaactgacttcaatcatggatgccgataaaatcatcgttttggaagacggcatggttttaaatgtgggtacgcatgaaacattgctgaatgagagcaagttttacggagatttttatcgaaagttccttgaaaaagagcaat

SEQ ID NO: 2188 - DNA, 1129 bp, Bacillus licheniformis
atgaaaaaaatatggatcggcatcgtcattgttggggctgctgcgctttttatcggactcaacctctaccgctcggttcaaacgagcggaggggctgaagaagcggttcaaaccgtgaaattggaagaaaaagagatttcttctgaagtcatggttccggggacccttcagtttgcaaacgaacaatacgaatattttgaacctgaaaaaggagaaattgccgacatcaaagtaaaagaaggcgataaggtgaaaaaaggagatgtgcttttcacctatacaaatgaagaaattcgcctggaaaaggagcaaaacgctttatccattcaatcgaaggatctccagcttgaacaggttaagcgaaaaatcagcagcctaaaaagcaaggaagacgagctgaaggctgagctcggagcggaaaaagccaagaggcaaattgatgaagaacggtcacagcttgaaatggaagaaaaatcgctccagcttgaactgaaacaagccgacctgcaaaaggaaacgctcgagaagaaatcggcagcgctgcaagtgaaaagcggcattgacgggacggttattaccgttgacaaacaagccgctgcaaagcaatcggatattcaaaagccggttatacatataggtaacgaggacaagcttgtcgttaaaggcgtgctctcagagtatgacacattgaaagtgaaaaagggacagaacgtgaccatcacgtcggatgtcatccaaaataaagagtggcgtggaagggtatcacaagtcggattggttcccaaagaagaggcgtctgcaggtgttgcgggaacaaaggagcaagctgttcaatatccgtttgaagtcaaaataaaaggggagcgtcctaaagcaaagtccggctttaacatgattctcaaaatccagacggacaaaagaatcgttcaggctcttcctgaagatgccgtcaagcaggatggtgatcaatcatacgtgtttgccgtaagagacggcaaggcaaaacggatcaatgtcaaaaccggtgagaaagcagacggcctcgttgaaattaccggcggtctgacaaacaaggacccggttatcgcaaacccggccgaggatatgaaaagcggaacggaagtgaagc

SEQ ID NO: 2189 - DNA, 900 bp, Bacillus licheniformis
cgtctgtctgttgattgtgccccctgattgtcatttgggctgctgtttatcgaaaattcgcttcaggctacaatcataaacttaggtcaatcaacagcgagatcaacgccaaaatgaatgaatcgattcaaggcatgacgattattcaggcattccggcgcggacaggacacaaaagaagaatttgaacagctgaatgacagccactttcattaccaaaataaaatgctgaaattaaactcgcttatgtcccacaacttggtcaacattctgagaaatgtgatgttcaccgctctaatatggtatttcgggggagctgccctgaacgcggaaggaatgatttcaatcggcgtactctatgcattcgtcgattacttgaatcgtttatttcagccgattacgggcatcgtcaaccagtttgccaagcttgaattggcgcgcgtatcatcggagcgggttttccgcctgctggatgagccgggcgtcgatgtcaaagagccgagcagcgaaagagcgcgggggcgagtcgtgtttgaggatgtatcatttcgctatcatgacggtgaagatgtgctgaaaaacatctcatttgaagcgaagcaaggggagaccgttgcattggtcggtcatacgggctcaggcaaaagctcaatcatgaatgttcttttccgcttttacgatattgaaaagggcgatgtcaaaatcgacggcagaagcatatatgatatgtcaaggcaggaaatcagaaagcatatgggcatcgttctccaggatccttacttattttccggcacgattgcttcaaatgtcagccttgacaatgctgatattactagagagcaaatagaagacgccttgaaacaggtcggggctcttgaggtgctcgcccgtctgccgaaga

SEQ ID NO: 2190 - DNA, 966 bp, Bacillus licheniformis
atacgtttgcgaaaacgatgatcagcatggatccgccgaaacacacgagaatcagatcgatcgtcaacaaggcttttacaccgcgcgtcatgaaggagtgggagccgcgcattcgcgaactgacgaatcaattgctcgctgatgtccgcggcagggaagagatcgaccttgtacaggatttttcatatccgttgcccgtaatcgtcatttcggaattgctcggcgttcctttggtgtataagcatcatttcaaagaatggtccgacctgttggtcagcctgccgaagagcgatcggccggaagatgtgaacgagtggaaaaacatcagggaccaaggcgaagaagagctgaccgcattctttgaaaagatgattgaagagaaaagacaaaacctcggcaatgacctgatttcgcttttgatcaaagccgaacaagaaggggacaagctgtcccctgatgaattggttccattttgcaatctgctcttgatggcggggaatgaaacgacgacgaatttagtttcaaatgcggtctacagcattctcgaaacaccgggcgtgtatgacgagctcgccaggcatcctgaactgattccgcaggcagtcgaggaagccgtccgtttccgggcgccagcgccgatgattgtgcgcttcgttaaacaggataccgagatcagaggagtaagcttgaaaaaaggagaaggtgtgatcgctttccttgcttctgccaaccgtgatgaaacgaaatttgagagggcgcacgaatttgatattcaccgccatccgaacccgcatatcggatttgggcacggcatccacttttgtttgggcgccccgctcgcaaggctggaagcggcgatcgccattgaggcgctcttaaagcagtatgcctcgatggaaaagcttgcggtcgtgccgatggccgacagcagcatgtacggcttgaaacatttccgtctgcgggtga

SEQ ID NO: 2191 - DNA, 1512 bp, Bacillus licheniformis
agacaccgtttatagaacagatgcagcagacggaatgcggactgtgctgtatggcgatggtagccggacggtatggttcgcatcatactctgcatgagctgagggatttatcgggatgcggcagggacggtatgaccctttttcatatgcgtcagctcagcgaaaatctgggatttgacgcaaaggtgtacagggcaggcgcggcagaacttccacatgtgcgtctgccggcaatcgctttttggtccgataatcattatgtggttattgatcaaataaaagaccggcatgtcaacatcatcgatcctgcgattggacgaaaaaaactcagtatcgaagcttttctcgaaaattacagcgggatcgtgctggagatgatccctaccgagcggatcaggccgaagaaaaaaccgcccgtctggaggcattttctttttcatttaaaagaatccccttctctgcttgcgaccgtgctgttgtttgcgatgatctttcagctcgtttcattaggcataccgatgctcgtgcaatacctgatcgatgacatccttgctcaaaatcagcaggctctgctgcaaacatttatgacgggcgttcttgttttaatgctcgttcaaggcacggttcaattgatcaggggtcaatttatcattaaattaaataacttccttgacaaacgaatgatgagaacatttttctcgcatattctgaagcttccctatcaattctttcaattgaggtcgttcggggatctccttttccgcgcgacaagcctccggattgtcagggatatgatgtcttcccaattggtcctcggcgtactcgattttggcgcacttttatttatctcgttttatatgttttataaatcgccgcctttagcagggctggttattctgctggctcttctgaatgtcgggatcacggcgctcagccgcgggaagctgagagaaaaaaaccaggacgaaatcgcaaagacttcgcagattcaaagctatcagactgagtttttatatgggatttttggtattaagactgcgggaatcgaaaaagaaacgtatcaaaaatgggatcactatctgggggaactgatcggggcataccgacgcaaggaagggtttcttaacatcgtgaactctctgacaggcacgatgcagatcatatcaccaatgctgattttatggattggtgcaatgctcgtgttcgaagggaatttatcggttggggagctggtggcatttcatgctttatccacacaattctttaatacaagcagctcgatcgtccaaaccgtcaactcggtaatcttgacgacgtcttatcttcatcggatacaggatatccttcaaagcccgattgaagagacacctggaaataaagacaactccccgattaagggggagatcacaatcaatagaatccctataatagcgggcagcgtcaacgtctcgccaaaaaaggcgaccgccagcatgcaggtgagcagcgggcctgtccccctcgcgatcggat

SEQ ID NO: 2192 - DNA, 897 bp, Bacillus licheniformis
atgagcaatgttgtaagcttgacgaatgtgacaaagacattccgccaaaaaacggcggttgatcagatagatttttcaattaaaaaaggagaaattgtagccattctagggccaaacggagccgggaaaacaacaacgatttcaatgatattggggctgttaaaaccgacggctggcaacatcacattattcgattccatgccgcatgaaaaacgggtgcgtgaaaaaatcggcacgatgctccaggaagtcagcgtcatgcctggtttgcgtgcaggtgaaatcatcgaactcatccggagctactatccaaagcctctatcctttcaaaagcttagaacgttgacaggtttgacagacaaggatttaaaaacacaggcagaaaagttgtccggcgggcaaaagcggcgtctaggctttgccttggcacttgccggcgatccagaactgatgatctttgacgaacccacggtcggcatggatatcacttcaagaaaccgcttttggcaaacggttcaatcgctcgcagagcaaggaaaaacgatcattttttctacacactacttacaggaagcagatgatgccgcgcaacgaatcttgctgtttaaagacggcaagatagtagctgatggaacgccgctccaaataaaatcaagaatatcgaagcattcggtttcatttatagttgatccggaacagtcactcgagaagctgtatcagcacccagaaaccgaacagatttttcgtaaaaacaaccgggtttacatcgacacggccaatacggacaaaatactggaactcattttctcagaaaagatcggcgcttatgatattcaaattgagcgcggaaatctcgaagaggcatttcgccagctgacaagcaaaggagacgagtaa

SEQ ID NO: 2193 - DNA, 3798 bp, Bacillus licheniformis; identical to SEQ ID NO: 2175

SEQ ID NO: 2194 - DNA, 1950 bp, Bacillus licheniformis
atgaaggtgaagcatgtgtggaagatgaagcatattcaagagccgctgcaaacggcgggcctgcttgggaaaatggtctggaaatccggtccgcggctgatgatttgcatggttatcttcatgctgatcgaagccggagcacctttaatccaattgtacgcttcaaagcaaatgatcgacggcattgtcgatcaggaagccgtcatctatgcagaaatatgggctgtcatttatgcgggaagcctggtcatggtcagtgtcgttaaatcattggaaaaatgggtgaaggcaatgctttctgagaggtcgatgatcacagtcaacagtttgttgatcgacgcttttgaccgcattccggggatgcgtttttttgaggatccaaagtacagggaccggctggaaacactgcgggatcgttcgacatggcttccttcccaattcattaatatcagttcgaacttggtgaccgccgttatgtctttggcgggcgtcgttttgatcatcgcctatctgtcgcccgtccttgctttcatccttattttgtcgaccgctccatttgcttttgtccataatcattacaatgaaatggagtgggaatatcacaaggattatgcccctgtaagaaggagggccgcatatgcgcgccacattctgctcgggagacgatcggccaaagaagtacgcctttttggcctggggtctttctttcttgatttatatcaatctgcttttaaaggcctatattctgtgctgcggaatattcaggtcagaagcgcgcgctggtcggttttaacgggtttcttatcgggggcgggaacgggtttggggtacttttggattctgtcccaatcccattcaagcagtttttctgtgggggatatatcgctgtacttgggggccgtgttccaattatcaacggcactccgggatatcgccaaagaaggtgcagatacgttggatatatggagaatgggaagagacttttttctttttatgaacgccgaaaaggatatcaggcttccttccaatggcgaatctctcgagggcgaaggaccgctggcagtcgaattcaaaaatgtcaccttccgctatcctttcagagaagcggctgccggctcccgggtaaatgaagctgatgtggatgaggaagacttggatatgctcgatgagcttgaagatgaagagatgcggggacaagacgaacagcctgaatcgtatgacatgcacacaggctatgttctgaatcgaattagcttttcagtatcaccgggagaaagaattgccattgtaggggcgaatggatctgggaaaacaacgctcatcaaactgctctgccgtttttatgagtatgatgagggtgagattaaagtgaacggcaaagacatccgcaaggtcgatcttcaacagctgagaaacaaaatggcggtcgtgtttcaggagtttggcagatacgaattgtcactccggcacaatatcgcgataggccgaacggaagctttaggcgatgaagaaaaacttcgcgccgccgctcgggccgccaagctggaaccgattgtcgaagagttgcctgaagggctggaaacaatgatcggccctgaatggggcggcaccgatttttctggaggccaatggcagcggatcgctttagccagatcgtttatgaaagatgccggacttgtcatattggacgagccggccgcatctttggatattcgggctgaatatgatattttccggcagtttcaaagcttcacagagggaaaaacggtgatcatgatttcccatcggttcagtacggtaaagatggctgaccgcatactggttttgaaaaacggaagaatcgcagaagagggaagccatcaggaacttatggacaagaacggggaatacagcagaatgttccgcatgcaggccaaatcgtttcaggggaaggatgaggtatattgctga

SEQ ID NO: 2195 - DNA, 799 bp, Bacillus licheniformis
atgaacaatgaagacgggtggattctgccctacatcaagaaaaatacaaggcttttgatcattgtcgtgctgcttggcgggttgacggcatgctcggcggctgctctcatgtttacctccggttatttaatatccaaagcggctacgcgtccggaaaatgttttgatgatctatgttccgatcgtagcggttcgcaccttcgggattctgcgctcggtgtcgcgctatgttgagcggttgacagggcaccatatcattttgaaaattttatccgatatgcgcgtcaggctttacaggatgctcgaacctcaagctttaaaatggcgtgaacgtttccgaacgggggatatgctcggcattttggccgacgatgttgaacatttgcaggacatgtatttgagaacggtatttcccgggctgtcggctcttcttttatatggcgtattcatcgcagctatcggctttttttcatggccttttgctggactaatggcggtctatgccgcggttttcgtatttcttgttccgcttgtttccctgcttgtgacaagggcaaaaaatgttgcgctgaaaagaggacggagccacttgtaccgtcagctgacagacgcggtcatgggggtgagcgattgggtttgcatcggccggcaaaacgactctggccattcctatgaagcggcaaaacatgaatggctggcgatcgaaaagaaacaggtgcgctgaagtcgttggagggactttgccatgcaatgcctgacggcaggacttgttcttctgatgcttatatggacggacggtc

SEQ ID NO: 2196 - DNA, 871 bp, Bacillus licheniformis
atggcctatgtcatttcggcggggacaagcattccgcgctgccatgtcgaccagaaggaagcagccgtttttgcgagggagatgttcaaagattcatttaaagacattgatcgtctgctgtcagcttttcaaaatggcgaaatcgcttcacggcaatttgtcatgcctttggattggtacaaagaggccaagagcttcaaggagaaaaatcaaacgtacattgatatggctgtcagacacagtgctgaagccgtttcgaattgtctgtcggacgaccgttttttgaaaaaagaaatcccttgcggaaaaattgacgcgattttttttatttcctctacaggcatctcgactcccagcattgaagcgaagcttatgaacattctgcctttttcaaaacgggcgaagcggatcccgatctgggggctaggctgtgcaggaggggcttcaggtatagcgcgggcattcgaatactgcaaagcgtttccaaaagcccatgtccttgtgattgcggcggagctgtgcagtttaacgtttcaaaaggatgatcaatcgaaaagcaatcttatcggcacatctttatttggcgatggaatcgccgcgcttttaatgtgcggcaaggaagcggatttctcagaagccagatttgaggttcttccggaagtattgggctcacaatccagcaccttggaagattcggaagaggtcatgggatgggaaatcaatgacaacggttttcgcgtcgttttttccagggacattccgacattgatcaaaacacacttaaagaacgatatcgaagcatttctgaataaagaacattatcgctttggagaacattcaagtatttctggcccaccctggcggaaaaaaa

SEQ ID NO: 2197 - DNA, 758 bp, Bacillus licheniformis
atgaaaagtgcaagcaaacaaaaaataattcagcccgttgataagaacctcgatcaagtctatcaggtctcaacgatggtatctttattggacggaatttacgacggggatttttatatgtccgaagcgaaggagcacggagacttcgggatcggaacgttcaaccggctcgacggcgagctgatcggttttgacggtgagttttaccgtctccgttccgatggaaaagcctacccagttcaaggaagcgattgttctccattttgctcgctggctttcttccggccggatatctatcacgaaatcaagcagcggatgccgcttgaggcgttcgaagaagaaatgaaacggatcatgccgagtgaaaacctgttttacgcgattcgcatggacggaacctttaagaaagtcaaaacgagaacagttgaacttcaggaaaaaccgtatgtgccgatggttgatgcggtaaaatcacagccgatctttgattttaatgatattacggggacgatcgtcggcttttggacaccgcaatatgccaacggaatcgcagtttccggcttccatcttcactttatagatgaagaccgcaatgtcggcggacacgttttcgattatgaaatcgaagaatgcacggtgcaaatttctcaaaaactcaatatgaacctcagattgccgaatacgcaagatttctttcaagcggatttcaataaacacgatcttgcagccggaattgaagcggccgaaggcaatcccga

SEQ ID NO: 2198 - DNA, 1824 bp, Bacillus licheniformis
atgagccaacaaccaaagcatcacggctctatacccaaaggaatgcacaagacaaaaccgaaagaatttaaaaagacccttttgagattggcccgctatttaaaaccgcggaccttccagctggtgctcgttgtcttcgctgcaatattggcgacattatttaatgtcatcagtccaaaacttctcggggacgcgacctcttcccttttcgcaagctttaaagaaggcaccggtgttcaattcggctttctcggccggatcacgctgatcctggcaggattgtatctgctttctgctttgtttacgttcttgcagcattacctgatggccggggtagcccagaaaacgatatacgaaatgcgccaggaagtgaatgaaaagctgacgcggctccctttaaagtactatgacaagcattcgcacggcgacacgctcagccgcgccgtcaatgatatcgacaatatcaatacgtcattgcagcaggcgctgacgcaaatgattacgtctgtcattacaatagtcggaatcatcgtcatgatgcttttgatcagccctgtgctgacgctcgtcgtcttcatcacggtcccgctcagcatgctggccgtccgattcattgcctcattttcgcagaaacacttcgccgcgcagcaaaaagaactcggcgacatcaacggacacgttgaagaaatgtttacggggcatcaggaagtaaaggcattcgggcatgaagaaaaagcgattcagcaattcgatgaagtaaatgagcgtctttaccagtcaggctggaaagcgcagtttatttccggtctgatgatgccgatgatgacattcatcggcaacctcggctatgtgtttgtcagcataaccggcggtattttcgttcttaacggcacccttttgatcggaggcgtgcaggcttttatccaatatacgcagcaattttcccagccgctcgttcaagctgccggaatcgcgaatacaatccaatcggcaatcgcatccgccgaaagggtgttcagtcttttggacgaagaagaagaaaccggggagacgccggcttccatcgataccggcaaattaaaaggcgatgtatcgtttgaacatgtcgccttcggttatgataaaaacgttccggtcatccgcgacttaagccttcacgccaaagaaggccagacgattgcgatcgtcggaccgaccggcgctggaaaaacgacgatcatcaatttgctgatgcgtttttatgaactaaacaaaggcagcatcaaggtcggcggcacagatatcagcgagctgtcgcgcgaacaggcgagaagcatgtttgcgatggtgttacaggacacatggctgttcaacggcaccatccgggaaaacatcgcttacgggcgtgaaggcgcgaccgaagaagacatcatcagagcggcaaaaggcgcctatgccgacgattttatccgcaccttgccggacggctatgatacggtacttggcgaagatgcccaaaacatctcgcaagggcaacggcagctcttaacgatcgcgagagccattttagctgatccgaagattttaatattagatgaagcgacaagcagtgtcgacacccggacggaaatgaatattcaaaaagcgatgaacaaactgatggccaaccgtacgagctttgttatcgcccaccgtctttctaccattaaagatgccgacatgattcttgtgatgaaaaacggagatattattgaaaaaggcagccacgaagagctgctccgcaagaacggattttatgccgatttgtataacagccagttctcccgggaagaagccgtcagctaa

SEQ ID NO: 2199 - DNA, 1086 bp, Bacillus licheniformis
tacatggggaagatactttttacattatctacacatccggaagcacgggaaatccaaaaggcgtgcaaatctcagccgataaccttcagagcttcacagattggatcacgaatgactttccggtggaaagcggccaagtgttcttaaatcaagccccgttttcctttgatttatcggtaatggacctttatccgtgcctgcagtccggaggcaccttatggacggttacgaaagacatgattaatcggccgaaactattgtttgaagcactgaaacagtccaacgtcaacgtctggacatcgacgccttcattcgcacaaatgtgcttgatggatccgtcttattcggaagagctgcttccggagctgagcttgtttatgttctgcggagaaacgcttcctgcgtcagtcgccagacagcttaaagaaagatttccaaaggctcgtgtttttaacacatacggcccgaccgaagcgaccgttgccgtcacttccatcgaagtaacagacgacgtattaaacaagtattcttctcttcccgtcggttctgaaaagcccgaaaccgaaatcgtaatcatcaatgaagacggaaaagccgtccaagacggggaaaaaggcgagatcataattaccggagcaagcgtcagcaaaggctatttaggcgaaaaagcgctgacggaaaaagcgtttttctcttacaacggctcccctgcttaccgcaccggtgacgcaggttacaaagaaaacggccagctcttcttcctcggaagactcgatttccaaatcaaactgcacggctaccggattgagcttgaagaaatcgaatatcagatcaatcagtcccgatatgtgcagtcggcagtcgttattccattctaccgcgaggagaaaatcgagtatctgatcgccatgattgtgcctgccgaacacgatttcgaaaaggaataccagttaaccagcgcgattaagaaagatttgggcagcaagctgccggcctatatgattccgagaaaattcatgtatcaaaaagagattccgatgacagcaaacggtaaaatcgaccgcaagagattaaaagaagaggtaa

SEQ ID NO: 2200 - DNA, 906 bp, Bacillus licheniformis
tgaatcacaagcaatatctagcactcgccgttccgctgatcatttcaacgatcaccactcctttattgggtgcggtcgatacggcggtcgccggccagctttcctcccctgcttacatcggcggtgttgcagtcggaacgatgatttttaatacgatgtattggctcctcggttttttgcgggtaagcacatccggattcgccgctcagtcactcggctcccaaaacagatcagagagcgttttggcccttgcccggcccgttttcatcgcgctgtttgccggactgatgttcatcatcttgcaaaaaccgcttgaatacgcagcgctgacgctcatacagcccgaccgccataccgctgaattcgcctcgcagtatttttcgctgaggatttggggagctccatttgctttaatcagctattgcattctcggctggctgatgggaatgtctctaatcaaagtgacattgcttttgcagatttcgatgaacgtcttgaatatcgtgcttgacatcgtttttgtctacgtctttcacatggaagtatacggcatcgctctagccactttgatttcggatgtgacgggctgcctgatcggctgctggcttgtgaaaacgaatgccgccatgccgtttaagctgccgtccgtcaagcttttattcgacccgaaaccgtttaaaaaaatgatggttgtcaaccgagatctattgattcggacattgtgccttttgacggttttcaatttatttacggctaaaggagccggcttcggcgctgaaattttagccgcaaatgcgatcttgattcaaattcattatttgatggcttatgtttttgacgggtttgccaatgcatcgagcatctttgccgggaaagccgtggaagaaggatcgggatctctattcc

SEQ ID NO: 2201 - DNA, 1677 bp, Bacillus licheniformis
atgctcggacctctcctagtctggctgagtgcagaggtgatcgatgagattgcacgggcgccgtttgagctgtcttcttggaatgcactggtttgggcggcctttgcatacattgcttttacgctgatcgtagatgcccttcagcctgtagctgaaatgcagaaaaggctccttaccgccaagctcgaagcttatcttgatgaaatgctcatgaaaaaggcaatttccattcctgatatcgcggcttttgaagacgcatcttttcataccaatacacaaatcatccgctataatgaatattttgtcacgatgtgggtttccatcgtgtctcaaaccttcggcggaatggtgatgattgcagccagcagtttattgattggcatggctgcaccgtgggtgccgctgctgtttctcatattggccgttcccaaactgtactgggaggcgaagttaaacaacgcgacctttgaaggacggaaagaggttcaggaactgaggcggcgcgcggaatattatgcaggtgtccctcttatgtctgaaacagccggagaggtcaagatatacaatcttgttcctttttttaaatccttttataaaaacacctcaatggagctcctccatacgctgtccaacgatcaaaaaaaactggcgctgtatcagctgttctggtcggtattacaatctttggccgcaggtgccgtcctgatttacatcgttcaccaggcttttcatgggggattatccatcggggatgtgatgctgtttatcggagccgcggttcagttcaatgaaggaatcaatgaaatgttcgctgcttttgcgatcggagcaagagaaacgaggcacctcggaaatgtgcattcttttttaaacagcaaaaattccatggaaaatggggaaaccgctccagctgttcaaaagcaaaaaggatttacatgtgatcaagtggaattttcttatgatggaaccaaaacggtacttgatattcaacagcttgatattccattgaataagacgaccgttctcgtgggagaaaacggatcaggcaaaagcacactcgttaaattgcttctgcgttattttgatcccaatcaaggcacgatctcgtataatggtttaccgctttataagtatgatatagagcattaccggtcaaatgccgcggccgtgtttcaggattttttgcggtacgaaatgacattgaaatacaatatcggtctgggcgacatttcttcatgcaccgacttggccaaaataaaaagtgcttcggctttcggcggagtggatcagtttttgcataagcttgaagacggctatgaaacagagcttggcagattgttcggcggcaggaatttgtcggggggagaatggcagcggatcgccatatcccgcgcatttatgcgtgatgagtctgccgacattttaatatttgatgaaccctcttctgcgctggatgtatttattgaggaagagatatttgataagctgcaaaagctgacgcagggcaaaacagtcattattgtctcgcaccggttaagcacggcccgttttgccgaccacatcatctttttagaaaaaggaagggtggcggaggccggaacccatcaagaattgatgaaaaatcaggcacagtacgcagagctttatcgcctgcaagctgaaaaatacgcgcaataa

SEQ ID NO: 2202 - DNA, 565 bp, Bacillus licheniformis
atgagaaaaagtaagagagaacgccaagaattgctgcagcagacgattcgtacgaccccgtttattacggacgaggagttagcggagaaatttaacgtcagcattcagacgattcgcttggaccgtttggaactttccatacctgaactgagagaaagaatcaaaagtgttgccgagaagtctcttgaagatgaagtcaagtcattgccgcttgacgaggtcatcggcgagatcattgatttggagctggatgagcacgcgatttcaattcttgagatcagaagggagcatgttttcagccgaaatcaaatcgccagggggcaccatttgtttgcccaggccaactcgctcgccgtcgccctcatcgacgatgagctcgcattgacggccaaagcggacatccgctttacaaggcaggtcaagcaaggcgaacgggtcgttgcaaaagcgaaagtcgtgaagcttgataaagataaaggcagaacggttgttgaagtgaacagctatgttgccgaagagcctgtgttttcaggcgaatttgtcatgtatcgttcaaaacaatcat

SEQ ID NO: 2203 - DNA, 550 bp, Bacillus licheniformis
atgaaaaaagctcttatatgtatagattatacgaatgactttgtcgcagctgacggtaagctgacgtgcggggaacccggccgcaaaatcgaagacgccgtggcgcgtctcgcggatacgtttattcaaaacggcgattatgtcgtatttgcagtcgattcacacgaggccggcgatacgcttcatccggaaacccgtttgtttcctccgcataatataaaaggtacatcaggacaggatttatacgggaagcttgaaaagctttatcgaaaacacgaacacgatcagaatgtctattacatggaaaaaacaaggtactctgcttttgccgggacaaacctcgagctgaagcttcgtgaaagggatattcaagaactgcaccttgttggcgtatgcacagatatatgcgtgctccataccgcagtagatgcttataataaagggtttaatcttgtcattcatcaaaacgcagtggctagctttaacccggacggacacgactgggctctttctcattttgcaaacaccctgggagcctcagtgtcagatt

SEQ ID NO: 2204 - DNA, 1470 bp, Bacillus licheniformis
atgacctattatgaagtcaccatgaaagaatttcagcagcagcttcaccgcgatctgccgccgactcggctgtttggatataacggagtttatcccggccctaccttcgaagtgcagaaacacgaaaaagtcgcagtcaagtggttaaataagcttccggatcgccattttctccccgtcgaccatacgcttcacgatgacggccatcacgaacatgaagtgaagacggtcgttcatttgcacggaggctgtacgcctgctgacagcgacggatatcctgaggcttggtacacaaaagacttccatgcaaaaggccctttctttgaaagggaggtgtatgaatatccgaatgagcaggatgctacagctctttggtatcatgaccatgcaatggccatcacaaggctgaatgtatatgcggggcttgtcggtttatattttattcgcgacagggaagagcgttcattgaacttgccgaagggagaatatgaaatcccgcttttgattcaggataaatcatttcatgaagatggttcattgttttatccgcggcagcctgacaacccttcgccggatcttccggacccgtcgattgttccggctttttgcggtgataccattttagtcaacggcaaggtatggcctttcgctgaactggaaccccgaaaataccgttttcggatactgaacgcctccaatacgagaatctttgagctgtatttcgatcatgacatcacatgtcatcaaatcggcacggacggcggtcttctgcagcatccggtcaaagtcaatgaactggtgatcgcgccggctgaaaggtgcgatatcatcgttgatttttcacgagcagaaggaaaaaccgtgacactgaaaaaacggatcggctgcggcggacaagacgcagatcccgatactgatgccgacatcatgcaattccgcatctcaaaacctttgaagcaaaaagatacaagttcattgccgagaatattgagaaagcgcccattttaccggagacacaagatcaatgccctcagaaatctgtcattgggcgcggccgttgaccaatatggaagacctgttctgcttttaaacaacacaaagtggcatgaaccggtaaccgaaacacccgcactcggcagcactgagatctggtcgatcatcaatgccggaagggcgatccatccgatccatttacatcttgttcaatttatgattctcgaccaccggccgtttgatatcgagcggtatcaggaaaacggagaacttgtttttaccggtccggcagttcctccggcaccgaatgaaaaggggctgaaagacaccgtcaaagtacccccgggttcagtgacgcgcattatcgccacctttgcgccgtacagcggcagatatgtttggcactgccacatccttgagcacgaagattacgatatgatgcgccctcttgaagtgacagatgttcgtcatcaataa

SEQ ID NO: 2205 - DNA, 553 bp, Bacillus licheniformis
atggccattcctgccatcttaccgtaccaaatgccagaagcatcaaatatgccgaaaaacaaggtgtcatggactcctcatccgaagcgtgcggcgcttctgatccacgatatgcagcaatattttctcaacgcttaccgttacggcgagtctccggtcacagatctgctggctaatatcaagaagcttcggaagcgatgtgccgagctcggcatgccggttattttcacggctcaacccggcgcccagacaccggaagaacgggggcttctccaagacttttggggacccggaatcggtcctgatcccgatgagcagaagatcgtggatgagctgaaaccgaatgaaggcgacattgttttgaccaagtggaggtacaatgccttcagaaaaaccaaccttttaggcgtgctggaggagcaggggcgggatcagctcataatcaccggaatctatgcccatatcggctgcctgatgacggcatgtgatgcttttatgcaagatattgaaacatttttcgtcggagatgccgtggcgggatttctcattaaag

SEQ ID NO: 2206 - DNA, 668 bp, Bacillus licheniformis
atgaagatttacgccgtttatatggatcagctgccggaagccggtcaatttaaccgaatgatggccatggtgtctgaagaaaagcgaaaaaaagtgggcagatacagatatcccgaagatgccagccggacgctgatcggagaagtgctggcgaggcacatcatcagcgaaacgtttcatttgccgaatgagcagatccgttttacagaaggaaggtacggcaaaccggctgctgaaggtctgaacgactttcatttcaacatttcccactccggaaaatggatcgtgtgcggagccggcgcgcagccgatcggagtggatgtcgaaaagatcaagccgatcaatttcgacattgccaaacggtttttttcaccttccgagcacgatgatctcatggaaaaggacgaatcagaacgcctgtcgtatttctatcatttgtggacgatgaaagaaagctttattaaacaggcgggaaaaggcctgtctctgccgcttgattccttctccgtcaaactgaacgaacaggggcgagcttcggtggaaactccccccggctatccgccttgctatatacaagcctatgaaattgaccccggctataaaatggcggtgtgttccgccgcacctgaatttcccggccggattgtgatgaaaagctgcgctgaact

SEQ ID NO: 2207 - DNA, 525 bp, Bacillus licheniformis
ccaattcagctctcattatagtcgacatcattaatgattttcaattcgatatgggtaacgttctttccaaaaagaccagaaatatcaccgagcatcttctggcattaaaagaacacgcagccaaaatgaaatggcctatcatatacattaatgaccattttggaatttggcaagcggatattgctgccattatcaagaaatgcaaaaacggcaggagcgaatatatcatcgaccggcttgcaccgaatgacagcgattattttttaatcaaaccaaagcactcagccttttacggcactgctcttgaaacattgctgcatgaacttcatgtcgatcatttgatcatcactgggatcgcaggcaatatctgcgtattatttacggcaaacgatgcttatatgcgggagtacgagattacgattccgcgcgattgcatcgcctcaaacaatgaaaaagacaacaaatacgccttgacgatgatggaaaatgttctgttcgccaatatcacgacggctaaggcgatta

SEQ ID NO: 2208 - DNA, 870 bp, Bacillus licheniformis
aacaaaagattcaaaaggtgtatcctttgacaccgatgcaggaaggaatgctgtaccacgcaatgcttgatccggaatcttcctcttacttcacacagctggagcttgtcatagacggggaatttgatttggggatctttgaaaaaagcgtgaatcagctcgtgcgttcatacgatattctcagaacggtttttgttcatcagcaattgcaaaaaccgcgccaggttgtcctggctgaacggcaggcaatagtggaatttgaggatcttgcggacttggatgaggaaaggcaaaaaacccgcattgaccggtataaacaagaggtacaggcggccgggtttaatttggcgaaagacatgctgtttaaaacggcggtctttcggcttgaccggaaaaaataccatctcgtctggagcaaccatcatatcgtgatggacggctggagcatggggatattgatgaaacgcctttttcaaaactatgaagcgtttcgagcaaaccggacggttccgcttgatcagggaaaaccgtatgcggactatattaaatggctcggccggcaggataaggatgaagcggcatcctactgggaacaccgcctttcgggtttagaaagcccgagcgtcattcccggcggaaaaacgcggccggattcaggatcgtaccggaacgaggagttcacgtttgtttgggacaaagacatggtggatgctcttcaaaaggcggcaaaccgctatcatgtcacagctcccaatctttttcaggcgatttggggaacagtgcttgctaaatataacagatccgaagatgtggtgttcggcacggttgtgtccgggcgcccgtcggaaatgacggaatcgaacataggca

SEQ ID NO: 2209 - DNA, 1038 bp, Bacillus licheniformis
ggctgttcatcaacacgatccccgtccgtttaagggtcgatcaaaacgcatcgtttgccgagttgttcaaacaagcacagcagcatgcaattgacgcggagcggtacgactatctcccgctatatgagattcagaagcaatcggcattggacggccgcttgatcagccaccttgtcgcgtttgagaactatccgcttgataaagagctggaaagcggaacgatccatgagcggctcggcttttccatcaaggctgccggagcttttgaacaaacgaattacgactttaatttgatcgtttatccgggagcggagtggacgatcaaattgaaatacaacggcgaagcttttgacgcggctttcattgagcaggccgcagggcatttaacgagacttgcagaagaggcgattgcaaatcccgaatcaaaagcaggcagcgccgacatgttatcaaaacaggagcaacaaacgctgctcgcttttaatcaaacgaaaaccggttatccaagagaaaagacgattccggagctgtttgaagaacaggttgaagcgtctcctgacaaaacggctgttgccgctgacggaagaagcctgacttaccgcaggctgaatgagaaagccaatcagctcgcgagaaggctgaaagcaagaggcttgatgcacggaaatgccgccgccattatgatggagcggtcgcttgaagcagccgtcagcatgctggcggtactgaaagcaggaggcgtgtacgtaccgatcgatcccggatatcctgaagagcggattcgcttcttgctcgaagacagcggagcaaagatcgtccttacaaaagacagcccgcagatttcgctggaagggtatgaggtactcgccgcaaatgcggtggatgcagaaaaagaagatgccgccaaccttgtacatgccaacaaacccggagatcttgcctattacatttatacatccggatcgacgggcaagccgaagggcgtgatggtcgaacaccgcaatatcgtccgccttgtcaaaaatgcgggctacatcc

SEQ ID NO: 2210 - DNA, 447 bp, Bacillus licheniformis
  misc_feature (1)...(447): n = A,T,C or G
ggttttgaataatatccggctcgggaaccttgacgcgagcgatgagnacgtgtattgggcggcgcgccaggtgaagcttcacgattatattcagtctcttcccgatggatatcatacatctgtacaggaaacgggcatccgtttttcaggtggagaacgccagcggattgctttggcgcggattctgctgcaggacgcacccatcgtcgtgttggacgaaccgaccgtaggccttgatcctaaaacagagaaggagcttctttcaacgatgtttcaagtacttgatggaaagaccgttctatggattacacaccatttggcaggagccgaagcggccgaccggattctgtttttagacaaagggaagcttgcaatggcagggagccatcagcagcttttggaaaacaatccgcgctattcaagactttatcgtctggatgcgcctgt

SEQ ID NO: 2211 - DNA, 546 bp, Bacillus licheniformis
ttaaagagttaactggagggtatacaagaaacccggtgctgcgcgatgtttcatttgcgattgaacgggagcagatcgtcgggctgatcggtttgaacggagcggggaaaagcacgacgatccggcatatcatcggcttaatggaaccgcacaaaggatctgttgaattgaacggcaaaacgttcatggacgatccggaaagctaccgttcccaatttacgtttattccggaaacgccgattttatatgaagagctgacattgaaggagcatttggagctgactgcgatggcgtacgggctttcgaaggaaacgttcgagaaaaggctgccgccgcttttgaaggaattcagaatggagaagcgtctgaaatggttcccggcccatttttcaaaaggaatgaagcagaaggttatgatcatgtgcgctttccttgtcgaacgtgacctgtacattataggcgaaccgtttctcggtcttgatccgcctggcgatcaatgcccttctcgagcggatgaatgaagcgaagaaaaacggctcggccgtt

SEQ ID NO: 2212 - DNA, 614 bp, Bacillus licheniformis
atgagtacaattctactggaaacaaggcatcttcaaaaaaagttcggaagatcgcaagcggtctcagacgtctcattgtcagttgaaaagaacagtatttacggattgcttggaccgaatggagcaggaaaatcaacgactttaaaacttttaaccggaatcttaaacccaactgccggggatattttgtttgaggggcggcaatggaaaaggtccgtattaaaagacatcggttctttaatagaatccccgcctctgtatgataatttaacagcctacgagaatgccaaggtgcatgccgcattattgggccttccagatgcgagaataacagaggtgcttaaaactgttgatatgcatcataccggaaagaaaaaggcggggcagttttctatggggatgaggcagaggctggggatcgccatcgctcttttaaatcgccctaaactactcatacttgatgagcctactaacggtcttgatccgatcggtatacaagagttgagggaactcatcaggtcatttcccgaacaggggatgacggtcattttatcaagccacattttatcggaagtcgagcagatcgcagaccatatcgggattatcagcggagg

SEQ ID NO: 2213 - DNA, 756 bp, Bacillus licheniformis
tggcgcgactcttgtatcttgccgaaacagataagcgtgaagttgaaagaatcacaaaggactacccggagctgaccgttgaataggcgtatgcgatccaagaagagctgattcagcttaaattatgggatggcaatagcatcatcggtccgaaaatgggactgaccagccgggcgaaaatgaagcagatgaacgtcgaggagccgttctacggttatatttttgaagatatgatcgtgccaaacggcggaagcatccggatgaacgagctgattcacccgaaggttgaagcagagattgcttttgtgctgggggaggatattgaaggaccgggtgttacaaaggagcaggtccttgaagccgttgctgaattgattcccgttctagaagtgattgacagccgctatgaaaatttctcattcactttgcctgacgtcatcgcggacaatgcgtcatcttcaagagtggtgttaggtgaaaaagtgaagaagccggacgatttcaagctggatgaagcaagagtctctttaatgataaacggcgaggtcaaagagcggggcactggagcagcggttgtcgggcatcccgcaaattcggcggccatgctcgccaacatgctctcccggaaaaaacaaaagcttgcggctggcagcatcattttaacgggcggtgtaacgggagctgtcatgctgcagccgggcgaccgcgtttcagcacaagtagaagggctgggagatgtatcattttcggtcaagc

SEQ ID NO: 2214 - DNA, 738 bp, Bacillus licheniformis
ggatggcaaagccgacatcaggagatatccgcatcgacggctattcagttaaaagcaattacgaggaagcggcagcccgagtcggttctgttgttgaaaacccatccttttatgagcacttaacaggataccaaaaccttaaatatctcggcggattccacagccacgtgtcaaaggagcgcatagaagagatcgttcagcttgttgatttgacaggaagtattcataaaccagttaaaacgtattcattaggcatgaaacagcgtttgggccttgccgtcgcgctcttgcatgatccggaatttctcattctcgatgaaccgacaaacggccttgatcctcagggaatcattgatttgcgcgaacaccttcagtacttggcgaaaaccttcaacaaaacgattttgatttcgagtcatcttctgtctgaggttgagatgatttgtgatgaatacggcgtcatgaaaaacggagaactcctgcaaattaagagcaatcaccgcgataccgatacggttcgttatcggcttacattaaacggccacgccgatgaagcggctgacctgttgaatgagtaccagtatgcaggcggtctcacggaagataaaaatgagatttatgtcctttgcatggaagaagacattatgaaagtcgttaatctgttaatggagaacaaaataagagttctgcatatgaagcaggaaaaacagtcgatagaacaaagctttctggaattga

SEQ ID NO: 2215 - DNA, 858 bp, Bacillus licheniformis
tcacgaagaagttttccaatggcaaaggtatctttgatctttcttttcatgttcaaaaaggtgaagtttttgggtttttagggccgaacggagccggaaaatcgacgaccatccgacatatcatggggtttatgaagcctgatcaaggcgacattaaagtaaacggaatggatgttttgaagcagcagggcgatattcagcggcatatcggctatctccccggagagattgcatttatcgaaggaatgacgggaaaacaatttctcgatttcatggcagacatgcacggcttaaaagatacagccaagcgcaatgatcttattgaacggctccagttcgatgttcatactccgatcagaaaaatgtcaaaaggaatgaagcaaaaggtcgggattgtcgccgcctttatgcacagccccgaagtgattattcttgatgaaccgacatcaggcctcgatccgctgatgcaaaaagtatttattgaaatcgtcctcgaagaaaaagcgaaaggaacgacgtttttaatgtcttcccacagctttccggaaatcgaaagaacctgtgacagagcagccattataaaagacggcatcatcattgccgtcaaggatattcatgaactgcagtcgatgcagcgaaaagtatttgaagtcacatttgaaaacacgggcgacattcccgccttcatgaattcaagtctgcaaattgagtcccggacggacaaccgcgtcaaagtggccgttttagggaaccatgatcaatttattaaagaaaccgccaaatatcacattcggcacattgatgcttcatcacaaagcttggaagaaatttttatgaactactataacagaaagggga

SEQ ID NO: 2216 - DNA, 927 bp, Bacillus licheniformis
atgaatgtggtgatcgaggcaaaagggctgatgaaaagctacggcgccaaaaccgtcgtcaaccatgtcgaccttcaagttgaaaaaggagagatttacggattcctcggccgcaacggtgcggggaaatctacgtttatgaatatgatcacaggcattatccagccgacagccggcagttttctgctgttaaatgaagcttcgattgaaagcgtcaagcaccgcatcggcgttttacccgattatttgaccctctatgattcaatgacagcggtcgggcatttgaagtattttgcaaagctgaacggacggaccgtatcgactgagcgttgcgaagaagtcttagagagggtagggttcactgagcatactgaaaaaaaagcgggcgcgtattcattcggtatgaaaaaaaagctcggcatcgcccaagcgatcatccatgatcccgagctcatctttttggatgaaccgacatcaggtgttgatgccgaatcggcactccacattcaaaagctgattatggatttgcaaaaagaaggtaagacggtatttatgacgtcacacaacctgcatgaaatcgagaaaatctgtacacgaatcgcgatcatgaaaaacggccgcattttaatggaaggcacgctcgatgagttaagaaggcatttcatgtcgaacataagcgttcacatccgccattcgaatattcccgagcagcatttcggcctgatcgaccgatttcttgagtcagctggtgaaaacgttcaatttaagcaccatgagatttcgatcatcgtcaattcagaagaaaaaattcctgccatcgtcagagtattaacgaactgcaaggtgggaatctacagaatccacgtcgatgaaccgtcgcttgaagacatctttatcgacagctcggaggaacgcgttgtgtcttga

SEQ ID NO: 2217 - DNA, 927 bp, Bacillus licheniformis
atgacaaagcagcctgttttacatatagaaaatgttgataaaatcatagacggcaaaacgatattgaaagatatccgcttaacggcggatgaaggggagatcatcggtctgcttggtccgaacggatcaggaaaaacgaccctcatcaaattgatcaccggtttaatcaaaatgaagagcggatcaattgtcataaacggctttccgattgaccgccaatttgaaaaagcgatccagtccgtcggagccattgtagaaaatcctgaattctatccgtatctgacaggctatgaaaatctgaagcactatgcaaatatgcacgctggaatcggacgggaaagactggaggaagtcatcagcagagtcggccttgaagatgccgcagaagacaaggtcaaaacatactcgcttggaatgaaacagcgcctcggtattgcccaggcgattcttcaccggccaaaactgctgattttggacgagccgacgaacggattggacccggcgggaatgaaagatttccgcgaacacttgcgtgaactcgccgaagaagaaggaacggcgatcctgtttgcgactcacttgctgaaggaagtggaagatttatgcgaccgggtcgtcatccttcaaaaagggaaaatcaaatcaactgtcgtccttaatcaagcggacgagaaacaggaaaaggcgatgctggaggtacagcctcatgacaaagcgcttcagtggctgaaagaccaaggatacgaagctcgcaccgaaaaaggcctgcttgccgtaaaggtggagaaagcgcaaattccggctttaaatcaacagcttgtcgccaatgatattgacgtctattcgatcgctccgtttaagcagtctcttgaggatgaatatatggcgcggacgaatggaatagaagagaggaatgctgatgtttaa

SEQ ID NO: 2218 - DNA, 306 bp, Bacillus licheniformis
aatttccgatattatgcgcaacggccagtatactgatccttttgacgattatcttggagcccggccgctcgtttaacgtggtcatcattaattctctcagagctgcgggagacgcgaaatatccggtttatatggcgattgtctcgatgtggggaatcggacttccgatcgcttacattttcggcattcagctcggattcggcctggcgggaatttggttttccttcatcgccgacgaatgggtcaggggaattttaatgtacagaagatggagatctaaaatgtggcttcaaaaaggatttgcag

SEQ ID NO: 2219 - DNA, 885 bp, Bacillus licheniformis
atgatggacaatgtaattgaactccggcatgttcataaatcgttcgatggtttccagctcaaggacttttcgatgagcgtaaaaaaaggttttatcaccggatttatcggcggaaatggcgtgggaaaatcgacaacgattaaactgatcatgaacttattgcagcctgacagcggaacaattacggtatttggcatgaattacaaggagcatgagaaagaaatcaaacaacgtattggctttgtatttgattccaacatattttatgaacatttaacgttagctaaaatgaaagatattgtgaaaagatcctatgtcaattgggatgaacaagtatttaatgattatgtgaacacatttaacttgccgctcacaaaaaaaatcaagacgttctcaaaagggatgataatgaaagcatcattaaccgttgctttgtcccatcatgcggaattaattattatggatgaaccgacgtccggactcgacccgattttccgccgggagctgttggaaatcttgcatcagctcatgcaagatggggataagacgatctttttttcgactcatattacaactgatttagataagattgcagattatatcacgttcattgataaaggagagcacatctttacaaaggacttttacgaaattgaggaacaatatgcaattgtaaaaggcggaatggagttgttagaccgggagaccgaacaggaatttatagcggttcgaaaatcaactcatggatttgaagcattgactgcgaataaatcacgaacagaaaaaatctttggggacatggcgttaatagaaaaaccgacccttgaagatattatgttctatacgaagaaaggagccaaagaacatgttcaacttaattcttaa

SEQ ID NO: 2220 - DNA, 283 bp, Bacillus licheniformis
atgaacgagatcattaagcagtttggagcgccggcaagcggtatgcagttgatctgtttcccgtttgccgggggatattcggcatcattcagaccgcttcacgaacatttaaaaacagattttgatatgctggcgatcgaaccgcctggacacggcacaaatcgaatggcgcttgtcgacaatttggaaaagctcgccgatttgtatatagcggcgcttaagccgcggctttcctctcaattcgtgctgttcggccacagtatgggcggcatggttgtttaca

SEQ ID NO: 2221 - DNA, 312 bp, Bacillus licheniformis
gctcaacgcttgcgaaaacaatcgacatggatcatctgtacattactgctaacattgaagaaaacgacctgaaagacatcgaaaaaggggacaaagtcgatatcgtcgttgacggtgattcaggcactacatttgaagggaatgtcgaagaaatcggctatgcgacaaactcaacatttgacttgctttctcaaagcaattcaagcggaaactacacgaaagtaacgcagaaagtacctgtgaaaatttcaatcaaaaacccgtctgacaaagtgctgccgggaatgaacgcatccgtgaaaatttcaaaat

SEQ ID NO: 2222 - DNA, 876 bp, Bacillus licheniformis
tgtccgtcaatggcttaacaaaaatgtatcagcagcaccaagctgtccaaaatgtcagctttgaccttgaatatcagcaatgcgttgcccttctcgggccgaacggagcgggaaaaacgaccacattgcaaatgctttccggtttattggcccctacatcaggacgcatccgctttttggggagagaatcgataaacaggctggaaatcggatatttgcctcagcatcctgcgtttttttcatggatgacagctttagaatatacggtattcgctgcaaggctttccaaaatgaaacgtcgtgaagccctggaaaagagtcgaaccgctttgcgctatgtcggtctggaaaaggaagaagaccggaaaatcggcggtttttcaggagggatgaagcaaaggctcgggctggcgcaggctttggttcatgagcagaggctgttgattttggatgaacctgtttccgccctggatccggcggggcggcgcgaagtgcttgatatgatgaaggatttaaaaaagaagatgacaatcctattttcgactcatgtgctgcatgatgccgaagaggtgtgcgatcaagtgatcatgctgaaagaaggggctgtcaaatggtctggtccgcttcacagattgaagaaccgtcatttaaagccatcatatatgctgacagctgaagaaagtcttgaaggatggctggaacacctgccttatgtcagcaaagtcgtgtatcataagccttcacaagctgaattttatttaacagatcggtctgacagccgccgactgttggctgaatgcttgaacagacaagtatcgattgttcgttttgaacaaaaaacgatgtccttggaagatatgtatctgaaggtgatgg

SEQ ID NO: 2223 - DNA, 852 bp, Bacillus licheniformis
atgcatatacgaaagggagaaatatacggttttctcggcccgaacggagccggaaaaacgaccatcatgaagatgctgacgagcctcgtgaaaccgacaagcggcgaaatcaatatccttgggcataagctgacaaatcgatcatacgagattctcgggaaaataggcagcatgatcgaatacccgattttttatgaaaatctgacagccaaagaaaatttaaatctgcattgtgagtatatgggatatcacaataaagccaagattcaggaagtgctggacatggtgaatttaaaaaatatcgacagcaaacctgtcaaaacattttccctcggtatgaagcagcgtcttggaatcgcgcgggccattctcaccaaaccctacttgctcatcttggatgagccgattaatggccttgatcccatcggaattaaagaaatcagaaacttatttcaagtattgagcaaagagtatggcatgacattgctcatctcaagccacatcttgaacgaagtagagcaaattgcagatacaatcggagtgattcgggacggcaggcttgttgaagaagtatcgatggaaagcgtaaggggacggaacacagagtacattgaactcgtgacgccgaaccaattgcatgcttgctttgtgcttgaacatgagctgcagattgctaattttaaaatactaaatgataaaacgatccgaatttatgatgccgaagcttctcaaacagccatttctaaagctctgattttgaatgatgtagaaattgaatccatgaataaaaagcatacttcgcttgaggactacttcctcagcttaatcaacggcaatgcggtcaacgcataa

SEQ ID NO: 2224 - DNA, 885 bp, Bacillus licheniformis; identical to SEQ ID NO: 2219

SEQ ID NO: 2225 - DNA, 834 bp, Bacillus licheniformis
atgaagtttgcgacagcaaagctgcacagccgtacatttgtagggcttgtcatggatgagaagataatggatttgcaaaaggcggaaaaaaagctgtttgagcttgaaacgatacctgaaacgcttatcgaatgcgtaagcgagggagagaagtttgtccgccatgtcgaacagctagtggaatggtcaaagaagaaaaacagcgaagagagcggttcgtatatttatccgctgtcagacgtcgatttgcttgcaccgattcccgaaccgcggaaaaatgtgatctgcatcggaaaaaattatcgggatcatgcgattgaaatgggaagtgaagcagatattcccgaacatatcatggtgtttacaaaagcgccgacttcggtcatcggccacatggaagggattgatgcccacgaaggcgtgacagaggcgctcgattatgaaggcgagctcgcggttgtcatcggcaaaacgggaaaaaacatcccgaaagctgaagcgctcgactatgtgttcggctatacgatcattaacgatgtgacggcgcgcgatctgcaaaagaggcacaagcagttttttatcggcaaaagccttgatgcgacctgcccgatggggccgtttcttgtacataaatcaatgattgaagaccccggtgacctgaaggtggagacgagagtgaacggcgaactccgccagtcggggagcacaaaggacatgatttttccgattgcggatttgatcgtgacgctgtacaaaggatcgactgccctaatcgggggattttttcttttccggttctcttttttgagtcttttttggcttttttgcttctaa

SEQ ID NO: 2226 - DNA, 285 bp, Bacillus licheniformis
tatactcgtttgcccgtgcgctggcatacgatccggctattcttattttagacgaggcgacggcccatatcgataccgaaacagaagcggtcattcaaaaagcgcttgacgtcgtcaaacaagggcgcacaacctttatcatcgaccacaggctgtcaacgatcaaaaacgccgaccagattctggtgcttgaaaaaggccggattatcgaaaggggaaatgatgaagagctgatgaagcagaaaggccaatactatcaaatgtatgaactgcaaaaggggaaag

SEQ ID NO: 2227 - DNA, 768 bp, Bacillus licheniformis
cagcatactggaattaaagaatgtaacaaaacactatcaagatttctctttaaaaaacatcaacttctcgcttgagaaaggttatattatgggttttatcggcccgaacggagccggaaaaagcacgaccatcaagctgatcatgaacctgatcaaaaaagacgaagggaacatcagcattttcggtctcgacaatgaaaaacacaatatcgaaatcaagcagagaatcggctttgtatacgatgaaaatcatttttacgaagaactgacaccaaacgaaatgaaaggaatcatcagaccgttttacaaaaagtgggacgaagctgtttttcagcggtacgcaaaagacttccagctccctttaaacaaacagatcaaaaacttgtcaaaagggatgaagatgaaattctcattggcggtcgcgctttcccatcatgccgaattattgatcatggatgaaccgacatcaggactggatccgcttgtcaggtccgagctcctcgacgtgctgcaaacattgctgcaggacgagaacaagtcgattttcttttcgacgcatattacctctgatttagaaaaagtagcggactatattactttcattcataacggccggctcgtgctgagcaagacaaaggatgagctgttggaggagtactgcattgtgaaaggagacctcgatacgctgcgcaaagggaacgaagacgccttaatcggcatcaagaaaaaccgctatggttttgaagcgctctccagagataagcggga

SEQ ID NO: 2228 - DNA, 279 bp, Bacillus licheniformis
aagacttcttgctgtatgcgttgttttttcagctgtcagatgccattgccgcgccgattcaaggagcgctcagaggatataaagatgtcaactacacgcttgtcacagctctcgtctcatattggattatcgggcttccggtcggttttgtaatcggaacgtatacttcattcggagctttcggatactggatcgggctgatcacggggctagcggccggtgcagtcgggctgttcttcaggctcaaacgcattcaaaaccgctatattcacactcaaa

SEQ ID NO: 2229 - DNA, 780 bp, Bacillus licheniformis
atgattgtcggacatatgagcattaccgccggtgaaatcgccgtgtgcggcgtcagcgtaaaagaaaactttgaaaaggctgcacggcatatcggagcgatcgttgaaaacccggagctttataaatttttaacgggctaccaaaaccttcagcaatacgcgcgcatgacgaaaggcgtgacgaaaaagaaaattgacgaaatcgtcgagctcgtcggattgaaaaacaggatcaacgacaaggtcaaaacgtattcgttaggaatgagacaaaggcttggccttgcccaaagccttttgcacgatccaaagctgttgattctcgatgagccgacgaacgggcttgatccggcaggtatccgggaaatccgtgactatttaagaaagctgacgagagaaaagggaatggcggtcatcgtttcaagccacctgctttcagaaatggagctgatgtgcgacaggatcgccattattcaaaacggaaagctccgggatattcagcatgtgcacggacccgctcgggatgagaagaagcgctattatattcaagcggacgacacccaggctctcacacgggaagcggctgctttcagaaaggtgaaggttgacgaagcggaaggcgggatagagctcagcattcaaaaggatgaagtgcctgatttgattaaacacttgacagacagcggtgttcgcttatatgaagtgaaggctgtgaacaaatcgctggaagaccgattcctggaaatcaccgcagataaggaggaagctcagcatgtttaa

SEQ ID NO: 2230 - DNA, 759 bp, Bacillus licheniformis
atgacgacgatgctcgattcgctgtttaagaggattggatacaagccaggtcagcaggtgacatttgccgacttgcccgagtttttatcgctgctggctttgcagtttccatttgaaaatggcgcggttttaagaaacgaacggatttcgatgacgaaaacagagctgacggaagccttgctgaacaataaaaggggcggtttatgctatgatttgaacgcttttctttactatgtgctgacagagctcggcttttccgttcacatggtccgcggaacggtatttaatgcaaaagagcaggcgtgggcgctgacgggaacgcatgtcgccgtaattctgcgggaaggtgatgaaacctatctgctggacactggattcggcatcaacctgccgcttgcacccgttccgttctcaggtgaacctgtcccctcaaaaacaggagcttaccgtatcagggaaacaaagacggataaaggggattaccttcttgaaatggataagggagatgggtggcagatcggctatgcattttcgctgacgccaatcgatgaagctgtgcttacatgcgtgcgggatgcaattttcgatgagaaggcgtcgccttttaataaaaacccgctcgcttccaagctgataaaggacggaaagttaattttgacgaaggatcacttcacaaagcagacagggggcggtttgacgaaagaggatgtgaatgcaggagatttccaaaccattttcgttcattcattttttgactga

SEQ ID NO: 2231 - DNA, 690 bp, Bacillus licheniformis
atgcacatctttgccatcgggtttccaagctttctggcagaggccgggctcctcgtatttgttacaggatacaacttggcaatggcaagcctggcaggcacggaaggagtcgctgccttctcggtcattaactaccttcacgggttcatgttcctgtccttcttcggcattgaaatggcacttcagcccatgattagctattatcatggtgctgaagaaaccgaacaaatcaaaagcagcatgaagattggggagaagaccaccgtaatcctgggcatacttttgctcgttatcggctggggggctgccccattccttgtaggcttattcggaatagaatcaaccgaaatccagcagctggccatcgatggaatccgcctgttttttatcggctataccttccttggctataactttgtctatatgagttactttcaatctattggccgggccggctcatcggttgttatcattatattgcgaagcttcgtgtccctgttcatcctgctttggattttgccaaagctttattggcgtcacgggagtttggctatccttgccgctttccgagttttttgttgccgtcctcctctttttcattgcaagaaaacatgtgatgggaaaaagaaatcccgctatcgggaaaggatgattttacatcccggagaatttcaccgcttgttggcctaa

SEQ ID NO: 2232 - DNA, 726 bp, Bacillus licheniformis
cattgatgtgccggacgatatgacgcggctgacgctggacacgatcggcttatgcgggtttaactaccgctttaacagcttctaccgtgaagggcagcatccgtttattgagagcatggtccggggtttgagcgaagcgatgagacagacgaagcgcttcccgctgcaggataagctgatgattcaaacgaagcgccggtttaacagcgatgtcgagtcgatgttttctcttgttgaccggatcatcgctgaccggaagcaggccgagagtgaaagcggaaatgacctcttgtcgcttatgcttcatgcgaaagaccctgagaccggcgaaaaactggatgatgagaatatccgctatcaaattattacatttttgattgccggacacgagacgacgagcggtttattatcgtttgcaatctatctgctcctgaagcatccggataagcttaagaaagcgtatgaagaagcagaccgcgtgctgaccgatcccgtcccatcctacaaacaggttcagcagctgaaatacatccgaatgattttgaatgaatcgataaggctttggccgacggcaccggctttctctctttatgcaaaagaagaaacggttatcgggggaaaatatttgattccaaaaggacagagcgttacagtgctcatcccaaaactgcacagagatcaaagcgtctggggagaagatgccgaggcattccggcctgaacggtt

SEQ ID NO: 2233 - DNA, 603 bp, Bacillus licheniformis
ccccatgcttaccgcaccaaatgccataagcatcaaatataccgaaaaaacaggtgagatggactcctcatccgaagcgtgcggcgcgtcagatccacagtatgcatccggcgagtctccggtcacagatctgctggctaatatcaagaatcttctgaagcgatgtgccgagctcggcatgccggttattttcacggctcaacccggcgcccaaacaccgaaagaacgggggcttctccaatacttttggggacccggaatcggtcctgatcccgatgagcaaaaaatcgtggcgtgagctgaaaccgaatgaaggcgacattgttttgaccaagtggaggtacaataccttcaaaaaagccagccttttacgcgttctagaggagcatgggcgggatcagctcataatcaccagaatctatgccagtatcgagtgcctgaagacggcatgtgatgctttcgtgcaaagtattgaagcatttaggctcgaggatacggtggcggatttctcattaaaccatgatgaaagggccaagacatacgcagcaaagcgttgcagagtcaaaatacgctgcaaacagcttatgagccgactgaaagatg

SEQ ID NO: 2234 - DNA, 636 bp, Bacillus licheniformis
atgagtaaaggacgtttgatgatcatcaatatgattggtattatcgcaactttagcgcttgtcgctgtatgcggatattactattatcaaaataaacattatgtcacgacggatgaagcaagggtttccgcaaatatgacaaaaataacggcgcctgcttccggaaaattaagcggctgggatgcaaaagaaggcgaccatatatcagacggcgacaacctcggaaaaatatcggacgggcagcagtcggtagctgtcaaagccatttccgacggaacactggtcaaaaatacagccgtcaatcataaaatcgtaaatgcgggggttgtcatcggtcaaactgccgatatggataacatatatattacggctcatattaaagaaacggaattacgcgatatcgaaaaagacgacaaagtggacatcaaagtcgacggggaccctgatacaacgtttgaagggaaggtcgaagagatcggatatgcgacagattcggtattttcaatgtttccggaaatgaaccaaagcggagactatacgaaagtcaccgagaaagttcaagtcaagatttcgattcaaaatccgtccgccaaattgcttcccggcatgaatgcggaagtgaaaatttcgttatag

SEQ ID NO: 2235 - DNA, 858 bp, Bacillus licheniformis
ttgagctcaaatctgtttcaaaaacgattgacggaaaacaaatacttaaagacatctcctttaagctggaggaaggagagattttcggacttctcggaagaaacggctcaggaaaaacgacgcttcttcgcctgattcagcaaatcctgctgcctgatgagggagatatctttttcggcagcgtcaaggtgaaggatcatccgctcgtcaagcgcaacatcgtctatatgcccgttcaaaacacctatttcgaaaaatacaattacaaacagctcgtcaatattttgcgtaacatttatccggactttgatgttacatatgcaaatgaattaatgaaccgatacgatattcccgaaacaaaaaagtacagggaattgtctacaggattgaaaaagcaaatgtcgctgatcctgtcatttgcgatccggccggcggtcatcctgcttgatgagccgacagacggcattgatgccgtcacaagacaagacgttcttcagctgatggtcgatgaagtggctgaaaacaacacgacgattctcatcacatctcaccggcttgaggacattgaaagaatgtgcaaccgaatcggttttctcgaagacaatacattgtcgaacatcatggatcttgatgaactgaaaggcgattttattaaaattcaaatggcatttgaagaagatgtcaatttaaaaatcagggaaagggaaatccctgttttggaccacaccggcgtcttttatacggtattggttccgaaagaagacaatgtgagcaaacaatttcttaaaagtttgtctccgaaagtttggaacgagcttccggtcagtcttgaggaagtattcatcgcgaagtatggag

SEQ ID NO: 2236 - DNA, 657 bp, Bacillus licheniformis
ttagcgggtttcatataaaaatcgaaaaaaaccagatcgtcgcgatagcgggtccgaacggttcagggaagacgacgatcattaactccattttaggaatcatcacgcctaccgaaggaaccattctgttggatgacctgccgaacacgacggcggaattcaagcagaaattcgcctacgttcccgatgaactccttttgccggacgccctttcagccgcagaatatttggattttgtatcttctatgtatcattgtacatcaaatgaaaaacggaaacaattaatcgagcttttcgatatgaaagaggctttgcaggagccgattgaaacgtactcgcacggaatgaaaaaaaagacgcagctgatcgccgcttttatgctggagagcgaatttgtcattatggatgagccgtttcgcgggctcgatatagaagcggtcatcaatacgaaaaagctgatgaagcgctatgcggccacgcaagggtcgatactgctggccacccatgacatgctttctgcggaagaactgtgcgataagatagcaattctatcaaaaggcgtcaaaatggatgaaggaaaagtgaaagaattgaaggctaaatataacagcgattcacttgaagaagtattcttaaaagcttcgatgctgagtgata

SEQ ID NO: 2237 - DNA, 342 bp, Bacillus licheniformis
tgggaatcgagttgaaggagtgcagcaaagaacggtgtgttgccgtcatgcctgtcgatgaaagaacgcgtcagcctttcggctatctgcacggaggcgcgtccgttgcgctcgctgaaacggtggcaagcatcggggcatatcagcatatcgatccaaaagagcaggcatgcttcgggcttgagatcaacgccaaccatattaaatcggtaaaagacggaacggttaaagcggtcgctacgcctctgcatgtgggcaaatcaacaatggtgtttcaaattgacatacgcgatgagcaggacagcctgatttgcacgtccaggtgcacgatggcggtcatca

SEQ ID NO: 2238 - DNA, 252 bp, Bacillus licheniformis
tcatgcactgacaaaacagattattcgcgaacaggtggcatcgcttcttcttgaatcgccggaaaagataagcgacagcgaaaatttgatctaccggggaattgattccgtgagaatcatgagtctcgcagagcgctggcgccgagcggggcgggaggtgtcgtttgtagagcttgcggaggacccttcgattgaaaactggtggagactgttgtcctcctctaaagaagcacctttgccaaatgcagacta

SEQ ID NO: 2239 - DNA, 489 bp, Bacillus licheniformis
  misc_feature (1)...(489): n = A,T,C or G
atgctgcgctccaatatcggcgtcgttccgcaggaatcgtttttattttcctcaacgatcaggtcaaatatatcgtatggaaagcctgatgcatcgatggatgagattatcgaaagcgcgaaaagagcccaggctcacgattttatcatggagcttccgaatcaatatgatacgatgctcggcgagagggggctcgggctgtccggtggccaaaaacagcggattgcgattgcgagagcgatttgtatgaacccgggcattctcatcctggatgattcgacgagtgccgttgacatggaaacggagcaccgcattcaacttgcattgcgggaagtgatgcgggatcggacgactttcatcatcgctcacagaatctcatccttaaagcatgccgacgaaatccttgttctcgataaaggcgtanttcaaggaaagggggacacacgaacaattaatggaagcaaacggtttatacaaacggatttttga

SEQ ID NO: 2240 - DNA, 405 bp, Bacillus licheniformis
atctctattcccgtacgctttccctttcgatccgtggtcgctgatctcggccgcgctgctttcagtcggctactttctcttgagaaatgcgatccttccattgtttacaccgcttgaaagcgttctggaagcagcgaaaacttacgatgtttggatcgctctctttcctttggccgcaagtttcggactcgttttttacgggattttcacaggcgccaccgaaataggcccggtcagaaattcaatgtttttggctgttctcgtcttcctggccgccttttttaccgctgtccccgctttcggaaaccatgggctgtggctcgcttttcttttattcagccttgggcgttccgtattcttatgcatggctgttcccgggctgaccacccggcttttcggagagcg

SEQ ID NO: 2241 - DNA, 206 bp, Bacillus licheniformis
gatgaagcgcacgtggcaggccagatgcccgataaaaaggcgcctgcatcagggaagctcgcagattgggatttgaaagaaggatcaaaagtttcgaaggacgaaaaaacagcgaaaatcaaaggggaacaaacggttgacgtgaagtcgatcatggacggaacgattgtcaaaaacgaagcgaaggaaggccagatcgtacaagc

SEQ ID NO: 2242 - DNA, 215 bp, Bacillus licheniformis
atgagtcaaacaaaacagcagaaccccattcagaaagcgctgattaacggaaagaacagacaagacccgtatgatccgtttccgtggtataaaaaaatgcgcaccgaatcaccgattcactatgatgaagacagcaaagtgtggagtgtgttccgctatgacgatgtcaaaagagtgatcagcgacaaagactttttttcaaatcaattccctca

SEQ ID NO: 2243 - DNA, 297 bp, Bacillus licheniformis
gaaagggggctaaagtgtcagggggccaaaagcagagaattgccatcggcaggatgttttaaaaaaccggccgattctcatattggacgaagccacatcagcacttgacacagagacggagcaggtgattcaaaacgctttgacggagctcgcaaaagacaggacgacgctggtcattgcccacagacttgttacgatccgcaatgccgaccggatcgtggtcgtgacagagaatggaatcgcagaagaagggacacatgatgaactggttgagcgcggcggtattttcgcaaatct

SEQ ID NO: 2244 - DNA, 417 bp, Bacillus licheniformis
ggggtgatcggggcaagccaaggaggcgggctggccgtcgcggtttcggcgctgtccgatattccaaaagcagccgtgtcagaatacccttatttaagcaattttcaacgagcgatcgtatctcgatcgaccagccatatctcgaaatcaactcctttttcagaagaaacaccagtccggatattgagcaggcggccatgcataccctgtcttatttcgatgtcatgaaccttgcccaattggtcaaagcgaccgtactcatgtcgatcggactggttgacaccatcactccgccatccaccgtctttgcggcttacaatcacttggaaacggataaagaaataaaagtgtaccgttattttggacacgaatacatcccgccgttccaaaccgaaaagctggcgtttctgagaaagc

SEQ ID NO: 2245 - DNA, 354 bp, Bacillus licheniformis
atgatgaacttttgcaaaaaaccgctttcttcttcactaatgcgaacaacggcaaatttaaacagcggactgtcatacaaaggcaggggccggcgcgcctcagcttgtccccatttaagaacgccgtctgctcctccgctttctgaagcatcaaaatattcaatttggaaaggttcgtcttccgctatatactgcttcggctcatcctctccttcaaacatcagcctgaatcgcatcgtgtcattcgtacgaacaaacttgcgaatcgcttcagtcaataacccggaatcgattccggatgcagattttaattttccaaagccgctcaaatttgaaacacttgtaccgggatag

SEQ ID NO: 2246 - DNA, 353 bp, Bacillus licheniformis
  misc_feature (1)...(353): n = A,T,C or G
atggaattccaatccctaaaacttacgggccgctcggcaacctgcctttgcttgacaaaaacagggtctcccagtcactttggaaaatcgcggatgagatggggcctatctttcaatttaagtttgcggatgcgattgggggtttttgtgtccagccatgaactggttaaagaagtctctgaagaatcccgttttgacaaaaacatggggaaggngctattgaaagttcgcgagttcagcggagacgggctctttacaagctggacggaagaacccaattggcggaaagcccacaacatncttctgccgagcttcagccagaaagcgatgaaaggataccatcccatgatgca

SEQ ID NO: 2247 - DNA, 134 bp, Bacillus licheniformis
atgaaaaaaacagcacctcaaaacctctctttattcgcattgacttggcctatctttatcgaggtttcattatatatgttaatgggcaacgcagataccctgatgctcagccaatattccgacgacagcgtggc

SEQ ID NO: 2248 - DNA, 153 bp, Bacillus licheniformis
agaatcgcgcgagtaatatgaatcgtatccagaatatgtcgtaccgtaagtcgcagatatcacatttatgaaaatgccggaatcgataatgaagatctgatttcaaaagcccccttatcccggaatgacggatgacatcagggcaggaaagcg

SEQ ID NO: 2249 - DNA, 204 bp, Bacillus licheniformis
atggtaaaaatggcagcggcaggaggagaaccgatgaaatcatgctattcgtatcagaaaatacagcacatgctgcagcaatccggactgctcgtttacgagcatttatcaccttcagatattcaagggcgttattttaaaaatcgaaaagatgatctgtcagcctttgaaacgattcattacattcttgccgtaaaaaaataa

SEQ ID NO: 2250 - DNA, 856 bp, Bacillus licheniformis
ttgagcaagcagccgaagaaagtactgcctccccagcaccaaacacagcgtcccggattggagtatttgatggatccccggcccgttttcgaccggccgaaacgagagcgaaaactggctgggaaaaccgcgattattacgggaggagacagcggaatcggccgtgccgtgtccgttttgtttgcgaaggaaggcgcgaacgttgtcatcgtttacttaaatgaacaccgcgatgcagaagaaacaaaggggtatgtggaaaaagaaggcgtcggatgcaagctgattgcaggggacatcggggacgaggctttttgcaacgatgtggtgcgccgggcaaaggaagcattcccaacgatcgatattctcgtcaataatgcggctgaacagcatccgcaaaagggaatcgaaaaaatcacgagccatcagctgatccgaacgtttcagacgaatattttttccatgttttatttgacaaaagctgtgctgccgcatttgaaaaaaggcagctcaatcatcaatacgacctcgattacggcttatgccggcaatgaaaggctgatcgattattcttcgacgaaaggagcgattacatcatttacgcgttcgctcgctttgtcgcttgtcgatcagggcattcgtgtgaacggtgtggcaccggggccgatttggacgccgcttataccgtcgacgtttactgagagagaggtcgaaatattcggttcaacaacgccgatggaacggccgggacagcctgctgaagtggcgccgagctatctgtttctagccagcgacgattcttcctacatgacgggccaggtgctccatgtcaacggcggaacgattattaacggat

SEQ ID NO: 2251 - DNA, 774 bp, Bacillus licheniformis
gggaaaaagagcgttggtgaccggatcgacgtccggaatcggcaaagcgattgccgcttcacttgcgaaagaaggtgcgtctgtcatcattaacggacgccggcaagaaaaggtcaaccaaacaatagacgaattgaaaggccaatttcccgaggctgttcttcaagcggccccttatgaccttggcactgaaaaagggtgtcaaagcctattagcagcattcccggatgttgatattctggtcaataatttagggatctttgaaccggcggaatatttcgagataccggatgaggattggttccgctttttcgaagtgaatattatgagcggggtaaggctctcgcggaggtatttgcaaagcatgatcgagaaaaaagaaggccgggtcatttttattgcgagcgaagccgcggttatgccgtcacaggaaatggctcattacagcgcaacaaaaacgatgcagctttcgatttcccggagcctggcagagcttgcggcaggtacaaatgtgaccgtcaatacggttatgccgggctcaaccttaaccgaaggcgttgaaacgatgctgaagaccctctatccggatgaaaacctgacagtcgaagaagcggaaaagcggtttatgaaagaaaaccggccgacctctatcatacaaaggctgattcggccggaagaaatcgcgcactttgtcacatttttaagcagtccgctttcttcgccgatcaatggtgcagccttgcgtgcggacggcggattggtccgcagcgtctt

SEQ ID NO: 2252 - DNA, 717 bp, Bacillus licheniformis
atgcaatccttacaaaacaaaaccgctctgattacaggagggggaagaggaatcggccgcgccacagcgattgccctcgcaaaagaaggcgtacatatcggccttatcggccgtacagctgcgaatcttgaaaaagcggcagaggaattgaaggcgttcggtgtaaaagtatctgtagccgcagctgacgtaaaggatttaacagctgtagaacgtgcagtccaatccgtcaaagaagagcttggacaaatcgatattctcattaacaatgccgggatcggcgggtttgcaggatttcttgagcaatctcccgaagaatgggaaaatattatccaggttaatctgatgggggtttacaatgtaacacgcgccgttctgcctgaaatgattgaaagaaaagccggcgatatcattaatatttcttctacagccggccaaaggggagcagccggcacaagcgcctacagtgcgtctaagttcgctgtgctcgggctgaccgaatcgctgatgcaggaagtcagaaagcacaatatccgcgtgagcgcccttacaccaagcacggttgcgacggatttggcaatcgactcaaaattgacagacggcaatccggaacgcgtcatgcagcctgaagatctggcggaatacatggttgcccagctcaaactgcatccgcgcattttcattaaatcagccggcatgtggtctacaaatccttaa

SEQ ID NO: 2253 - DNA, 845 bp, Bacillus licheniformis
atgcttgaaatccatgaaaatttagcggggaaaactgcggtcatcacaggcggcagcggggtgctttgcggtgcgatggcgagagagctcggccggcagggtatgaatgttgccattcttaatcgaaccgttgaaaaaggggaactcgtggccgaagctgtccgaaaagccggcggcgcagcgattgcagttgagtgtgatgtcatcagccaacggagcgttgaacaggcgaaacgcgttgtggccgaccgattcggcggctgtgatctattggtgaacggagccggcggcaatcaccccaatggcacgacatcagatgaaacattcaactccgagcacatcttccaggacaacatcaagacgttatttgatctgaactgcgatgatgtcggttctgttctcaatttaaacttcctcggttctttcattccaacacagcaatttgcaaaaatgatgctgaatcaaaaaggggcgtccgtgatcaatatttcttcaatgagcgctcaaaccccgatgacgaaagtgcctgcatacagcgcggcgaaagcgggcatcgacaattttacgaaatggctggccgtctatctggccgaaacgggaatcagggtcaacgccattgccccgggatttttcctaaccaatcaaaatgaaaggcttcttcttgatcaaaacggcgaatttacagatagagcaaagaagatcatctctcacaccccgatgaggcgtttcggcaaaccggaagatttgctggggacgctgctttggctggcggatgagaagatgtccggatttgttaccggcataacagtgccggtagatggcggatttacggcttatgccggtgt

SEQ ID NO: 2254 - DNA, 813 bp, Bacillus licheniformis
taaggaggaatcaacccatgtatccaagtttagagggaaaaacggtcgttatcacaggggcgggtacaggccttggaaaagcgatggcactgcgcttcggtgctgaaaaagccaatgtagtgatcaattatttcaaggaagaagaaaatcctgaagagacggtggagaaaatagaaagcagcggagcgcgcgcgattgccgttcaaggagatgtctcaaaagaagatgatgtaaaagcgctgatcagacaggctgttgattcattcggttccgttgatgtgatggtgaacaacgcaggggtggaaaatgaagtaccttctgaggatttggctctagaggactggaaccgcgtcatatcaaccaatttgacggggatgtttctaggatgccgggaagcgatcggctatatgctcgaccataatattaaaggctcggtcatcaatatgtccagcgtccatcagcaaatcccgtggccgcattttgtccattatgcggcaagcaagggcggggcaaaactgctgacggaaacccttgcccttgaatatgccccgaaaggaatccgggtaaacgcgatcggccccggtgcaatcgatacgccgattaacgccgaaaaattcgctgatcccgaattgaaaaaaggcgttattgaattgattcctatagggtatatcggaaagccggaggaagtcgcagcctgcgcggcctggctagcatccgaagaagcaagctatgtgacgggcctgacgctgtatgtagacggcgggatgacaaaatacccgggattccaagcgggaaaagggtgaaaagaaggcg

SEQ ID NO: 2255 - DNA, 597 bp, Bacillus licheniformis
gttgcaagttgttaagggtgatgtcacaaggaaagaagacttgctccggatggtgaatgccgctcttgagcgatttggaaaaattgattttctgatcaataatgccggcccatacatatttgaacgaaaaaagcttgcggattatactgatgatgaatggtatgacatgcttgaaggcaacttaagctctgtcttccatctgtttaaagcggttgttccgatcatgaggcgccagcggttcggccgaatcatcacttacggatttcagggggccgaccatgcgcctggctggctgcatcgttccgcttttggagcggcaaaagtagggctggcttctttaacaaagacgatcgccattgaagaagcgggctccggcatcacagccaacatggtctgtccaggcaacattgtcggggatatgaaagaggcctcgatttcagaagcgagggcgtcacttgatgaggaaacgccgatcggcaggtcgggaaccggtgaagacatcgcaaggatcatcacttttctatgcgatgaacattccgactacattacgggaacagtcattgaagccacaggcggcttgaatgtgattaaccgtca

SEQ ID NO: 2256 - DNA, 765 bp, Bacillus licheniformis
tgaaaggcaaggttgctttggtgactggggcttcgcaaggaatcggcaaagaagtggccctggcgcttgctggacgcggggtgtttgttgcagcggctgatcaaaatcgaaaagggctgcttgaacttgaagacgaacttgaacaaaaaggactgcagggttcaggttttgccgcggatgtgggcgacagtgccgcagttgaccagcttatcgccgatattgaacgcgagatcggtccgatagacatgcttgtcaatgtagccggcgtgctcagaacgggtctgatccattcgttgagtgatgaagattgggagaagacgttcaatgtcaactccaccggggtttttaacgtatcgcgtgccgtcgcccgccggatggtaccgcgcaggactggagcgatcgtgactgtcggatcaaatgcggcagctgtgccgcggatgcacatggccgcctacgcggcctccaaggcggccgctttaatgtttacgaaatgcctcggccttgaacttgccgagtacaatatccgctgcaatatcatatcgcccggatcaacggataccccgatgcagcggtcgctatggcagtgtgaggaagctgcgcaaggcgtcattgaaggatcacttgaaacattcaaaacgggaatcccgctcggaaaattggcttcgccggctgacattgcagatgctgtagtatttttgctgtctgacggggctcgtcatattacgatgcacgatttgcgcgtcgatggcggagcaacgcttggag

SEQ ID NO: 2257 - DNA, 730 bp, Bacillus licheniformis
atgcatttatccattgttaccggagcgtcaaaagggcttggcgccgcgatggccgaagggcttttgcaaaaaggccatattgttcatgctgtttcaaggaccaagtctgatatcagtcatgacaggctgatccagcatgaggccgatctggcgcagctcgccgaaacagaaaagtggtttcggcaattctcagattctgtccaagcccatgattttgcttcgatcaccttgatcaataatgcgggaatggtgacgccgatcaagcgcgccggcgaagctgaaccggaagaactgaggctgcattatgacttgaatttgttagcgccggtgatgctcagccagctgtttaccaaatggctcaagccatataaaggcaaaaaatcgattgtcaatatatcatcaggcgcggccaaaaacccttataaaggatggagtgcctactgcagctcaaaagcggggctcgatatgttcacgaaaacattcggctttgaacaggaagatgagtctgatccggtgaagatgatttctttctcccccgggatcatggataccggcatgcaagaggttatccgttcatcatcgaaaaaagattttcatgaaattgaacgattcaaaacctatcaaacagaaggaaagctgagaagcacctcttatgtggccggcattctgctcgacctgcttgagaccgactttgaaaacggcagagtgtatgatattaaagagtttttgt

SEQ ID NO: 2258 - DNA, 756 bp, Bacillus licheniformis
atgatctataaaggattttccagtatttatgacaagctgatgtctcatgctccttacgatcagtgggtcagctggattgaacaaacgatcggcgcgcagcagaaagaacgtatacgggtgcttgatctggcgtgcggaacgggtgaaatatctgtccgcctggctgaaaaaggctatgatgtcacaggaatcgatatcagcgaagacatgcttgcccaggcccagtacaaagcagccgtcaggcagctcgatattcagttctttcagcaggatatgcgcgaacttgccgggcacggacaagagtttgacgcggttgcgatctgctgtgactcgctgaattatctaaagagcgaaaaagacgttttcaatacttttaaaaacgttttttctctattaaaagagggcggtcttcttctgtttgatgttcattccgtttacaaaatggatgtcatttttccgggaagtacgtatgccgatcaggatgaagaagtgagcgtcatctggcaaagctatgcgggggaagagcctcattcagctgttcacgatttgaccttctttgtacaaaatagagacgtatacgaaaggtttgatgaatcgcatgaacagcggactttccagacggaaaagtacatcagtttattgcggcaagccggatttgaggtgcagtgcatcagtgctgatttttcaaaattggagcctagcgcagagtcggaacgtcatttttatacagcaaaaaaaacaaaaaccatcgtttaa

SEQ ID NO: 2259 - DNA, 762 bp, Bacillus licheniformis
aaaagtggcattgatatgcggcggcggccaaagtctcggagaagcgctgtcctaccggatggcagaggcgggatatgacatcgcggtcgcagacatcaacggcgagaacgccgaaaggacggcagatcatgcagccggtcaatacggggtcaaatcgctgtggattcaagcggattttacaaaggaagccgatgtgaaaaaaatgatcggcagggtcacggacgaattcaataaaatcgatgtgatggtgtacagtgcgggaatcgccaaaagcaataaaatcacggattttgaacttgaagactgggaacggaccatcgaggtcaatttgaccgggtattttctttgcgcgagggaaacgtcaaaggtcatgattgagcagggaagcgggtcaatcattcaaatcaattccaaatcgggaaaagtcggcagcaagcataatacagcttattcagcttctaaatttggaggggtcggtctcacgcaaagcctcgcgcttgatcttgccgaacacaacattcgggtgaacagcattatgccgggaaacttgttaaaatcgccgatgttccaaagcttgatcccgcaatacgcgaaaaagctcggcattccagagagcgaagtagagcgcgtgtacaccgaaaaagtgcctctaggacggggctgtacgtatgatgacatcgccaatgccatcttattttacgcctctgaccaagcatcttatatgacgggtcaatcgatcaatgtaaccggggggcaggtcat

SEQ ID NO: 2260 - DNA, 735 bp, Bacillus licheniformis
gtcaaggtattggagaagcaatctgcaaacgattggcagaggacggattcgcagttgcagttgccgattataatgtagaaactgcaacacaagttgctgaggacatcaataagcttaacggcaaagcaattgcggttaaagtggatgttgctgatcgcgatgatgtttttaaagctgtcgatgaaacagtaaaacgtcttggcggtcttgatgtggtgattaataatgcgggtcttggaccaaccacccctattgaaagcattacatatgaagattaccggaaagtctatgatgttaacgttggcggtacttattggggaatacaggggggtgtaaaagcctttaaagaacttggacacggcgggaaaatcattaatgcatcctctcaagccggccaagtcggcaacccgggcttagcggtttacggaggaacaaagttcgctgttcgcgggattacccaaactgcggcaaaagatctagctgaattaggtattactgtaaacgccttttgtccgggtatcgttaaaactcctatgatgatggggattgcacagcaaaccgctgatgaagcaggcaagccgtttgaatggggcatggaacaattcgctaaaaatattgcattaaaacgcttatccgagccggaagatgtagcagcatgcgtttcttaccttgcagggccagattcagattatatgactggtcaagctcttatcattgatggcggaatggtattta

SEQ ID NO: 2261 - DNA, 822 bp, Bacillus licheniformis
aaaaacaagaaaaacaacccggtgctgagcacaagatggtgccccttccgctctcggaagaccgcgactacaaaggaagcggcaaattaaaaggaaaaacagcgattattaccggaggagacagcggaatcggcagagcggccgccattgcatacgccaaagaaggtgccgacattgccgtcatgtacttggatgaacacaaggatgccgaggaaacgaaagagcgaatcgaacaggaaggagcagaatgcctcttgattcccggagatgtcggtgatgaggcgcattgcaaatcatctgtcgaaaaaacggtgaatcactttggcgggcttgacattctcgtgaacaatgctgcagaacagcatccgcaaaaagggatagaagatatttcgaccgaacagcttgaaagaacgtttagaacgaatattttctccatgttccatatgacaaaagccgcgctcccgcatttaggggaaggcagcgcgatcatcaataccgcatcgatcacggcgtatgaaggcagtccggcgctgattgactattcgagcacaaagggcgcgattgtcgcgtttacccgttcgatggctgcatcccttgtcaaaaaaggaatacgcgtcaacgctgtagcgccgggtcccatttggacgccgcttattccggctacttttccgccggaaaaaacggaaaaacacggcacagatacgccgatgggaaggcccggacagccttctgaacacgctgcagtgtatgttctgctcgcttcagacgactcctcttatatgacaggacagacgatccacatcaacggcggaagatatgtga

SEQ ID NO: 2262 - DNA, 583 bp, Bacillus licheniformis
atgaagctcaagaaaatcctcccgtatgcgaaagaactgctgaaaacagccgcaggcgaaggagacatcgtcattgatgcgacaatgggaaacggacatgatactcactttttagctgaacttgtcggtgaaagcgggcatgtctatgcctttgacattcaagaagcagctcttatgaatactgccgaaagacttggaaacgagtataaagaccgggtgacattgattcaaaaaagccatgatgagctcaccacttcgcttcctgacgacatctcaggcaaggtggcagcagccgtgtttaacctcggatatcttccgggaggcgacaaatcggtgacgacaaaaagcgattcgaccatcgccagcatcaagcagcttctcaaaatcctgaaaaatgaggggctgatcgtgcttgtcgtctaccatggccatcccgaaggaaagcgggaaaaagacgccctgctcgaattttgtgcatcgctcgaccaggatacggcccgtgtcctctgttaccaatatttaaaccagcgaaacgatccgccgtttatcattgcgatcgaaaagaaagaagcggtccaaaagt

SEQ ID NO: 2263 - DNA, 637 bp, Bacillus licheniformis
atgggaagagagttcattcctttatttgagaactgggcaaattcttatgatgatacagtagttggccgcgatcttcaatacaaagaagtgtttcgcgactacgacggcattttggatgatgtcgtcagccgctcggggcataaagttcttgaattcggcgtcggcacaggcaatctgactgcaaaattgctggcggccggaaaggcagtcaccggtgtagagccttcaaaagcgatgagggaaattgccgaggcaaagctgccggagaatgcagtgatcgttgacggagactttattgactttccggaccctccgttttctcccgacacgattgtcagttcttatgcgtttcaccatctgacaaacgaagagaagcgggaagctgtgaagcgatatggaaaaatgctcgggaagcatggtaaaatagtgtttgctgataccgtcttcaagaatcgggaagccttctctgccgctgttaaaaaagcgaaggaaaacgggtttctgcaattggcggaagaccttgaaacggaacattatccgacgatttcggagatggaaacgatctttacctcagaacatttcagtatcgcctttcaaaagcataatgattttgtctgggtaatggaagcggcaaaat

SEQ ID NO: 2264 - DNA, 604 bp, Bacillus licheniformis
atggaacaaagaaaatgtgcccttattacaggaagcagccgcggcgtcggcaaagcagcagcgctgaggtttgccgaaaacggctacaatatcgtcatcaactatgctagaagcaaaaaagcggcccttgagacggctgaagaaatcgaaaagctcggtgtcaaagcattggtcgtcaaggcgaatgtcggacagccggcgaaaataaaagatatgtttcagcaaatcgaggaggcgttcggcagactggacgtgttcgtcaacaatgctgcatccggcgtattgcgccctgtcatggagcttgaggaaagccattgggactggacgatgaacatcaatgcgaaagctctgctattctgcgcgcaggaagcggcaaagctgatggagaaaacgggaggcggccacattgtcagcatcagctcgcttcgttcaatccgttatttggaaaacatacgacagtaggcgtttcaaagctgcgcttgatcattgacgagaatcttgccgtagagcttgcgcagaaacatcatcgtaatggcgggtttcggaaggcgcgattgatacagacgccctgaaagcatttccgaccgcgaaaagcttctggaaa

SEQ ID NO: 2265 - DNA, 834 bp, Bacillus licheniformis
gccggcgcagacgcaagaccgccagcccggcatcgaaagcgtcatgaatccgcgtccgatctatgaggatgaaaattacaaaggaacggataaactgaaaggaaaggtcgcgctgatcacaggaggcgacagcggaatcggcagagctgttgccgttgcctatgctaaagaaggcgcggacatctcgatcgtctacttgaatgaacacgaagacgctcaggagacgaaagcgcgcgttgaaaaagagggcgtcaaatgcctgctgcttcccggcgatgtcagggatgaagctttctgcaatgacgcggttgagcagacggtgaaggagctgggccgtcttgatattcttgtcaataatgcggccgaacagcatcctaaagacagcattaaagagatttccagtgaacagctcgagaaaacatttaaaacaaatttcttctcttatttctactttacaaaaaaagcgattgattatctggagccgggcagcgcgatcatcaatacaacatcgatcaacccttaccggggcaatccgcagctgattgactacacggcaacaaaaggggcgatcaatgcgtttacacggtcgatgtcacaggcgctcgtcaaagacggcatccgtgtcaatgccgttgcaccgggaccgatttggacgccgctgatcccgtcaacgttttcaggggaggaagtggcgaagttcggtacagatacaccgatgggccgtccaggtcagccggtcgaccatgtgggctgctatgtgcttttagcatctgacgattcttcgtatatgacagggcagaccctccacgtcaacggcggagactttatcacgac

SEQ ID NO: 2266 - DNA, 704 bp, Bacillus licheniformis
ttgagcgattatttagacatgctcgccagcttcggcgtctcatccgctcatcccggcgggatgtccctgtcaaaggcagtgctcgccaaagccggcatcgaccctgagcagccgattcttgatgcaggctgcggaaccggccagaccgccgcttatttgggtcagcttctgtttcctgtcactgcccttgatgccgacccggtcatgatcgataaagcccgacagcgttttaaaaaagaacagctttccattccggctgtccgctctccacttgaggaaatgccgtttcagtctgaaagctttgcctgtgtattaactgaatctgtgctgagcttcacaaatatccggtctgctttacaggaaatccggcggattttaaaacccggagggatgctggtcgcgatcgaagtctgccttaaggaaggaaacgcactgacagacgaagcaaaaaaagaaatcacggaattttacggattcaccgcattatatgacgaggatgagtgggtcaatgtccttcgagaagaaggattttcaaagattgacatcattcctgtcgtattggaagatgcaggagacccggatgacgccgttgaaatggatctgtcgcctgcaatttccgacaaagactatgaaacgatggaaaaacacctgcattacctggaaaaataccgggactctctcgatcatattatttttatatcaca

SEQ ID NO: 2267 - DNA, 795 bp, Bacillus licheniformis
atggatatgggattaaaaaataaaacagctttagttaccggatcgacgaaaggtataggaaaagccatcgctattgaacttgccaaagaaggtgttcatgtactcattaacggacgaaatgaggaagaggcagaacgaacagtcaatgaaataaaatcagcttttcctgacacctttccccaaaacgccgcggctgatattgtggatattaggcaaagggaagctttatttaaaaaacaccctcaaatcgatattttagtaaacaatatgggcatttatgaactgatgcaatatgaggacgttgacgatgaagtatgggaaaaatacttccgcaccaatgtgctggctgcaaacggtttatctaaattttatttgcctaaaatgctgaaaagtgattttggccgcatcatctttatcgcaagtgaagaagcgatgatgccttcaggccagatgcctcagtattgtatgacaaaatcaatgctattatcattgtcaaaaagcttatcaaaattaacaatcggaacagaagtgacagtcaatacgatcatgccggggccgacgctctctgagaatgtgaagcaaatcattgagggaatgtaccccgatgaagggatgactttttcagaaaaagagaagaaatttatgacgacaaacctgcctcaatccgaaatacagcgatttatcaagcctattgaaatcggcagactggctgcatttgtatgcagtccctatgcatccgcatttaaagggtccccgatccgtatggacgggggaatggtgccgactattttttaa

SEQ ID NO: 2268 - DNA, 534 bp, Bacillus licheniformis
acacgaagaattgaccggctatcttgaaaagctgctaaagccgcggccggctgaaattatgaaactggaggcctatgccgaagagcatggcgtgcccattatggaaccgacaggaatcgaagtgctcctgcagcttctttcattcaaaaatccgaaaaaaattcttgaaatcggtaccgccatcggctattcggcgattcggatggcgcttgcccttcccgaagccgagatttttacaatcgagcgcgatgaggacaggtatcgggaagcgctgaaaaacatccggtcattccagcttgaaaacagaattcacgtgttcttcggcgatgcgctcagcgagtctgaccccgttcaatcgatggctccctatgatgcgctgtttatcgatgccgcaaaaggccagtatcagaagtttttcagtatatatgaaaaaatgcttgccgatgacggcatcatttttacggacaatgtccttttcaaaggccttgtcgcatcagaatacaatcagatcgaaagcaagcgcatcaaaaagct

SEQ ID NO: 2269 - DNA, 732 bp, Bacillus licheniformis
agaaactgtcgtcattacaggcggggcaaaaggcattggaagagacctcgtggccgcctatgctcaaaaaggttttatcgtcgtattcgccgacgtattgaaggaagagggtgaacagcttgaaaaagagctgaccgcttccggtgcgcgggtccaatttgcaccttgtgatgtagcttctgaagaagacgtgaaacggctgatgcaggaagcttcccgaaacggccgttcgatatcggcgctcatcaataatgcgggccgatcagtttggaagtccccttacgacttgacggctgaagaatgggacggcgtcctgaatacgaatttgaaaggcgcgtttctttgcgcaagagaagcggccaaaagaatgaaagaggcgaaaacaggcggtgccatcgtcaatatcgcttcgacaagggcatttatgtccgaaccggactcagaagcctatgccgcgtcaaaagggggcttaatagctttgactcacgcattggccgcgtctttaagcaaagattcaatcgtggtcaacagcatttccccgggctggattgaaaccggtgattatactgccctgcggcctattgaccacgcgcagcatttgtcaaacagggtcggccgcccacaggatatcgtcaaagcatgcttttatttgaccgatccggacaatcgcttcgtcaccggtacaaacataacggtggacggcggaatgacaaaaaaaatgatttatgaaga

SEQ ID NO: 2270 - DNA, 693 bp, Bacillus licheniformis
ctccttccgttaagatttatttgaagccagaagaatgttagcagccgccggcttttttgaaccgatgagaggcgcgttgacagaccgtcttaaacaagccggcctgccgttttgcaattttgtcaggatcctcgatgccggctgcggggaaggttcgcatttgacgcgaatcgctgaaacgctagaagcgcgtttcggaacgcctgtccttggagtcgggctggatttggcgaaagccgggattgtatcggcggctaagcaagaaagagaggcgatctggtgtgtcgccgatctggctgccgcaccgtttcggaatcgttcattcgacgcgatcctcaatatattgtcgccttctaattacgcggaattcgagcggctgttatcggatgacggcatcgttttgaaagtgattccgagaagcggccatctgaaagaactgaggagatttttgtacgacggctcggacaaacaagcctatacgagcgaggatacggctgagcgcttcgcgtctcattttgatctgatcgacagaacggagatcgcctacagcaaacgtttagaccgaatccagctcccgccgctcatcaagatgacgcctttatcatggcgcgcgcaaaaggagcggatcaatgcctttctaaagaaggaatccgctgttatgaccgtccatctcgatattttagccggcaggaa

SEQ ID NO: 2271 - DNA, 741 bp, Bacillus licheniformis
atggaaatgaaaaataaaacagcccttgtcacaggaggcggcacagggatcggcagagcggtatcgctctctttggcaaaccgaggggcagcggttgttgtcaactattcgcgttccaaagcggaggctgaagagacggttggaatgattgaaagtcaaggcggccgcgcgctcgcggtgaaagccgatgtttctaagatcagtgaagttcaagacatgtttgatcgggcggtgggcgagttcggtaccgtcgatctgctcgtcaacaatgcaagcatcaccaggcatatcgagcttgatgacttggaaggggcttctgaagaagtctgggatgaactgtatgcggtaaatgtcaaagggatgtttaattgtgcgagagcggcggcaccttttatgaagcgaaataaacaaggcgccatcgtaaatgtcggcagcatcgccgggcttaccggttcaggctcttcgttaccctatgccgtatcaaaagcggcggtccacggtctgacgaaatcattggcgcatgcgcttgctcctgatattagagtcagctgtgtggcaccgggcgcggtatcaacgagatggtgggaggggaatgaagagaaaatgaagcggctcagccaaaagctcccgcttgagcggatagcggaaccggaagatatcgccttgctcatttgtgcgctgctcgaacaagaaacagttacaggccaaatcttaacggctgactgcggtcaaacattatag

SEQ ID NO: 2272 - DNA, 741 bp, Bacillus licheniformis
tggacagaaaagttgtaatcgtgaccggcgggtcgagcggaatgggaaaagcgatcgccaaaaagcaggctgaagaaggatggaatgtgatgattacgggcagaacacaagaaacgctcgaagcggccaaagaagaaattgaaacttttgccgggcaggtggccgtatgccggatggatgtccggtctgttgaagatgtggaacagatgatcacagaggcggcaggacggtttggcacgatcgacgctttggttaacaatgccgcaggcaactttatctgcccggctgaaaaactatcggtcaacggctggaaggcggtcatcgatatcgtgctgaacggcacattttattgcagccaagcagccggccgctactggatcaaggaaaagaaacgcggccagattttaaatatggtcgcgacgtatgcatggggcgccggtgccggtgtcgttcactccgcggcggcaaaagcaggcgttctgtcgctgacaaggacgcttgccgtcgagtggggaagtgcatacgggattaggtgcaacgccattgcgcccggtccgatcgagaggacgggcggagccgaaaaattatttgaatcggaagaagccgcgcacgcgacaatcaaaagcgttccgctcaaaaggctgggcacccctgaagaaatcgcgggactcgccgcatttttgctttctgagcaggcgggatatgtcaacggggagtgtgtgacgatggacggaggtcaat

SEQ ID NO: 2273 - DNA, 546 bp, Bacillus licheniformis
ggagcttgatgtcctcgtcaataatatgggcttctttgaagtgaaggattttacagacgtgacagacgaagagtggctcaaatattttgaagtaaatgttttaagcgccgttaggctttgccgcgcgtttttgccggccatgctgaagcggaataagggaagggttctcaatttggcaagcgaggccggcattaaaccgcttccgcagatgatcccttattccatgacaaaaaccgctttgatcagtttgtcaagaggtttggccgaaatgacaaaagggacaaatgtgaccgtcaactctgttcttccgggacctacctggacggaaggcgtcgccaattatatggaaggtgccgccgctcaggagaaaaccgatttagacacctttgtcaaagattatttcaaagtgaatgagccgacttctttgattcagcgctatgcaaaaccggaagaagtggcgagtacgatcgtctacctcgcttccgaaaaagctgcggctatcaacggttcagctcaaagagtggagggcggaatcatccgctcgat

SEQ ID NO: 2274 - DNA, 366 bp, Bacillus licheniformis
gttaacactctcatccatgaacgcctatacgccgctgacgaaaattcccgcctacagcggtgcaaaagcggccgtcagtaactttacacaatggcttgctgtgcatatgtcaaaagtcggaattcgtgtcaatgccattgccccaggcttttttcttaccgcccaaaataggagcctattgctcaatgaagacggaacatatacggagcgagcacaaaaaattatcaaccagacgccgttggatagatttggggttccggaagatctaatcggaacgttattatggttggtaagcgataaagcctcgcgatttgtcactggaaccatcataccggtcgatggaggattctccgcctattctggagt

SEQ ID NO: 2275 - DNA, 795 bp, Bacillus licheniformis
gggagtgatcattgtggacttaaagatgaatggcaaaacagcgcttgtggctgcaagcagcaaaggacttggcaatgcgatcgccaaagccattgcgaaagaaggggcaaatgtcatgctgtccgggagacacgaagcggacttgaaaaaagccgcggaagagctgaacggactcggcggcggcaccgtctcttatcaagtatgcgatcttgcagacgccgacgggatcaaagcgctcgttcaaaagaccgctgacacatttggaacgatcgatatgcttgtcaacaatgtcggaggaccgaagggcggcagcctgcttgatctgacagacgatgactggacctcatcatttgaattgcatctgctcagctatgtccgtttaatccgcgaagcttttccatatctcaaaaaggatgggggacgcatcgttaatatcgcttcatcatcagtcaaacagccgattccgggcttgctgctttccaacacgtttcgaatgggaatcgtcggtctgacaaaatcgattgccgaagagttggccgaacaccgcattttgatcaacacgctcgcccccggaagaatcgcgacggaccgcgtggcagagcttgatcggctgaaagccgagaaaacaggcctttccgagcagcaggtgaaagaaagctatgagaaagaaattccgctcggctcctacggaaaacctgacgactttgcacagtatgcaagctttcttttatcagagtgcaatacatatatgactggacaaacgctgctgatcgacggcggaatggtaaaagcaat

SEQ ID NO: 2276 - DNA, 314 bp, Bacillus licheniformis
atgattcaattaaaagatgatgaacgactggattatttactggcggaagatatgaaaatcgtgcaaagcccgacagtttttgcattttccttagatgctgttctgctgtcgaaatttgcttacgttccgatacaaaaaggaaacatcattgatttgtgcacagggaacgggattgttccgctgcttctcagcacccgcacaaaagccgccatcaccggggtggaaattcaggaaaggctgtatgacatggccctccgcagcgtggaatacaacaacctgcaaaaacagattcatcttatcagggacgacctgaa

SEQ ID NO: 2277 - DNA, 480 bp, Bacillus licheniformis
taacagcggacaaagcttccgggggcttggtgacagataatgaccgatgaagctgttacaggaacatgggtgcagctccatgtctcaagcccgtttctattaacgagggatctgcttccggcgatgatcaggaaaaagtccggcgctattgtaacccgtcagctctatttggggtgagacaggggcgtcgtgcgaagttttatacagcatgacaaaaggcgcgcaaaatgtgtttgtcaaagcccttgcaaaagagcttgcgccgagcggcatcagagtcaacgctgtttctccgggcgctgtaaaaacaaagatgatgagctcattttcaaaagaggaagaagagatgatcgccgatgagattccgatgggaaggctcgccgaagccgaagaggttgcagacgccgtcttgtttctgctctcggcgaaagcatcttatatcacgggtcaaattttgtcagttaatggcggctggcattg

SEQ ID NO: 2278 - DNA, 741 bp, Bacillus licheniformis
tggaaaagccggtgcaaccgtgtatattacaggccgcagcatcagaggggcttccacgaatcaatggcccggtacaattgatgacaccgtgtcacaaattgaagcttccggcggaaaggctattgctgtaagatgtgatcatacgaacgatgcagaaacagaggctgtcatcgctaaaattcgcgaagagcaaggaaaactggatattttgatcaacaatgtgtggggggcgcacgatctgggtgtcgaggcaaagcctttttgggaattgtcattgaaaaattgggatacgatgttcgccgccggggtgcgtgcccagctggcgacaaaccacttcgccgtgccgctccttcgcgaaaataaacaagctcttatcattcacacgaccttctgggatgagaacaagtacaccggacagttttattacgatttggccaagaacgcaatcgtccgcatggcgtacggtctttcattggaattaaaacgggacaacattgccgttattgccgtttcgccgggatttatgagaaccgaacttgtgctgaaataccatgaatcagatgaggcgcattggcgggagtcggaagatttaaggagaaccgaaacgccttattatgtcggacgcggaatcacagcattggctaaggatccggatgtgatggagaaaagcggacgtgcgttaagagttggtgatttagccaaagaatatcagtttaccgatgtggatggacgatatattcc

SEQ ID NO: 2279 - DNA, 765 bp, Bacillus licheniformis
atgggatatcttgaatcgtatttttcacttgaaggcaaaacggcgcttgtcacaggcccgggaacgggaatcggcaaagggattgccgaagcgctggcaaaagcgggagcggatatcatcggcacttcgcatacgagcggacttgatgaaacaaagcggctgatcgaagaagccggcagaacgtttacttcttatcagcttgatatgggcaaccttgacgaggtcgaggcttttgcaaaagaggtgcctgaccgccatcaaattgatattctcgttaacaacgccgggacgatccgcagagaaaaagcggctgatttttcccgggagaactgggaagcggtgatcaatgtcaatttgaacagcttatttttgctgacgcaggctatcggccggcagatgattgagcgaaagcaagggaaaatcatcaatattgcctctcttctttcatttcaaggaggcattcttgtccctgcatatacggcaagcaaacatgcagtagccggattgacgaagtcttttgccaatgaatgggcggcttataatgtccaggtcaatgcgattgctccgggctatatcgcgacgaacaatacaaagcagatccgcgacgatcaaaaccgcaatgccgaaatcttaaaacggattccggccgagcgctggggtcagccggatgacattgccggcgccgccgtattcctttcgtcgccggcatccgattatgtgaatggacatgtgttagccgtcgatggcggatggctggcaaggtaa

SEQ ID NO: 2280 - DNA, 680 bp, Bacillus licheniformis
atggaatttaatcagcaaacggccattatcacaggtgcaagccgcggcatcggcagagccattgcggagttgcttgcggataaaggggcaaatgtcgttatcaatgggacaaacgaagaattgctcaagtccctgtgtacacaattgaatactgagagaaagtgcgcttcttatgttgccggtgatgcaagtttgccagaaacagcctcgcttctcatcgctgaggcaaaacagcggtttgggcggatcgatattttggtcaacaatgccggcgttaatttgcgcaaaacgaccgttgatacgtcgcttgaagaatggaaaagagtgatagatttgaatttaaccggcacctttctcatgtgtcaggctgtcatcccggaaatgatcacgcagggcggcggaaaaatcgtgaacatgagctctacgacgagcaaaacaccgcatcacaatgcctctcctgcttacggtgcatcgaaagcaggcatcaactatttaacgatgcatttggcaaaggagcttgctgaacaccgcattcatgtcaacggcgtctgcccgggaccgattgaaacggatatgagcaagcagtggagcgaggagtaccgcgcagcagtcgtcgaacggattccgctgaaaatgctcggctcaccagagcatgtcgcaaacgttgtcgcctttcttgc

SEQ ID NO: 2281 - DNA, 495 bp, Bacillus licheniformis
acttgaaagataaggtggctgtagtgacaggtggaagcggcatcttatgcagcggtttcgctaaagcattagctcaatgcggtgcaaaagtagcagtagtcagccgaagagctgaatcggcagacagagtagcgagagatatccaagaaaacggaggcgaagcacttgccgttacagcaaacgtccttgataaacaaagccttgaacaagcgaaacaactcattaacagaacattcggcagatgcaatatcctcattaacggagcaggcggcaatcatccaatgggaacaacagataaagaatatttatataaaaaagacttgaatactaaagaattgactacgttttttgatttagaaatagagggtgtaaggtctgtattggatttaaactttcttggtacactgttaaccactcaagtatttgcaaaagacatggctgatcacgacggaaatgtgatcgttacatctcatccatgaacgcctatacgccgct

SEQ ID NO: 2282 - DNA, 597 bp, Bacillus licheniformis
atggaaaataacgtttttgaacagatcgcaaagcgatatgatacagaagaaagaattgaattagctaaagtgatcgtgaatgaagtaagaccggaattgcgaaacagtcaatcaaaatctttaattgactatgggagcggtacgggtctcattagtttagaattatcagatttagtacattctattttgctggtcgattcatccaaacaaatgctggaggtggcgaaagctaaaatttctcgcaaaggaatcgccaacgcaaagacgctttattcagatttcacccaagaaactcctgaactgaaggcagacatcgttttaatgtcactagtccttcttcatattccggatacaaataaaattttacaagaactgttcggcattttaaatgatggcggcaagctcataattattgattttgacaaaaatgacaaaatacaacatccgaaagttcacaacggtttttcgcacgaagaattgaaaaaaagattatccgatgttggatttaaatcaactgaaatgaagacattttttcacggccggcgtatttttatgaatcaagatgcttcaatgtttatatccagcagcataaagtga

SEQ ID NO: 2283 - DNA, 699 bp, Bacillus licheniformis
tatagccaagtcgggttcagaacggttggaaaagaaaacaagcaatgtggttttccaatattcccagcgattccgaaggcgcacggtaagccgttcccaatatccaacagcggtcgataaccgccctttcgatagaagctgacggtcttccgaagaggacgtgaaaaagttgatttattcagcagttgaacactttggttcacttgatgttatggtcaataattcaggatttaacggcgcgggcgcctttccgcacgaacttgagcttgatgagtggcagaaagtgatcgacgttaatttaaccggtgcgtttctctgcgcacgcgaagccttaaaatatatggcggaccgccgcatgaaaggaagcatactcaatatatccagcgttcatcagcaaattccgagaccgaaaaatgttcactactccgcttcaaaaggcggaatgaagctgttaacagaaacgcttgccctagactatgcggacaaaggaatccgcgtcaatgcgattgcgccgggaacgattgcgaccgaaagcaatgaagacttggagggaagccgcaagtcggaacagctgaaaaagatacccatgaacgaatttggcgagcctgaacaagtggcttccgcagcggcatggcttgtgtcgcaagaagccgcctatgtaacgggcgcgactttattcgttgacggcggcatgacgct

SEQ ID NO: 2284 - DNA, 534 bp, Bacillus licheniformis
atggaaaacgggaatcatgatataaacgaatggaccatcaacttgatggatatctgtccgcatgagcgcatccttgaaatcggaacgggaagcggagcggcactttatcggattgcggagatgcttgagggcggcaaggcctgcggcatagacgcatcaaaaagcatggtcaagcagggaatgcggcgaatccgtcatgtgaaagaagaaggaaaagccgaattaaagcttggccatgccgaacaaattccttatccggatcgttcttttcataaagtattttcagtccacaccatttatttttggacggatttcaaacaggcattaaaagaaatttaccgtgttttacaggttgacggcacgctgtttctcgctgtgcatctggaagggcaaatgaaaaaatcgaaaaaaacaaaaggcttttccttatactcagaagagcaaatcaagcaactgcttgaggaaagccatttcagagacatcacggtacatatgaacaaaaattactgctgcatttctgcggtaaaatcatga

SEQ ID NO: 2285 - DNA, 222 bp, Bacillus licheniformis
atatcgtctacttcgacccgatgtttgatgatggaatcaaagaatcaaacggcatcgcccctttaagaaagtgggcgcattccgagtttacgcttgacggcgctttacatgaagcccttcgggtcgccagaaaaagagtggttctgaaagaccactggaagagtccgcgctgtgaaaaatacggattttccgtttaaaaacgcaaaacggacctgttacatt

SEQ ID NO: 2286 - DNA, 432 bp, Bacillus licheniformis
atgtgtttaggaaagggaaaagacatgattcaattaaaagatgatgaacgactggattatttactggcggaagatatgaaaatcgtgcaaagcccgacagtttttgcattttccttagatgctgttctgctgtcgaaatttgcttacgttccgatacaaaaaggaaacatcattgatttgtgcacagggaacgggattgttccgctgcttctcagcacccgcacaaaagccgccatcaccggggtggaaattcaggaaaggctgtatgacatggccctccgcagcgtggaatacaacaacctgcaaaaacagattcatcttatcagggacgacctgaaaatatgccgcaggtgctcggatacaataaggccgatgtcgtcacatgcaatcctccttatttcaagacgccgcaaaaaacggagcaaaacctaa

SEQ ID NO: 2287 - DNA, 468 bp, Bacillus licheniformis
gtgacaggagcctcaagaggaatcggccgcgcgatcgccctggacctggcgaaaaacggagcaaatgtcgtcgtcaactacgcgggaaatgaagcgaaagcgaacgaagtcgtagacgaaatcaaagcgctcggccgcgatgcgtttgcttttaaagcggacgtttccaatgcggatgaggttcaggcgatgatgaaggaagcggtcggacgcttcggcacgcttgacatccttgtcaacaatgcgggcattactaaagacaatctgttcatgagaatgaaagaagatgaatgggacgacgtcattaacataaacttaaaaggtgtgttcaattgttcaaaagctgtgacaagacagatgatgaaacaaagaagcggccggatcatcaatatcacctcggttgtaggcgtcgtcggtaacgccgggcaggccaactatgtcgcggctaaatcaggcgtattccagtag

SEQ ID NO: 2288 - DNA, 2937 bp, Bacillus licheniformis
tggacggaaagccaatcagtatccggatagacggcaaagaatttgaagcagtggccggggcaaccgttttagacatattgaacaaaaacgggtttgaacacccgcaaatatgccatgtaccagagacggatcctattcaaacgtgtgatacgtgtattgtggaagcagacggaaaattaaaacgggcatgctccctgcgggctgaagacggaatgacgatcagcctgtcagcagaacgggtcaaagctgcacaaaaagaagcaatggaccgcctgctcgaaaatcatttgctctattgtacggtatgcgacaacaacaacgggaactgtaagctacataatacggcagaaatgatgggaatcgaagaccagaaatacccttacacgcctaaagaagacccgtcttgcgccgtcgatatgtcacaccccttttaccgctatgatccgaatcagtgcattgcttgcggacaatgtgttgaagtttgccaaaacctgcaggtcaatgagacgctctcgattgactgggagcttgaacggccgcgggtaatctgggatgaaggcgtatcaatcaacgaatcctcatgcgtcagctgcgggcagtgtgtcacggtctgtccgtgcaatgcgttaatggaaaaatcaatgcttggaaaagccggtttcatgacaggcatcaaaccggatgtcatggagccgatgatcgaccttgtcaaagatgtagagccgggatacagcagcatctttgccgtttcagaagtcgaggcggcgatgcgttcacagcggaccaaaaagacaaaaaccgtctgtacgttctgcggtgtcggctgttcatttgaagtatggacaaaaggccgtgacatcttaaaaattcagccggtttcagaagctccagtcaatgccatctcgacgtgtgtgaaagggaaattcggatgggatttcgtcaattcggaagaacgtttaaccaaaccgctgatccgcaaaaataacgaatttgtcgaatcgacttgggaagaagcgcttgactacgttgcccgcagattaggctcgattcgggagcagaacggaaaagacgcagtcggatttatttcgtcttcaaaaatcacgaatgaagaaaactacttaatgcaaaagctggcgcggcaagtatttggcactaacaatgtcgacaactgctcgcgctactgccagtctccggcaacagacggattgttccgcacggtcggcatgggcggcgatgcaggcaccattcaagacatcgcgaaagcaggcctcgtcatcatcgtcggcgccaacccggccgaaggccacccggtactggcgacccgcgtgaagcgcgcccataagcttcacggacaaaagctgatcgtcgccgatcttcgcaaaaacgaaatggccgaacgctcggatctgttcatcagaccgcggcaaggaactgatcaagtatggctgatggccgtgacaaagtatatgatcgaccagggctggcacgatcaggcgtttatcgatgaaaacgtcaatttctttgaggaatataagcaatctcttgagacatacacccttgaatatgcagaaaaaattacaggcatccataaacagacgctgattcaaatcgctgagatgatccgcgacgccgacggtacatgcattctttggggaatgggggtcacccaaaacacgggcggttccgacacgtccgcagcgatttcaaacctgcttttagctaccgggaattaccgccgcccgggcgcaggagcttacccgctccgcggccacaacaatgtccagggcgcctgcgacatggggacgcttcccggctggcttccgggatatcagcacattacagatgacaaagcgcggaaaaagttcgaacaagcttacggcacaacaatcgacgaggagcccggacttgacaacattgaaatgcttcacgccgttgaagaaggcaaaatgaaagccatgtatatcgtcggagaagatatggctttagtcgattcaaacgcaaaccgggtccatgacattttatcaagccttgaattccttgtggttcaggatgtgttcctttcgaaaacagctcaatacgccgacgtcgttctgcctgcgtcagcttctcttgaaaaagatggaacttttacaaacacggaaagacgtgtccagcggttgtatcaggcgctcccgccgctcggagatgcgaagccggactgggttatcattcaagacatcgcaaaccggcttggagctgactggagttacagccaccctggcgacattttttcagaaatggcaagcctgtctccgctgttctccaaggcggattatgacgcaattgaaggatggaacagcttcctgtggggcagcttgaccggagaaagcacgcctcttttgtatgaagacggctttaactttcctgaccggaaagcgcgctttgccatcgcagactgggcagagcccgccgaatttcctgaggagtacgaccttcacattaacaacggccgaatgctggagcattttcacgaaggcaatatgacaaacaaatcggcaggcatccaggcaaaagtgccggacgtctttgtggaagtctcgcctgagctcgccaaagaacggggcatctgcgacggatcgcaggtcaggctgatctcgccgtttggcgccgtaaaattaacggcgcttgtgacagaccgggtcagagcgaacgaactttatctgccgatgaactcgacagataaagaatcggcgatcaatttcttgaccggtcccgcagtagatgcgcgcaccaatacaccggcttacaagcagaccaaggttcgtatggaagtgctcggcggatgtgcagaaccgccgcttccgaaaacaaatccgcgcaataagaaacgccatccgcaaaacggggctgaagtcgagcggaaatggaagcgtccggggtacgttcatttaacagact

SEQ ID NO: 2289 - DNA, 1984 bp, Bacillus licheniformis
gtgccaagtttttatgaaaaaccgttatttcgatatcccatatattctttaatcgtcgtcacaatcatttctgtcatcatcaacatttattttaatagaatggcagaaacgaccggcataatgatactgggtgtcattttgtactttttgaaacgggccgacttccaaatcagaaaagagatggacgattatataacgacgatatattatacgatctgaaacaagtcggagaagaaacaactgcttgaaatccggatcgggatcatgctgtttaccgatcagtactatatcgagtgggccaatccttttatggcgtcatgctttaatgaaaatacgctcgtcggccggtcgctttatgatacttgtgaatctgtcgtccctttgattaagcaggaagtggacacagaaacgattacgctgaatgagcggaaatttaatgtggtcatcaaacgggaagaaaagctgctttatttctttgatgtcacagagcagacgcagattgaaaaacaatacgaaaatgaaagaacggttcttgcctacatctttctcgataattacgacgatgtgacgcaagggcttgatgaccagaccagaagctcgataaacagtgaagtaacatcgcttttgaaccagtgggcccaagagtacggcattttcttaaaacgggtttcctctgagcggttcatcggcgtattaaacgaacatattttaagcgagctagaagcatcaaagttttcgattcttgatgaagttcgggagaagacatccgttcataccatttccttgacgttaagcatcggaatcggtgcatctgttgcctcgttgaaagagctcggcgatttggcgcaatccagccttgacttggcgctgggacgcggaggagatcaggtggcaatcaagcagccgaacgggaaagtgaagttttacggcggtaagacgaatcctatggaaaaacggacgcgcgtcagagcccgggtcatttcacacgcgctcaaggagattgtctctgaaagcagcaatgtgataatcatgggtcataagtttcccgatatggattcgatcggatcagccatcgggattttgaaggtcgcacaggcaaacggcaaagacggctttgtcgtgatcgactccaatcagatcggttcaagtgttcaaagactgatcggggagattaaaaaatacgaagaactgtggtccaggtttattacgccggaagaggcgcttgagatcgcaaaagacgacacgctgctcgtgatcgttgatacgcataagccttcttttgtcattgaagaaaggctggtcaataaaattgaaaatatcgtcgttatcgatcatcatagaagaggggaagagtttattaaagacccgctgcttgtctatatggagccgtacgcttcatctacagcggagcttgtgacagagctgctcgaataccagccgaagcgcttaaaaatcaacatgatcgaagcaacagctcttttggccgggattattgtcgatacgaagagcttctcgctgcgcaccggctcccgtacgttcgatgcggcgtcttatctgcgcgcaaaaggcgctgacactgtattggtgcaaaagtttttaaaagaaacggccgatcattatattaaaagggcgaagcttatccagcataccgttttttatcaaaacggcatcgccattgcatcgctgccggacgatgaggcggacgaatactttgaccaggttatcattgcacaagccgcggattctcttctgtctatgagcgatgtcgaagcgtcatttgctgtggcgagaagagacgagaacacggtatgtatcagcgcaagatcgctcggcgaagtaaatgttcaaatcattatggaagcgctcgagggcggcggtcatttaaccaatgctgcgacacagctgaccgatatcacggttgaagaaacgctccgccgactgaaagaagcgattgacgagtatttcgaaggaggcattcagaaat

SEQ ID NO: 2290 - DNA, 2140 bp, Bacillus licheniformis
ttgttgaaaaagaaaaaaagaggcggaaagtttcggcttatccgcttgaataacgggggcttccttcccgtcattctttatgcggctttatccgcgctgatgttcatcctgctgtttttccatgtgaggccggagtccctcgacctcgatttattttcgatcagcgagaatacgatctatgcgccggcgacagttgaagaccaaaaggcaacggctaataaaaagcaggaagcgagagaggaagttcccgaccagtacactttgaaaaaagagtactctgacaacagggtcgaccttgtctcatcgattttcgacatcattaaagaagtgaaaaaagaaagcgcagaaaaagagaaaaaagacaagcaggccccatctgaaaaagaccagatcaaatctgttgaagaaaagctgacttccgatgtgacggactcgctgtcacaggattcagtcaaacacctgctgagggccagcgacggagagctttccatgacgcaggattcggtcatcaccgccgtcaatgacgtgatgagcaaagaaatccgcgcaggaaagctcgatgaagcgaaagaacatgtaacgaaagaactgaagggcaattcgataccttcaaaattaaaaaacgccgctgatgaaatcggacgctttgcgatcattcccaattacgtatacgatcctgacaagacggagcagaagcgtcaagaagcggctgacagcgtacagcaggtacagatcaagcaggggcagatactcgttgaggaaaatcagctgatcgacagggaagtctatcgaaagctcgaattgacagggctcttgagcggagccaacatcttcaaacctgtcggcggactgctgcttttaatcgcgcttttcatctcagctttggtttactatttcgaaaagcaatacagcagccggattccgaaaaacaagtcgctcatgctgttttcgttgatcacagggatcgttttaatcgtcatggaagtgatcagcctgtttcagcagcttgaaatcggccatatcggctatctcgtgccgattgcgatgggcgtgatgctcattaaactgctgatcaatgaaaggctggcgatcctgtcgagcatgattctttccatttgcggaagcatgatgtttaaccagggtgtgacaggcacgttcaactatggaatcggaacgtatttcttaatcagctcgatggcgggtatactgtttttagggaagcataacgcgagggcgaaaattctccaggccggtttatttgtctctctgatcaacatcgttgttctgtttaccctgcagctgattcaaaacacggcgcaaaccgggcttgagatgggtacatatcttgtcatgggggcggtgtccggcatcggatcgtcagttcttgttctcggactcatgccgttttttgaaagcggatttggcatcctgtccacgatgaagcttctcgagctttcaaatccgaatcatccgctgctccgcaaaattctgacggaaacaccgggcacataccatcacagcgttatggtcgcgaacttatctgaggcggcatgcgaagcggtcggagcaaacgggctgctggcaagggtcggcgcctattaccatgatatcggcaagacaaagcggccccaatattttatagaaaaccaaatgaatattgataacccgcatgacaagctttctccgcagctgagcaaaaacattatcattgcccatgtgacggacggcgccgatatgctgagggatcataaaatgccgaaggagcttgtcgacatagccgaacagcatcacggcacatcgctgctcaagtttttttactataaggcgaaagaaaaaggcgatcagacgactgaagaagagttccgctatcccggtccgaagccccagacaaaagaggcggcgatcatctcggtggccgacagcgtcgaagcggccgtccgctcaatgcataaccctaatcccgaaaggattgaaaagctggtgcgcgggatcatagcggataagctgcaggacgggcagtttgacgaatgtgatttgactttaaaagagctcaatactatcgcgaagacgctctgcgaaacgctgaaaggcatttttcattcccggatagaatatccggaagctaatcctaaacagaagg

SEQ ID NO: 2291 - DNA, 1668 bp, Bacillus licheniformis
atgaaatttgttaaaaatgaccaaacggctgtatttgcccttggaggacttggggaaatcggcaaaaacacgtacggggtccagttccaggacgagatcgtgctcatcgatgcggggattaagtttccggaagacgagcttctcggaatcgactatgtcatccctgactacacttatttagtcaaaaacgaagaaaaaatcaaaggtctttttattacgcacggacacgaagaccacatcggcggaattccgtacctgctcaaacaggtgaacattccggtttacggcggacagctcgccatcggccttctcaggaagaagcttgaagagcacggtttgcttcgccaaacaaagcttcatatcattgaagaagacgatatcgtcaaattcagaaaaacgtcggtttcttttttcaggacgacccacagcattccggactcatacgggattgtcgtaaaaacaccgcaaggaaacatcgtacataccggtgactttaaattcgattttacaccggtgggcgaacccgccaacttgacaaagatggccgaaatcggaaaagaaggcgtgctttgcctgctgtcagacagcacaaacagtgaaatccctgatttcacgatgtcagagcgcaaagtcggagaaagcattgataatattttcgaaaaagtcgaaggcgggatcatcttcgcaacctttgcgtcaaacatccaccgcctgcagcaggtgatcgaagcggctgttgcaaacggacggaaggttgccgtatttgggcgaagcatggagtcggcgatcgaaatcggccaaacgctcggatatattaagtgtccgaaaaacactttcgttgaagcgaatgaaatcaacaggctccctgccgggaaagtgacgattctctgtaccggaagccaaggcgaaccgatggctgctctatctcgaattgcaaacggcacacaccggcaaatctccatcaatcccggggatacggtcgtattttcatcatctccgatcccgggcaatacgatcagcgtcagccgcacgattaaccagctttaccgggcgggtgccgatgtcatccacggagctgtgactaacattcacacctcgggacacggcggacaggaagagcaaaaactgatgctccgcctcatcaagccaaagtttttcatgccgattcacggtgaatacagaatgcagaaaatgcatgtcaaactggcgacagactgcggaattcctgaggaaaactgctttattatggacaacggggaagtgcttgctttgacaagcgaagaagcctcagttgcgggtaaaatcccgtcaggcaatgtttatattgacggaagcggcatcggcgacatcggcaatatcgtgcttcgcgaccgccggattctttccgaagaagggctcgtcattgtcgttgtcagcatcaacatgaaagaattcaaagtgtccgcagggcctgacttaatttccagaggatttgtctatatgagagaatccggtgatttaatcaatgatgcccaggaactgattgcaggacaccttaaaaaagtgatggagcgcaaaacgacacagtggtctgaaattaagaacgagattacagacacgcttgctcctttcctctatgaaaaaacaaaacgccggccgatgatccttccgattattatggaagtctaa

SEQ ID NO: 2292 - DNA, 1941 bp, Bacillus licheniformis
atgagcattaatcagctgatcatccgcaacctgaaaaaaaatatacggaactattacctttatgtgtttgcgttgatcttcagcgcagcgctttattttgcgtttgttacgctccagtatgatccagcgatcaatgaagtgaaggcatcgataaaaggcgcagcggctttgaaggcagcttccattctccttgtggcagtagtagcggtgtttgttttgtatgccaatacgatatttatcaaaagacgaagcaaagaaatcggtttattccaattaatcggcatgaggaagcaaaaaatcttccgcatcttaagcttggaaaatgtcatgctgtatttcggctctttggtcattggggtgtttgccgggttttcgatctcaaagctcgtgctcatgattttgtttaaaattgtagatgttcaagccgaagccaaattgaatttttccgtcgaagcgcttgtgcaaaccgtcattgtattctgcggcatctaccttctcgtaatggtgatgaattatgcgtttatcaaaaagcagagcattttatctttatttaaagtgacatcagctacggaggataaggtaaagagaatatccgttttccaaatgatcatcggcttattgggcatcttgtttattttatccggatactatgtatccactgagcttttcagcggaaaattcaagaccgtagatgagctgttttatgcgatgagctttattctcggaaccgtcatcatcggaacgtacctcttctataaaggatcggtcagctttgtctccaacatcatccgcaaaagcaaaggaggctacttgaatatttatgaagtgctgtccctttcatcgatcatgttccggatgaaatcaaacgccctattattaacaatcattaccaccgtttcggcgctggcgatcggattgttatccttgagctatatttcgtactattctgcagagaaaaccgccgaacaaaacgtggcggctgatttcgccatgacaaatcaaaaggatgcaaagcgttttgaacaacttttggacgaaaataacatttcctacagcaaaaaagaaattcatgtcattcaagcggtttttaatctggaacaaattgtcgatggagatcctgaaaatatggctggagacccggggaaattgcccctcgccgtggtcagcgatgcagagattgccgggatggacgtgccaaaaggagacgtcattttttcaggatataccgaccttctccagaaatttatggctttaaaagagaccggtgccgttaaggtaaagagcaggcatgagacaatcccattaaactatttaggcttgaaaaaagagtctcttttatccttcaactttaccagcggcggattgcctgttgccgttgtagatgatgcgctgtttaaacgtcttagccaagacaaagatccaaagctgcagcagaagccgagccttttttacggaatcaatttaaaacatgaagatcagcttcagcaggcaaatgagctgtttgcaacagtgaatcaaaacgatcagcatttatcgctccttgatgcaagcacagctcaaaaatcgcttttcggccttgccatgtttattgtaggctttttaggactaacgtttctgatcacttcaggatgcatcctatattttaaacaaatggacgaaagcgaagatgagaaaccgaattacacgattttgagaaaactcggtttcacacggaacgatctgttgaaggggatacgaatcaaacaaatctacaacttcggcattccattagttatcggcctgtctcacagctacttcgccgtccagtccggctggttcctattcggggcagagctgtggacgccgatgatcatcgtgatggtgctgtacaccgtcctgtactctattttcggcttgctttccgttctttacggcaagaaagtgatcaagtcggcgctgtag

SEQ ID NO: 2293 - DNA, 1890 bp, Bacillus licheniformis
atgagcatttttaaagcggaaggtttatataaaacttacggagacaaaacattatttgaccatatatcgttccatattgaagaaaacgaacggatcggcttgatcggaccgaacggaacgggaaaaagcagcttgctgaaagtgatcgccggccatgaatcgaccgaaaaaggagacatcacaaagcccggcagcctccatatcgagtacttggatcaggatcctgatttggacggtccggaaaccgtgcttgagcacatttattcgggagattccgtgatgatgcggacgatgaggacgtatgagcaggcgcttcaggagctgaatgcggcgcctgatgatccgaagaagcaggaaaacctgctggcggcgcaggggaaaatggacgaacatggcgcctgggacgcgaatacggcggcaaaaacgatattgacgaagcttggcgtcgcggatgtggcaaaagaagtgagctccctttccggggggcaaaaaaagcgtgttgcgattgcgaaaacattaattcagcccgctgacctcctcattttggatgagccgacaaaccaccttgacaatgaaacgatcgaatggcttgaaggctatttgagcgggtatccgggctccgtcgtcctcgtcacccatgaccgctattttttaaaccgggtgaccaacaggatctatgaactggatcgagggcgcctatacacatacaaagggaactacgaagtgtttttggaaaagcgggccgaaagagaagcgctcgccgaacaaaacgaaacgaagcggcaaaaccttctcagaagggagcttgcttggctgagaaggggggccaaagcccgttcgacaaagcaaaaagcaagaattcagcgggtggaggaactaaaggagcaggacgcgcctgaaaccggttcttcccttgatttcgcgatcggctcccaccgtctcggcaagcaggtgattgaagcggaaggcgttgacatcagccgcggcgggaatcagcttgtccgttcattcaatgaactgattgtgccgggggaccggatcggcatcatcggaccgaacgggatcggcaaaacaacactcttaaacgcgcttgccgggcgcattaagcctgacggaggacagatcacgatcggccagaccgtaagaatcggctattatacacaggatcacagcgaaatgaacgatgcgctgcaggtcgtcgaatacatcaaggagacggctgaggtcgtcaaaacggccgacggacaagtggtcacagcggagcagatgctggaaaggttcctctttccgcggagcgtgcagcgcaacttgatccgcaagctgtcaggcggggaaaagaggcgcctttatctcttgaaagtgctgatggaggagccgaacgtcctgttcctcgatgagccgacaaacgaccttgataccgagacgctcggcgtgctcgaagattatttggagcagtttcccggcgttgtcgtgaccgtatcccatgaccgctatttccttgaccgcgtagtcgacaggctgcttgtatttgaaggcggcggaaacgtatcgcgttttcaaggttcctacagcgaatatatggagaagcaaaaggagaacagccgtcaaaagccggcgtctgaagccgcagaacctgtcaaacctgagaaaaagaaaaggaagaaactgtcttataaagatcagctggaatgggacggcatcgaagacagaatcgccgctctggaagaaaagcataaacggcttgaagaggaaatcgccgccgccggcagcgattttgccaaaatccagacattgatggaagagcaggcgcaaacagccgaagagctcgaagcggcaatggagcgctggacagagctgtcgctgttgatcgaagagcttgaacaatcgtaa

SEQ ID NO: 2294 - DNA, 1917 bp, Bacillus licheniformis
gctagtttgggtatctatacgcacatgccactggtgccatgtcatggctcatgaaagcttcgaagatgaagaagttgcgaagcttctgaatgagaaattcgtctccattaaagtggaccgcgaggagcggcctgatgtggattcgatttatatgacgatctgccagatgatgacggggcagggcggctggccgctgaatgtgtttttaacccctgatcagaagccgttttatgcgggtacatattttccgaagacgagccgttttaaccgtccggggtttgttgaggtggtgaagcagctttccgataccttcgcgaaaaaccgggagcatgttgaagatattgccgaaaaagcggccaacaacctgagaatcaaagcgaaaagcgatgccggcgattcgctcggcgaagacatattgaggcggacgtatcagcagctgatcaacagctttgatgcggcgtacggcggtttcggcagcgcgccgaaatttccaatcccccatatgctgacatttctgcttcgctatcatcaatacagcggcgaggagaacgcgctgtacagcgtgatgaaaacgttggacagcatggcgaacggcggcatttacgaccatgtcggctacgggtttgcccgctattcgacagatgacgaatggcttgttccccactttgaaaaaatgctttacgataatgctttattgctgatcgcatatactgaagcctatcaaatcacgaaaaacgaacggtataaacagatttccgagcagatcatcacatttgtccgccgcgaaatgaccgatgagaaaggcgctttttattcagcgcttgatgccgacacggaaggcgtagagggcaaatattatgtgtggtcaaaagaagaagtccttgaaacgcttggagatgaacttggcgaattgtattgcgcggtctacaacatcacgcaagaagggaattttgaaggccataatattccaaacttgatctacaccaggctggaagacatcaaggatgaattcgcgctgacagatgaagagcttcagaacaagcttgaagaagcgagaacaaagctttttgaaaaacgtcaggaaagaacgtatcctcatgtcgacgataaagtgctgacttcttggaacgctctgatgatcgcgggtcttgccaaagcggcgaaagtctacaatgcgcccgaatacctggagatggcgcgagctgcagccgagtttatcgagaataaattgattcaagacggtcgcatcatggtccgctaccgtgacggcgaggtgaaaaataaaggatttatcgatgactacgccttcctgctgtgggcctacatcgaattgtatgaagcatcacttgatttaaccgatttgcgaaaagccaaaaagctcgaagcagacatgaaggggctgttctgggatgaagagcacggcggtttttattttacgggaagcgatgccgaggctttgatcgtgcgggataaagaagtatacgacggcgccctcccgtccggaaacggcgtcctggccgtgcagctgtcccggctgggcaggctgactggcgacttgtcgctccatgatcaagcggcaaaaatgtttgctgccttccatggagacgtctctgcttatccgagcggccatacaaactttctccaaggtttgctgagccaattcatgccgcaaaaggaaatcgttgtgctcggaaaacggaatgatccggacagacagaagatcgtaagcgctttgcagcaggccttccagccgaattatgccgtcctcgccgcagaatcgcctgacgatttcaaagggattgccgactttgcggccgaatacaaagcagtcgataacaaaacgactgtctatatttgtgaaaatttcgcctgcaggcagccgacgacgaatatagacgaagcgctcgatcagctggt

SEQ ID NO: 2295 - DNA, 1537 bp, Bacillus licheniformis
gtgtccgaaaaactggatctttcccgctttgaaaaaaagatcgtcatccgcaatattgaagaaaaagatatcgacagcatcatcgggcttcaagagctttgttttccgggaatgatcccatggaaacgggagcatctggaaagccatttggaacacttcccggaaggccagttttgcgcagagcttgacggagaagtgatcggttcctgttcaagcctgttgatcaactttgatgaatatgacgacagacatacatggcaggatattacagacgacgggtatattacgaatcacaatcccgacggcttaaacatgtacggcatcgaggtcatggttcatcccgaatacagacggatgaagatcggccaccgtctctatgaagcgcgaaaagatctggcaaggcgcttgaatttaaagagcattatcatcggcggcagaattccgaactatcataagtacgcttccgagatgacgccgagggagtatgtcgaacaggtcatccaccaccagatatatgatccggtcctttcgttccagctgctgaacggattcaccatgatgcggatcaacccgaactatctcccggatgacagagcatcaagcaaatatgcgacattgatggagtggaataatgtcgactacttgccgcagacgaagcgctattacaaatcagcttttccggtgagaatatgcgtgattcaatatgaaatgaagcagatccattccttcgaggagttcgccaaccaagtcgaatactatgcagatgtggcttcagacgcaggagcggattttgccgtctatccggaaatctttacgacgcagctgatgtcgtttctggaagagcgctcaccgagcctggccgttcagcggattaccgaatatacagaagactatatcagcctgttcacagaccttgccgttaaatacaatgtcaacattatcggcggttcccacttcgttgaagaagaaggaaagatctacaatatcgcttacttgttcagaagggacggaaccatcgaaaagcaatataagctccatattaccccgaatgaacgaaaatggtggggcatcagcaggggggacgaagtgcgcgtctttgacacagactgcggcaaaatcgcgatccagatctgctatgacatcgagtttccggagctaggcagaatcgcaaccgaaaaaggggccaagattatttttacccctttctgcacggaagaccgccaaggctatttgcgagtcaggtactgcgctcaagcaagagcggttgaaaaccaggtgtacacggttatttccggaacggtcggcaatctgccgcaaaccgaaaatatggatattcaatacgcgcaatccgcgattttcgctccttcagattttgaatttgcaagggatggaatcgtcggcgaatgcaatccgaacattgagatggtggtcatcggcgatgtcgacctggaaattctcagaagacagcggcaggacggaacggtccggcagctcaaggacagacgccatgacatctacaggattcattataaaaaat

SEQ ID NO: 2296 - DNA, 1557 bp, Bacillus licheniformis
atgagtttacttacagttacaaagctgagccacggttttggcgaccgggcgatctttcatgatatatcctttcgcttgctgaaaggcgaacatgtcggtctcatcggagcaaacggcgaaggaaaatcgaccttcatgaatatcattacgggcaaacttgagcctgacgaaggaaaagtagaatggtcaaaaaacgtccgggtcggctatcttgaccagcatacatcgcttgagcgcggacaaacgatccgcgatgtgctgagaaacgctttccattatttatttgcgatggaagaagaagtgaatgccatctacacaaaaatgggcgaggccgaccccgacgagcttgaaaagcttctcgaagaagtcggaacgattcaggacgccctgaccaacaacgacttttacgcgattgacgcaaaagttgaagaaatcgcccgcggcctcgggctcaacgatctcggacttgacagggatgtcgcggaattgagcggcggtcagcggacaaaggtgctgctcgccaaactgctcttggaaaagcccgacatcctgctgctcgatgagccgacaaactatctggacgaacagcatatcgaatggctgaaacgctatttgcaggagtacgagaacgcctttattttgatttctcacgacattccgtttttaaacagcgtcatcaatctgatctaccatgtggaaaaccaggagctgacccgctatgtcggcgactacaaccaattccgcgaagtatatgaagtgaaaaaacaacagcttgaagccgcctacaaaaaacagcagcaggagatttcagagctgaaagacttcgtcgcccgcaacaaagcgcgcgtcagcacaagaaatatggcaatgtcacggcaaaaaaagctcgataaaatggatatgatcgagctcccttcggaaaaaccgaagcctgaatttcactttaaacaagcaagaacatccggaaagctgatttttgaaacgaaggagctcgtcatcggctatgatgagccgttgtcccgcccgctgaacttgagaatggagcgcggccaaaaaatcgctctgtacggagccaacggcattggaaaaacgacattgctgaaaagcctcctgggggaaatttcaccgctgtcgggagaagtcgaacgcggcgaacaccttcatatcggctatttcgagcaggaagtcaaagagaccaacaacaacacatgcatagaagaagtgtggaacgacttcccgtcctttacacagtacgaaatccgcgcggccctggcgaagtgcgggctgacgacaaagcatatcgaaagcagggtttccgtattaagcggaggggaaaaagcaaaagtcagactatgcaagcttatcaattcagaaacgaatctgcttgtactcgatgaaccgacaaaccaccttgatgttgaagcaaaagaagaattaaaaagagctttgaaagaatacaaaggctctgtcctgctcatctctcacgaacctgaattctatatggacatagcgacagaaacatggaattgcgagtcatggacaacgaaagttttataa

SEQ ID NO: 2297 - DNA, 1413 bp, Bacillus licheniformis
gagaagccggatatttaacaggaatcgatgacgaaacgctgcgtccgatgatcgagatcacaaaaggcgtagaaacaggttacggctctattctcgccatttctgatatggaatccgccatgcgtgacgagcgaattaagaaaacaaaaaccgtctgcacctattgcggtgtcggctgcagctttgatgtctggacaaagggcagagatattctgaaagtcgagccgcaggaggaagcaccggccaacggcatttctacttgtgtaaaaggaaaattcggctgggatttcatcaacagcgaggagcgcttgacaaagccgctgatccgcgaaggcgaccatttccgtgaagcggaatgggaggaagcgttaacgctgatcgccagcaagttcacggatttaaaagaggagtttggcccggattcacttgcctttattacatcttctaaatgtacaaacgaagaatcctacctcatgcaaaagctggcgagagggatcatcggcacaaataatgtcgacaactgctcgcgctattgccaatctcctgcgactgccggcctgttccggacagtgggctatggcggtgactcagggtcgattgcagatatcgcgcaagcggaccttgtgttgattatcggttcgaacacgtctgagtcgcatccggtcttgtccactcgcattaaacgggctcataagctgagagggcagaaagtgatcgtagcggatatcagaaaacacgaaatggcagagcgatctgatctgtttgttcagccgcgtgccggatcagatatcgtctggctgaatgccatcgccaaatatttaattgaaaacggcaaggccgatgaacgctttttgcaggaaagagtgaacggacgggatgaatatgtgaaaagcctcacgccgtatacccttgaatatgccgaggagaaaaccgggattgatcaagaaaccctcatccaaatggcggagatgattggccaggctgacagtgtgtgcgcattgtgggccatgggggtgacacagcatattggcggaagcgacacgagcacagcaatctctaatctgctgcttgtgacaggaaactacggaaaaccgggagcgggctcttacccattgcgcggccataacaacgtgcagggagcaagtgacttcggaagcatgcctgacagactgccgggctatgaaaaagtgacggacgaacaagtccgccaaaaatacgagcaggcatggggtgtaccgctgccgaaggagccgggcatgaccaaccacgaaatgatcgaaaaaatccactctggcaagctgaaagcgatgtatgtaaaaggtgaagaaatgggtctggtcgattccaatatcaatcatgtacacgccgcatatgaaaagcttgatttctttgtggtgcaggatatttttcttt

SEQ ID NO: 2298 - DNA, 1398 bp, Bacillus licheniformis
atggctaagaaaatgccggatatcggcgaatataaatacggttttgccgacaaagacgtttccattttccgttcagagcggggattgacaaaagaaatcgttgaagaaatttcacgcatgaaagaagagccacagtggatgctcgactttcgcttgaaatctcttgaacacttctacaatatgccaatgccgcaatggggcggagatttaaactcattaaactttgatgaaatcacatactatgtaaagccttctgagcgttcagaaagatcatgggacgaagtgcctgaggaaatcaaacagacatttgacaagctcggaatcccagaagctgagcaaaaatatttggccggtgtatccgcgcaatatgagtcagaagtcgtttaccataacatgaaagaagaccttgagtctcaagggatcgtcttcaaagacacagacagcgccctcaaagaaaatgaagacattttccgcgagcattgggcaaaagtcatcccgccgactgacaacaagtttgcggccttgaactcagcggtatggtcaggcggatcattcatctacgtgccaaaaggcgtaaaagtggatactccgctgcaagcatacttccgcatcaactcagaaaacatgggacagttcgaacggacgctgatcatcgtagacgaaggcgctcacgtccactatgtagagggatgtacagcacctgtttatacgacgaactcccttcacagcgcggttgttgagatcatcgttaaaaaaggcggctactgccgttatacaacgattcaaaactgggcgaacaacgtcttcaaccttgtgacaaagcgtgcggtttgtgaagaaaacgcgacgatggaatggatcgacggaaacatcggctccaagctgacaatgaaatatcctgccgttatcctgaaaggcgaaggcgcgcgcggcatgacgctttctatcgccctggcaggaaaaggacagcatcaggatgccggtgcgaaaatgattcaccttgcaccgaatacgtcatccacaatcgtttcaaaatcaatctcaaaacaaggcggaaaagtcacataccgcggaatcgtacacttcggacgcaaagccgaaggcgcccgctcaaacatcgagtgcgacacgcttatcatggacaacaaatcaacttctgatacaatcccatacaatgaaattttgaacgacaacatttcattggagcacgaagcgaaagtatcaaaagtatctgaagagcagctcttctacttgatgagccgcggtatttctgaagaagaagcaacagaaatgatcgtcatgggcttcatcgagccgttcacgaaagaactgccgatggaatacgcagtcgaaatgaaccgtcttatcaagttcgagatggaagggtctattggttaa

SEQ ID NO: 2299 - DNA, 1311 bp, Bacillus licheniformis
atgggaaaacctgtcgtagccatagttggaagacccaatgtggggaagtccacgatctttaacaggatcgcgggcgaaagaatttcgattgtggaagatacacctggcgtgacgcgggatcggatatacagctctgccgagtggctgaatcacgacttcaacctgattgatacaggcggaatcgaagtcggcgatgagccgtttttggcgcagattcgccatcaggccgagatcgccatggaagaagcagatgtgattattttcatgacgaacggccgcgaaggcgtcacagccgctgatgaagaagtggcgaaaattttataccgtacaaaaaaacccgtcgttctggcggttaataaagtggataatcctgaaatgagagcaaacatttacgatttttatgccctcggctttggcgagccgttcccgatttcatggacgcatggccttggtctcggcgatctgcttgacgcggtcagcgaacattttaaaaacatacccgagacgaagtatgaggatgaagtcgttcaattttgcctcatcggccggccgaacgtcggaaaatcctcccttgtaaacgccatgattggagaagagcgcgttatcgtcagcaatattgcgggaacgacgcgcgacgccattgacacgaggtttacatacaatcaaagagactttgtcatcgtggatacagccgggatgagaaaaaaggggaaagtgtatgaggcaactgaaaaatacagcgtcctccgagctttaaaggcgatcgaccgttcagaagtcgtctgcgtcgtcttggacggcgaagaaggcattattgagcaggacaagcggattgccggctatgcgcatgaagcaggaaaagctgttgtcatcgtcgtaaacaaatgggatgcagtcgaaaaagacgagcggacgatgaaagaatttgaagaaaaggttagagaccactttcaatttttggactacgcgcctgttttgtttatgtccgctttgactaaaaagcgcatccatacgctgatgcctgcggtcatgacggcgagcgaaaaccattcgatgagggtgcagaccaatattcttaatgatatcattatggatgcggtggctatgaacccgacgccgacgcataatggaaaccggttaaaaatttattatgcgacacaagtggctgtgaagccgccgacatttgtcgtatttgtcaatgaccctgagctgatgcatttttcttacgaacgctttttggaaaaccggatacgcgacgccttcggatttgaaggaacaccaatcaggattttcgcaagagcaagaaaataa

SEQ ID NO: 2300 - DNA, 1861 bp, Bacillus licheniformis
atgacctttcttcagttcgcttataaaaacgtcgtccggaataaaagagcctatctcgccttctttttaagcagctcattttcagtgatgatttttttcacatttgcgatgtttttgttccaccccgctttagaggaaggctacttaaacaccattgcaaaacgggggttgtcggtggctgaatggatgattttcgccttttccattctgtttgtgctttattccgtcaacgcctttctcaagtcgagaagcaaggaattcgggatcctcaccatccagggaatcgctccgggtcaattgaggaagctgattaccgcagaaaacatcatcatcggcgtgctttcgatcgttacaggcatcatcggcggtcttgtttttgcaaaaacattctttacgatcggcgcttatattctggaaatggacgctttgccattgtatctgccttggaaagcgatggcccttacatccgcctgctttcttgcgctgtttattctgctgtcgcaatttacggtgttatttattaaatcaaaaaccgttgtcaagctgatcaaaggcaccgggaaaattaaaccggagccaaaaccgtccattattttttcggtcgtcggcatcggctgcctcggctccggctactggcttgtattgttcgccgacatccattttccccaagccgtcacgatcttaattttgacgatcatcgggacttatttcttcttcagccaaagcagcatttggctgctgcggctgttaaaaaagcggaggtcattttatttacgaggaaaaaacgtgctttggatatccgatcttgtttatcggctgaaggataatgcccgcctgttctttctcgtttgcatcatttccgcggtcgcctttaccgccatgggtgcattggtaatttccaagacttctatcggaaaattggattcccgatatgagatagagtacttattatacagcgggagccaaaaggaacaaacacacgttaaggtgatcgaacaaaaattgaaggacggacatttttcgtatgcaaaggaagtgacaaaaggaatttatatgagctatagccagggagatctccttcctccggtgctcctggtctctgaaggcgaattccaaaagcacttcaagttaaattccggtgaactgaaagacggtgaggcgctgtattatccaaacgcctttgaggcaaaagaaaagcgggaaattcctgagaccttggacatgttgaacaaagatttgaagccggcaaatgaacggctaaaggtaaaaggtattaaaaaaccgctcatttcgttagaaagcatcgttgtcgtaaacggcaaaaccttcgaaaagctgaaaaaacaaggcgaatccctcacattgtacggctatcagtacaaccgctggaaagagagcctcgacatgagccaatcattggaaaaagatctcagagaaaaatctcacaatatccaatttcaatttgaagcaaaggccatcaattattttgaaactgttcagcttccaagcctgagtctgtttatcggattctttattgcggttctcttttttacggcatccgggagctttctgtacttccgcctgtttaccgatcttgaagaagatcaagagcgctaccggtcactctcaaaaatcggcctgagcgaaaaggaaatgtcgcagagcgtaacgattcaattggccatcctgttcttctttccgttcgtactcgcctcaattcatacgtattttgcgatgaagacgctcgaggcacagagccttggtcatttcgcatctccggtgatcatgacaataggcggatttctgatcttccaactattattctttatgatgattcgaaaaagctatctgaaaaaattaa

SEQ ID NO: 2301 - DNA, 1287 bp, Bacillus licheniformis
atgtttgttgatcaggtgaaaatatacgtaaaaggcggagacggaggcaacggtatggttgctttccgccgcgaaaaatatgtgccaaaaggaggccctgccggaggtgacggcggaaaaggcggagacgtcgttttcaaagttgacgaaggtctcagcacgctgatggattttagatatcaaagacattttaaggcagcgcgcggagaacacggcatgtctaaaaaccagcacggccgaaatgccgaagacatggttgtgaaagtcccgcccggcacggttgtcattgacgatgatacaaaacaggtcatcgctgatttaacggagcacggacaggaagccgtcatcgcaaaagggggacgcggcggacggggcaatacacgttttgcgacgcctgccaacccggcgccgcagctttctgaaaacggcgaacccggcaaggagcgctatattgttctcgagctgaaagttttggcagatgtcggtcttgtcggcttcccaagcgtcggaaaatcaacgctcctgtctgtcgtgtcttcggccaagccgaaaattgccgattaccactttacaacgctgaacccgaatctcggaatggtcgaaacggaagacggccgcagctttgtaatggcggatcttccgggactgattgagggggcgcacgaaggagttggcctcggacaccaattcctcaggcatatcgaaagaacgcgcgtcatcgtgcacgttattgacatgtcgggtcttgaagggcgcgacccgtatgaagattatgtgaccattaataaagagcttgaacagtataatctcaggctgacagaacgtcctcaaattattgtcgccaataaaatggatatgccggatgcggaagaaaatctgaaggctttcaaagaaaagctcacagatgattatcctgtttttccaatcagcgcggtgaccagacaaggcttgagggatctgctgtttgaaattgccgaccgtttggaaacgacgccggaattcccgctctacgacgaagaagacatggctgaaaacagagtcatgtataagcttgaggatgaggaagcgccgtttgagatcagccgtgatcctgacggcaccttcgtgctcagcggagccaagcttgaacgcttatttaaaatgacggacttttcaagagatgagtctgttaagcgttttgccagacagcttcgcggaatgggcgtcgatgatgcgcttcgggcccgcggtgcaaaagacggggatacgatccgtcttctcgaatttgaatttgaatttatcgactga

SEQ ID NO: 2302 - DNA, 1314 bp, Bacillus licheniformis
atgacattggaaacaaaactatctgtagatcgggaatatgtcaaaagcttctctgagaagcaccaggaaccggcatggctgcaagatctacgcttagaagcgcttgaaaaagcagaagatctgccgctgccgaaacctgataaaacaaaaattacaaattggaattttacacggtttgataagcatactgtagaaaataaaccgcttgattctttggatgatctttcagatgaggtcaaatcgctgatcgatcttggaaatgaagacaaaacgctttatgtccagagagaccagacgccggcttacctttctctttcaaaagagctgcaggataaaggcgtcatctttacagatattcatactgcgttccgcgaacacggcgagcttgtcaaaaagtactttatgaaagacggcgtaaaagccgatgagcataaattaactgcattgcatgcagccctcctgaacggcggagccttcctttacgtaccgaaaaacgtcgagctggaagctccggtgcaggctgtttatgtccatgaaagcaacgatacaacgcttttcaaccatgtacttgtcgttgcagatgacaacagtgccgtcacatatgtagaaaactacatcagcacggtgaatcctaaggaagcggtctttaacatcgtgtcagaagtgatcacaggcgcgaatgcccgcgtgcaatacggagccgtcgacaacctttccgcaggggtaacggcttatgtcagccgccgcggaactgcactcggacgcgacagcaaaattgaatgggcgctcggtttgatgaatgacggagacaccatttctgaaaacacgacgaatctgcatggagacggcacattcggcgatacgaaaacggttgtcgtcggcagaggagaacagactcaaaactttacaacgcaaatcattcaccacggaaagcattcagaaggctatattttaaaacacggcgttatgaaagattccgcgtcttcgatcttcaacggtatcggaaagatcgagcacggcgcgtcaaaatcaaatgcagagcaggagtcacgcgttcttatgctgagtgaaaaagcgcgcggcgacgcaaacccgatcctattaatcgatgaagacgatgtaacggcaggacacgctgcatctgtcggccgcgtcgatccggttcagctctactatttgatgagccgcggaattcctaaagaagaagcagagcgcctcgtcatttacggcttcctcgcaccggttgtcaatgaacttccgattgaaggcgtgaagaagcagctggtctctgtgattgaaaggaaagtaaaataa

SEQ ID NO: 2303 - DNA, 1671 bp, Bacillus licheniformis
tcaaacaaatcgcaaaagaaacggggcttgcgccaaagcatgtcgagagtgtcattcaattattagaggacggcaacaccgtcccctttattgcgagataccgaaaagaacaaacgggctccatggatgaagtccaaatacaaactatctccgaacgctggggatacattcagcatttaaatcagcggaaagacgaagtcatcaggctgatcgatgaacagggcaagctgaccggacagctgaagctggatatagaaaaagcggacaagctccaggaagttgaagacttatacagaccgtttaaacaaaaacgaaaaaccaaggcgacgatcgccaaaagcaaagggcttgaacctttggctgatttcatcatctcgctcccgcgtaatgaagatgtagcagccgaagcccgcaagtacataaatgaagaaaaggaagtcatgagcgccgaagaagcgcttgaaggagcaaagaacatactggctgaacggatctcagacgaaccggaatacaggaagtggatcaggcaggagacttttaaaagaggaacgctgaagtccgcggcaaaagatgccgaagcggatgagaagaaaatctatgaaatgtattatgaatacgaagagccgattcaaaaaatcgttcctcatcgcgtactcgcagttaaccgcggcgaaaaagaggagattttgagagcgtcggtcgagccgccggcagaccgcatccaagcttacttggaaaaacggattttacaacaaaagcaaacaagtgctcaagatgtcctgaaaagcgcgatcgaagacggctataagcgcctgattcagccgtcaatcgagagggaaatcagaaaagaattgacggaaaaggcggaagaccaagcgattcacatatttgccgaaaatctgcgcaagctgctgctgcagccgccgatgaaaggaaagctcgttctcggcgtcgacccggcattccgcacaggctgcaagctggcagtcgtggatgagacgggaaagatgctcaagatcgacgtcatatacccgcaccctcccgtcaataagaaaagcgccgccatcgaaaaagtaaaacgcatcatcgaagactttcaaatcgaggtcatcgcaatcgggaacggaacggcatcaagagagacggaacagtttatcgccgatctcttgaaggacatcgacagaaaggtgtactatctgatcgtcaatgaagcgggagccagcgtctattcggcatcagagcttgcgagggaagaattccccgatctgcaggttgaagaacggagcgccgtgtcgatcgcacgcagactccaagacccgctcgccgaactcgtcaaaatcgatcccaagtcggtcggggtcggccagtaccagcacgatgtcagccagaaaaaactaaacgattcgctccgctttgtcgtggaaaccgtcgtcaaccaggtcggcgtcaacgtgaatactgcatcagccgcgctcttgcaatatgtggccggactatcgaaaacagtcgcggccaacatcgtcaaaaaacgggatgagatcggaaaattcacgagccggaaagagctgaaagacattccgcgcctgggcgcgaaaacgtatgagcaatgcatcggctttttaagggtgcctgacggcgatgaaccgctcgaccggacaggcatcccacccg

SEQ ID NO: 2304 - DNA, 1463 bp, Bacillus licheniformis
atggccggtaaaatcacggtagtcggccttggggcaggcgatatgaatcaattaaccctcggtgtatataaacggctcacacaagcggaggttctttatgtcaggacgaaagaccatccattaatagaagacctgaaaaaagaaatagcggagattcatttttttgatgaggtctatgaaaagcatgatcaattcgaagatgtttacgaggagatcgtagagcggctttttgaggaggcgaagcagggggatgtgctctatgccgttccaggccatccgttcgtcgctgaaaaaacggtccagcttttgcttgagaggcgtggggctcatcaggccgatgtcgtcgtcgagggaggccacagctttattgatgcgacgttaaatgctttgcagatcgatccgattgacgggtttcagtttgtcgatgccgtccggttttcagccgacgaagtcgagctccgtcatcatttgattatttgccaggtatatgatcaaatgacggcttcagaggtcaaactgacgttaatggaaaagcttcctgatgactatgaagtcgtcattgtaacagcggccggaagcagcatgcaagacattcggacagtgcctctttacgaattggacagaagcgtgggcatcaataatttaacgagcgtctatgtgccgcctgtcaaagacgaagagattctccaccaggaattttcgatgttccgcagtgtcatcagaaagctgcgcggaccggacggttgcccttgggaccgaaaacaaacccatgagtcgctcaaaaagtacttaatcgaggaatgctatgaggtgctagaggcgattgatgaagaagatcccgaccacttagtagaggagcttggcgatgtgatgctccaagttcttctgcatgcgcagatcggcgaggatgacggcctttttacaattgacgatgtgattcgcggcatcaccgcaaaaatgatcagaaggcatccgcacgtcttcggagaggtctctgttcgtgatgaggccgacgtcatggtaaactgggaagagatcaagaagcaggagaaacaagcggacgataaatccctcctcgacgatattccaaagccgcttcctgctttgtcaaaagcgaacaagcttcagaaaaaggcggcaaagaccgggttcgactggtcgaatgtccaggatatttgggataaagtccaggaggaaatgaaagaattttcttcagaaatttccgaagccgaacagcacagcaaaaaaatgaaagaagagttcggcgaccttttattcgcgctcgtcaatatcggccggttttataaaattgaaccggaagaagccctcgcgatgacaaacgccaagttttacagaaggttcacatatattgaacaatctgcaaagcgcatgggcaaggatctggaaagtatgacgcttgaagaaatggacgaactgtggaatgaagcgaaaggcattgaaag

SEQ ID NO: 2305 - DNA, 1262 bp, Bacillus licheniformis
atgtacgaatttaaaaacataccgcaagagctaaaaaacgcccctcagtggattttatggcgttccgaagaacgtgacggtaagaaaacaaaagtgccgtaccagattgacggcagcatggctcaatccagtaataaaagaacctggtcgacattcccgaccgttttgaaattctataacgatcgagattatgacgggatcggcttcatgttttcaaaagatgatccgttcatcggcatagacatagatcattgtgtggaggacggtgtcttgtccccattcgctgaggaaatcgttcaggccattagcagttacaccgaatattcacccagcggcaaaggagtccacatcatcacaaaaggtaagatcccattgcgggggccgggcacaggtaggaaaaatcctgaacttgggctggaagtataccgccatggccgttatttcacctttaccggcaatagtctcgggatcggggccgttgaagaacgaacggacgagctcaaagagcttttcgagaaatatttgaaggataaaaaagaagaatcgaaaccttccaaactccctgctgcttcatcccgtgatatgagcaacctctctaataaggagatatgggaaaggatgttcaacagcaagaacgggaagagcattcaggatctgtttaacggtcatctgataaatgatgatcactcggccacagatatggctttgtgtaatcatttggcattctggacggataaggatcccgcaaaaatggattcaatgtttcgcgaatcaggtttgttccgggagaaatgggatcggcagcattcatccgatggcgctacatatggagaaatgaccattgccgcggccgtttattctactcatacgacaatttctgatttgctggaagagcagcaggaacagccgtatgaaatatatatttcccatcccgaaaattctcaagttgaggataccgaagagatcattgacactccgccggcgtttcatttgacggagctcggcaacgctgaacgaattgtctactaccacggaaagaatattcgatattgtaacgagcttgactggctgatctggaacggcaagcgatgggaagaagacagcaaacggaaaattgaagctatcaccgccaagacattacgggcgttgtacggcgaggctaaggccacagaagacaaattccgaaaaaagcagctgaacgattgggcgaagaaatgcgagcgccgcaacatacggatgaacacaattttagatgttcggcc

SEQ ID NO: 2306 - DNA, 2295 bp, Bacillus licheniformis
catcttcccgtgcggagcgatttcagcggcagccggaatcgcctccgctcactcttctctttatctcttcctcgccgtcggtttttttctgttctttatcctctgtttcttcaaaaaacaaatactccttttcgctttatgtgcagcggtttgtattttatattttacttctttttacgtgatcgaccatttcaatacaacgatttatcatgaaggcaaatttcacacgctcgcttctgttcaggatattcccgtaatagacggagaccggctttctttcacagccgaaacagatgagggagaagctttgaaagcgggatatacgctccggtctccacaagaaaaacgggcgctctcagctcttcagccgggcagcctctgtgtcatgcaaggtgaattaaaagagccgaaaaaagagacggttcctggcacttttaatcaaaaagaatccatgtatcaaaaagggattcactggatttttgcagttcagtctattacaagctgcaagccgggcggcggcctgatgccatctctattgaaaatcagaaaagcgggccttgattttatagaggaaaatatggcggactcggctgccggtattggaagagcgctaattttcggagaccggtttctcattgaacaagatgtcctggacggctatcagcgtcttggaatcattcaccttttagcgatttccgggcttcatgtcggtctgctctcagccgctctgttttacatatttattcgcttcggcgtcacgagggaatgcgcaaaatggctgctcgtgatcggccttcccgttgccgcagttttgaccggaggcgccccgtcggtgatgagagcggttttcatgtctgaaatctatctgctggcatcactgtctaaaaagaacttcaaaagtgccgatgtgatcagcattgcctgcctcggactgctgctgtatcatccttatctgttatttcaagccggattccagctttcttttgctgtatccttcgttttcattctttcaaaggagatattgaccaggccgaaaagccgaatctctcagctgctattggggtcatttttggctcagctcgcttccctcccgattctgctttttcattttcaagagttttcatttctcagcacattaatgaatctattttttatacctctttatattttcatcatcatgccgctgtctttcggaagcctgcttgctttcatatgttttcatcccttgggggaggcggcagccgccgttcttgaccgtctgcttgtgtggagccatcaggctgttaaaacggtgtctgccgcggatgtttcggtcttttctgcggctaagccgccggatcttttgttgtttttctacttcacagccatttttctgtttttgctgttgctggaaaaagagatgtcgcttcgtgcggtcatgattccgtccggcctgcttgctgctgtgtttgtgattcacgcatgtcttcctcagcttgcaggtgagggagaggttacaatgcttgatatcggccaaggggacagcatgtatgtcagcgctcccggtcagaatggcacggtcttcattgatacgggaggaaccgtatccttccggaaagagcggtggagaaagcggaagaaggatttttcattgggggagagcgtgttaatgccttttctggcaaccaaaggggtcaagaagctcgatgctttaattttgacccatgctgatcaggatcatatcggtgaagcgcatgtgctgatccaaaaacataaagtgaagcaattgatcgtgccgaaaggcttcgcagccgaaccgtctgatgaaaagctgcttcgccttgccttgaaggaaggcgtcgaggtgaatgtagccaaaagaggtgacatccttcatattggcaatcttgaattttatgttctttcaccgaaagaggcggacaaaaacagcaaaaacaatggttccctcgtattgtggatgaaagcaggcggattttcgtggctgttaactggagatttggagaaggagggcgaaaaggagatgatggaagtgtatccgaatcttaaagcggatattctgaaagtcggtcaccatggaagcaaaggttcgacgggtgaagagctgatcaagcaaattgagccgaaaaccgccctcatttcggcgggggagcacaaccgctacgggcatccccacggggaagtgctggacatcctaaaccgccacgatgtgaaggtgttcagaacggatcggcacggttcgattcagcacctatttcgaggcgggaacggaacgtttttgctacatcctccatatga

SEQ ID NO: 2307 - DNA, 1506 bp, Bacillus licheniformis
tcaaaaacgaaatttgacagatatgattcagcttctgaaagaagaccaagctttcagcaggcaaattgttcattggcatacaatcgagggaaaagaagcggattaccgcgattttcctgaaggtttagataagagaatcgtgcatgctttacagcaaagagggatagaaaagctgtattcccatcaggccgacgcatttctgcacagcgccgccggcaaaaacgtgacgcttgtgacgccgacggcatctgggaagacgctttgctacaatctgcccgtcattcagaggatcacagaagaccaagatgcgcgcagcttatacctttttcctactaaagcattgtcgcaggaccaaaaaagcgaactgaatgaattaatcgatgaaatcggtgcgtcgatcaactgttatacatatgacggagatacgtcgccttcgatcaggcagaaagtcagaaaagcgggccatatcgtgattacaaatccagatatgctgcattcggcgatcttgcctcaccatacaaaatgggtgtcattgtttgaaaatctgaaatacatcgtcatcgatgagcttcacgtatacaggggagtctttggcagccatgtagccaatgtcatcagacggctgatgcggattgctgaattttatggaagcaagccgcagtttatctgtacatccgcgacgatcgccaatccattggagctcgctgagacgctcacggggcagccgatgcacctgatttcaaacaacggcgccccgtcgggaagaaagcacttcttattttacaacccgccgatggtcaaccgttcccttaacatcagaaaaagcgcgacccttgaagtgagaaagctcgcatccgaatttctaaaaaacggcattcagacgattgtgtttgcaagaagcagagttcgggtggaaattatattgacatacttgcaggaagtgatgaagccgattgtcggcccgcattcgattcaggggtacaggggcggctatctgccgaacgagcggcgcgtcattgaaaaaggccttcgcagcggggacatcaaaggcgttgtcagcacgaatgcactcgaactgggcgttgacatcggacagctgcagacatgcatcatgaccggttatcctggaacgatctcaagcgcctggcagcaggccggccgcgccggaagaaggcacaacgaagcgctgattgtcatggtggcaagttccgccccgctcgatcagtacatcgtacagaatccggactatttctttaaacaaaatcccgagactgccgtcattaacccggacaacctggtcattctcgtcgatcatatcaaatgcgcggcctttgaactgccattcaaaagaacggacacattcggcggtatcgaaattgaggatattcttgactacttggcagaagaaagggtcctccacttaaccgggaatacgtaccactggatgaatgacgcttttcccgcgcacggcatcagcttaagatcggcttctcaggaaaatgttgt

SEQ ID NO: 2308 - DNA, 1295 bp, Bacillus licheniformis
ttgatcataaaagaagtcaatccgcattttgaagattatttgtttaactgggatcagacctttcaatttcttgtcggcggatacggttcgtcgaaaagctatcataccgctttaaaagtcgtattaaaactgcttcaggaaaagcggaccgctcttgtcgtaagggaagtgtttgaaacacacagggattcgacgttttctttattcgcatccattatcgatgagctgggtgtccaaaaggcggctcaggcggtttcttctccgatgcatatcaggtttgcaaacggcagccgaattatttttaaaggaatggacaacccggcgaaattgaaatccgtcaacaacatctcgctgatttggattgaagaatgttcagaggtgaagtatgaaggcttcaaggaactgatcggccggctgaggcatccttatcacaggctgtatatgatgttgacgacaaaccccgtcagccagtcaaactggacgtacagacactttttcaaggatgagcggaacaagcggttcattttggatgatgaggtcttgtataaaaagcgggtcgctgtcgtcggtgatacgtattaccaccattccacagctgatgacaacctgtttttgccgaaaagctacctcaaacagcttgatgatatgaaagcatatgatcccgacctgtaccggattgccagaaaagggcggtttggggtaaacggcaccagggttctgccgcaatttgaagtgatggagcatgaggaggtcatgaggcagatctccgccatttccaacccgctgaagagaaccggaatggatttcggatttgaggaatcatacaatgccgtcgtccgggcggccgtcgatcccgacaaaaaatatctatatatctattgggagtactacaaaaataaaatgacagatgataagacggccgaagaacttcacgaattcgcggttgcgaaggagctgattaaagctgatcccgctgagccgaaaagcattcagtttttcaggcagaatggttttaacatgacagcagcacgcaagttccaaggctcgcgcctgcaatatacgaaaaaaatcaagcggtttaaaaaaatattctgttctgaccgatgtgccaatacgatctacgaattgcagccgctgacctatgcgacggatcaagacggcaatctgaaggaggatcagtttacaattgatccgcacacgctttccgcgctatggtacgcgcttgatgattatgaagtaaccgatttgaaggctgagccggaagtgagaaaacggccgaacaggaaaagggggag

SEQ ID NO: 2309 - DNA, 1137 bp, Bacillus licheniformis
aaaagtgaaggtccttcttgcacaggccctgttcggaaaacccgacgtccttcttctcgatgagccgaccaaccacttggatattcaggcgatccaatggctagaagagtttttaatcaattttgagaatacggttatcgtcgtatcgcatgaccgccactttttaaataaagtatgtacgcatattgccgacctggattttaacaagattcaaatttatgtcggaaactatgatttctggtatgaatcaagccagcttgcgcttaaaatggctcaggaagccaataagaaaaaagaggagcagatcaaacagctccaagagttcgtcgccagattcagcgccaacgcctcaaaatcgaagcaggcgacatcgagaaaaaaactgcttgaaaaaattacgcttgacgatattaagccttcatctcgcaagtatccgtatgtacatttcgcacctgaacgcgaaattggaaacgatgtgcttgttgtcaaagacctgtcgaaaacgatcgacggcgtcaaggtgcttgactctgtcagctttatgatgaataaagaggataaaatcgcctttacaggccggaacgagctagccgctacaacgctctttaaaatccttgccggggaaatggagcctgacagcggatcgtttaaatggggcgtcactacatcccaagcgtttttcccgaaagacaacagcgagtattttgaaaacagcgatttaaaccttgtcgactggctccgccaattttcgccgcatgaccaaagtgaaagcttcctgcgcggatttttaggccggatgctgttctccggagaagaagtgctgaaaaaagcaagcgttttgtcagggggagaaaaagtccgctgcatgctgtcgaaaatgatgctgtccggcgccaatgtgctgatgcttgatgagccgacaaaccatttggacctcgagtccattacagcgctgaataacggtttaatcagctttaaaggcgccatgctgtttacatctcatgaccatcagtttgtccaaacaatcgccaaccggatcatcgagatcacgccaaacggaatcgtcgataaacaaatgagctacgacgagtttttggaagacaaaacggttcaggacaagcttgctgaactttacgc

SEQ ID NO: 2310 - DNA, 1353 bp, Bacillus licheniformis
atgatcagaggaattttaatcgcccttttaggtgtcgccatcgtcggaacaagctattggggctataaagaacatcaggagaaagacgccgttttgcttcatgccgaaaacaactatcaaagggcatttcacgacttaacttatcaggtggatcagctgcatgataaaatcgggagcacgcttgcgatgaacagcaaaaaaacgctgtctcccgctttggcggaagtctggaaaacgacttctgaagcgcataacaatgtcagccagctgccgctgaccttaatgccgtttaacaagaccgaagagtttttggcaaaggtcggagatttcagctacaaagcagccgtgcgcgatcttgacaaagagccgctcaataaaaaagagtacgcttctttaaatcagctatatgaaaattcaaaggatatacaaaatgaactgcgtaatgtccagcatttgattattgacaaaaatttgagatggatggatgtagaacttgcgctcgcgtccggccaaaaacaaagcgacaataagattattaatggctttaaaaccgttgaaaaaagcgcaagtgcattttcggatacggatttaggcgcgacagagatgacgaacacgaaaaaagagcagcaagggtacgaccatttacaaggcaaaagaataaccgaaaaagaagcgcgcaagattgcccaaaaattcgcccaggacaaaaattacaatatcaaagtatcgaaaagcggcaagaaaacgaacagggatgtatacagcatcagtatgcaggaccctgatcaaaaagcggatatttatatggacattaccgaaaaaggcggatatccggtttatctgattcaaaacaaaaaaattaaagatgaaaaaatcagcttaaacgatgcgtcaaacaaagcccttcaatttttgaaaaaaaacggctataaaacggaagacctgaagatggatgaaagctcgcaatacgacggcgtcggggtgttttcatttgttccggtccaggacgatgtctggctctatccggacagcatccgcatcaaggtcgcgcttgacgacggcgagattaccgggtttaatgcaaaggatttcttaatctcccataaaaaaagagacttgccgaagcccaaactaacgcctgaaaaagcgaaagcaagcctgaatcccaacgtaaaagttcaggagacgcgccttgctttagtcacgaacgagctttcgcaagaagtgctctgctacgaaattctcggcacgattgaaaacgatacattccgcatgttcatcaatgccaatgacggcacggaagagaaggttcagaaaatgaaaagcgcagaaccgatatacaacgacttgtaa

SEQ ID NO: 2311 - DNA, 1341 bp, Bacillus licheniformis
atgaaccgttttgtaaaaggaatcgttcttctttcgctagctgctttttttgcagaatgtcttgaattcgtcatcaacatgattcttgcacgggagcttggcgagcatggcatggggctctacatgagtgttttgccttccatttttttggtcgtggtgattgcgagccttgagctgcccgtatcaatatcgaagtttatcgccgagtccaacccgaagctgcacgaaagcatgctgaaacatgcattgcggatgactgcggtctgcacggttttctccacggcagccgcagtgatcattcttccatttattccggtttttgattcttaccaccctctaatcagaggacttgtgatcgggatgattcctacggttgcattcacatcgatcgcgagaggctacttcatgggcgttcagcaaatgggtaaaatcgcaacggcgaatgccttgaaaaaaatctttcagctcatcggcttgtttttattttttcaatggtattcctttgaattggatacttctcttctcatttcattgtttgtcctcgttgcaagtgaagtggtcgtgtttgtttatttgttttcgcagtttgttttggtcaggcgtgccgctcaaaaagggcagcagatccacttgcggagaaacgatgttttaaaacgcctgctcactgtttcgatcccgacgacggggctgcgcgtgtttcatgctgtgacaaatgccgtcgaaccttttttggtgaaggggacgctgcttgccgctggcgtatcaagaacatcggccatcgaccagttcggcatgctttcgggagttgcgatgacaatcggcttttttccggcttttatcgcccattcactgatggtcgtcatgatcccgagcatttctgaaagctacgcttacgggcaatacgaaagagtgatcaaacggattaaacaggcgatctttattacgctgttttacggcataccgtccgtcatggtgatgtatcactttgcagagccgctgacccatttatttttcgattcggtcaaggcgtcgttttaccttaaaatgttgtggccgtattttttattccacttttttgcgatgccttttcaggcctgtttaatcggaatggggttggccaaagatgctttttatcataacgtttgggccagtgtcttatcgtttttgatgatgtatgttctcgggtccatgcagactttgcagatgacggggatcattcttgcgatgaataccggtatgattttgctgacggcgctgcattatgtgacgatttgcaaggagctgggcgtcacgctttttttgacaaacaaatcccgatctccgagaattgaaagccgctga

SEQ ID NO: 2312 - DNA, 1359 bp, Bacillus licheniformis
atgagcgaccgcagaatgacagcaaagtgggcatccaaacttggatttgttctcgccgccgcggggtccgccatcggtctgggagcgatttggaagtttccctatgtggcgggaacgagcgggggaggcgcatttttccttgtgtttgtcctatttacgatactgctgggataccccctgcttttgggggaatttgtattaggccgaaaaagccaatcggacgctatcggcacctatcaaaaaatagcgccagggacgccttgggtgatcacaggctggatcggaatcgccgcctgcttccttgtcctgtcgttttacagcgtgatcggcggctggattttgctttatatcattaaagcagtaaccggttcattgtcgggtctcacgcaggccggatacggggagctattcggttcgatcatccaagatccgctgcagacactggcagcgcagcttgcgtttatcatcatgacgatcctcgtcgtggcgaaaggtgtgcaaaaaggaatcgagcgcgtcagttcgattatgatgccgctattatttattttatttattgcgctcgttttaagggctctgacgcttgagcatgcgatcgacggcgtgcgttttctgcttgtgcccgattttggcagcctgacgccgcaggcgattctttttgcgctcggacaagctttctttacactgacgcttggcgtatctgtgatggtgacgtacagctcctatttgtcaaagtcacaaaaccttccgaagtcggcgctgtcgatcgtgatcatgaaccttgccgtcacgctgcttgccggcttggcgatttttccggccgtcttttcattcggccttcagccggatcaggggccgactttattatttgcggttctgccggcagtttttgaccggcttccattcgggatgctgttttttatcggatttttgacggcctttttattcgccgccttgacttcggctttttcgatgatcgagatcattgttgcggccattacaaaaggcgaccaaacgaaaaggggaaaatggacgtggacgatcggccttttgatttttgccgtcggcattccttcctgcttgtcttacgggatgcttgatgagccgttcatttttaagaagacgttttttgatgcggcggattatgtcgtcagcaatattttgatgccgcttggcgcgctctttatctccatttttattccgctgaaattgtccaaacacgatctatatgaagagatgaaaagcggatcaaaagcggggaaaggcttttttatcgtgtggttttatcttcttcgtttccttgttccgcttgcgattgtacttgtttttttaaatttaatcggagtgttttcattttaa

SEQ ID NO: 2313 - DNA, 1398 bp, Bacillus licheniformis
atcaattgctggaagagatcgccgactatacggtaaatgccaagatttcaagcgaagaagcgattgaaaccgcccgttacgtcttaatggatacactgggctgcggaatattggcgctcaaatatccggaatgcgccaagcatctcggcccgattgccccgggtaccgtcgtcccgaacggcacccgcgtcccgggaacgcaatttgagcttgatcctgttcacggcgcctttaatatcggctgcatgatccgctggctcgattataacgacacatggcttgcggccgaatggggccatccgtcagataacctcggagcgattttagcctgcgccgactatgtcagcaggcagctgctcgcggcgggcaaggaaccgctcacgattaacgatgtcctgacggcaattgttaaggctcatgaaatccaaggcgtccttgctctcgacaacagcttaaacagaaacgggcttgaccatgtgctattcgtaaaagtcgcctccactgctgtggcatgctcactattggggggcacaaaacaggatgttatcaatgccgtctcccaggcctgggtcgataattcaagcctgcggacgtaccgccatgctccgaataccggctcgcgtaagtcctgggcagccggtgatgcgactagccgcggcgtgaggctcgcgatgatgaccttgaaaggcgaaatgggatataaaaccgctttgtctgctccaatgtggggttttcaggatgtcttattcggaggaaaagaattgacgctcgccagaccgctcgactcttatgtcatcgaaaatgtcctttttaaaatttcgtatccggctgaattccacgctcaaacggctgctgaagccgcgatcaggcttcaccctgaagtgaaggacagacttgatgacatcggccaaatcgtgatcacgacgcacgaatcggccatccggattatcgacaaaacgggagaattacacaatccggctgaccgtgatcactgccttcagtatataacagcgatcggactgatctacggcgatattaccgctgaccattatgaagacgaaaccgcgcaaaatccggagatcgacaggctgcgcgaaaaaatgacgacagtcgaaaacaaacagtattccgtcgattatctcgacccggaaaaacgctcgatcgccaacgctgttcaagtgttttataaagacggcacacactcggaaaaaatcgcggtcgaatacccgattggtcatcggcgccgccgcaacgagggcatcccgctcttaaaagacaaatttatcaataatttaaaaacgcgctttccggcggggcaagcggaacgaatcaacgccctgctgaatgatcctcacagattaagcggtgcacctgtaccggatttcatggaattgtttg

SEQ ID NO: 2314 - DNA, 1101 bp, Bacillus licheniformis
atggctttaacagctgggattgttggtttgcctaacgttgggaaatcaaccttatttaatgcaattactcaggccggggcagaatcggccaactacccgttttgtacgattgatccaaacgtcgggatcgtagaggtgcctgatgagcgtctgcaaaagctgacagaactcgtcaatccgaagaaaaccgttcctaccgcatttgaattcaccgatatcgcaggcattgtaaaaggagcatcaaaaggagaagggctcggaaacaagttcctgtcccacatccgccaagtagatgcgatctgccatgttgtccgctgtttcgccgatgacaatatcacacacgtgtccgggaaagtagatccgatttcggatatcgagacgattaaccttgagctgatactggctgaccttgaaaccgtggaaaagcggatcgggcgggtcggaaagatggccaagcaaaaagataaagaagccgtgtttgaatttgagattttgacaaagttaaaagaggcgtttgaacaggaaaagccggcccgctctgtcgagttctccgaagagcagcaaaaggtgttgaagcagcttcatctgctgacgacaaaacctgtcttatatgtagctaatgtcagcgaagatgaagtggctgatccttcaggtaacgagtacgttcagaaggtccgggaatttgcagctgctgaaaatgcggaagtcatcgtcgtctgcgcaaagattgagtccgaaattgcagagcttgaaggcgaagagaaggcgatgttccttgaagaactcggcattgaagaatccggtctcgatcagctgattaaagcgtcctactccctcctcggacttgctacttattttacagcgggagaacaggaagtcagagcttggacatttaaaaaaggaatgaaagcccctgaatgtgcgggcatcatccatacggactttgaacgcggatttatccgtgcggaaacggtcgcctacgacgatctgcttgaagcgggaagcatgaccgcagcaaaagaggccggaaaagtccgccttgaagggaaagaatacattgttaaagacggcgatgtcattcatttccgtttcaatgtataa

SEQ ID NO: 2315 - DNA, 1044 bp, Bacillus licheniformis
cttatgcttttacgaaatatctcctatctcttatcaaactgatgccgactgcccgaactggaaaactttcttggaaagtatttttatagatgaccagggcacgccaaactatgaaattattgatttcatgcaaaaggcaattggctattcgctgaccggggacaccacagaacaggtcatgttctttctatttggaaatggtcggaatggtaaatcaacttttatcaatactgttcagcacctgttcggggactatgggcggcagacaaacagcgacaccttcataaagaagaaaaatgacagcgccataaacaatgacattgccaggttggacggcgcccggtttgtgtcggctgtcgagagtgaagagggacagcagctgtctgaatcgttggtgaagcagatcactggcggagaaaagatgtcagcgcgttttcttcgccaggaatactttgagtttacaccggaatttaaagtcttctttaccacaaaccataaaccgatcgtgaaaggcagcgatgaaggtatttggcgccggatccggctgattccgtttactgtcacgattccaaaagaaaaagtagacaagaagctgccgcagaaactggctgcagaaatgcctgggatccttcgctgggctgttgagggctgtttgaagtggcagaaggaaggcctgggagaaccggaagcgatcaagaaggcaacagatggctatcgggaggatatggacattctcggtccattcatggaagaaagatgcatccaacatccgaaggccaaggtagaggccaaggagctctataaagattacaaagactggtgttttgaaaatgacgaaattgaactgaagaaccgggctttttatcggcaactcgaaattcgtggatttaaaaaatatcgcggcaactataacaaaaattattttgatgggatcggtttaataaaagaaaaccgagatttgcataagcaattaaatcctttgaaacagaggcagaatccatcggaattaaaaagtaatgtcacaagtattcaaagaaaaaaatt

SEQ ID NO: 2316 - DNA, 1080 bp, Bacillus licheniformis
ggtaaaagaagtcaatccgcattttgaagattttctctttgactggaaccaaaaatttcagctgctcgttggcggttacggatcatccaaaagctatcacattgctctcaagctcattttgaagcttcttgaagaaaaacggacagtcttagtcattcgtgaagtgtacgacactcatcgggattctacattctctcattttgaagggatcatcaatgacttagagattgatcatattgtgaggtgtatgacatctccgatgcaagtcaggttcccaaatggcagccggatcatcttcaaggggctggacaaaccggccaaactgaaatcgatcaacaacatctcaataatatggattgaggaatgttcagaggtcaaatatgaaggctttaaagagcttctcggccgtctgcggcatcctacactgccgcttcatatgattttttccacgaacccggtcggggaagacaactggacatacaagcatttctttaaagacgatctgaacaatcgatttgtcctagatgataaggagctgtacgaaaagcgaacgatcgtcttaaatgacacatactatcatcattccacggcggaagataatttgtttctgccagaaagctatgtaaggcagctggatgaactgaaagaatacgatccagacctttaccgcatcgccaggaaaggtcattttggcgtgaatggggttcgggtttttcctcagcttgaagagtggccacacgatgaagtaatgcaggccgtctcgaacattgactgccccatcaagcgggtaggaatggactttggttttgaagaatcctataacgccgttgtccggcttgcggtggatcataagaaaaagtacctctatatctattgggagtattacaaaagaggaatgacggatgacaggacagcagaggagctccaagaatttaagaacacccaagagcttatcaaagctgattcagcggagcctaaaacgattcagtatttccggcagcagggtttcaatatggtgggagctcataagtaccagggttcgcgcctgcagtatacgaaaaagaacaagcggttttaaaa

SEQ ID NO: 2317 - DNA, 1378 bp, Bacillus licheniformis
atggataccatcgctgcgatttcaacgccgatgggagaaggggcgattgcgatcgtccggatgagcggccctgaggctcttgcgatcgccgataaagtgtataaaggacctcgcggaaaaaggctgagttccgtcgattcacatacgattaactacggtcatatcgttgatccggaaacggaaaaagtcgtggaagaagtcatggtttcggtactgaaagcgccgaaaacttttacgcgggaagatattgtagaaatcaactgccacggcggacttgtgactgtcaaccaggtgcttcagctcgttttgagagagggagcgcgtctggcggaaccgggagaatttacgaaaagagcctttttgaacggaagaatcgatctttcccaggctgaagctgtcatggatctcatcagggccaaaacagaccgggcaatgaatgtggccatgaatcagatggaaggaaggctgtcttcactgatcaaacggttgagggccgagattcttgaaacattggcccacgttgaagtgaatattgactatccggaatacgatgacgttgaagaaatgacgcacaagatgctgattgaaaaagcgacaaaggtcaaaaaggaaatcgaggcgctgctgacgacttcagagcagggtaaaatattaagagaaggcatctcgacagttatcatcgggcggcccaatgtcggcaagtcctcgcttttaaacagtctcgtccacgagacaaaagcgatcgtaacggatattccgggcacgacgcgggatgtcattgaagaatatgtgaatgtcagaggcgtgccgctgcgtctcgtcgatacagccgggatccgcgagaccgaagacatcgtcgagcgaatcggcgttgaacgttcaagacaggtattaaaagaagcagatttgattttgcttgtcctcaattacagcgagtccctttcagatgaagacatcaagctctttgaagcaacgaagggaatggacatcatcgtcattgtcaataagaccgatcttgagcaaaagcttgatcttgatcgggttcgggaattggctgggaatcagcctgtcgtgacgacttccttattaaaagaggaagggattgatgagctggaggaagccattcaatcgctgtttttcacaggcgcgatcgagagcggcgacttgacatatgtcagcaatacaaggcatatttcactgctgcatgaggcgaagcgcgccatcactgacgcattggagggcatcgaaaacgatgtgccgatcgatatggttcaaattgatttaacaagatgctgggaagttcttggggagatcattggcgatgctgtacacgaaagtctgatcgaccagctcttctctcaattttgcttaggaaaat

SEQ ID NO: 2318 - DNA, 1035 bp, Bacillus licheniformis
atgaaactacgcattggtgttattggtacaggagcaatcggaaaagaacacatcaaccgcatcacaaataaattagccggcggcgaaattgtcgcggtcaccgatgtgaaccaggaggcagctcagcaagttgtaacggactacagcctgaacgccaaggtctatccggatgacgacagtctaatcgcagccgaaaatgtagacgcagtcttagtaacaagctggggaccggcacatgaatcaagcgttttgaaagcgattaaagcaaacaaattcgtattttgcgaaaagcctctggcgacgactgcggaaggatgcatgcggatcgtcaatgaagaagtcaaagcgggcaaacgtctcgttcaagtcggctttatgcgccgctatgacagcggttacgtacagctgaaagaagcgatcgacaatcgggtcatcggcgagcccctcatgatccactgtgcgcaccgcaacccggttgtaggcgacaactatacaacagatatggctgtcgtcgatacgcttgtccatgaaatagacgccctgcactggctgattaatgatgactacgaatccgttcaggtcatttatccgaaaaaatcgaaaaacgcgcttcctcatttgcgtgatccgcaaatcgtcatcatcgaaacaaaaggcggagtcgtgatcaatgcggaaatctatgtcaactgcaaatacggctacgatatccagtgtgaaatcgtcggcgaggacggaatcgtgaagcttcctgaaccatcaagcatctctctcagaaaagacggcaaattctcgacggatatcctcatggattggcagcgccgctttgtagacgcttacgatgtagaaattcaagatttcattgactcgatccaacagaaaggcgaggtcagcgggccgactgcgtgggacggctatatcgccgccgtgacgacggacgcctgtgtgaaagctcaggaatccggacagaaagaacctgtggcgcttcaggagaagccggaattctatcaaacgttcacaactgttaaaaaataa

SEQ ID NO: 2319 - DNA, 1221 bp, Bacillus licheniformis
atgattcaggtgagtcaagacagcataaaaaaaacagacggaagcgtcgcttcgcctaagggctatcttgcaaaaggggtccactgcggcctccgctattcaaaaaaggatcttgggatcatcatcagctcaagaccggcggtgagcgccgccgtttatacccaaagccactttcaggctgcgccgatcaaggtgacgcaggaaagcctcaaaaaaagcgcgcatctccaagccgtcatcgtcaacagcgccaatgccaacgcatgcacgggagagcagggcttaaaagatgcttatgaaatgcgccgtcaaagcgctgatatgctcgggatcgagccggatctggtggccgtgtcctcaaccggcgtcatcggcgaatacctcaatatggaaaacatcacaaaaggcatcagccttctcgccgagacagagcctgccgaaggcgatttcgaagaagcgatcttaacgacggacaccgtgatcaaacaaacgtgctatgaactgatgatcggcggccaaaaagtgacgatcggcggagcggccaaggggtcgggaatgatccacccgaatatggcgacgatgctcggctttgtcacaacagatgcatgcatcgaagaaagcgcgctgcaaagggctttaagggaaatcacggacgtttcgttcaaccagataacggtcgacggcgatacatcgacgaacgatatggtgctcgtcatggcgaacggatgcgccggaaatgagcgcctccatgaagaacacgaagattggccggttttcaaaaaaggcctgcagcttgtctgcacagacctcgccaaacaaatcgcaagagacggggaaggggcgacaaagctgatcgaggttgaagtgaacggcgcgaaaagcaatcttgaagcgcaaatcatcgccaaaaaaatcgtcggctcaaaccttgtaaaaaccgcggtttacggaacggatgcgaactggggcagaatcgttgtcgcaatcggggacagcatggctgctgtgacaccggagaaggtggaaatccgcctgggcggccaatgcctatttaaaaacaacgaaccccagccgttttcggaagagctggccaaaacatatttagaaaacagcgaagtgaaaatcgaggttttcatgcaggaaggtgaaggaaagggtacggcttggggctgcgatttaacttatgaatacgtcaaaatcaatgcgagctatcgtacgtaa

SEQ ID NO: 2320 - DNA, 1089 bp, Bacillus licheniformis
atgttaaaacgaatagttcaagcgttctttgcgattttgggaggcgttatcggtatttttctcataccggaattgtttgtactgttaaatgtacaggacatacctttagtaacaaacccgtatgcgtctgcttgtttaggagctatcatcttttttcttctgggcatctggtgtgcggatcacgtcatcaactgggtgaaacagattgaggattccttgatcaaagcacctgtctcagacttgttgttcggctctttgggattaatcttcggacttatgctcgcttatcttatcgtcaacgtcattccgttaaaagacatcccttatcagttaatcagcacggtcattccgattgtgttggccgcatttctcggctatctcggattccgtgtgggtttcaagaaaaaggatgaaatgctgacactttttacatcgagaaagaaaaaaggttctgctgaggaagagcgtccggaagaagacaaaaagctgaaaattttagacacaagtgttattatagatgggagaattgctgatatttgtcagaccggatttcttgaaggcgtcattgtgattcctcagtttgtgcttgaggaactgcagcatatcgccgactcttcagacgtcctcaaacgaaacagagggcggagaggactggatattttaaaccgtatccagaaagagcttgatattaaagttgaaatttatgaaggcgattttgaagacatccaagaggtcgacagcaagctcgtcaaactggcgaagctgacctcgggcgttgtcgtcacaaacgatttcaatttgaacaaagtatgcgagctccaaaaggttgccgtattgaacatcaacgaccttgccaacgccgtcaagcctgtcgtgcttccgggagaagaaatgaaggtgcaggtcatcaaagacggaaaagaacataatcagggcgtggcttatctggacgacggcacgatgattgtcgttgaagaagggcgaaattatattggcaaacatatcgacgtgctcgtgaccagcgtgctgcagacagcggcaggcagaatgatattcgccaagccgaaactgctggaaaaggcgctttga

SEQ ID NO: 2321 - DNA, 1136 bp, Bacillus licheniformis
atggactctttgcatatgtggggcggcaggtttaaaaagttttttttagacaataaattcgtcctgtttctgcttattctgcttttgatcggactgaacatccttgtatttacaaaagcatcgtttattttcacgcctttcatcgttcttgtggaaaccatcgctctgcctgtcgtgctgacaggtgtcgtttattatttgttaaatccgatcgttgattttctagagtggaaaaacgtgaaaagaatttattcgattcttcttctctacattgtgatcatcggtctgatcacgatttcgatcgtctctgttatcccgctgttaagggaacagatcacaagccttgtcgataacttcccaaggtatgtccacattgtggaagaccaaattaaacagctgatcggaagccagttctttaatcaggtccagcagacgatgaacatcaatctgaccgatttggcaagcaaattatccgatcaggctaccaccattttaaacagtacgtttaccggtgtgggaacgttcataggcgccgtgacagaggtcgtgatttcgattgtgaccgtgccgtttatcctgttttacttgttgaaagacggcaaaaaactgccgctgtttattctaaaactcataccggtccgcctgcgggagcagacgtatgtgatgatgtccgagatgaatcaccggctgagttcgtatatcagggggcagatcatcgtcagcttctgtatcggctgcctgttgtttatcggatatatgatcatcggtcttgattatgcttctcttttggcccttgtggcggcgtgtacgagcatcgttccgtatctcggaccgacgattgcgattacgccggcaatcatcatcgctttggtcacttctccgtttatgcttgtgaagctgatcatcgtttggactgtggtgcagctgtttgaaggaaaatttatttcgccgcagattatgggaaaaaacctgcacatccatccggtaacaatcatctttgtgctgctgacggcagccaagctgttcggcgtgatcggcgtcattctcgccatccccggatacgcggtcatcaaagtggttgtcacgcatttatttgaatggtttaaacagcgttcacacctttacgaaaaaaacga

SEQ ID NO: 2322 - DNA, 1290 bp, Bacillus licheniformis
attggagttattgaagctgattgcagtagcaggattaatcgcatttacgggctttttcgtcgcggtcgaattcgccatcgtcaaagtaaggcggacaaagatcgaccaattgatcattcagaaaaaaaagggcgctcttgccgcaaaagaagtgacctcgcaccttgacgaatacttgtcagcctgccagcttggaatcaccgtgacggcattgggcttgggctggcttggtgaaccgacgatgcagaccttgctgcatccccttttctcaaaaatcggcttgaacgagtcgattacacatattctttcatttttggccgcttttttatcagttacttatctcaatgttgtcgtcggagagctggcgccaaaaacgatcgccattcaaaaagcggagaccgttacgctgctttttgcacagccgatgatctggttttatagaatcatgtttccttttatatggctgctcaatcattcagcccgcatgatcacaagtctgttcggcctgaagccgaccggtgaacacgaattggcctattcggaggaagaactgcgaacgcttttatctgaaagctatcgaagcggggagattaaccaaaatgaattgaaatatgtaaacaatatttttaaattcgacgaacgtacggcaaaagaaattatggtgccgcgcaatgaaatgaccgtcttatctcttgacgacagtttaaaaaaagcgaagcagcttatcaaagaaacgaagcacacccgcttccccgtcatggaggaagacaaagatcacatcaccggaatgatcaatataaaagaactgctgctggcggagcttgcaggggaattttctttagaaacaaaatcgctaaagccatatatccatccggttatccatgtgattgaaacgattcccgtctaccagctgttcgtcaaaatgcagaaagagcatacacatatggcgattctcgtagatgagtatggcggaacatcgggtcttgtgacggttgaggatattgtcgaggaaatcgtcggcgacattcgcgatgaattcgatactgaagaagtatctgctgttcagaaactcgaagatgaccattacatcctaaacgcgaaagtactggtcagcgacgtaaacgacctgcttggaattcatttatcagatgaggagattgatacaatcggcggctggatgctgacgcagaatattgagagcaagcccggaacgacgatcgaaagtgaaggataccgttttaaagtaaaagaaatggacggacatcgaatcgttgcagttgaggttgaaaa

SEQ ID NO: 2323 - DNA, 1077 bp, Bacillus licheniformis
atggacaaagacaaaaaaggagcgaaacaggatctttcagaaatattgcagtttgtcgcccccggcacgcctcttcgcgaaggaatcgaaaacgtccttcgggccaaaacaggcggattaatcgtggtcggcttcaacgataaagtgaaagaagtggttgacggagggttccacataaattcttctttctctccggctcatctgtacgagctggctaaaatggacggggcgatcattctcagcgattcagggcaaaaaattctatatgccaatacacagctcatgcctgaggcgacgattccctcctctgagacgggcatgagacacagaacagccgagcgtgtggccaagcagaccggctgtctgatcatcgcgatttctgaaagacggaatgtgattacgctctatcaggaaaatatgaaatatatactcaaagatatcggctttatcttaacaaaagccaatcaggcgattcagacgctcgaaaaatacaaactcattttggaccatgcgatttccaatttgaacgcgctggaatttgaagagcttgttacatttggggatgtcatctccgttctgcatcgatatgaaatggtgctcagaatcaaaaacgaaattaatatgtatattaaagagcttggaacagaaggccatctcatcagactccaggttagcgaactgatcaccgatatggagcaggaagcggcgctgttcgtcaaagattatgtgaaagaaaaaatcaaagacccgtttgttctgctgaaacagcttcaggatatgtcgagtttcgaattgctggatgatgcgattctccttaagcttttaggctattcagcaactacgaacatggaagaatacgtttttccgagaggctacaggcttctccacaaaattccccgcctcccgatgccgatcgtcgaaaatgttgtcgaagcattcggccatttaaagctcattatcgaagcggatgtaaaagatttggatgaagtggaaggaattggggctgttcgtgcccaaaagataaagaaagggttaaagagacttcaggagaaacattatactgacaggcagctgtga

SEQ ID NO: 2324 - DNA, 1265 bp, Bacillus licheniformis
ttgaatacttctattcaagaagccataaaattagttgaagcaggccacccggaaagcggattgaaaaaacttgctgatatcgagtctgaccttcatgatgaagacaaagccatagtagcccagctgtattacgaatggggaattgtcgataaggctatcgccatcgtgactgacctccatgaactgtatccggatgaaacagaactgacatgcttttatgccgaactcctcatcgaaaccgatcaggaagaaaaagcgctcagcgtgctcgaaacgattccggaaacagacgaggcgtacccgcagtgcctgcttttaatggctgatctctatcagatgcagggtctgtttgaagtcagcgagcaaaagctgttaaaggcgcaagccattttgccggatgagccggttatcgattttgctttgggagagctgtattttactcagggagcttacggcaaagcggtccgtcaattcaaaaaagcggccgaagaagaagccgtcatcggcggcgtcaatgtgtaccaaaggctggcggaatcattaagttcatccggagcgtttgaagaagcgcttgaatggtatgaaaaagccgtcaaggagaaccccgagcccaacacactgttcggctttggttttacggcactgaaagcggggtatcctaaaactgcgattaaacagctgacagagctgaaggaaatggatcccgcttattcttcgctttacaagcctctggccaacagctttgaaacagaagggctttatgaggaagcattcgaaacggcaaaagaaggaatccgtgtcgatgaattcaacaaagagctttatctttctgctgcaaaagcagccttaaaaacgaaaaggcattcggaagcgaaggagctgcttcgtgaagcgctggcgctggatcccggatatctggaagccgttcatacactgcttgccctgtttcttgaagaagaagacgatgagagcatcattgaactcgttcgggaagtgcgcaaatacggagaggatgatccgaagttcagctggcatctggcatcggcgttcgcccggaccgaagcgtacgacaaagcccgcgaggaatatgagaacgcatttttgcactatcgggatgacgccgatttcctttacgaatattccatgtttctgcttgaagaaggacggcggaaagaagcgctgcctctgctgaaaaaactggcagagctcgacccggcaaacgaggaagtccaggagacgattttcagaatcgaagatgaaaattc

SEQ ID NO: 2325 - DNA, 957 bp, Bacillus licheniformis
agaacaacccttttccatatacgaacagtgaaaaacgatatcatacatggaattatcatttaagaaatcatttcggtcataaagtgtttaaagtcgcccttgacggaggctttgactgcccgaaccgcgacggtacggtcgcacacggcggatgcacattttgcagcgccgcagggagcggagactttgcgggaaaccgcgccgacgatctgattacccaatttaatgaagtgcgcgacagaatgcatgaaaaatggaaagacggcaaatacatggcgtactttcaagcatttacgaatacgcacgctcccgtcagcgttcttcgcgaaaaatacgagaccgtcctcggccttgacggcgtagtcggcctttcaatcgctacccggccggattgtctacctgacgatgttgtcgaatatcttgccgagcttaatgaacgcacatacctctgggtggagctcggccttcagaccgttcatgaacggacggctgatttgatcaaccgcgcccatgatttcgactgctacgtggaaggcgtgaacaagctgaggaaacacggcatccgggtctgctcccacatcattaacggactgcctctcgaagaccgcggcatgatgatggaaaccgcaaaagccgtcgccgatttggacgtgcaggggattaaaatccatctgctccacctgttaaaagggacaccaatggtgaagcagtatgaaaaaggaaaattaacgttcctttctcaagatgaatatgtccagcttgtttgcgatcagcttgaaattcttccgccggaaatgatcattcaccggattacgggtgacggaccgatcgaattgatggtcggaccgatgtggagcgtcaataaatgggaagtcttaaacgccatcaacggggaattggaaaggcgcggcagccatcaggggaaatggttcaacaaggcgaaagaaggcatggcca

SEQ ID NO: 2326 - DNA, 1680 bp, Bacillus licheniformis
cttgtgcatggccgtttcgctcatcctgatcttgagcggcattcaatacgcgttccgggtatatgaccagcagatttacaggaagtcgtcacaggtgctgatgctatcatcaaaaagcattgaagatgaattgaaaaagattgaggatgtgtcatatcaaatcaccactgacgcagacatccaagcgaacctcctgaaagccggccgcggccagaacaaatacggacgctaccggataaaaagcaaaatttgggataagctggccgaatataccggctctaagcggtacattaaatcgattcatttgtttgatgcttccggcaccgagtactccgcaggggcgaatttaaccgaagcattgcgggagcaaaagaatgcactgatcgaaaaagcgtcgcgccaaaaaggcagcaacatgtgggagcccatgccgggtgaaaccggcgagctgttatccgtccgggaaatccgctcctatgagcgtttaaaccttgaccacctgggaacagtggtgattgtcgccgatttaaaacgggtgatcggcgatcttccgaaagactggggggaaggcgcgggcaagattgcgatgtcggacgggcgggagctgtttttttctgaaatgcctttcagccaaaccgatggcctccgattgtcttctcatgctgaaaacggatatgacattgtggaggaaaacggccagcggtttttcgtttcatatgtcaaatcagcgtataagaattggacatattggagcctgatcccctttgacgctatgttttcgaaaatttctgcgatgaagacgatcctgatttccctttttatccttttttttctgattgcggttctctttggaagaaaaatggccaggggcattacgagcccgattgagaagctggtggcggccatgaaaaatgtccaaaacggcgattttaaactggcgccgctcactcgcgctcctttagaccggcaggatgaagtcagcgtcttaaaccgcaatttctttacaatggttgaacggatcaatgaactgattgccgagaactacaagaagcagctgatgctgaaagagacggaattcaaagcgcttcaagcgcaaatcaacccccactttttatacaacacgctcgagtcgatcaactggcttgcaaaaacgaaccggcagccgcaaatttcaaagatgacggaatctctagggtttttgctcagaaatgccatcaatatgaaaaccgacgtgctgacgatcgaggaagaagctgaaatcgtgcgccactattttacgattcagcggtttcgctttgaggagcggctcgtttttgagctcgacattgagccggctgtgaaaaaatgccgcgtacctaagcttgttctccagcctttggctgaaaacgcgattacatattgccttgagcccttcattgaaccttgccatattcaaatcaaagcatataaaaaagaagagcttgtctatttaacggttgccgacaacggccccggcatggatgaagactttttggaaaaggcgagaaaggagcttgtccggacaaccgggagaggaatcgggctgcaaaatatcgacgagcgcattcagctgatgtttggcaaagggtatggcttgacgatttcaagcgaaaagaataagggaaccgtgatgatgattaaaataccatttcaaagcggggt

SEQ ID NO: 2327 - DNA, 1056 bp, Bacillus licheniformis
tcgggctcttaatcgcgacgacagccgtcgctgctgcggtgggtatcgcgtccgcgcttgctttcgacctgcaggccgtccatgtggaccaaggccaggcggagacaatgagaggggcggaactcgaacagaaatcgcaggacatggaagccaaaacgcttccgcagcaaattgtcgagcttcttcctggaaatccgtttttagactttactggagcaagaccgacatcaacgatcgcagttgttatttttgcggctttccttgggatcgcttatctcggggtcaaccgaaaacagcctgaacaagctgaacttttcaaaaaaatggttgatgccgtgtatgcgatcattatgcgtgtggtcaccttaattctgaggttgacgccttacggtgtattggcgatcatgacaaaaacgattgcaacgagcgacctcgacagcattgccaaactcggcaaatttgtcatcgcttcatatgcggcgctgatcgtcatgttcatcattcacctgctgctcattacattcagcggtttaaatcctgtcacatacttgaaaaaggcgtttccagttcttgtattcgcgtttacatcaagatcaagcgcaggcgctttgccgctgaacattaaaacgcagcgaagccttggtgttccagaaggcattgcgaactttgccggatccttcggactgtccatcggtcaaaacggatgtgccggcatttaccctgcaatgctcgcgattatgatcgcgccgactgtcggccaaaatccgcttgatccgtcattcttgttcacggttatcgcagttgttgcgatcagctctttcggagtggcaggcgtcggcggaggtgcgacctttgcagcgcttctcgtcctttcggcattaaacatgcctgtagcgcttgccggacttctgatttctgttgagccgctgatcgacatggggcgtacggctctcaatgtcagcggcagcatgacgtcaggacttgtcacgagcaaagtgacaaatgagcttgaaaaagacacgtaccaagaccgtacaaatatcattgaagcagaag

SEQ ID NO: 2328 - DNA, 1032 bp, Bacillus licheniformis
gtatgcgctcgaagcttcgttgtccaaagaagcggtcattcgccagcgtggactcagagcgtagcattataacgaaattcaagatgtttcactgacggacgatgactttttgaagattctgcacggcatcggggaaacggattcactcatcgtgaaaatcgtcgacatctttgatttcaacggaagctggatcaacggactgaaccgctttgtcggaggtaatccgatcttattaataggaaacaaagcagatattctccctaaatcagtcaagcgcgagcgccttgtaaactggatgaagcgcgaggcgaaagagcttggcttaaggcctgttgatgtgctgctcgtcagcgccgggcgcgggcaggggatgaaagatgcgatcgacgcgatcgaacattacagacaaggcaaggacgtgtatgtcgtcggatgtacgaacgtcgggaaatcaacgttcatcaaccggattattaaagaggtttccggagaagacgacattatcacgacatcccaatatccggggacgacgcttgatgcgattgaaatccctctggatgatggatctgcgatgtatgatacgccgggaatcatcaaccatcatcaaatggcgcactatgtcgcgaaacgcgatctgaaaatattgacgccgaagaaggagctgaagccgcgcacctttcagctgaacgaggaacagacgctgtttttcggcggattatcgcggtttgattatgcaagcggaggcaggtcttcgtttgtatgctatatgccgaatgaactcaagatccatagaacaaagcttgaaaacgcggatcagctgtatgaaaagcacgctggggaaatgcttgctccccctgcaaaagaagatcttgactcgtttccggcgcttgtcaaacatacgtttacgattaaagagccgaaaacggacgttgtgttctcgggccttggctgggtaacggtccagggggcaaaccaaaaaattgtcgcccacgcccctaaaggcgttcacgtgtttttgcgcagatctctaat

SEQ ID NO: 2329 - DNA, 1116 bp, Bacillus licheniformis
ttgccaaatcgcaacagcgtgtgcttgcctgctttcagacagcgccaatgcgagaagccggatatacgctttcagaagcactcgttgtcggagagatatcggatttgatgtacaacgccgaaaacagcgtgattattgcgtgtttcgcgtctaactttaaccggattcagcaggtgattgatgccgcgctgcaaaacggcaggaagcttgcagtttcagggaaaaatatttcggcgatactccagctggcgatgaaactcgggtatgtcacggcagatgaagatatgttcatccctgtccaagaagtcaaaaagtatccaaaaagagaagtcgcgattttgacaggggacaaccatggagagccgctcgccgcattgaccaggatcgcaaaacaagggcataagcagcttgacattgaggaaggggataccgtcctgatcgcatcctcccctatcccgggtcaggagcttgtttactccaaagcggtcgatctcttaacgagagcgggcgcccaggtcgtattcgcacaaaaacgcgtccatgtatcaggccatggctgtcaagaagagctgaagctgatgctcaacttgctgaagccgaagtatttaatccccgtaaacggtgaatacagaatgcaaaaagcgcattccaagcttgccgaagaaatcggcatgaaacggagcgacattttcctgattgaaaaaggagatgtcgtggaattccgcggacaaaacgttaaaatcggcgataaagtacactcaggcaatatattgatcgacggactcggcgtcggcgatatcggcaacatcgtgctcagagaccgccgtctgctatcccaggacggaatcttaattgttgtgattacccttgataaaaagaaaaaacatctagtttcaggacccgaaattatcacgagaggttttgtctatgtcagagaatctgaacagctgatcgttgaagcgacagagcttgtcagggaactcgtcaacgaaagcacagaaaacgccgtcgtcgaatggtccgccttaaaacagacgatgcgtgaggcattaaaccagttcctatacgaaaaaacgaaacgaaaaccaatgatcattccaatcatcatggaagtat

SEQ ID NO: 2330 - DNA, 1140 bp, Bacillus licheniformis
taaactgcgatcgattttaacaatgcttggaatcattattggtgtaggctccgttattgtcgttgttgcagcggggcaaggaggagagcagatgctcaagcagacgatcagcggacccggcaacacggtcgaaatctattatcagcccagcaatgaagaattaaccgccaatccgaacgcctacttagacgccggcttcaccgaagaagacatcagaagcttaaagtcactcgaaggcgtgaaacatgtcgttgcgaaaacaaccgagtccatgaatgcccgcttccgggatgaaaatacggatgccgctgtaaacggcattaatgacggatatatcagcatcaattcgatggaaatcgaaaagggaagagaattttcagaagaggattaccttgctggaagcagggtcgccattatttcgccgaagcttgcggaagaactgttttctcagcagtcgcctctcggccgtgtcgtatggataaatagccagcctgttgaaatcatcggcgtattgaaagaagaaaccgggctgcttgcattggggatgaatgagatgtatgttccattttcaatgttaaaatcgtccttcggcatcagcgactatgactctgtctccgttcaagctgagtctgccgacgatctgcaggccgtcgggaagcgggctgcagcggccgtcaacaagaatcacggcacttcggactcgtacgaagtgatgaacatggaggccatagcggccggaatcagccagattacaacaattatgacgatgttcatcggttcaattgcaggcatttctttactcgttggggggatcggcgtcatgaatattatgctggtgtcggtcactgaacggacgagggaaatcgggattcgaaaatcgcttggtgcaacaagaggccagattctgatgcaatttttaatagaatcgtctttaattacactgatcggcggggtgtttggcatcggccttggatacggcggtgcagccctcgtatcgttttttgccgggtggccgccgctcgtttcctggcaggtggtcctcggaggcgtcctgttcagcatggcgatcgggattatctttggactcatcccggccaataaagcggcccgccttcatccgattgatgcattgaggtatga

SEQ ID NO: 2331 - DNA, 2879 bp, Bacillus licheniformis
  misc_feature (1)...(2879): n = A,T,C or G
atgagaacgattataaaggcgagatggatcattgcggcgctctggattgcaatggccgccgtcttattcatcacggcgcccgatatggggcaattaacaaaggagaagggccagatagcggttcctgaaggctatccgtcttcttatgcgaacaagcttctcgaacaaatgtcaaaagacggggatacgaacaaatcggttgtcgtcgtatttcaggacaaacacctcctgccgaatcgggaggcggctttaaaaaaagcgatcaccactttagagaaggattcctcccttcacgtctcagatattacatcgtactttaacgcggatgaggatattcaaaagcagctgttgtcaaaggatcgaacgacgctgctcgtgcctgtcacatttgatgcaaacaaaatcagtgcggccgaatttaaagcaaaggtcaatgaaaagcttaaaactttaaaacttgactacgagatgaccgggcagccgctcatcgatgatgatgtcatgacaagctcgcaggaaggcttgaagaagaccgaatatatcacggtcggttttattttaatcgtgctgattctcgtattccgttctgcggttgcgccttttgttccgcttttggcggtcgcgctttcataccttgtgagccagtccgtcgtcgcctatctagtcaaatacgctgattttccgctgtccacgtttacgcaaatctttatggtggcgatcatgttcggaatcggcacggattactgcattcttcttttaagccgttttaaggaagagatcgcccgcgggaaagacaagatcgaagccattctgacaacgtataaaacggcggggagaaccgttctgttcagcggaatcgccgttttgatcggttttacttgcatcggctttgccgaattccagctttacaagtctgcggtcgcagtagcggtgggtgtcgcggtcttgattttggcgcttctgtcgatcgtgccgtttttcatggctgttttggggaaagtgctgttttggcctgtcagaggaaatatcgggcacccgcagtcaaagctatgggaaaccgccggccgtttcgctttcagtaagccgctgatcagcctgttgatcgtagcggccgtggccgtgccgccgatcttgatgtataaaggaacgctttcctacaacagccttgacgaaatcggagatcaatacgaatccgtcagcgcatttaacaccatttccgacaagttcgggccgggagaatctttgccggtcacggtcgtgctcaaaacatcggatgcgctcgataccaatgacgggctgatcgcgattgaaaaaatcagccgcgccattgaacagacaaacggcgtcagcaaagttcgcagtgcgacccggccggtcggaaaagggctgagcgacctgtacgtcaaaacacaggcgaacgagctgaataaaggccttgaaagcggcaataaaggtctgaaaaagattaaagacgggcttgcagaagcgagcaagtcaatcgcggatcaaaagccgcaaatcgaagcgtccggaaaaggaatcaaccagctgatcaaaggaaccgaatcgatccaagccggaatcagcgacgttgaagccaacatgagaaagctgaaggaaggaacagaccaaagcaaacaaggcgtcgcccaggcgaaaaaagaaatccaaactgcgaaaaaacagctgacggcgcaagtcgatcaattaaatggacaaatcgaaacctacaaagaaatatcgaaaatcttaaaagcggcattgtctcaagccgaaaatgcccaaggcataacggctgacgtgcaaaagatgattgagcagacaaatcaaaatttcaaaaatcttgaaagcgaaattcccgaagtgaaggagaatccttcttatttggcgatcaaaggctcttacacagagcttgcatcggcaatcaagcagggatcacagaaagcggccgtttacacgaagcaggcggcaaacgcgaaaaagcagcttgaagcagcagatgcatttatcgcaaaagcgcaggaagagcaaaaagtgtacacaagcaaaatcgatgctctgataaacggcctcggccaaatcgaaaaagggcttgaagagacatcgaaggggcagggacagctcgccgattcgctgcctaagctcgaatcaggcgcaggtgaggtcgctgaaggccaaaagcagatgaaggaaaaagtcggagaattcgccggccagctcgatcaattaacaaaagggctgaattcaagcgtggacggcctcgaaaaaatttcaagcggtctgatgggagcaggcgactacctggatcagctgaaaaacgcatcggatcaagaaatgtccggctggtttgtccctaaagaagtgctgaaaaacaagcaatttcagcaggtgtttaattcctatatgtcagacgaccgccatatcacgacgatcgatgtgatattggaagacaatccgtatggaaacggagcgattgccaaggtcaaagacattgaagcatcagtaaaacgggctcttcccgacacgcatttgcacgatgcatcgtttggcgtcggcggcgtttccagcatcaacgccgatttgaagcagctgtcagaccaggacttcagcaacacggtgatctatatgatgatcggaatcttcctgatcctcgtcctgctgttccgttcaatcgtcatgccggtgtatttggtcggatcgctggtcttgacgtactttgcatccatcggtgtaaccgaatttattttcacggcgtttttcggctatcccggcctcaactgggcggtgcctttctttggctttgtgattttaatggcgcttggtgtggactattcgatcttcctgatggaacggtttaacnggatacctgggcgtgcatc

SEQ ID NO: 2332 - DNA, 1257 bp, Bacillus licheniformis
tgctgaaggaaacaaaaaggccggtccgcgcaaaacaagtggtgtcggatttggatgaatacctttcagcttgccagctcggtattacgattacagcgcttggactcggctggatgggggagccgacggttaaaaaggtgctgcatccggtctttgaaagcctgcatgtttctggcgctgtatcgcacgctctttcagttgccattgcatttttagtgattacattcctgaacgtcgtggttggagaactcgctccaaaaaccatcgcgattcaaaaagccgaacagatgacgctgtggctggcgggacctctgcactttttcaatgttgtcatgttcccgttcatctggacgctgaacgcctcagccagagtgctgaccgggttattcggtttgaagcctgcttcggaaaaggatgaatcccattcggaggaagagctgcgaatcctgttatcagaaagctacaaaagcggagaaatcaatccgtctgaatatagatatgtcaataaaatctttgaattcgacaatcgaatcgccaaagaaattatggtgccgcgtacggaaatcgcctctgtcccgctggatatgccgattgatgaggccatttcggtcatgctgcaagaaaaatatacgcgctggcccgtctataaaggcgataaggatcatgtcatcggcatgatcaatacgaaacagctgtttacggatatgctcatgatgtcagaggcagagaaaaagctgctgtctcttgaagcctacgtccgtccggttattgaagtcattgaaaccgtgcctgttcaaaagctgctgatcaaaatgcagcgggaacggattcacatggcgatcttaacggatgagtacggagggacatcgggtcttgtgacggccgaggatattcttgaagaaatcgtcggggagatcagggacgaattcgatgaagacgaaaaaccgctcatcgaaaaagtttccgatcacgaatacatcatggatggaaaagtgagaatcgatcaggtcaatgagctgtttgaagacgatatcgaggaagaggaagtcgaaactgtcggcggacttgtgctgaaagaaaacatagatatcgcggaaggccaggcggtgcatatcggctcttacacgataacggttctcgaaatggaagggcgtctgattaagcacgtcgaagtcaagcgggaacaaactacagaacatgtagagctggcaccggcaaatccggtcgtcgtaaacgaaatcaccttgagcgaaaaat

SEQ ID NO: 2333 - DNA, 1554 bp, Bacillus licheniformis
ccaaagacaattgctttggcaaggcgcctttgtactttcattggcggggatattatcaaagatattaagcgctgtatatagagtgccttttcaaaatatagttggagatgtcggtttttatatttttcagcaggtgtacccgatgatcggaatatctgtcatgcttgccacctccgggttcccggtcatcatttcaaagttgctgaatgattacgggtccgcaaaccgggcaaagattctccgcgtgtctatgctttttttatcggcagtcggccttggcttttttcttctcttgtttgccggagccggagccatcgcagggtttatgggcgatcccgaccttgccggggtgatccgcgccgtgtcgttttcttatttgctgctaccgttcgtatctttgttgagaggctattttcaaggaagcgaacggatgctgccgaccgcactttctcaaattggagaacagacactccgggtcggggcgattcttgttttgacatggtggctcgtcaaaagcggcttttccttatatgacgccggtgcaggggcggcctttggctcccttgtcggcggccttgcggcgtttttcattctcgccgtgttttgggccaagcgtgaaaagaaagccactgccgcccggatggaggccggtacgggtgatattttgaaacagctgtgtctgtattcggttacgatttgtaccgccggcctcatgctgattctcatccagctcgtcgacgcattgcacttgtattcattgctggccggacaaggaatgggcgaacttcaggcgaaacatacaaaaggagtgtatgacagggggcagccgcttttgcagctgggaaccgtttttgctgcgagcattgcgacggctcttgtcccgtcccttacgaaagcgaagaaaaagggagaaactgcagtgctggaggaaaagatccggtattcgctaaaaatgagctttgtcatcggcactggagcagccgccggtctgatttgtattttggagccggtcaatgtcatgctgtttaaaaacagcgatggaacggctgcgctccaaattttcagcgcgtcgattctctttgcatcgctggcgatgacgatgaccgctgttttgcaaggactcggcaatacatgtcttccggctgtttccgtctgctgcggctttttggtgaaagccgtattgaacgagctcctgatccccggtttcggcatttccggcgccgcttttgcgactatgatgtcattcgccgctgttgcggggctcaatttttttcagctgaaaagaaaaggctggattaagctgtcggaatacaggatagcgggtgttttgttgtcggctgtgatcatgtcggccgctctggcggtgtggctttttgcatttgaagcggccataccacataaaagcagatggatctcagcggcggaaagtcttagcgccgttttcgtcggcggcgttgtctttttgtccggtatcttcacattgcgcgtgttttcagaaaaagaacttgagcttgtgccttttggcagcaagctcctgacattaaaacgagaaag

SEQ ID NO: 2334 - DNA, 1086 bp, Bacillus licheniformis
gatcaccccggaatatgatccgtgggaagcctacatggacgttgaccaatttggagatatacagctgacgaacgttgaatttacgacgacgactctttgcaatatgcgctgcgagcactgcgccgtcgggtatacgctccagacgaaggacccggacgcgctgccagtcagccttctgttgaaacggcttgatgagattccccgccttcgttctttaagcattacgggcggcgagccgatgctctcattaaaatctgtaaaggaatatgtcgttcctttattaaaatacgctcatgaacgcggcgtgcggacgcagatcaactcaaacttgacgctcgatatcggccgctacgagctgatcatcccctacctggatgtgcttcatatttcccacaactggggaacggtcgaagactttgcagaaatcggcttcgctatgatggataaaaagccgacgtttgcacagcgggcgcgctatttcgaaaaaatgatcgaaaacagccggacgcttgttgatgaaggggtcatggtctccgccgagacgatgctcaacaaacggacgcttcctcatatcgagcatattcaccggcaaattgtcgaagacatgaaatgccagcgccatgaggtccatccgatgtatccgagcgactttgcaagcgcacttgaatctttaagcttaaaagacatgagaaaagcgatccaccgccttcttgacattcgcgacgaaaatacgtggatgctgttcggcactctgccgttttacgcgtgcagccctgatcctgaagatcacgccctcttacagcggctgcgcgaagcgaaaaacgtcaccgtcagaaacgaccctgacggcagatcgcgcctgaacgtcaatatttttgacggcaatatcatcgtgaccgatttcggagatactccgccgctcggcaacattcagacagacagcctgccaagcgcctacgcgaagtggagaaaaacagagcttgccaaagaactcaactgccactgcccgcacgtccggtgcctcggaccgaatgtgctcgtcaaaaacagctattatcaagatgttgattttacttccagaacagc

SEQ ID NO: 2335 - DNA, 906 bp, Bacillus licheniformis
atgacacaggaaagctttaaatcaggatttgtctcgattatcggacgaccaaacgtaggaaaatctacttttttgaatcgcgtaatcggccaaaaaatcgccatcatgagcgacaaaccgcaaacaacaagaaacaaagtgcaaggtgtgctgacaaccgatacatcccagacgatttttatcgatacgcccggcattcataaaccgaagcataaattgggcgattttatgatgaaggtggcgcacaacactttaaaggaagtcgacttgatcttgttcatgatcaatgcggaggaaggctacggaaaaggcgacgaatttatcattgagcgattaaaaggagtcaagacgccggtatttttgatcgtcaacaaaattgaccggattcatccggatgagcttcttgtgctgatcgatgagtacagaaccaggtatccgtttcaggaaatcgttccgatctccgcccttgagggaaataatatcgatacgcttttaaagcaaattgaggattatttgccggaaggtccgcagttttacccgagtgaccaggtgaccgatcatccggagcgatttatcatttctgagctgattcgggaaaaagtgctgcatctgacaagggaagagatccctcacagcattgcggtctcgatcgagtccattcaagaacgggaaaacggttctgtgtatgtgagcgcgaccatcgtcgtcgagcgagattcgcaaaaagggatcgtcatcggaaaaagaggcagcctgcttaaagaaatcggcaagcgggcaagaaccgatatcgaggcgctgctcgggtcatcggtgtttttagagctgtgggttaaagtgcagaaagactggcgcaacaagatgtctcagcttcgtgattttggatttagagaagacgagtattaa

SEQ ID NO: 2336 - DNA, 1330 bp, Bacillus licheniformis
ttgaagtttaaggaccagttgaagttcattagaagaaatatgaggaaaaaccgcctgcgtgtattcatgaccattctcgcaacaacggtggcctgcgcgtttttaatcgtgctcgcatcggtcggattcggactgcaaaaatcaatgactgaacagctgatgaaagagcagatcgtgaccgagataaatgttgtcggaaaagaagggcaaagcgatcaaaaggttcaaaagaaagacctgaaagaatttgaaaaccgcaaagatgtgtccgcgattatcgagcgcacaaacgtgttcgcacctgctgaagcaaaattgggcaacaggaccaataatcaaatgtcgaatattacaattaccgacatggccgctgagcaaaaagccaatatcaaactcgatcgcggccgcgtagcgaaaacaccgaatgaaattgtcgtcggctaccatttcgggaagaacctctggacgaaaaaggaagccgcagattatgaaaagcagatggaaaataatgctgaggaagcaaaagagccgaaaggatacgaagaagatattctcggcaaaacgattgaattaaagatctcaaaaatggatgaaaaaacaggagaagaaggggaagcgaaaacatatgatctgaaagttgtcggagtgacaaaaaaaccttcgtatgaatgggcgagcgattcaacagtctatgtcagcaacggcatgcaaaaagacatcaccggctttctgaagtcggaaaaagacagcggcatgatcgaaaaaacgctttcggtttacgcggataactttgaacatgtcggacagctgacaacagatttggaggatgaaggctactacgtcgattcaataacgaaaaagctcgatagcatcaatctttttttcatggcttttaaaatcggtctgatctttgtcggagtcattgccgtctttatttcagcgatcgggattttcaacacgatgacaatggcggttacagagcggacgcaggaaatcggcattatgaaagcgatcggtgcaagcccgaatgtgatccgaaaaatgttcctgctggaaagcgcctatatcggcatcttaggatctgttttaggtattatcatttcatacggtgtcagctttttagtgaacaagattatacctgtcattttatcatcggtttcagaaggagaagcgagtgcggcagagctcagtatcaccttctcgcatattccggtcagtcttgtcctcatcgcgacattgatcagtgcgggtgtcgccattctttccggcctgaatccggccattaaagcgacaagaacgaacgtgctgacagcattaagaagagagcttt

SEQ ID NO: 2337 - DNA, 1346 bp, Bacillus licheniformis
atgaagagaaaaatgatgatgttcggattggcgctatcgatcattgcaggcggcgtggtcgccgatggaacggggaatgcagctcaagcggcccctcaggaaacagccatcgcaaaagatatcgaaaaattcagcaaaaaattcaacgagaaccgcgcctatcaaacgatttaccatttaagcgaaacgatcgggccgcgtgtgacaggcacggcagaagaaaaaaagagcgccgcttttatcgcctcacagatgaaaaagtcaaatctgaaagtaagcacacaaaagttcagcatacctgaccggctggaaggaacgcttaccgttcagggaaataacgtgcctgcgcggcctgccgccggttccgccccgactgcagcagaaggcttggccgctcctctctatgatgccggcctcggcttgcccggcgacttcacagaagaagcgaaaggaaaaatcgccgtcattttgagaggagagctgacattctatgaaaaggccaaaaacgctgctgacgcaggcgcaagcggagttatcatttataataacgtcgacagcctcgtccctctgactccgaatctaagcggtaataaagtcgatattccagttgtcggcgtcaaaaaggaagacggggaaaagctgctttctgaacaagaagcgatcctgaagctgaaagctcataaaaatcaaacctcgcaaaacgtaatcggcgtccgcaaagcaaaaggtgtcaaaaatcctgacatcgtttatgtgacttcgcattatgacagcgttccatatgcaccgggagccaatgacaatgcctccggcacttcagtcgtccttgaactggcccgaattttgaagacagtgccagccgacaaagaaattcgctttattacattcggagccgaagaaatcggactcctcggttcgcgccattatgtcagcacattgtcaaatcaggaagtcaaacggagcgttgccaactttaacttagatatggtggcgacaagctgggagaatgcttcacagctgtacatcaatacgcccgacggttcggcaaacctcgtctggcagctaagtaaagccgcttctttaagccttggaaaagacgtattatttttacatcaaggcggatcatccgaccatgtcccattccatgaagccggcatcgactcggccaactttatttggagagagccgggaacaggcgctttggagccttggtaccacaccccttacgacacgattgaacatatcagcaaagacaggctgaaaacagccggtcaaatcgcgggaacagctgtgtataacttcaccaagaaggaaaacagaaaaccgtcttacagctcagttgccca

SEQ ID NO: 2338 - DNA, 879 bp, Bacillus licheniformis
aacaggtaagtccgacatttgcaaaggatgtcgctgaagtcatcgcgaaaacctatcaaaataagcaggtcgtcagcctgatctcaagccagattgacgctgaccgcatggactaccttcagagggacgcctattacaccggcgtcagctacggtcattttgatatggagcggattctccgcgtcatgcggccgcgcgaagaccaaatcgtcattaagcaaagcggaatgcatgctgttgaggactatattatgagccggtaccagatgtactggcaggtctacttccatcctgtgacaagaagtgcggaagtgattttgacgaagattcttcaccgtgcaaagcagcttcatgaggaaggctatgttttcacgcatgcgccagtgcatttttattctatttttgaaggcaatgtcacattggaagattatttaagtcttgatgaatcaatcattctttattattttcaggcctgggaaaaagaagaggacgaaattttgtctgatttatgccgccgttttatcaaccgcaggctgttccagtatgcggaattcaatccgaatgaggaaatggcgacttactttgaactgaccaacttgtttaaagaatcagggattgatcccgaatattatcttgtggtggattcgtcctcagatcttccttatgatttctacagaccgggggaagaagaggaacgcctcccgattcaattgctgacgcacaacggccagattaaggagctgtcgcggcagtccgatattgtcgatgcgatatcaggcaagcggagaacggaccataagctgtatttcccgctcgatttaatcgaagggctgcctgacggccgtcatgcgaaaagaatgaaagaattgctcggactga

SEQ ID NO: 2339 - DNA, 810 bp, Bacillus licheniformis
  misc_feature (1)...(810): n = A,T,C or G
catttaaggaattcggaccgggtttggtctgcgccgaaatggtcagcgataaggcgatcctttacaataatgcgaaaacgatgggaatgctttatatcgatgaacgtgaaaaaccgctcagcctgcagatcttcggcggagaaaaagaaacgcttgtcgaagcggcgaagtttgttgaccaaaacacaactgcggatattattgatataaacatgggatgtccagtgccaaagatcacaaaatgtgatgcaggagccaaatggctgcttgatccgaataaaatttatgaaatggtttcagctgtcgtggaggctgttgacaagcctgtgaccgtgaaaatgagaatgggttgggacgaaaaccatatctttgctgttgagaatgcgagagctgtanaacgagcaggcggaaaagcggtcgctcttcacggacggacccgcgtgcaaatgtacgaaggaacggcgaactgggatattatcaaagaagtgaagcactccgtttcaatccctgtaatcggaaacggtgatgtcaaaactccgcaagatgcaaaacgcatgcttgatgaaacaggggtggacggcgtcatgatcggccgtgcagcgctgggtaacccgtggatgatttaccgtacggttcactatntggaaacaggcgaattgaaagatgagccgaaagtgcgtgagacaatttctgtctgcaaacttcaccttgaccgattaatcgggctgaaaggcgaatatgttgcggttcgcgaaatgagaaagcacgcatgctggtatctaaaaggcgtaagaggaaacgcaaaggtcc

SEQ ID NO: 2340 - DNA, 1038 bp, Bacillus licheniformis
ggtggacaaggttcgcacagggatattaggatacggtttgtccggttcggtgtttcatgcgcctttattatcagtgttagaagattatgagattcgaaaggttatgacttcaaggaaagaacaagtcaaacaggacctccccgaagcagaagcggtcagtacgatcgaagacatcacaaaagatccggacattgatctcgtcatcgtgaccacgccgagcggccttcattacgaaatggcgaaagagtgcatccgcgccggaaagcatgtcgttcttgaaaagccgatgacagcaacagcggaagaagcggaagagctcattaatgccgcgaaagaaaaaggcgtgcttctcagcgtgtatcacaaccgaagatgggataacgactttttgacgatcaaacagctcatcaaagaggggcgccttggagaggtcaacacattccacgcctcctacgaccggttccggccgaatgtcagacagcgctggagagaacagaaaggaccggggtcaggtgcactgtacgatttaggttcacacttgatcgatcaggcgcttcatttattcggcatgccgaacggcgtcaccgctcaagtgaccgctcagagagccaatgcggaaacagacgattacttccatgtcatccttcactatgatcagcgccaagtgattctccactcgggctcgattgttccggccaacggcccccgctaccaaatccacggctcaaaaggaagctttattaaatacggaatcgacggccaggaggatgcactcagagcgggtcataaacctgcaggcgatgagtggggagccgatcaacccgaatattacggggaactggccacagtcgaaggcgacgagatcaggaaggaaaccgtggaaacgctcccgggttcatacttaacttattacaagcagcttgcttcaagtattctagaaggcggcagcttgcctgtcacggcggaagaaggacgcgacgtcatccgaatcatcgaagctgcgcaaaaaagcagcgaaacgaatcaaacggtgttctt

SEQ ID NO: 2341 - DNA, 955 bp, Bacillus licheniformis
ttgagctttttaaatattttaatcctccttgcgccaatattttttgttattgcgctgggatggtttgcgggtcactttggaagctatgatgctaaatcagcaaaaggggtaagtacgctcgtaacgaaatacgcgcttccggcccactttgtatcaagcattttgtcaacgccaaaagataagttttacagccagattccgcttatgatttcattggtaatcggtatcgttggattttacgttattattttgcttcttttacgatttttgtttaaatacgatttaacagatgcttcaatgttctcattgaactcagcacagccgacattcgcctttatgggcattcctgtattgggcagcctgttcggcatgcaggaagttgcgattccaatcgcgattacgggaattgtcgtaaatgcgatgcttgatcctcttgcgatcatcgtcggaaccgtcggccgttcttcaaaaaaacaaacggaaacgacggacagcatttggaaggtgacaggaaaatcaattttacacggtttgtctgaaccgcttgcttttgcaccgcttgcaagtatcattcttgtgttattcggtctgcaaattcctgaattgccgcagaaaatgcttgatatgctcggagatacgacttcaggaatcgccctattcgcagtcggggtgactgtcggaatccgcaaaattaaattcagcatgcctgccttgagcatcgctttattaaaagtcgctgctcagcctgctttaatgtttgtgatcgcgatggtcgtcggcctttcttctgccgacatgacaaaagcggttctgctcgtggcattccctggttctgctgtggcggccatgattgctacaaactttgaaagccaggaagcggaaacggcatccgcgtttgtgatcagtgcggtgctgtcaattatttcgctgccgatattgattgcaattacagctt

SEQ ID NO: 2342 - DNA, 810 bp, Bacillus licheniformis
aaggaagggaactttgcccatcattacagtagttcatgaaacaggtccaaatgatgcagcaacgaaggatttggtaaaggatgtacgcagcttatcagataaaaacggagtagatttgctcgtcactggatcaaccgcagtgaatattgatatttcagatcgccttaatgatgcgataccggtgtttgctgtactcattgttggttttgcgtttgtattgctgacaatcgtattccgttcgttgcttgtgcctcttgttgctgtcgcaggtttcatattgacgatgacagccactcttggaatgtgtgtatttgttttacaagacgggaatctcatcgactttttcaaaatacttgaaaaagggccgatactcgcgttcgtgccgattttatccattgggattctgttcggattagcgatggattatcaagtattccttgtaagcagaatgcgtgaagaatatgtaaaagcaaagaatccagtgcaagccattcaggctgcattaaaactcagcggtcctgttgtcaccgcagccggcctgatcatgatattcgtttttgcagggtttatctttgctggtgaagcttctattaaagccaacgggttggctctttcctttggtgtgctctttgatgcatttattgtacgaatgacactgattccaagtctgatgaagctgatggggaatgcagcctggtatttgccaaaatggctggacaagatcattccgaatgtagacatagaagggcatcaactcacgaaggaaatacagccagaaacagctcatgaacaaaagaaacaaatcagtat

SEQ ID NO: 2343 - DNA, 966 bp, Bacillus licheniformis
ttggaaggctcggctatgaccatgcgaaaaacgtcaaaaccgaggtgcccggagtcctgctcgccgctgtagccgatccggcagagggaagtgcgagggaggttgcagctgaacggggtgttgaaaagtggtttgaagacccgtttgagtagctccgcgatccggaaattgatgccgttgtcatcgttacaccgacatccactcatgccgaaatgatcaaacaggcagccgaattcggcaaacagatttttgtggagaagccgctgacattaaatcttgaagagtcaatagaagtcatttccaaggtcaaagaaatgggcgtgatttgccagggggggtttatgaggcggtttgatccggcttatgcggatgccaaaagaaggatcgatgccggagagatcggcaaaccgatctattataaagggtttacgcgcgattttggctctcctccggccgaattcatcaaaaaaagcggcggtattttcgtcgattgttcgattcatgactatgacatcgctcgttatttaatgggggctgaaatcactgcggtttccggccacggaagggttttgaagcacgcattcatgccgggatgccatgacgtcgatcaggcgctcacctatatggagtttgattcgggagcggcgggtgatgcggaagcaagccgcaattcgtcttacggccacgatatccgcgccgaaatcatcggaacggacggcagcatcttcatcgggatgctgcggaacccggcggttacagtgcggaccggaaaggggagcagctataatatcattcccgatttccaggcgaggttccatgaagcgtactgtttggagctgcagcattttgctgattgtgttcgcatcaaaacgaaaccgcttgtgactgaagtggatgcggcggtcaatcttgaaatcgcgcttgcggccacacaatcctggtcaacaggcaggcccgtcaagattc

SEQ ID NO: 2344 - DNA, 960 bp, Bacillus licheniformis
gccccgtcttgtgcttcgagccgattttgacgcgctgcccattcatgatgaaaaagacgcgccttaccgatcgactgtgccgggagtcatgcatgcctgcggacacgacgggcacacggcaaccctgcttgtcctcgctaaagttttgaatgagcacgcggaccgtttaaaaggaaagatcgtcttcattcatcagcatgccgaggagtattcgccgggcggagccaggccgatgattgaagacggctgccttgacggggttgacgtgattttcgggacccatttgtgggctacagagccgacgggaacagttcaataccggacaggaccgatcatggccgctgcagaccgttttacgattacgattaaaggcaaaggggggcatggcgcacagcctcataaaacaaaagacgccgtgctgatcggatcgcagatcgtcacttccctccagcagattgtcagccgcaggcttgatccgactcagccggctgtcatttcgacaggttcatttgttgccgacaactcctttaatgtaatcgctgataaagccgttttaatcggaacggcgcgttccttcaatgaagaaatccgcaccttgattgaaaacgaaattgaacaggttgcaaaaggtatatgcggcatgcatggcgctgactgcgactattccttcgaaaggggctatccgcctgtctgcaaccacccggaagaaacgtcttttctcgcaaaaatcgccaaacagacggaaggcgttgaaaaagttgaagaaagcggcatgcaaatgggcggggaagatttcgcttactacttgcagcacgtcaaagggacatttttcttcacaggcgcccgtcctgaagatccggaggcggtgtttccccatcaccatccgaagtttgatatcgatgaaaaagcgatgctgatcgcagccaaagtgctggcaaatgccgcggtctcctatcacga

SEQ ID NO: 2345 - DNA, 843 bp, Bacillus licheniformis
ttgttgagggtgaagggacaaactcgaacgtgtcaagaaccgtacaacaaacagaccgctatatgagtgaaatgaaaagcgatccccgctttgaaaacatggtatttaaaatcgatgaatcagaagggcacgctttcaaaaaaatgcatgtccgccatcgcgatgagctggtgacgctccgcctggaagatgatatcgatccgaacgaattaacaggaaaatacctggagccaaaagaattttatgaggcgatgcagcaggaagatacgattgtcgtcgacgcacggaacgactatgagtacgatttggggcatttccgcggagcgatcagaccggacattaaagcgttccgcgaattacctgagtggatccgcgataacaaagaaaagctcgaaggcaagaaaatattgacttactgcacgggcggaatccgctgcgaaaaattttcaggatggctgaaaaaagaaggatttgaagacgtgtcccagcttcacggcggtattgtaacgtacggaaaagaccctgaagttcaaggtgaactgtgggacgggaaatgctatgttttcgatgaaagaatcagcgttccggtcaatcagaaagagcacgtcattgtcggaaaagattatttcaccggcgagccttgcgagcgctatgtcaactgcgcaaacccggaatgcaacaagcagatcatctgctctgaagaaaatgagcaccgctatttgcggggctgcacgcacgagtgccgggttcatccgcgcaacctgtatgtcaaagagcacggcctttcagaagaagaggtgcaagagagactcgaaaagctgaaagaagaggaacatgcagcgc

SEQ ID NO: 2346 - DNA, 885 bp, Bacillus licheniformis
atgcctgagggcaaaatcattaaagcattaagtggattttactatgtattggatggcgatcaggtcattcagtgcagaggaagaggggttttcagaaaaaataaagtaacccctctcgtcggcgacgatgttgtctaccaagccgataacgataaggaaggctacattctcgagattaaagacagattcaatgaattggtcagacctccgatcagcaacgtggatcaggcggttctcgtgttttcggcaaaggagccgacattcagcacgtcgcttttggatcgttttttagtgctggttgaggcgggtgatattaggccgatcatatgcatcacgaaaatggaccttgtggatgatgacgcgctgaaagagcagattcatcaatatgccgaagactaccggaacatcgggtacagcgtctatttgacatcaatgaaaagcggaagaggcatcgaagacatcatcccccattttcaggataaaatcaccgtattcgccggccagtccggcgtgggcaagtcttcgcttttaaatgcgatcagccctgaccttgaactgaaaaccgccgggatttccgcccacttgggaaggggaaaacatacgacgcgccatgtggagctgatcgatataaacggcgggctcgtcgcggacaccccgggcttcagctcgcttgagtttgccggtattgaagctgaagatttagggcagacatttttggaaatcggcgaaaagagcgccgaatgcaagttccgcggatgcctgcatataaaagaaccgaactgcgccgtcaaacgcgccgtggaaaacggtgaaatcgcccagtatcgctacaaccattatgttgaatttttaacagagatcaaagatagaaagccgaggtattaa

SEQ ID NO: 2347 - DNA, 1446 bp, Bacillus licheniformis
tggggaattttggagattcccggcagtagcttatgaaaacgggggaggcgcgttctttctgccatatttgttcgcgctcttgacagcaggaattcctcttctcatcatggaatttacaatcggtcataaatacagaggctcagccccgctgtcctatgccaggatggggaaagggaaggaatggatcggctggtggcaggtcgccatctcatttgtcatctcgacgtattatgccgttatcgtggcatgggccatttcttacactgtcttttcattcaatttaggttggggtaaaaatacagaaaatttcctaatgaataaatatttaaacagaattgatatcgggggaggagccatcggccaattcggcggcttcgtgccgggcgtcctgattccgctcgcgattgtatggattgtttcattggggattttatttgccggagtcaaaaaaggaatcgaaatcgcgaaccgcattttcattccgctgcttgtggtcttattttttatcattgtcatttattcgataacacttgatggggctgcacaaggactgaatgcctttttcacgcctgattggagccagattacaaacggaaaagtgtgggtggcggcctacggccaaattttcttcagtctgtcgattgcgtttgccatcatgattacgtattccagctatttgccgaaaaaatccgatattacaaacaatgcgtttatcaccggctttgggaactcgtcatttgaactgctggccggaatcggggtattcagtgcgctgggctttatggctgcgcagcaaggcgttccagtcaaagaagtcgtctcttcgggaatcggtttggcgttcgtcgtcttcccgcaaatcatcaatgagtttccggcgtttaatgcgtttttcggatttttattctttggctcgctcgttttggcaggtctgacatctctcatttctatctctgaaacatatgttgccgcgattcaggataaattcaacgttccgcggcggaaagccgtcctgttcggcggaggggctgctgcattgtgttcgctcgtatttgcgacgaaaggcggactgttcttcctcgatgcggccgattactttatcaacaatttcggagtggcgcttgccggattgatcgaagtcgttgcgattgcatggtttgcgaaagagctgaaagctctgcaggctcacgccaattcggtttccgacattcagctcggcgcttggtggagaatctgcctgagcgtcgtcaccccgattgttctggggtatatgatgtttgataatatcaagacgaatatcacaacagcctatggcgacctgccggttgaattcctcctgaaatggggatggtgcgtcgcttttggagcgatcgcagccggatttatcctttcgctttcaaaatggaagaatgggctggcatatacgccatttcaacatgacaagga

SEQ ID NO: 2348 - DNA, 963 bp, Bacillus licheniformis
  misc_feature (1)...(963): n = A,T,C or G
gccttgtcgacgaatttgccgacgngacgtccaagatcacggaaggccgtgctttaacaaaggatgatgtgaatgaaaaagtcgccgtgattgaagaaacgcttgccgaagaaaacgagctgaaggtcggcgatacgatcaaagtcaaagcgagcagcgatgaagatgcaacgatcaatttaaaaatcgtcggaatctataaaacgacttcatccggagacaatcaagcgcaaaacttcgcctttttaaacccttataacaaaatctatacaccatatacggcggcatcggccttaaaaggcgacgattatcaaaacgcgatagatgaagcggtctacaatatggacgacgcctccaacatcgacgctttcattgcggctgccaagaaaacaggcattgatttggatacattcacattggacgccaatgaccagttgtaccagcagatggtcggcccgattgaaaatgtcgcctccttctcgaaaaatgtcgtctatcttgtcacggtcgccggggcggtgattctcggactgatcgtcatgatgtcaatcagggagagaaaatacgaaatgggtgttctgatggcgatcggcgaaaaacgccggaaactcatcggacagtttttaaccgaaatcttaatgatcgcagtgcttgccatcgggatctcagcattaaccggcagcctgattgcaaagcaaatcgggaaccagctcttgagccagcaaatcgaacaaacgtcagctagccagtctgcaggcggaatgatgggcccaggcggcggaggcttcttcggacaaagtactgctcaagtctcagccattgatcagctcgacattcaagtatccttcgggaacttaatggcacttggcggaatcggccttttaattgcgatgttcgcgacactccttccgtccatatctgttttaaggctccatccgaaaacgattttaacaaaacaagaat

SEQ ID NO: 2349 - DNA, 1236 bp, Bacillus licheniformis
atgatcacttgaacgaacaggaagtcatgaaagagaaagccatattagtcggatgccagcttccgcacgtgtctgatgagcgtttttcatactcgatggaagagctcgccgcgctgacgaaaacggccgacggaacggttgtttccacggtcacgcagaagcggaaccgtgtggatgctgctacatatatcggaaaaggaaaagtagatgaattggcggtgctctgtgaagagctgtcgcccgatgttttaatttttaatgatgaattgtcgccgagtcagctgaaagcgcttgtcacaacgcttgacgtgaaaatcatcgaccggacgcagttgatccttgatattttcgccaaacgcgcgaggacaagggaaggaaagctgcaaattgagctggcacagctgcaatacgccctcccgcggttaagcggccagggaatcaacctgtcaaggcaaggcggaggaatcggaacaagaggtccaggggagacaaagcttgaaaccgaccggcgccatatcagaaaccggattcatgaaatcaatgttcagctgtctaccgtcattcgccacagaagcagatacagagaaagaagaaagaaaaacggtgtactgcaaatcgcgcttgtcggctacaccaatgcagggaaatcgacatggtttaacaggcttacagacgccgacagctatgaagaaaaccttttgttcgccacacttgacccgatgacccgcaaaatgatgctcccgagcggatacagcgtgctgctctcggatacagtcgggtttattcaggatctgccgacaactttgatcgcggctttcagatcgacgctcgaagaggtgaaagaagccgatctgattcttcatatgatcgattcttctcacgaagactacgagggccatgaggagacggtcaagcgccttcttgaggaacttgaagcagacgatattcctgttttaaccgtctataacaaaagagaccggaagcggcctgatttcatcccttcttcagggagagggcatatcatgacgagcgccaaaatagacggagacttgccgctgtttaagcaggcggttgaagactatctgaaaaaggagctgctcgttccgtatgacgtgagaattcccgcttcagaaggaaggctgttgtcgagaatcaagtctgagacaatgacgaacagcaccgtttttgacgaagatcgcgaagcatatgaagtggaaggatatattctccctgacc

SEQ ID NO: 2350 - DNA, 876 bp, Bacillus licheniformis
atgtacatcgacggggttttttcaggcggcggcatgaaaggggttgcgcttgtgggagcatacgaagcgcttgaaaaacggggcttccgatttaaaaggctggccggaacgagcgccggttcgatcattgcctcatttatcgcggccggctatacaagcgcggagatccgccaaatgatggaggaattaaatgaaagcgagctccttgacccgaggttttcactcttgcctttgaaattgctgcaatgggcatcgatttattggcggctcggtttatataaaggagataaattggaaaactggatttccgaaaagttgaaagcgaagggcatttcagtgttcggggatcttgaacagggaaagctgaagttgatcgcttccgacttatcgaacggcaagatgcttgtgctgcctgacgatttaaacaggtacggtttgaatccagggcgattttccgtcgccagggcggtccggatgagctgcagcatcccttatttttttgagccggtgaagctcaagtcacctctcggaatcagcgtcgtcgtagacggcggagttctgagcaattttccgatgtggctgtttacaacagaaaaaaaacggccggtattgggcatcacgctgatgcccaatgaaaaagagaggccgaagaaaacgattaaaaatgcgttcgagctgttcggggcgctgtttgagacgatgaaagaggcgcatgacgccaggcacattgccacgaaacatgagcggaacatcatttttttgcctgttgaggaagttttgtcgactgaattcgcgatgtcggcagaaaaaaaactagctctaatcgagctaggaaaaaaacgaacagaattatttttgaaacagtggacgttttaa

SEQ ID NO: 2351 - DNA, 773 bp, Bacillus licheniformis
atgaaagccgtattttttgatttagacgatacattgctctgggatgaaaaaagcgtcagcacagcattttccaaaacgtgccttaaagctgaagaaaaatacggaatccatgcggaagaatttgaagcagccgtgcgcgaagcagcgcgaaagctttacatgtcttatgaaacatatccatacaccgtcatgatcggcatcaacccatttgaaggactgtggtcaaacttcagcgagccgatcagcgaagggtttcaaaaactgaacaaaattgttcccgaatacagaagaaacgcatggacaaacggattgaaggcgtttggcatcgacgatcccgccttcggggaagaactcggcgaatattttgcggcagtgcgccgaaagagcccttttgtttatgaagaaacatttgccgttttagatgagctgaaaggaaaagtagagcttcttttgctgacaaacggcgatccgagcctgcagaaagaaaagttggcaggcgtaccggaacttgctccttattttaatgaaatcgtgatttccggtgaatttggaaaaggaaagcctgatccaagcatatttgaacactgcctcaccctcctcggcatgacaaaagatgatgccgtgatggtcggagacaacttgaacaccgacattctcggggcttccagagcaggcatccaaaccgtctgggtcaaccgcaaaggcaaaaagaatgaaactgatgttgcacctgatcacgaaatcagccatttaagcgaactgttcgatatcct

SEQ ID NO: 2352 - DNA, 873 bp, Bacillus licheniformis
cagtcatcctgaatatgcagattccttggcagacggctctttcaggcgttatggtttccggacttatttttatcgttctttcgctatccggtttaagggaaaaaattatcaattcgattccttatgagctgaaaatggctgtcggtgcggggattggcctgtttatcgctttcgtcggtttgcagggctccaaaatcgtcgtatccaacccggatacgattgtgtcgtttgggaatattcattcaggtcccgttcttttgactgttttcggactgatcatcactgtcattttaatggtattgcgcgtcaacggcggcattttcttcgggatgctgatcacggcgattgtcggcatgattttcggacagattgacgttcctgacaaaatcgtcggtgccgttcctagtcttgcgccaacatttggacaagcctttatccaccttcatgatatctttacggtgcaaatgcttgtcgtcattttaacgtttttattcgtcgacttttttgatacggccggtactttggtgggtgttgcatcacaagccggtttgatgaaggataacaaactgccgcgcgcgggaagagctttgcttgccgattcttccgcaactgtggccggagcgatccttggtacatcgacaacgaccgcttatgttgagtcaagcgccggggtagcggccggagcgagaagcggttttgcggcgattgtaaccggcgttttgttcttgctgtcgctgttcttctcgcccgtactcagcgttatcacttcacaagtgacggcgcctgctttaatcatcgtcggcgtgctgatggtggcgaatctcaacaaaatcgactggaccaaatttgagattgcggtgccccgcattcttc

SEQ ID NO: 2353 - DNA, 1034 bp, Bacillus licheniformis
atgaatcagttcatggaacgcctctctttgtcaaagcctgtggtccaggcgccgatggcgggcgggccgacaacaccaaggctcgccgccgccgtatcagactgcggcggcttaggcagccttgcatccggctatttgacgccggaagtgcttcaacaacagattctggaaacgaaaaagctgacatcagccggatttcaagtcaacctcttcattccggaaaaacgggaaaccgtcacccgggaagaatatgaaaggtggcaagagaagatacctttggcgcggtcggcttcacccgtgacagatgagaaacaagattgggacgatttttacgagaaaatagaaatcattctcaaagaaggaatcagcgccgtttcatttacgtttggccctccgccggctgatgccgtcaaggaactgaaaaaccgaaattgctgtttaatgggcaccgccgtttcagttgaagaagccgtgctgcttgaagaactggggatggatgtcatcattgttcaaggaagtgaagcgggcggccacaggggagccttcttgaaaacgaagggagagcctgctgtcggctcgatggctttaattccccaagcggcagatcatgtgtcggttccagttatcgcagcgggcggcatttttgacaaaagaggtgttgctgcagcttttgccctcggcgcacagggcgttcaaatcggtaccgcttttttgacgtgcgaagaaagcggaacacaccctgcctacaaacaaaaattgttcgaagcggttgaaaccgacacaagcctgacccgtttgttctcggggaagccggcaagaggcatcgtcaatcagtggatggaagacagacgccaggaagaagctgaagcgctgccttatcctctgcaaaacacgctgacgcaaccgatgagaaaacaggcgaagcttgacgggaatacggataacatgtcattgtgggccggacagagcgtgcgggccaccgtcgagcaaacgacggtgaaggagctgatggatcagcttgtgccggccgatgt

SEQ ID NO: 2354 - DNA, 2250 bp, Bacillus licheniformis
atgcagcagcacattttacaccaaagcaaaatctcttttttaaatgaaaccagcatgatcacagcattctttattaccggtttatactttctcggcttttttctgcatcgaagaaaggataagcacttattctttttttccacgatgtgtcttcttttttcggtcatagtgcttttaatcggaagagaacgaatgatctttcttctctttccgtctatctcattctcagctttaagcgtcgtgagggcgaccacaatggtgcttgtcagtatggcggtttttctctatctatatttcgcttacaaagaaatcgtttcgaaaaaatggataatcgccgcgactgcattttctgtactggttttgatgattgattttattacctggggttacacagaccgtctcgcatatatattgcactctgttcttgccgtcacgactttgatttatattacgtatgtgtttgcgatttctgctgttcggaaaatgaaaggcagcctttatcttacgattgcagcgatctcgatgagcgcattcgtcattttaacgacagtttctgcttacagcggcaaaagaggcttttcattcaattcgctctatgccgtgccgtcgatcatcgctttgctggcggctgtactgatgatggcgcagcaattcgcaggcgcattccgcgagaacgaaatcctgtccttgaaattgctcagaatgaatcgattaaaagacgagtttatcgccaaaacatcacatgaatttaaaacgccgctgaacagcatgattaatatatgccagacccttttggcaaggaagagaaaaaggacgttagaggaagaaaaagaaaatctgcagctggtcatccgcatgggatacagactctccagtctggtgaacgacattctcgatttggaaaaaatgaagcagggcatgctgcagattcaggccgttcctgtcgatgcccattcggcgatcagcacggaaatggacttctatcggctgttgtcaaaaaataaaaatgtccggattgtaaaccgtgttccatccggactgccgctcgtcttggccgacgaaaaccgcttccggcaaatcatgaccaacctggttgataacgcgatcaagtatacgccggaggggcagattacgctctccgccgaaaggctcgaccaagagaaggtcaaaattacagtagcagatacaggagtcggcataccaaaagccgtgcgtcaattgatattcgaagcttttcaacaagcaaaaaaccataaagacgacggagccgggcttggtttaagcatcgtcagacagctcgttcagcttcaaaatggagagatctgggtagaatcggaagaagggaaaggatcggcatttcatttcacactgcctgttgcaaaaaatgaccctcttcctgacgcgaagaaggagaacatgcctcaacagcaagccgtcagagatctgcccgatgtttctatcagcacgccgtactactcaaagaaaatggatgcttcaactgttttgatcgtcgatgataacatcgaaagcttaaaaattttggccgatatgcttgaaggcgttccttatcaagtcatcgcagcaaaaagcggccatgaggctctcgaagtcgtctcccgttcaaagcttgacttggtgattttggacctgatgatgccggatatgacagggtttgaagtctgcatgaaaatccgcgaaaggttcacaatggtggaacttccggttctgatcattacggcagccatcatcgaccatgataaatacaaggcttttcacgctggggcaaatgacattttgcagaaaccgtacaactacactgaatttgcagcccgcgttaaaaacctgatcatgatgaaagatacggcagcccaagcgacaaatatggagatggcattcctccaatcgcagatcaagccgcactttcttttcaatgtattaaataccattatcgcgctcagtcatttggatattgaaaaggcgcgcgaagtgacggctgattttacaaactacttgagaatgagttttgactttcaaaatacatcagggatgagttctttcaagcatgaactgtcgattgtgaattcgtatctttccattgaaaaaacgcgcttcggcgatcggctggacgtcatttacgatattgaggaagacatcgactttacccttccgcctttaatgattcagcctcttgtcgagaatgccgtccaccaggcatcagcaagaaaagaggcggaggctggatcaagctga

SEQ ID NO: 2355 - DNA, 816 bp, Bacillus licheniformis
atgtttattatcgcatgtttattgattatcttaggcctcatgccttttttatataaagcgaaccacaatacaaaagatgtgaaagtcaacacgatttcggtcgagcgcgtgcaggctcccgctttaaagaaaaagctgaacattcttcatctgtccgatcttcatttagaaaacatttcgatttcacctgaacggattcttgaacttgccaataaaaaacgagtggatctcattgctttaacaggagattttcttgataggaagagaaatattccaaagcttgcaaactacttaaaagctttgaaaaaactgaagccggcatacgggatgtacgctgtattcggcaaccatgactacctattgaaagacgaacactttcggaagctgaaacgtgtactggaagataacggatgcatcaccctacagaaccagcatgtctccattgaagtggaaggcgagacactcaacattatcgggattgatgattacagcacgaagcgaagcgatattgccggttcatataaagggcttaaagagggctacaaccttgtattgacgcatgatccgaacgttgtgcttgatatgcaggaatttcactttgactatcttctttcaggacattttcacggcggtcagattcattggccgaagccttatcatctcgtgaagatgggaaagcttgtgcgaatgaatatgataaaaggtcttcactaccatcatgacaaaccgttttatatcagcgagggattgggtcagactggggcgaacatccgaatcggaagccgtccggaaatgacgttccatcacatttcataa

SEQ ID NO: 2356 - DNA, 834 bp, Bacillus licheniformis
tcctgagggcaacctaccccgaaaaaaatattttcgcggtcggagctcctgaaccttctctcgcttttttgtatactccagatgtgattgaagacccggtgtatgaaaatgcacttgtcatcgtttgcgacacggcaaatcaagcgagaatttcagattcgcgctacaacctgtgcgataagttgatcaaaatcgaccaccatccgaatgaagaccggtacggcgaccttttatgggtggatacgagtgcgagctcgacgagcgagatgatttacgaactgtatttagcgggtaaagaacaagcgggatgggcgcttccaacaaagggcgccgaactgatctatgccggcattgtgggggatacagggcgcttcttatttccgaacacgacaaaaaagacattgaaatatgccggagagctgatcgagtatcctttttcttcccaggcgctttttgatcaattatatgagacgaaattaaatgttgtgaggctgaatggctatatttaccagaatgtttctctgtccgaaaacggtgttgcgtcggttttcatcacccgcgatattttacatcaatacaatattacgccgtctgaagcttcacagcttgtcagcacgctcggcaatatttcggggatcaaagcatgggtgttttttgtggaggaagccgatcaaatcagggtaaggcttcgttcaaaggggccgattgtcaatgaagtcgctaaaaaatacaacggcgggggccatccgctcgcagccggcgcttccatctatgactggaaagacgctgatcttgtcatcgctgacctggagcgtatatgcaaagaaaacaaat

SEQ ID NO: 2357 - DNA, 811 bp, Bacillus licheniformis
atgtacaaactaatcgcgatagatatggatggaacattgttgaatgatcttcatgaagtaacagaggaagtacggaatgccctgcatgccgcgaaaaaacaaggcgtaaaaatcgttctctgcacgggccgtcccctcggcggtgtaagccgctacctggaagaactgaatttaaatgaagacggcgattatgtcatcgcctataacggagcgctcgttcaaaatacgcatactcaggaagttgtgtcagaactgacactgggctatgatgatgtgaaatcgttatatgagctcagccaaaagcttgatactccgatgcacttttttgattcggcttatttgtatacgccaaaccgggaaatcagcccgtataccgtttacgaatcatacgtcaccaaagtgccgctccggttccggacgatcgaagaaatcccgcaagatcttctggcgccaaaggcgatgtacattgatgagccggaaaagctggaccggacgatcgccgcaataccggaagacgtcaaggaacgctatacaatggtgaaaagttcgccgttcttttatgaaattcttcaccctgcggcaagtaaaggaaatgctgttcagcagcttgccgacatattaggcatcgcgcaggaagaagtgatgtgtattggagacaacggaaacgacatgtccatgatcgaatgggcgggttgcggagtcgccatggggaatgcgatccctgaggtaaaagcttcggccgattacgaaacgcgtacgaataatgaaaacggcgttgcccacgccattcgtgagcttgtattgtccaaat

SEQ ID NO: 2358 - DNA, 767 bp, Bacillus licheniformis
atgttcggcgttgttcccaagccgctttggtcaaaaaagtattacgccaatgagaaaaatcaaatcgaacttagaacagatcctatactagttcagaaagacggcacgaacctgctgatcgattccggtatcgggctcggcaaactgacggataagcaaaaacgaaattacggagtcaccgaagaatcgtcaattgatgactcgttaaaagcactcgggctctcaacggaagatatcaaagccgttttgatgactcatctccattttgaccatgcatgcggattgacgcgctatgagggagaaagccttgtttccgtgtttccaaatgcggcgatttacacgtctgcaatcgaatgggaagagatgagaaacccgaatatccgctccaaaaatacatattggaaagagaactgggaagcggttcagcatcaagtgagaaccttcgacgagaagcttgaagttttgcccggaatcacgatgcatcatacaggcggccacagcgacggccattccgtgatcgttctcgaagatgccggtgaaacggcccttcatatggctgacattatgccgacgcacgcccatcaaaatcctctctgggtgctggcgtacgacgattatccgatgacatcgattgccgcgaagcaagcatggcaggcgaaggccgccgagaaaaacgcctggtacattttttaccacgatgccctttacagagcattaaaatgggatgaaaacggcgatattgcagagtcagtaaaaagagaaagccg

SEQ ID NO: 2359 - DNA, 861 bp, Bacillus licheniformis
atgagattaattgcgatcgatttagacgggactcttttaaataccgaaagcaaaatatccgcagaaaaccgggccgctatcaaaaaggcgctcatttcagactgcatcgtaaccatttgcacgggacgggccacatttgacgtaaaagcgcttctgaacgatttggatattccgattatcgctgcaaacgggggaacggtccacgatttcaactataaactcctaagcagaacgctaatggacaaggaagcgggaaaaaaggccgcccaatacttaacagatcatcaaatctatttcgaggtttatacggacgatgcgctgctttctccttatgacggagagcagaagcttaaagcagagctcgatatcgtcacaagcgccaaccctgatgaagacagggatacgctttggcaaggcgcactgactcagtttaaacaattcggcatcaaacccgtccccgacattcgcgagatttttaacggagacgaacatatttataagctgttgtgcttctcatttgatatggaaaagctgaagaaagcaaaagatgatctttctgcctttccaaaactgggactcacttcttccggaagacatatcatcgagattctgcctgatgaatccggcaaaggccgcgctttaaaagagctggcccgccactatggaatcgagaaaaaagacatctacgcgatcggcgacagcccgaacgatctgtcaatgtttgaggaagccggccatcggatcgcgatgggcaatgcaatcgatgagctaaagcatatcagcacctttatcacgaaaagcaatgacgaaaacggcgtcgcttatttcattaacaaactgctggaaaatgaatatcaataa

SEQ ID NO: 2360 - DNA, 799 bp, Bacillus licheniformis
atgacagcaaaaaatttgcaagatcgaatcaaattgaataacgggacagctatgccttggtttggacttggcgtatttaaagtagaagaagggcccgaactggtacaagccgtaaaaacggcgattaaacacggctaccgcagtattgataccgcagccatctacggtaatgaagagggggttgggcaaggaatccgcgaggggttgaaagaagccggcatttcaagagaagacctgtttgttacatcaaaggtctggaatgacgatttaggctatgacgaaacgattgcagcctatgaggcgagtctcgaaaagctcggacttgactaccttgatttatacctgatccactggcctgttgaaggacgctacaaagcggcgtggaaagcgcttgaaacactttatgaacaaggacgcgtaaaagcaatcggagtgagcaattttcagattcaccatctggaagacttgctgaaagatgccgccgtcaaaccggcgatcaaccaggttgagtatcatccgcggctgacgcagaaagagctgcaagcgttttgccgtgcgcacggcatccagctgcaagcatggtcgccgctgatgcaaggccaattgctcagccatccactgctgaaagatatcgcggacaagtacggcaagacaccggcccaagtcattttgcgctgggatttgcaaaacggggtcgttacgattccgaagtcgactaaagcggagcggattgcccaaaacgcggacatatttgattttgaactgaccaccgaggaaatgaagcaaattgacgcgctaa

SEQ ID NO: 2361 - DNA, 819 bp, Bacillus licheniformis
gtggatttttgcgtttatgacgtttgccggcagcctgggagcaaattttcagtcgctgaaaacagcggtggctcatcccttgccgatgtttctcgctttatttgttttgcacatatttatgcctgttttggcatggagcacggggcatcttgtgtttagcggggattcattgacgattacagggcttacccttggtgttgtcattccgacgggtattacgagcatgatttgggctgcaatgtataaaggtaacatcggtttaaccctgtcaattattttagtggacacgattctttcgccttttattgttccattcagtctttccatcttggccggggcgcatgttgaaatggatgtcatcggcatgatgaaggggttagttggaatgattgtgattccttctttattgggaatgctcgtcaatcaattttcaacgccggagcggacagtgcgattaagcgcaaattgtgctccgttttcgaaagtcgggttagccgccgtagtggcgattaacagctcggtggtcgctccttaccttaaaaacgtcgatttaaagtttttaacgatagccgttacggtctttttggtggcatttacaggctacctgacagcttggctgataggacggctgatgaagcggccccaggaggaaatcgtggctttaatttttactggaggaatgcggaatattagcgcgggcgctgtgttggccactagcttttttccgcctcaagtggcggtgcccgttgtcattggcatgctgttccaacagattctggccgcgctgtttgggcatttgcttgcaagaagcgagctgaa

SEQ ID NO: 2362 - DNA, 2055 bp, Bacillus licheniformis
atgttcatcctgctgtttttccatgtgaggccggagtccctcgacctcgatttattttcgatcagcgagaatacgatctatgcgccggcgacagttgaagaccaaaaggcaacggctaataaaaagcaggaagcgagagaggaagttcccgaccagtacactttgaaaaaagagtactctgacaacagggtcgaccttgtctcatcgattttcgacatcattaaagaagtgaaaaaagaaagcgcagaaaaagagaaaaaagacaagcaggccccatctgaaaaagaccagatcaaatctgttgaagaaaagctgacttccgatgtgacggactcgctgtcacaggattcagtcaaacacctgctgagggccagcgacggagagctttccatgacgcaggattcggtcatcaccgccgtcaatgacgtgatgagcaaagaaatccgcgcaggaaagctcgatgaagcgaaagaacatgtaacgaaagaactgaagggcaattcgataccttcaaaattaaaaaacgccgctgatgaaatcggacgctttgcgatcattcccaattacgtatacgatcctgacaagacggagcagaagcgtcaagaagcggctgacagcgtacagcaggtacagatcaagcaggggcagatactcgttgaggaaaatcagctgatcgacagggaagtctatcgaaagctcgaattgacagggctcttgagcggagccaacatcttcaaacctgtcggcggactgctgcttttaatcgcgcttttcatctcagctttggtttactatttcgaaaagcaatacagcagccggattccgaaaaacaagtcgctcatgctgttttcgttgatcacagggatcgttttaatcgtcatggaagtgatcagcctgtttcagcagcttgaaatcggccatatcggctatctcgtgccgattgcgatgggcgtgatgctcattaaactgctgatcaatgaaaggctggcgatcctgtcgagcatgattctttccatttgcggaagcatgatgtttaaccagggtgtgacaggcacgttcaactatggaatcggaacgtatttcttaatcagctcgatggcgggtatactgtttttagggaagcataacgcgagggcgaaaattctccaggccggtttatttgtctctctgatcaacatcgttgttctgtttaccctgcagctgattcaaaacacggcgcaaaccgggcttgagatgggtacatatcttgtcatgggggcggtgtccggcatcggatcgtcagttcttgttctcggactcatgccgttttttgaaagcggatttggcatcctgtccacgatgaagcttctcgagctttcaaatccgaatcatccgctgctccgcaaaattctgacggaaacaccgggcacataccatcacagcgttatggtcgcgaacttatctgaggcggcatgcgaagcggtcggagcaaacgggctgctggcaagggtcggcgcctattaccatgatatcggcaagacaaagcggccccaatattttatagaaaaccaaatgaatattgataacccgcatgacaagctttctccgcagctgagcaaaaacattatcattgcccatgtgacggacggcgccgatatgctgagggatcataaaatgccgaaggagcttgtcgacatagccgaacagcatcacggcacatcgctgctcaagtttttttactataaggcgaaagaaaaaggcgatcagacgactgaagaagagttccgctatcccggtccgaagccccagacaaaagaggcggcgatcatctcggtggccgacagcgtcgaagcggccgtccgctcaatgcataaccctaatcccgaaaggattgaaaagctggtgcgcgggatcatagcggataagctgcaggacgggcagtttgacgaatgtgatttgactttaaaagagctcaatactatcgcgaagacgctctgcgaaacgctgaaaggcatttttcattcccggatagaatatccggaagctaatcctaaacagaaggtgaaacatacatga

SEQ ID NO: 2363 - DNA, 1041 bp, Bacillus licheniformis
caattacttggaaagctccgggattggccggagaacgaatgtcggcggccaaggggtcgtcggtcacataaagccgggcggccccggcaagacggtcgccttgagagccgattttgacgctctgcctttacaggatcaaaaaaatgttccgtaccggtcgactgtccccggcgtcatgcatgcctgcgggcacgatgcccacacgtctgctctcctcacagccgcaaaagccctggcaaagcatcgaaaagacttgaagggaaatgtcgtgctgatccatcaattcggtgaagaggttacaccaggcggcgccaagccgatgattgaagccggctgtctcgaaggcgtggatgccattttcggcacccacatctgggctccgatgcccgtcggtcaagtcggtgtcaaatcaggcccgatgatggcagccgctgataaatttaaagtcacgatatccgggcggggcggacacggaggcgcgcctcacctaacgacagacgctttaatcacgggagcctcggtcgtcaaccatctccagcaaatcgtcagccgcagaatcgatccgacagaagcagccgtcttgtcgatcggaacatttcattcaggccaggcatttaacgtcattgccgaagaagcggtcattgaaggaacggtccgcaccttttcaaagcatgtccaggaaacgatcatcgccgagatcgaacgcgtaattaaaggcgtctgcgacagcaacggggcctcgttttcactcgattatgaaaaaggctacccgcctgtcgtcaaccatgaaaatgaaacggacatcgtccgtcaatgcgccaaacatgtcgtcggccctgaagccgtcatcgaactcgaaccgaatatgatcggcgaagatttctcttattatcttgaacatgtccctggatcattcttttttaccggcgcgggcaatccgcagactggagccgtttacccgcaccatcacccgatgtttgacatcgatgaaaaaggcatgctgaacgcggcgaaaattcttgtgtcggcggctctagcatt

SEQ ID NO: 2364 - DNA, 912 bp, Bacillus licheniformis
atgacaactgtaaatgagcaaattgaacatacattaaaacttgcggaaaaacacggccttcggctgaaacgaaagcatgcggaaatcaacgagtccggcatggattttcaagtcgtttttgcagaagatgaagcaggtaagagttgggtgttgagaaaaccgcggcgcgacgatgtgattgaaagggcagtgtatgaagggaaagtgctgaagctgctgcaaaaccgtcttcccgcggctgtgccggattggcgcattcatactcccgaactgattgcatatccggagcttccgggtgtgcctgccgcagtcattgacatggacatcaagaattacgtatggaacatggagcatgagcctccggctgaagcgtttaccaggtcattggcgaaaacgctcgcgctattgcacggcatcgatcataaggacgcagaagaagcgggcatgcatgtgatgaatccggatgacgtcaggcagacaaaagcagagcatatggagcggatcaaaagtgagctcggggttagcgccgagctctgggaaagatggcaaaagtggctgtctgacgactcgtattggcctgaacatacggtgtttatccacggcgacttgcaccctccgcatattttgattgaccagcatcagagcataactgggctgttggattggacagaagcaaaaatcgccgacccggctaaagactttctgttataccagacgattttaggagaagccgaaaccgcacggctcatctcttattacgaagaagaaggaggacgcgtctggccgcggatgaaagagcatattaaagaaatgcaggccgcctacggcatcgaaatcggcatgtttgcccttcaaacgaaacaagaagagcacttgaaaatggcgctggacgcgcttggcgtcacacaataa

SEQ ID NO: 2365 - DNA, 696 bp, Bacillus licheniformis
tgatcgccttttttaccggccagcttgagtttaccaaagggattatgtcgatgcctcatctgccggaaaaactgatcgtcacaaaccctttcgccgcttttggcgatgtcatccactacggcctttattcggttgtcttttcgtttctgctcgtgacgatttttgatacgacaggaacgatgatcggtgtcgctgagcaagccggactcatgaaaaacaacaaactgccgaatgcaagaaaagccctccttgccgattctacagcgacgacagtcggtgcaatgttcgggacaagtccgacgaccgcctatatcgaatcatccgccggggtggccgcaggcggaagaacggggcttacgtctttaacagtcgctgtgcttttcggcgcggccctgtttttcagcccgcttgtcagtgcggtctccggaatcgcagcgattacgtcgccggcattgatcattgtaggaagcatgatgatcggcgccgtgacgaacatccgctggaaagaacttgacgaagcatttccggcctttctcgtcatcttgacaatgccgctgacatcatctattgcgacaggcatttccctcgggtttatcgcttatccgattgtgaaagccgcgaaaggcaaatggcgcgagattcatccgcttgtcttcgtgtttgctgttctctttttcatacaccttttctttttgg

SEQ ID NO: 2366 - DNA, 1022 bp, Bacillus licheniformis
  misc_feature (1)...(1022): n = A,T,C or G
atgtttgaagatcagacaaagaaaccgtttataaaaagactccttaaacataaaataaagttttggctgactgtggttgcggttctgctgattttaaccgcaggcgctgtttcgctctacngttaatcggcgctcgaaccggtcgantaaaataatgcaaaaacggtcaatgtctatattccggaaggatcgaccgttacgctccatcgccgccaaactgaaaaaagagacctaattaaaaatgaaaaagtatttatcgcttatgtgaaatttaaaaatgcctccggctttcaagcggggaactttcagctcagccagtcgatggatgcggcaggcatgattaataagctgacaaccgcttcacatgtgccggcatttaaaattaccgttcctgaaggaaggcagctccaggaaatcgcagacatcatcgccggacaaacgaactactcggcaaaggacattatgaaaaagctggatgacagggaattcatcagccgattaaaacagaagtatccgaaactgatcacagacgacgtgttgaacaagaaagtcaagcatccgctcgaaggatacctgcatcctgcgacatatccattttacgaccctgagacgaagcttgatgccattatcgaagcgatgatcaaacaaacagatcagctggctgaaaagtatgaaaagcagatgaaagacaaaaagatgtccgtccacaaagccttgacgatggcttcgttaattgaagaagaagctaccgaaaaagcggaccggcacaaaatctcaagcgttttctacaaccgcatcagcaaaaatatgccattgcaaacggatccgaccgtcttatatgcactgggagaacataaaaaccgcgtcatgtacaaagaccttgaagcggattccccatataatacgtacaaacataccggtcttccgcccgggccgattgcaaacgctggagagacttcctgggaggcggcattaaatccggagcaaacagactatgtttattttcttgcaaagaaaaacgg

SEQ ID NO: 2367 - DNA, 1167 bp, Bacillus licheniformis
ccttaacaaaagaggatgtacaaagagggcgctttttccgcatgtgcttttgcggggaacgagcacccgccccaaaacggccgaactcagatcgtatcttgatgaactttacggcacttccgtatcatgcgatctctccaaaaaaggggaaatgcatgtcatcacattcaggctcgatatcgctaacgaaaaatttttaaaggatcagacaccgcttctggaaaaagggcttgagcttttgtcagagatcattttttcgccggcgcttgaagacggggcctttctgccgctgtacgtgtctcaggaaaaacgcacactaaagcaaagaatacaggcggtctataacgacaaaatgcgctattcaaatttgaggctgattcaggagatgtgcaaagatgagccatacgcgcttcacgtcaacggagagcttgatgatgtggacggcatcacgcctcaaagcctgtatgaagcttatcaaaaagcggtcagcgaagaccagctcgacatttacgtcgttggggatgtggatgagcagcaggtggattcgtacatttccaaatactttgaagcaaacgagcgggagctgagacctgttcccgagcttgagcaaacccgcacaagggagcctcaggaagtcatcgaggatgctgatgtcaagcaagggaagctgaacatgggatttcggacgggaacgcattttacggatgacgattatccggcgcttcagctgtttaacggcttgtttggcggattttcacattccaagctgtttattaatgtcagggaaaaggccagccttgcctattatgcggcttccagaatcgaaagctttaaagggctgttgatggtgatgtcggggattgaagtcggcaattatcaaaaagccgtcgacatcatcaaggagcagtttcaggaaatgaaaaaaggcagctttacagaagaggcaatcgaccagacgaaagccgtcattaaaaaccagattcttgaaacgcttgatacaccgtacggtttagtcgaatttatttatcagcaggctgccgcccaaaccgaattttccttggaagactggctgggacgaatcgacaatgtcacaaaagaagacatcatcgaagtcggaaagaaaatcgatttggatacaacgtactttctcaaagggacggagggagc

SEQ ID NO: 2368 - DNA, 1647 bp, Bacillus licheniformis
agcaaacgattttaaaaaacattgattttgacatttccaatcatgagcggattggtttggtcggatgcaatggagcggggaaaacaacgcttgcaaatatattgagcggtcatgcagaagccgacaaaggcactgttcaaacagaccggacgctcaaaatcggctatctgctccagtcgattgagtactctgttcatgatttcaacagcatattaacaggcgacgagggcgggaaattatatcagttgacgagcagtcttggcttatcaaaggttcaaagctggaattccgaacggctcagccatttgagcgggggagaaaaactgaagcttgcactggcacacgtctggaagacgatgcctgatcttctcatcttagatgaaccgaccaatcacttggatttaaaagggatcagctggctccttgaagaactgcaacaatatcaaggggctgtattgattatttctcacgaccgttattttctggatcaatccgtctccaaaatacttgagctggaagatgggaatttgcacacctatcaaggaaactacagtgcataccggcgggagaaaaaacggttatacgaagcacgcctgcaccaatacgaagtccagcagaagcaaaaagaaagaatcgagtcacagattgccactcttcaaaattggtcgcagaaagcccaccgcgactcaacaaaacagggatcacagtcagaaagaaggcagcttggttttaaagaataccaccgggtaaaagccaaaaagcttgacaaccaagtcaaatcaaaactgaaacgccttgaacaggagcttgaaaaaaacaaagctgaaaagccaaaggaagcagcatctgtcaattttcagttttcatcaggagaaaaaaggggcaagcggattatcgaagcaaaagatctgacaaaagcgtttgacggacgtactttattcaaagacagccatttttacgtcaaacacggcgagagaatagcgcttatcggagacaacgggtgcggcaaaacgacccttgtcaaaatgatgttggatgccgaacctccaacagccggaacgctatggaaaagccggtctgtaaaggccgcatatttaagccaggatgtcagtgatctaagggttgaccaaacagttgctgaagtgctgaatttgtctgacagagccgaaatcgcaaatgcgcggacgattttggccaatatggggatcaaagaaaaccgctttcatgatgaaatcgggacgttcagtctcggggagcggacccgaatcaaactggcaggcatgattttaaaagattatgatctgctgattctggatgaaccgaccaaccacctcgatttgccaagcagggagcagcttgagcagacattgcttgagtttcagggaacgatcatcattgtgtcgcatgacctgtacttcacagacaaattgtgtgagaagctccttgtatttgaaaacggtcgtatcacccgcgtcgaaaccggattaaaagattatcggaacagacagaaacagccccatgcaaaaagcgatgaagaggagcggctgcgcatcgaaaatcggatgaccgccgttcttggagagttggccggacttacgcctcaagatccgaaatatcatgaattggatcaggagttttcagagctgg

SEQ ID NO: 2369 - DNA, 792 bp, Bacillus licheniformis
tgcatgcgggatctgtcgttattgctgtcggcgggaaaagcgtcccccatactggatcgaccggagacggcgtatgaatgggcggaaaaagccggccatacgattacggaactgtttcctacagaggttccggttacgtctgacaagccattatcaatcagaaaacattgcagggcctatcactgagaaacgtcgccctcagcgtattgaacaaaaaaggaaagccggtcatcacccaccaaatggatatgatttttacccattttggactgtccggacccgcagtcctcagatgcagccaatttgtcgtcaaagagttgaaaaagcaggaaaaagtcaggctgaaaatcgacttgttccctgatattcatgaggaacagctttttcaacgcatgcataaagaattgaaggacgctccgaagaaatcactcaaaaacgtgctgaagccttggatgcaggaaaggtatctgctgtttcttttcgagcgcaacaagattgatccttctgaaaccttctcttccctttccaaagaccgtttcagagctttcgtcaaagactgtaaagagtttactgtcaacgtgaacggcaccctttcgcttgacaaagcctttgtgaccggcggaggggtttccgtaaaagaaatcgatcctaaaaaaatggcgtccaaaaaaaaggaagggctttatttctgcggggaaatcctcgatattcacggctatacgggtgggtataatatcacatccgcgcttgtcacaggcagacttgcaggcttgaatgcaggcgaattttcgc

SEQ ID NO: 2370 - DNA, 896 bp, Bacillus licheniformis
atgaagattgcgattgccggggggacaggttttatcggcagacatttgacaaacgccttaaccgcccggggacatcacgtctatattttaacaagaaaaccggccgaaaccgaacaaaaaaacacttctttcgttctctggcaaaaaaacggcgcccgtcctgaaaaagatctgaccgatatcgatgtttggatcaatttagccggaaaatcgcttttcggccgttggaatgaaaaaacgaaggcggagatcgcgacaagccgcctccgctctgtggaggagtcggcccgcatcatacaaagtcttcagaagaagccgaacaccctcattcaggcgagcgcagtcggaatttacggaaccagtcttgaacagacattcacggaggaatctccagtttcggctgaggattttttaagcagaacgacagctttgtgggaacaggcagccgaaccaatcgaagcgcttggcatccgcaccgtctggatgcgttttggccttgtgcttggaaaagacggaggcgcgctcccgaaaatggcgctcccctatcaattgtttgcaggcggacgcatcggctcggggcggcaatgggtgccatggattcatatcgaagacgccgtcggcatgattttatctgcgattgaacagacgctgatgtccggccccgtcaatgtcacggcaccgaatcccgttcagatggatacattcgggcaaaccgtcgcgaaagtagaaaaacgcccacactggctcccggttcccgaatttgcgataaaaggcgtacttggagaaatgagcatgctcgtgctgaaaggacagcgcgtcctcccgaaaaaagcgcttcagaacggctatcatttcttatatcccgatctggaagatgccctgcacaaccttctggc

SEQ ID NO: 2371 - DNA, 681 bp, Bacillus licheniformis
atgagcatgattttttacttgttaacatttgctgcattaggtttatcgatttgggcacaatttaaagtaaagagcaactttgaaaaatattcaaaagtagaggcgtcaagcgggagaactggagccgaagtggccagacagattctcgaccgaaacggcctttacgatgtcccggttgaaccggtaagaggaaccttgacagaccattatgacccgacagcacgcgttgtgcgcctgtccgaacccgtatactacggccgttcaatcgcagcggtttccgttgcttcccatgaatgcggacatgccctgcagcaccaggagtcatacggcgcacttgttttgaggcataagatgtttccggtcgtgaacttttcttcgggagtggcgccgtttttgtttatcggcggaatgctgctcggaagcctgaatctgatcggactcggcatcatattgttttctgcggccgtattcttccagcttgtgacattgcctgttgaatttaacgcaagctcccgggcaaaaaggatcatcgtttcagaaggaatgatccgcaacacggaggaaagaggcgtcagcaaggtgctggatgccgcggctctgacatacgtcgcagcagcgcttgtttcgctgtttgagctgctgcgcttcgtcgcaattttcctgtccggtcgtaatgactaa

SEQ ID NO: 2372 - DNA, 637 bp, Bacillus licheniformis
gtgagtacgatcgaactaaataaacgtcaggagcatattttgcagattgtcaaagagaacgggccgattaccggagaacatatcgcggaaaagctgaatctgacgagggctacccttcgtccggatttggcaatattgacgatgtcgggatttttggaagcaaggccgcgggtcggttatttctacacgggaaagacgggcacgcagctcttggctgataagctgaaaaaactgcaggtgaaagacttccagtccattccggtggtcattcatgaaaatgtctccgtttatgatgcgatttgcacgatgtttttagaggacgtaggaacgctttttgtcgttgatgataatgccatcttagtcggtgtactttcacgaaaagacttgctcagagccagcatcggcaaacaggagctcccttcaatacccgtccatatcattatgacgagaatgccgaacattacgctttgcaggcgcgacgatttcattttggacattgccaagatgctcatcgaaaaacaaattgacgcactgcctgttgtaaaagatacagaaaaaggctatgaagttgtgggaagaattacgaaaacgaacatgacaaaaattttagtcggcttatctgaaaatgaaatcatgt

SEQ ID NO: 2373 - DNA, 675 bp, Bacillus licheniformis
taaaaagattcctgtgacagtattaagcggatacctgggggcgggtaaaacgacgatgctgaatcacatattgcaaaaccgccaagggctgaaagtcgccgttattgttaatgacatgagcgaagtcaacattgatgcagggcttgtcaagcaaggcggcctgtcgaggacggatgaaaagctggtcgaaatgtcaaacggccgcatttgctgcacactcagagaggatttgctggttgaagtcgaaaagctggcgaagcagggaaatattgattatatcgtgatcgaatcgaccggtatcagcgaaccgatcccggtcgctcagacgttctcttacatcgacgaagaattgggtattgatttgacccggttctgccgcttggacacaatggtgacggttgtcgacgccaatcgtttttggcacgattttcagtcgggggacagcctgctggaccggaaagaggctgtcggcgaagaggatgaacgcgacatcgccgatctgctcatcgatcaaatcgagttctgcgatgtgctgattttgaataaatgcgaccttgtctccgaggaagatctgcaaaagcttgagaaagtgctgaaaactttgcagcctaaagcaaacatcatcagagcggtcaaaggagaggtcgatccgaaggccgtcttaaacaccggtct

SEQ ID NO: 2374 - DNA, 684 bp, Bacillus licheniformis
atgggcagtattttagaatttcagaatgtcggctattggtataaaaatcaggatcagcctctattcgaggatatcagcattcaattcagccaaggactcttatatacgattgtcgggacttccggttccggcaaaaccacctttttatcgttggcgggcggacttgacgcgccaaaagaggggaacatcctctacaaaggagaaaacatttcaaaaatcggactgaccagcttccgcaatcaatatgtatcgatcgtttttcagtcctataacctgctgccgtatatgacggctctccaaaatatcacgtcggccatggaaatcaccggatctcaggtcaaaaacaaggaacaatacgctttggagatgctcgaaaaggtcggcatcggcgaaaagcaggccagacagaaagtattgacattaagcggcggccagcagcagcgtgtctccatcatcagagcgttctgctgtgacacggatttaatcgtcgccgatgaaccgacaggcaatttggatgaagatacatcaaaagacatcgtccggctctttcaaaaccttgcccaccaagaaaacaaatgcgtcatcatggtcacccatgatgaacagatcgcaaaggtatccgatgtcaacatcacgctttcaaggggcggctttaccgtcaaaaaacgcatatcagcaggataa

SEQ ID NO: 2375 - DNA, 659 bp, Bacillus licheniformis
atggtaagcagtttaaaggacactgtgacattacataacggtgtgaaaatgccatggtttggacttggagttttcaaagtggaagaaggcagccaagtcgttgaatctgtaaaagcagccattaaaaacggataccggagcattgacacagccgctatctatcaaaatgaagaaggcgtcggcaaagggattaaggaatcaggcgttccccgcgaagagcttttcatcacgtcaaaggtttggaacagtgaccagggatatgaaaaaacattggcggcttttgatgaaagccttcgaaaactcggccttgactaccttgatttatatttgattcattggccaggaaaagacaaatataaagatacgtggcgcgcacttgaaaagctgtacaaagacggcagagtgaaagcgatcggagtcagcaatttcaatgtccaccatttggaaagcttattggaagatgcggaaattaaaccgatggtcaatcaggttgaattccatccgcgcctcactcagactgagcttagggactactgcaagaagcaaggcattcaggtggaagcatggtctccgctcatgcagggaaaactcctcgatgatcaggtgctgactgacatcgctaaaaaattacacaaatcccgtgctcaagtcatcctgcg

SEQ ID NO: 2376 - DNA, 1029 bp, Bacillus licheniformis
aaatcggaattataggagccggaggaattgcaaaagcccatgcgaaagctctttcaacagtcaaaggtgccgagctttccgggttttttgatatcaactcgcttgcctctcgtaaatgtgcgtttgaatacggaggaactgcctttaccagtatgcaggagctgttgaatcagtcgacggcagtcatcgtttcatcgccgaacttttgccataaagaacatgcgcttgaagcgatggctgcagggaagtatgtattgtgtgaaaaaccgatggctgtctcaatggaagaagcggaggagatgaaaagcagggcgtctcaatccgcttatattccgatcatgggcttcaattaccgccatctcacattcgttaagcgcctaaaagatatgatatccggcaatgaacttggagatattttgtccatcaatgtccattttaagaaaaacagcgccttgagaagaaaaaaatatacttggcgcgatcattcgaaaagcaacaaaacgagcggggcattaggagatttgggcgtgcatttaatcgatctcatactctatttgttcgacagcccgtttaaactggacagtttaaaagtcaaaatgatgacggtcgtcaaagaaaaagaacaaaaacaggtatatgttgatgatcattcagaagtatacggccagcttgaaaatcatgtgtttgtcaatatgattacgtcaaaatgcacaaaatcggatgagtgcggcttcagcatcgaggtcaacggccaaaacggcgtattttactatcattcacggcagaaaaatcagtttttgctgagggccggattgacggagcagatgataacaatgccggacacgtggctgacagaccctgaaaatgaattttacggatgggccgattccttcagagttcagctgatccaatggatgaacggaattcgggatcgcaattttgcatctcttgccacttttgaagatggatacaagacgcagttctacttaaatgaatttttcaataaaggtcagcagctgtccctttcaa

SEQ ID NO: 2377 - DNA, 900 bp, Bacillus licheniformis
aaaacagccatttaggttccttaacgaccgaacgccgcaatgaaagatccaagcgcattcaccaggcagaaacgatcgatatgttgaaaatcatgaatgatgaagataaaacggtagccgaagctgtacaagaagtcttgcccgatgttaagaccgccgttgactacgccgtcgggtcgttaaagaaagggggacggatcatctacatcggtgccggtacaagcgggaggctcggcgtacttgatgcagctgaatgcccgccgacattcagcatatctcccgagtcggtcataggcatcattgcagggggagaaaaagctttgtacaatgccgtcgaaggcgctgaagatcatgaggcttttggcagacgggatttagaagccgttaacctctcaaacaatgataccgtaatcggaatcgccgccagcggccgaactccgtacgtcctaggcgccctgaagtatgccaagaaaacaggtgccaaggccatatcgctgacatgcaatgaaaactcggcgatcagccaggcggcagatcacagcatagaagtagtcgtcggccctgaagtcattgccggatcgacgagaatgaaagccgcaaccgctcataaaatgattttaaacatgatctcaacggcggccatgatcaaaatggggaaagtctatgaaaacctcatggtagatgtaaaagtaagcaatgacaaattaaaggagcgggcgatccgcatcatccaaacggtcacaggtatgccaaatgaaacagcggcgcaagcattggaaatgtccaataaccaagtcaaaaccgccatcatcatgctgaaaacaaacgaagatgcagccgctgcagaaaaactgctggagaaatcagaaggcgatattgaaaaggccctatccatttatg

SEQ ID NO: 2378 - DNA, 630 bp, Bacillus licheniformis
ttcaaaaattccgcaagcgacagcgaaacggctgccattatattatcgttttttaaaaaaccttcatgcatccgggaaacagcgtgtatcttccgctgagctgagcgatgccgtcaaagtcgattccgcgaccatccgaagggatttctcgtacttcggcgcgctcgggaaaaaaggatacggctacaatgtcaattatttgctgtcctttttcagaaagacgcttgatcaggatgaaacgacgaacgtaacgcttattggcgtggggaatttggggacagcctttctccattacaattttatcaaaaacaataatacaaaaatcgccatggcgtttgacatcaatgaagaaaaaatcggaaccgaggtcggcggcgttcccgtctatgacctgaataagcttgaagagcatatgacggatgatgatatcccggtcgccattttgacggttccagctcaagccgcacagtcgattacagacaggctggtggcgcttggcattaaaggcattcttaatttcacgccggctcgcttgaatgtgccggaacacattcgcattcatcatatagatttggcagtggaacttcagtcgctggtgtattttctgaaacattattcaatgcaggaaaa

SEQ ID NO: 2379 - DNA, 741 bp, Bacillus licheniformis
ttgttgttgcaaaaggagtcagaagcggaatagaaaaggcgagcaagtttatgatgcctgctctgttcattatttttctgcttttgatcgttcgttcgctcacacttcccggttcaatggagggcttggagtttttcttaaaacctgatctttcacatatcaaagccgaaacggtgctgtttgcgcttggacaatcctttttctcgctaagcgtcggtgtttccgtgatggtaacgtacagctcttatttatcgaaaaaagaaaaccttgtacagtcagccgtatcagtgacattgctcaatgtatctgtagcgattcttgccgggtttgcgatttttccggccgttttttcattcggattatctcctgatgccggcccgatgctgttatttaatgtgctgccgtcagtctttcataagatgcctttaggaatcatctttttattggcgtttctgctcttatttttatttgctacactgacgtctgcattttcaatgcttgaaatccttgtttcttccttgtcaaaaggggatcctaagaaaagacaggctttcgcttgggcgggaggaattgcgattttcctattcggtattccttcagcattgtcatacggcgtgcttcaggatgtgtcgatacttaatctatccatttttgatgcggcggattatcttgtcagcaatatattaatgccgctcggcgctttgcttattgccgttttcgtgccgtttaaatgtcgaaaga

SEQ ID NO: 2380 - DNA, 687 bp, Bacillus licheniformis
atgtacgatattaccgagtggaagcacgtctttaaactcgatccgaataaagatattacggatgatcagcttgaacagctgtgcgaatccggaacagacgcggttttgatcggcggaagcgaccatgtcacagaagatgacgtccttcggctgatgtcaaaggtgcgccgctttttagtgccgtgcgttcttgaagtatcgacgatcgatgcgatcgtcccggggtttgacctctattttattccgactgtgctcaacagcagggatacagactggattgccggcttacataaaaaggcgatgaaagaatacggcgagctgatgtcgccggaagagattgttgttgaagggtactgtattttgaatcaggactgcaaggctgccgctttgacgaacgcagataccgagcttgacattgaggatattaaagcgtacgcccgcgtagctgaacatcttttccgccttccggtcttttatcttgaatacagcggcatgctgggtgattcagagaccgttaaggaaacgaaagccgtgcttcaggaaacgacgctgttttacggcggcggcatcaaagatgcggagacggcggttaaaatggctgaacacgccgatgtgatcgtagtcggaaacgcgatttatgagaacttcgaagaagcgctgaaaacggtacaggccgtaaaaggatga

SEQ ID NO: 2381 - DNA, 788 bp, Bacillus licheniformis
atgaatcattcatctcaaacgaaaggaatcatttacacagcgctttcttatttgctgtgggggctccttcctttatattggaaagtgctcgatcagacggccgcgctcgatattctggcgcaccggattatctggtcatttgtttttatgtgcggggtgcttctcgttttgcggcagtggaaaaacggagtcaaagcatttcgctcgctttcgggaaaccgaaaggaatttgttccgctcattttgtcgtccgttctgatttcgatcaattggtatgtctacatatgggccgtcagcaacggctatattcttgaagcgagcctgggctactacatcaatccgctcgtatcgatcgttctcggaattgtctttttaaaggaaaagctaacgcggatgcagggagcggcagttcttctcgctgccctcggcgtgcttatttcagcttttcagtacgggtccgtgccgtacatcgccctgatgctcgcattcagcttcgggctctacggactggcgaaaaagcgcacatcgctctcaagtgccataggacttactttggaaacgatgatgatcgctccggttgcagcgatctacctgctgttcttcagccatccggagaaggctcaggcagcctcagggagcatcggcatgatggtgctgctgtttctggcgggggtgctgaccgcgattccgctgcttttatttgcggaaggtgcaaagaaactgccgctctatcaagtcggcattttgcaatatatcgctccgaccattacattatgtttaggcgtttt

SEQ ID NO: 2382 - DNA, 652 bp, Bacillus licheniformis
atgattaaagcagtgatttttgattttgacggtcttattttagatacagaaacgcacgaatatgaagtgctccaggaaatttttgaagagcacggctcagagctgccaatgtcggtttggggaaatgtcatcggcacggccgccggattccagccgttttcttatctggaggaacagctgcaaaaaaaactggaccatgaacaactaacgaaattgagacaagagcgttttacgaaaagaatggaaaatgaaaaagcgcgcccaggtgtggaagcttatttgtccgcggcgaaagagctcggtttaaaaatcgggctggcgtcaagctcagattataaatgggtgtcccagcatttaaaacaaatcggtctgtacgatgatttcgaatgcatcagaacggccgatgatgttgaggaagtcaaaccgaacccggaactctatttgaaagcggcggaatgcctcggtgtgaagcctgaggagtgcattgcattcgaagactctgtcaacggatcaatcgccgcgaaaagagccggaatgaaatgtgtcattgtaccgaataaagtaacgaaaagcctgctgttcgagcattatgaccaccgcctggaatcaatggcggaaatggagctggaacagctgatcgaaaaaatctccg

SEQ ID NO: 2383 - DNA, 665 bp, Bacillus licheniformis
atgtttgaaaaactgtttccaaacgtagatatggagcagctgtgggaagcaacgtatgaaacgatatatatgacaggaatttccctattgtttgcttttatcatcggagtgattctcggcatgctgctctatttgacttcaaaaggcaacatttggcagaaccgagtcgttaacggtgtaatctcggcaatcgtcaatgtgttcaggtctattccttttatcatattgattattttgctgctcggtttcacaaagtttttaatgaatacgattctggggccgaatgccgctcttccggctttgattatcgcatccgctccgttctatgcccgcctggttgaaattgctttgcgcgaggtcgacaaaggcgtgattgaagcagcgaaatcgatgggggcaaaaacatcgacgatcatatttaaagtgctcctgcccgaatcgatgccggcgctgatctcaggcattacggttacagccattgcactgatcggttcgacagcgatggccggagcaatcggttcaggcggactcgggaaccttgcctatgtaaacggctttcagatgaacaatcccgatattatactgatcgccactattttcatcttagctattgtgttcatcatccaatttatcggggattttataacaaataaattagacaaacg

SEQ ID NO: 2384 - DNA, 663 bp, Bacillus licheniformis
tagccggaaatgtgccggaaacttttataaaagaagctgaaaagcatttcggttcatatgaagccaaaggcaaaagaaccggcatgacaaaaccggattttcaccatgagaaaatgacgcgcaaaaaggaaaccgaacaggctcacctctgcctcggcttcaacgggctggaagcaggccatccggaaatctacgatttgatcgttctcaataatattttgggaggaagcatgagcagccgcctctttcaggatgtccgcgaagataaaggtcttgcatattccgtgttcagctaccacacttcctatgaagacagcggcatgatgaccatctacgcgggaaccggcgcaaatcagcttcagctcctgtcagaaacgattcatgaaacactgcgtgcgctgaaaagcgacggtattacaccgaaagagcttgaaaacagcaaagagcaaatgaaaggcagcctgatgctcagtctcgaaagcacaaacagcaaaatgagccgcaacggcaaaaatgagcttttgctcggtaaacaccggacgcttgatgaaatcatcgaaaagttgaatgccgtcagcctcgagcgtgtgaacaatcttgccaaccggattttcaccgatgattactcatctgcattaatcagcccgtcgggtgagctgccga

SEQ ID NO: 2385 - DNA, 1064 bp, Bacillus licheniformis
gtgggaaaagtaaaaagaaatatgccttgcccctgcggcagcgggctgaaatataaaaaatgctgcggcaaagcagagggagcgtttccggctgtcgcggtgcaagaattgaaacaaatccagaaagacgtcatggaattcgcttttacggaacataaagacacaatcgatcaatttctcaatcagtattcttttctgtcagacctggatcagtctgcgcaaaagatatgtgtttttaacctgggcgtgtggggagtatttgcccgcccgctggcagatggaggattgacgatttttgaagactttttacagaaaaaaggatcttcgattctcagatcgcagacaaaggaagccgttcaatcgtggaaagacctctcccctgcgttgctgcgtgtgaaacatataacagatggcggcattcgctttgaggatgctgtaacgaatgaagagctgaccgtgaggatgaatgtgaaacgggaagggccttttgtaggcgagtacgtgctcggctttccgatcaagatcggaagccataccgagttcttcttgcaattcaccatctatcctgcaaaaatggcggatgctctcaaagacaggctaagcgaggctttgaaccgttttacagaagaaggcgggacgaaagagcagctgatgagagaggatttccatcatgtgttaatgcatctttgccggcaggaagagagtacaccgtctgaacaagtgtccgaagacatcgaatgggccaatgagatggaaaaagaaacagcgctcgtttttgagaaaggtatgcttgacgaaggacattctgaaccatttgtgtcctgggcggtcggcctttggaaatcgtattgtgccaaaaaagcaccggtcatcaaaaaaacagaagcctttgcagctgctttggagtattttatcaatacgatctccaaatcggaaaaatcgatatcccaagcaaagcttgcaaaaaaatacggcgtcagcgcttcgaccgtatcgaatcgttttaaagatattgaagccgtcctgcaggatgaacttgaccatcatcttgagcttatgccatc

SEQ ID NO: 2386 - DNA, 573 bp, Bacillus licheniformis
cgaaaaaatgcctggcggcctcgatgtctatgttcttccgaaagaaggatttaacaagacatatgcggtctttaccacaaaatacgggtcgattgacaatcagtttgtcccgctcggaaaagatgaaatggtccgcgtgcctgatggaatcgcacactttctcgaacataagctctttgaaaaagaagacggcgacgtttttcagcaattcagcaggcagggagcttcggcaaatgcgtttacctccttcacaagaacggcctacctgttttcaagcacgtcaaatgtggaagaaaacctggaaacgctcgtcgactttgtgcaggacccttactttacagaaaaaacggttgagaaggaaaaaggcatcatcggacaggaaatcaacatgtatgacgacaaccccgactggcgcctgtttttcggcctgatcgaaaacatgtatcaagagcaccctgtccggatcgatatcgcaggcacgatcgaaagcatctctcatattacaaaagaccttttgtacgaatgctatgagacgttctatcatccgagcaatatgctgctgtttgtcgtcgg

SEQ ID NO: 2387 - DNA, 638 bp, Bacillus licheniformis
atgcgaatgcgtcacaagccatgggcggatgactacctggctgaaaactctcatattgtgatcagcgagccgtctcaatacaaagggaaatggcattccgtttttggaaatgacaacccgatccacatcgaagtaggaaccggaaaagggcaatttatttcaggaatggccctgcaaaacccggatgtaaactatatcggaatcgaactatttaaaagcgtcatcgtaaccgctgttgataaagtaaagcagacagaggcgccgaatgtaaagctcttgaacatcaatgccaatatgctttcagacgtttttgcagacggggaagtcgaccgggtctatttgaatttttccgacccgtggccgaaaaagcgccatgaaaagcgccgtcttaccaatcatgcgttcttgaaaaagtatgagcaggtgctcggaggcaagggagcgattcattttaaaaccgataaccgcgggttgtttgagtactccctcaccagtttttccgaatacggactcgttttgacattcgtcagccttgacctgcatcaaagcgattttgaaggaaatgtgatgaccgaatacgaagaaaagttcgccgctaaaggccagccgatctacagagtcgaagctgaatggcgaac

SEQ ID NO: 2388 - DNA, 642 bp, Bacillus licheniformis
atgtacacgattaaagaagaaattgctaatgcaataacccatggactcggcgtcctcctgtcaatacctgccatcgtatttttggtgatatttgcgatccgctacggaagtccggttgatgttgtcagcttttcaattttcggcgcttccatgctgttcctgtatttaagttcgacccttctgcacagcattcagcaccaaaaaacaaaagatattctggagatcatcgatcactcagccatctacgtactgattgcagggacatacacaccgctgctcctcggacctttgaaaggcgcgctaggctatacgatgcttgctgtcgtttgggggcttgcgattggcggggttgtgtttaaaatcttttttgtgaaacggtttatcgttgtcagcacactggtatatcttgtgatgggctggatggcgatcattgcgatcaagccgctttatacggccttgaccggagaagggttcgccctgctgcttttagggggaatcttgtattctgtcggaaccatcttttatttatggagaaagattccatatcatcatgcgatatggcacactttcgtgctcggcggcagcgcctcaatgtttttctgcgtgcttttctacgtggcaaaagtgccgtttgtatcgtaa

SEQ ID NO: 2389 - DNA, 813 bp, Bacillus licheniformis
cgtttcagcttgcttcaaggcttgtaaacaggcttggcgccaatatcgacatgattttaatcgggcggtttctcggtgcggaagcattgggaatctataacctggcgtatcagattattacgattcccgtattaaaaatcaatccgatcgtaacaagggtagcgtttcctgtcttctcaaagaatcaaggggacaaccaaacgctgcgcgaaggctttttaaatatgacaaagcttctcgcgctgatttcattcccgctcctgatcggactgacgactgtttcagatttatttgttgaagtcgtcttcggagaaaaatggctgcaggccgtaccggttctgaacatcctcgcgattgtcgggctgctcagggttctgatgaatccgaacggatcggttttgctggcgaaggggcgagcagacctggcattttattgggacagcgggatcatgctcctttatgggctgtctctttacgcggcggtattaacgaatgatttgacgatcaccgcctggacatatgcagcgatcagcctggtcaatttctttatcggcagatggctgctcaaatatgtcatccagctgaagctgggcgaatatttcagaaccgttggaaaaccgctggccttgacgctgctcatggcattgctggctcttgtcttgagcgtcggcagcagacatctgcttcacggcgccatgcttcagctggcagtttccgtcgggatcagcgggattttttacggttttctggtcggcaaattttatcggcgggctatgagggcccaattaggaagatgacagcagaaagggcggt

SEQ ID NO: 2390 - DNA, 859 bp, Bacillus licheniformis
atgacgcagcaaatccacccgggcactgagctcggatatgtcaagctgaaggtgagccgtcttgaaagatcggtttctttttacagggatgtgatcggttttcaagtattaaaacaggacggcaaaacggcggagttcacagttgacggaaaaaatccgcttttgatcattgaggagattccaaatgctgttgttcttcctgaacgatcggcagcaggcctttatcattttgccattttgcttccaaaccgaaagcagctcggcatggctgtgaagcatttgatccgcgccggcattgaactcggccagggagatcaccttgtcagcgaggcgttttacttgtcagatcctgatcaaaatggaatcgaaatctaccgcgaccgtccgcgagagggatggaagcgcgatgagcaggggaactacgtgatgggtacggagccggttgatgtccaaggacttctggaagaagccgatggccacgaatggcaaggtcttcccccggaaacaaaaatcggacacgtccattttcacgtccgggatttgaagcaggcgaaagaattttaccactctgtactgggatttgatatcacaggagattatcaacacatgtcagcgctttttgtctctgccggaggctaccatcatcatatcggcttaaacatctgggccggacagcatgcgccatttgccccgcttgatgcggcaggcatggcgtattacacggttcttttaccgaatcgagcggaacttgaccgaattgcaaaaaaactgaaaagctcgggttatgccgttgagcatgaagaaaacgcatggtttgttaaagacccggcatcaggtattgatatcagattgaccgttt

SEQ ID NO: 2391 - DNA, 689 bp, Bacillus licheniformis
gtgaaaaattatcgtactttattttttgatgtggatgatacactattagacttcggtgcggcagaaaagtcagcattgcgaatgctttttgaggagcagcaaattcgtttgacagctgaaatagaagcgaattataaacgaatcaatcaaggtttatggagggtgttcgaaaaaggggagatggaccgcgaccaagtggtgaacacacgcttttcccttttattcaaagaatatggtcttgaggctgacggcgttttgcttgagaagaagtatcgcagcttccttgaagaagggcatcagctgatagacggcgcttttgaattaatcaaaagcctgcgggatcaatatgatttatatatcgtgacgaacggtgtttcaaaaacgcagtataagcgcctgcaagcttcaggattgtacccgatgtttaaagggatttttgtttcagaagacaccggttttcaaaagccgatgaaagaatactttgattacgtttttgaacggattcctcatttttctgtcgatcaggggctgatcatcggggattcattgacagcggacatagaaggggggcggctggccggattggatacatgttggatgaatccgggcatgatagcaaatgaccctggtattgtaccaacctatcaaatacaaaaacttgatgagttgtattatattttaaacattga

SEQ ID NO: 2392 - DNA, 757 bp, Bacillus licheniformis
  misc_feature (1)...(757): n = A,T,C or G
atgccatatattacaaagatttctgcccagaaaaacaatgaagagcgggtcaatatttttctggatgaaaaatatgcgttcagcgtcgacctggacgtgctcgtcaagtttgacctgcgaaaaggcaaagagcttgatgagcttgatatcattgagattcaatacggagacgacgttaaaaaagggttcaaaaaagcgctcgattatttgtcataccggatgcgctcgacaaaggaagttcaagaccatcttaagaaaaaaggcgtcgcagactccgcgatcacagaaattctgcatatgcttaaaggttataaatatttggacgaccgcgaatttgcggctgcatatgtcagcacccacagaaaaacgagcggcaaaggccctgatgtcttattcagagagcttaaattgaaagggatcgatgatgaactgattcatgaagcgctcagttcgttttcgttttccgatcaggtcgaggccgcggtcaagcatgcggaaaaagtactgaaaaaagaaaaaaagctgtcctccaaagagacgaagcaggccatcgaacagcaccttgtcagaaagggtttctccttcgatgtcatttcggccgcgcttcaggaaaccgattacgaaaacgacgatngcgctgagagagaagcgcttgagaagcaaggagaaaaagcaatgaagaggtacggttatgacggatcatacgaaacgaaaatgaagtcaaacagtatctgtttagaaaaggattttcaattga

SEQ ID NO: 2393 - DNA, 1096 bp, Bacillus licheniformis
  misc_feature (1)...(1096): n = A,T,C or G
atgaaaaaactgtngctgctcatgcttgtttgnctgctcgtgtatccgcatgtatcgaaagcggagggattaaaagagggaggcggcaatccgggctactggttcgcgggagaccctgtagaacatcccgatcccgcaaaaccgccgattgtattcgtccatggattaaacggctcttcaagcgcttggtttgacgaaaacgacatggcggaacaggcctggaaaaacgggtatgacgcggcttttatcgatctccaccccgataaagacatgcaggacaacggagcgatgctggccgccaaactgcgcgaaatctaccagtatttcggccgcaaggtgattctcgtttcctacagcaaaggcggaattgacagtcagtcggctcttattcatcacaacgcataccattatgtcgagcgggtgattacactcggaaccccccatcacggctcacagctggcagaccttgcctacagcaactgggcaggatggctagccgatattttaggccagaaaaatgacgccgtttattcactccagacagggtttatgaaatcgttccgcgaccagaccgacaatcatcccaatcgattgaaaaccaaatattttaccctggcaggcaataaaatcggcgggttcggcagcgctttatttttcgggggcgtctatttaaacatgtttggcgaaaatgacggagccgtcactgaaaaaaatgcgagactcccttacgccacaaacctggatacagggaagtgggatcacttctcaattattaaaggaaacctcacgtttcctgtattcatgcctttactgacgattcaggcaaatgcaaatgaaactgcggccaccaaagaaaacttatcgtaccctttcatcagagggggggaaaatcatggattgagagaagaggagtttgccgttgaaaaaggcgtcaaggagataaccgttcactggctgagcaatcattcctcgggaaatatcaaattgacagatccacgcggcaagccgttcaaagatttttcaatcgcaaagacggcggatgtttttgaaggggggttcgtccattccgctgccatcaaaaatcccgcggcaggca

SEQ ID NO: 2394 - DNA, 588 bp, Bacillus licheniformis
atgaaagtaacgaaatcagagattgtcatcagtgcggtgaaacccgagcagtaccctgaagggggactgccggaaatcgcccttgcagggagatctaatgtcggaaaatcgtcattcatcaatacaatgatcaaccgtaaaaacttagcgaggacatcttcaaaaccgggcaaaacacagacattaaacttttatatcattaacgatgtccttcactttgtcgatgtgcccggctacggatttgcaaaagtctccaaaacggagcgcgaggcttggggccgtatgatagagacgtatttgacatcccgcgaagaactgaaagcggtcgttcaaatcgtcgacctcaggcatgctccttcacaggatgatgtgatgatgtacgactttttaaagcattatgaaattcctgtgatcgtgattgcgacaaaagcggataaaatccctaaaggcaaatgggaaaagcatgccaaagtcgtcaaagagacgcttaatatagaaaaagaagaccggctcatattgttttcctccgaaacgaaaaagggtaaacaagaagcatggtcggcgatcgagcaaatgatcgcgagataa

SEQ ID NO: 2395 - DNA, 764 bp, Bacillus licheniformis
atgaaacagcgaattgaagaagaactgaaaaacattgaagcaacatatggcgtcaaaatcctctatgccgttgaatctggcagcagggcatggggccttccttcacaggacagcgattacgacgtcagatttatttatgtccatcaaaaagactggtatctgtcaattgatgcaaagcgcgatgtgattgaactgccgattgacgattctctcgatatcagcggctgggagctgacaaaagcgttaaggctgttccggaaatcaaatcctccgcttctcgaatggctctcttcgggaaccgtttattatgaagcctattcgctggcagaaaaaatgaggcggctcaaaagccgcgccttttctccagtctcctgtatgtaccattatctcaatatggcgtcgggaaatttccgagactacctgacgcgtgaagaagtgaaaatcaaaaaatatttttatgtactccgcccgattctggcttgccagtggatcgaaagccgccggacggttcctccgattgaatttcaggttttgcttgacgaacttacggaagacggaccgctgaaaacagaaatccatcagctgcttgaaaggaaaaagaaaggggaggagttcaatcttgaacctcaaaaccccattctccacgaatttattgagcgtgaacttgagcggcttcagacagttgccaaagcatataaaacggatcatgaagatctgacgcaggagcttgaccgtctgtttagagaaacgctagacgaggtgtg

SEQ ID NO: 2396 - DNA, 501 bp, Bacillus licheniformis
atgatgacgacaagaaaagattcagaactggaaggcgtaacccttcttggaaatcaaggcaccaattatttgtttgactattctccggaagtgcttgagtctttcccgaataaacacgaaaacagggactatttcgtgaaattcaactgccctgaattcacatcgctgtgcccgaaaaccggacagcccgattttgccacgatctacatcagctacatccctgataaaaaaatggtagaaagcaagtctttgaaactgtatctcttcagtttccgaaaccacggcgattttcacgaagactgcatgaacatcatcatgaacgatttaattgagctgatggacccgcgctatatcgaagtctggggcaaattcacgccgaggggcggaatctcgatcgatccgtacaccaactacggcaagcccggcacaaagtatgaaaaaatggccgagtatcggatgatgaaccatgatctgtatccggagacgattgataatcggtga

SEQ ID NO: 2397 - DNA, 636 bp, Bacillus licheniformis
gaaagttaatacggttttatttgatttggatggaacgctcatcaatacaaatgagctgattatcgcctcatttttgcatacgctcgatcattatgcaccgggacgctataaacgggaggatgttcttgctttcatcggaccttccctttatgaaacgttctcaagcattcaaaaggataaggctgaagaaatgatcaccatgtaccggacatttaatcatcagatgcatgatgaactggtaaccgagtatgagacggtttacgagacgcttgaacgccttgcggaagaaggctataagctcggcatcgtcacgacaaagctgcgggacaccgtcatcatggggcttaaactgactgggcttgatgcctttttcgagacggttgtgacgctggatgacgtcgagcggccgaagcctgaccccgagcctgttttgctcgccctttccaagcttggcagccgtccggaagaagccattatgatcggtgataattaccacgatattttagccgggaagaatgctggaacgaaaacagcaggcgttgcatggacgattaagggagaagaaagcctggccaaacacgagcctgattttatgcttcagcaaatgagcgacctccttcacattcttggggtgga

SEQ ID NO: 2398 - DNA, 721 bp, Bacillus licheniformis
atgagtgatccttacatgcctttgacatccgttaacagcggggtcctggaggagtatgccgaaggtgtatttggtttgacggtgcaaatcgtcaatgtgtattttattttcgatcccgattcgcgggaagccgttttaatcgatgccggtatgcccaagtccgctccattcattttaagagaggcgaaagagcggtttggcgattttcggcttaaaggaatcgttttgacacacggacatttcgaccatgtcggcgctttggaaagtcttctcgaaacatggccggttccagtttacgcccatgagaaagaaatgccttatttaatgggaaaagccgattatccgcctgcaaaaccgcaagtgaaaagcgggctggttgcaaagatgtctccgttatttccgaggcactccatcaacatttcgtcccatgtaaagcagcttaataaagatggttcgcttccgtttcttgaaggatggaaatggattgagacgccgggccatacaccggggcatgtttcgcttttccggcagtcggacagaaccttgatcgcaggggacgccgttacaactgttgagcaggagtctctatttgaagtggcaattcaaaagcaggagctgaacggaccgccggcttatttcacaatggattggacaaaagcagcagattcggttcggaagctggcaggattaaaaccggctgcattattgacgggacacggtg

SEQ ID NO: 2399 - DNA, 639 bp, Bacillus licheniformis
cagggctttcttcaacgattgcgtatatgaagtataaaaccgttgactataaaagcggccttatttttttcatcggctcggggccgggcagcatcgtcggtgcccatgtatcgacatattttagctcagactcgttttctctatggttcgggatttttatgatcctcatttccctttccttaatgataaagaaaagggtgaaacctgccgagaaaaagcatacgggcgttatcagaacgttcacaggtgatgaaggacaggaatatacgtattcataccatcctttagccggaatcgcgatcgccttttttgtgggctttctcggcgggcttttcggcatcggaggcggctcgctgatggtgccggcgatgattcttctgtttttatttccgacaagggtcgccgttgcgacatcgatgtttatcattttcctttcatctgtcgcgggctctgccggccatgtcatctcgggacatgtcaactggctttatgcgcttgcattgatcccgggcgcctggtttggcggacagctcggcgcctacattaacaaaaagatgcagacaaagacgatcgtattgatcatgcggttcgtattgattctcatcggaatcagattaatctatcaaggcgtgtttagtt

SEQ ID NO: 2400 - DNA, 756 bp, Bacillus licheniformis
caaagtgatgattacaggagcttcaggagggcttggcgaacggatcgcatatcatgctgcaggggaaggagcggagatcattctggctgcgcgcagaagagaccgcctcgatgctttgaagcaaaacatcgcggataaaaccggcgcaaagtgccgtataatcgtattggacgtcagccggacggatgaagttgaagcggcgtttcaagaggccggtccggttgatattcttgtcaataatgcggggttcggcatttttgaaagcgcgcttgacgcttcccttgaagatatgaaagcgatgtttgaggtcaacgtattcggtctgatcgcctgcacgaaaatggcactcccgcatatgatcaggcaagacaaaggccatattatcaatatcgcttcacaagcgggcaaaatagcgacgcccaagtcaagcctttatgcggcaacaaagcatgcggtgctcggatattcaaacagcttgagaatggagcttgcagaaacaggggtcaacgtgacaacggtcaatcctggaccgattcaaacagactttttcaagacggcagataaaaaaggcgattatgtaaaaagcgtcgggagatggatgctagatccggatcgggttgctaagaaaatcgtctcggcaatgatgacgaacaagcgcgaaatcaatcttccaggctggatgaacagcgtcagcaaactctaccagcttttcccttcgctggttgaacgaacaggtcgaagcgctttctataaaaa

SEQ ID NO: 2401 - DNA, 699 bp, Bacillus licheniformis
gcaaaacagccgtctccgatttgaaagcgcacggccatcatgttttcatcgcgtcaggccgtgcgccgtttatggtcaggcctgttcttgaagaactgggcatcgattcttttgtctcttataacggacaatatgtcgtttttgaaggagaggtcatttataaaaatcccattgccgagcagtcgttagaagcgctgcttgcgcattcggacagctgcggccaccccctcgtcttcatgggggaagaggggatgcgctctacaactgccgcccatccgttcgtcgatgaagggatcggcagcttaaaagtcaatccgccggaagaggatcgtacctactttaagggcagggacattttccaggtcctcttgttctgcacgcaagacgaggaagagcggtacagccggtttaaagagtttgatctcgtccgctggcacgagcgctccacagatgtgctgccttcaggcggatcgaaagcggaaggaatcaaaaaagtcattgaaaaacttccgttcgacagagaggatacttatgcgttcggggacggtctgaacgacctgcagatgatcgaatttgcgggaaccggagtagcgatgggcaacgctgtgcccgagctgaaaaaaatagccgactttatcacaaagcccgtcgatgaagacggcattcaatacgcggtggaagcgctcggacttttgaaat

SEQ ID NO: 2402 - DNA, 762 bp, Bacillus licheniformis
gatgcttcaggtcaaacaagccagtaagatttacgaaggaaaaattgcgtaccgcgcgttaacagatattaacctaacaattgataaaggtgaattcgtcgggatcatggggccgtcgggaagcggaaaaacgaccctattaaatatgattgcaacgatcgatgagccgacgacgggcgaaatattgatcagcggccaaaacccgcatgttctcaaaaaagaaaaattggctaaatttcgccgcagagagctgggatttgtgtttcaggactttaatcttctgccgacattaaccgttgaagaaaatatcgtacttcctttgacgcttgacggcgaaaaggtcaaggaaatgaagcggagggcaaacgaattggccgaaaagctcgggattacccagatcatgaaaaagcgcacatatgagatatcgggcggtcaggcccagcgcgccgctgtagcaagagcgatgattcattcgccgaagcttctgcttgccgatgagccgacaggcaaccttgattcaaagtcatccaaagatgtgatggaaatgcttgagtcgatcaaccgcaatgaaaaagcgaccatgatgcttgtcacgcatgaccctcaggcggcaagctattgcaaccgggtcgtctttattaaggacggaaagctgtattcggagatcaaccgcggcgataaccgccaagcgtttttccaaaagattctcgatacactgtccttgttgggaggggatgcaaatgacctttcgtcagttcgcgt

SEQ ID NO: 2403 - DNA, 1722 bp, Bacillus licheniformis
atgctgtttaccgatcagtactatatcgagtgggccaatccttttatggcgtcatgctttaatgaaaatacgctcgtcggccggtcgctttatgatacttgtgaatctgtcgtccctttgattaagcaggaagtggacacagaaacgattacgctgaatgagcggaaatttaatgtggtcatcaaacgggaagaaaagctgctttatttctttgatgtcacagagcagacgcagattgaaaaacaatacgaaaatgaaagaacggttcttgcctacatctttctcgataattacgacgatgtgacgcaagggcttgatgaccagaccagaagctcgataaacagtgaagtaacatcgcttttgaaccagtgggcccaagagtacggcattttcttaaaacgggtttcctctgagcggttcatcggcgtattaaacgaacatattttaagcgagctagaagcatcaaagttttcgattcttgatgaagttcgggagaagacatccgttcataccatttccttgacgttaagcatcggaatcggtgcatctgttgcctcgttgaaagagctcggcgatttggcgcaatccagccttgacttggcgctgggacgcggaggagatcaggtggcaatcaagcagccgaacgggaaagtgaagttttacggcggtaagacgaatcctatggaaaaacggacgcgcgtcagagcccgggtcatttcacacgcgctcaaggagattgtctctgaaagcagcaatgtgataatcatgggtcataagtttcccgatatggattcgatcggatcagccatcgggattttgaaggtcgcacaggcaaacggcaaagacggctttgtcgtgatcgactccaatcagatcggttcaagtgttcaaagactgatcggggagattaaaaaatacgaagaactgtggtccaggtttattacgccggaagaggcgcttgagatcgcaaaagacgacacgctgctcgtgatcgttgatacgcataagccttcttttgtcattgaagaaaggctggtcaataaaattgaaaatatcgtcgttatcgatcatcatagaagaggggaagagtttattaaagacccgctgcttgtctatatggagccgtacgcttcatctacagcggagcttgtgacagagctgctcgaataccagccgaagcgcttaaaaatcaacatgatcgaagcaacagctcttttggccgggattattgtcgatacgaagagcttctcgctgcgcaccggctcccgtacgttcgatgcggcgtcttatctgcgcgcaaaaggcgctgacactgtattggtgcaaaagtttttaaaagaaacggccgatcattatattaaaagggcgaagcttatccagcataccgttttttatcaaaacggcatcgccattgcatcgctgccggacgatgaggcggacgaatactttgaccaggttatcattgcacaagccgcggattctcttctgtctatgagcgatgtcgaagcgtcatttgctgtggcgagaagagacgagaacacggtatgtatcagcgcaagatcgctcggcgaagtaaatgttcaaatcattatggaagcgctcgagggcggcggtcatttaaccaatgctgcgacacagctgaccgatatcacggttgaagaaacgctccgccgactgaaagaagcgattgacgagtatttcgaaggaggcattcagaaatga

SEQ ID NO: 2404 - DNA, 1013 bp, Bacillus licheniformis
ttgataaatcttcaaaatgtttcaaagatttatcggtcaaagcatggagatgtcaatgctgtccaagatgtcacccttacgattaaaaaaggtgaaatcttcggaattattggatatagcggagccggaaaaagctccttgatccgtctcttgaacggacttgaacagccgacttcaggcacggttgaagtagccggcagaaaaatcagcgagatcaaagggaagaagctgaggaaagcaaggcaggaaatcagcatgattttccagcatttcaacctgttatggtcgagaacggtgcgcgacaatattgcgtttccgctggagatcgccggtgtcagcaaagcaaaacgtctggaaagagtcgctgaactgattaagcttgtcggtcttgaaggcaaggaaaacgcctacccttcacagctgagcggaggccaaaagcagcgcgtcggcatcgcacgggcgctcgcaaacaatccgaaagttctgttatgcgatgaagcgacatcagcgcttgatccgcagacgactgattcgattctgggtcttctgtccgatatcaatgaaaggctcggactgaccattgtcctgatcactcatgaaatgcatgtcatcaggaaaatctgccacagagtggccgtcatggaaaacggaaaggtcgtagaagaaggcgatgtactgaacgtcttcatcaagccgaaggaagaaatgacaaagcgctttgttcagcaggtaacagaaccggtggaaacaaaggaaacgctgaagcatttcctcgaagaaacgacatccgggcggacgatcaagctcactttcgtcggcgaagcggccgaatcgccgctgatcacgcagatcattcggaagttcgatgttgaagtcaacatccttcaaggcaaaatctcgcagactcaggacggtgcatacggttcattgttcatacatgtcgacggacgtgaaaacgaggtcaatgacgtggtcgatttcatcaagagccgccaggtagaagcagaggtgat

SEQ ID NO: 2405 - DNA, 543 bp, Bacillus licheniformis
agcggcacaagcagaaattcgaagtcgcgaaaaagatcgctgcaaagcttggcgtcaagcatcaccttcttgatatggaactgttaaatcagctcgcgccgaatgctttgacaagggatgatatcgagattgaggcgaaagaaggcgagcttccgtccacttttgttccgggacgcaacctcgtgtttttatcgttcgcttcgatcctggcctaccaggtcggcgcgcggcacatcattacaggcgtatgcgagacagacttcagcgggtatccggattgccgtgatgagttcgtcaaatcctgcaatgtcactgtcaacttggcgatggagcgcccgtttgtcatccatacgccgcttatgtggctgaacaaggcggaaacgtgggagctcgccgatgagcttgatgcgcttgatttcgtgaaaaacgagacgctgacgtgctacaacggaatcattgccgacggctgcggcgaatgcccggcctgcaagcttcgcgcaaacggctacaatgaatatatgaaaatgaaaaaggagcgagctt

SEQ ID NO: 2406 - DNA, 622 bp, Bacillus licheniformis
  misc_feature (1)...(622): n = A,T,C or G
atgcagtcgaaaacagtatatctttatgcattccatacaatgtcagattgggaatatggatatttaatggccgaactgaactcgggaagatatttcaaaaaagatgcggcacctttaaaagtcatgacaataggagtgaataaagaaatggtgacgacgatgggtggactgcgcataaaaccggatatctcccttgatgnatggacgcccgngagtgcggatctaatcattttacccggagggaatacttggggagaaaagattcatcagccgatcttgaaaaaggccggcgaagctttagngcttggcgcgatggttgccgcaatatgaggtgcaactgcgggactggcgaatagcggatatctggattcaagaaagcatacaagcaatgacttggcctatatgaaaatggtctgtcctcattataaaggagaaccgttttatgagatgggacccgcggtatcaaatgggaatctggttactgcatcaggagcggctcctctcgaattcgcaagggaagtgctgaaaaaattagacgtgtttgcaccggatacattggattcatggtatcaactcaataagaccggtcaacgtgaatacttcttcaagctaatgaattcga

SEQ ID NO: 2407 - DNA, 638 bp, Bacillus licheniformis
ttgaagcgggaacttgttttgcgctggcttttttattttgtcggattgattgttttgtctttcggggtttctcttacgattgaagggaaagtgctcggcatcggtccttgggatgcgtttcactacgggctgtatatgcttttgggccttacggtcggccaatgggcgattattgtcggggcggtcatcgtaggtttaacgtccttatttacaaaagcatggccgaaaatcggcgccgtgctcaatatgctgttaatcggtatttttatagatttctttacttatattcttccagacccggaaacgtatatttcaagcactgtcgtattcgtgatcggcgttatttttatcggttacggagtcggcatttatgtatcggccgatctcggtgcgggtccgcgtgactccctgatgcttttgatttccgagaaaacgggctggaacgttcagtgggtccgaaacggaatggagctgacgattttattgatcggctggctgctcggcgggccgatcggcatcggtactgttttaaccgccattttaaccggcctgattttgcggttttctttgccgcagtccaaacagcttttaaaagcagcaatggcaggaaggcgcatcagagctgccaagcctgtaca

SEQ ID NO: 2408 - DNA, 640 bp, Bacillus licheniformis
gtggctgatatcgggtctgatcatgcgtatttgccttgctattgtgtgctgaatcgcctggcaagcgccgcgatcgccggagaaatcacagatggtccgtttctttctgcgaaacagcaggttgagaaactgcagttaagttcgctcatatccgtcaggaaaggagacgggcttgaagtgattgaaaagggcgaagccgatgtgatcacgattgccggaatgggtggctcgctcattgctcacattctaaaaacgggcaaggataagctctcaggtaaggagcgtttggttttacagccgaatatccacgctcaccatattagagagtggctctaccaggaaggctatgcactgatcaatgaagagatccttgaagaagacggcaagtactatgaggttctcgtggctgaagcgggcgatcgggatgcggcttacgatggggtttcctttgcggcaggcatgcttgtcggcccatttttggtcaaagaacaaaatgatgtttttatcaaaaaatggtcgcaggagctgaaacatacggaaaacatctatcgacaaattgaagcggctcctccgagtgaagaaaatcgacaaaaattgcttgagctgtcagaacggatagagatcttaaaggaggtactta

SEQ ID NO: 2409 - DNA, 766 bp, Bacillus licheniformis
  misc_feature (1)...(766): n = A,T,C or G
gtgatcataatcgaaaagcagcatatttcaaacattcctcttttgcatattgtaaaagaggagaaaaaagagaaagctcttcctcttgttttcttcatacatggttttacaagcgcaaaagagcataaccttcacttcgcatacctgcttgccgaaaaaggaatgcgcgtgattctgcccgaggctctctatcacggggaaaggaatgaacagctcacccaggaagagctcgccccgagattttgggagatcgtcacgaatgaaatcaaagagctggaagtgctgaaaaaccactttgaacgggaaaacatgattgaaaagggccgcatcggcgccgccggaacatcgatgggcggcattgtcacgctcggcgctttgactcaatacgaatggattacaactgccgtcagtttaatgggcagtcccgcctatgtagaattttttgatcagcagctcgcatttatgcgtgaaaagaaaattgaacttcctatcacagaagaacaaatcgatcagcagcgcgaagaactgaagcgttttgacttgagtctgcagccggacaaattgaacatgaggccgcttttattttggcacggcaaacaggacggcaccgttccatttgctttaacgcgccgcttctatgaatcgattattccactgtatgaagctcggcctgatttgctgcattttatcgaagatgagcgggccggacataaagtatcgagggaaggccttttgaaaacagtcgaatggtttgacgcgcancttg

SEQ ID NO: 2410 - DNA, 531 bp, Bacillus licheniformis
atgaaaatttatgttgtttacgacagtgaaggcgagcatacgaaaaagctggctgaagccattgcagaaggcgcgggggaacatgatgctgcagacgtgcggatcgatcatgtcagccaggcggatattagaaagctcgaagaaatggacgctatcatctggggatgcccgggccatttcggtacaatcagctccggattaaaaacttggatcgacaggctgggctacctttgggcggaaggaaagctgatcaataagatcggcgcagtcttctgcacaacggcgacgacccacggcggtcttgaggcgacaatgctcaacttaataacaccgatgcttcatcaaggcatgatggtcgtcggcttgcctggaaatgtacctgaaaatgctttatacgggtcttattacggtgcaggcatcacgtgtcctgtcgacagtgacgaattgatcggcgaggaaggcctggagctgggccgggctttaggcagacgcgtcgcccaggtggcagaccgctttacagcaggacagtga

SEQ ID NO: 2411 - DNA, 510 bp, Bacillus licheniformis
ggatcacttagattatccatccatcttaaagctgaaggaaaaggccggtcatttcttcgttccttacggaatcagcgcacacttgatccggtggggaattgagaaagaaaaaatcaccgaactcaattggtgggatgaaacggagtttcaaggtttgacaatagccctgacaccgtccaaacacttttcaggcagaggattattgaatcgaaacacgaccctgtggggcggctgggtcatcctcggaaaacatacgcgtttttatacgagcggtgacgggggatatgatgaacactttaaggaaatcggcaaaaaatacggccctttcgatatcacattaatggaaggcggccaatatgacagacgctggtccgggattcatatgacacccgaacaatctgtacaagcccataaagatgtaaaaggaaagaacatgatgttgattcattggggagcctttaccctcgcataccacggctggaaagagccgattgaacgcgcattgaacag

SEQ ID NO: 2412 - DNA, 727 bp, Bacillus licheniformis
  misc_feature (1)...(727): n = A,T,C or G
atgggtgcgctcaaagaaaagaattaccatgaagcgctcaggctgttttctgaagcgaagcgctataatgatgaggaatctgatatttatctgggaatggccatctgcctgcttgaaatcggcgagcttgaagaagcgaaaggcatctgcgaaaaaatgctgaaggaaggccacggccactattttaccgttttacaagtctatatgacgattttaatccagctcagacaatacgaaaaagttaaagaaacgatcgaagctgtactcgaagaaaacaagcttcctcctgaaagcgcggaacagttttataaactccttgatttcagccgcaagatgacggaagacccggggcctgaggacatcacccaagaccttcccgagacgcagcaggttgatcaggaaaggcttttgaatgacacggaagagcaggttaagcttcttcacgggctgaaggacatcaatctgacaagccacatcggcttgttgaaaacgattccgcaaaacccgagcgcacatcctgtcgtaaaaacgatgattcttcagcttttagccgagtcagaccatgaaaagccgacgcttgtcgcaaaatttggcgattcgatgacaattaaaacggaggnaacggtcaagcctgatgacatgccgatattaaagcatgttctgagcgtgctcgatgatacgctggggaatgaaaatcccacgctgtaccaggcggtcgaagagctgg

SEQ ID NO: 2413 - DNA, 621 bp, Bacillus licheniformis
atgcaaaaaggcgactttgaaaaagccgctgaagcctttacaaaggcaattgatgaaaacagcggagatccggtgccttatatcaactttgccaacctgctttctgcagtcggcgaattggacagggcgcttaagttttacgacagggcggctgctttggatgagaaagcaggagcggcttattatggagcagggaatgtctatgtcatgaaagagcggtatcaagaagcgaaggacatgttcgaaaaagcgcatcggacgggcatggaaaacagcgacttatattatatgctcggaaccacgctcgtgaagcttgagcagccgaagctcgcaatgccgtatttgcaaagagccgccgagctgaacgatgcggatgtcgaagcccgttttcattacgcgatgtgccttgccaatgaagggatgctggacgaagcgatcacggaattttcaaatgtaacggagcgcgacccgtcccatgccgatgcattttataatttaggcgttgcctatgcgtttaaggaagatcggaaaacagcgctcgacatgctgaacaaggcgctggacattcagccggatcatatgctcagcattcgcgccaagcagcttttagaagaagcttga

SEQ ID NO: 2414 - DNA, 966 bp, Bacillus licheniformis
tcaagatcaatgaccgcctttacggggaggcagatttggagcctgtgctgacagacctcattcgttcaaaagccgttcagcgtctgaaagggattcatcagggcggggcctcttttctcgtcaatcccgcatggaacatcagccgctgtgagcacagcatcggagttatgcttttgatccgcaggcttggcggaagcctggaagagcaaattgcaggtttgctccacgatgtttcccatacggcattttcccatgtggctgatgatgtatttaacatggaaaacgaagattaccatgaacagatgtttcggcaatgggtcaagcaatctgatatctccgggattctgcatacatacggattccatgatgaagacatcttatatgacgagcaaaaatggacgctgctggagcagccggctccttcattatgtgcggatcgcatcgattacacgcttcgcgactctttagcctatggatttggcgatccggtagagattggacgatttttagaaactggattgaccgttgctgaaggcgaaatctgctgcacttcggcagagcatgccgaatggttcgcccgcctttactatcaagaagtgattgacttctttatgaatcccctcaatatatatgcgctctgtaccctcagccaaatgctgaaagaggcgcttgacatgcgtgttattgcggggcgcgattttttcaaaaccgacacggaactgcttgcgatgctaaagcaaaaagcgcgcttccgggaaacgctggtaaagctcagcacagcgagcaagcgcgttaaacaaggcgacgaaggcgattttacttttcatcaaacattaaaggtgagatggatcgatccaaaagtcgctgttaacggaagaaaaatccccgcctccacactttcaaagaacgtccttctgatgaaagaaacggcaatagccgccatgaaaaaaggcgcatatgtaaaag

SEQ ID NO: 2415 - DNA, 639 bp, Bacillus licheniformis
tttactttaaaaaccagcttttgacatcatttcacggcccgcgagtccatcaccctatagagaaagctggggacgcttactacgtatattgatctaggcgtggccaaacggactcattgaagtcagcagaaacgtacaacgtacataatatccttgctgaaattgtcgatgatgtttattttcattatcatgacgaaaagctgattgatgtctttacgatgggcagcccgaatattacagtcggagatttaagaacaaacctcggccaggatgtgacaagcgtattgattcacgcaaaagaagaggatgttccggcgatccgctcctatctgtcagacgtacacgcagagatggtcgaccatagaagatgggcggccccgtggcatgtaatcgaactgattaaaagcggcatcaataaagcggtcggcttagagaaaatcacggactactacggaatcccgcctgagcgggtcattgccttcggcgatgaagacaacgaccttgaaatgcttgagttcgcaggctgcggagtagcgatgggcaacggcatcgaaggggtaaaaagcgttgcaaacaaggtcacgaaatcgaatgaggaagacggaatcgcagtctttttaaaggattacttcgctttat

SEQ ID NO: 2416 - DNA, 1584 bp, Bacillus licheniformis
atggtgaaaaaaccatatgtggaaaatgaagagaattttctcgaaacttgtttttggcctgttaagcctgctggaaactatgttatactactcacggtatatagtttgaaatggagggtatctgtgggaaagtacacttctgaacatcataaagattcgagaattgtccagctgttccaagatgggcaatatttttatcataaagggctcaaagcatacagagagcgaaatttatcccgcgcgagcaagctcatacagagagcgatttttcttgaacctgaaaacacgggaatgctgtcccaacttgcggttatttatacggaaatgggcttttatcagcaatcaaacgaacttttggactttatcctgaagaacatcaacgaaaaaatgactgaatgctactattttaaagcgaacaactatgcgcacctcggtctttttcaagaggcctataaagcggcggagacttatttaaaggaagatccggacggcgagttcagcgaggaaaatgcggagctgcttgatttattggatatgggagaggaagatcagggctattcgcagttcgatcaggacgacctgattctgaaacaggatcgggccaaatcactgctggaaaatggacagcttcaggaatcgatcgcgatgcttgaagaaattatttccgattaccctgagttttggtcggcttataacaatcttgcactcgcatacttttatgccggggacgttcagaaagccaaaacgacggtttttacggtcttggaaaaaagtcatggaaacctgcatgcgctttgcaatcttcttattttttatcactatgaacgacgggacgataaggtcgaggcgctttccgaacagctttcaaatatttatccgatgctttttgagcaaaggtataagctcggtgccacgctagcccttgtcggccgatacgatctcgggtttaaatggctgaaatcactctaccgcatgggatttgaaggggatgagaccttttattactggcttgcctgctcggcttattacacgggccgcgttcaatttgcccggtctgtatggaaaaagatgcaggaagagtatccggatgacgcccgcatggagccgtggaaagaacggaaggaaaagagacctgtccagcgaccgctcgaggagcgccttgccgcatattatatcagcggaagaaaaggggaaaaagcccagctgaaagcggtgcttgattcacagatggcaaaaacgccgtttgaagatcagtttgtcagacttgtgctttacggggaaagcggtgcagccgttgattcaaaagacgcgctacttgcttacaggactgcaaaagcgattgaacaagcggatcagtcggcgatggagcaggaggccatgtgcttttggattttccatgtcattcagcagatcagggcttacgggcttcagctgaaaaatgccggcgggcttgcggcagcgatctattacatttggaagacggagcatcaggagcgtttgacaaaagccgaaaccgctaaaattttccaaatatcgcccgggacgctttcaaagtatgaacgtacattaaaagagcatctatag

SEQ ID NO: 2417 - DNA, 533 bp, Bacillus licheniformis
gtgattcgttacccgaacggcaaatcctatcagccgaaaacagctgcctcatccttgcaaaagaagccgtcgtattccaatcgcggcatgaccctcgaagatgacctgaatgaaacgaatatgtattatcaatctcattcgattgcggtcatccataaaaaaccgacacctgtacagattgtccaggtcgattatccgaagcgaagcgctgcggttatcaaagaagcatatttcaagcagtcgtcaactactgattataatggggtttataaaggccgctacatcgattttgaagcgaaagaaacaaagagccgaacctcgttcccgcttcagaatttccacgatcatcagatcgagcatatgaagcaggttgtggcgcaagacggcatttgttttgttatcatatccgcttttgaagaaatttattttttggaagcagaaaaattattttatttctgggagcggaaaaagcaaaacggcagaaaatcgatccgaaaagacgagcttcaggaagccgctcaccccatttcact

SEQ ID NO: 2418 - DNA, 515 bp, Bacillus licheniformis
ttgagaaaaacgaagcgctacccggtgtccggcgccaattccttatggcacatctatcagacggttccgttttttaaagtagtcaaaaactttattgtcattcaggcggcgcgctatacgccgattcttggaatgaaaaactggatgtaccggacgtttttgcggatgaaaatcggagagaaatgctcgtttgctttaatggtcatgccggatatcatgtttcccgaaaaaatctcagtcgggcgaaacaccgtaatcggctataatacgaccattttggcgcacgagtatttaataaaagaatatcggctcggtgaggtgatcatcggcgatgaagtcatgatcggagccaatacgacgatcctcccgggcgtcgagatcggagacggcgccgtcatttccgccggtacgctcgttcataaagatgtgcccccgggcgcttttgtcggcggcaatccgatgcggctgatctatacaaaagaagaaatggaaaaaagattggagacccccgctga

SEQ ID NO: 2419 - DNA, 773 bp, Bacillus licheniformis
gtggacatatcttttattcttcttatatttttcatcggattcattggctcttttatgtccggaatgcttggtgtcgggggagcaattattaattacccgttgctattatatatacctgctttattagggtttacaggctttaacgcacaccaggtttcaggtatagtggcagtccaggtttttattgctgcattttccggtgtgtgggcttaccggaaagacggttacttaaataaagaactgatcttcatcatggggttaagtattttgcttggaagtctaatcggcggctatgggtcacattttttctccgaagatgccataaacatggtttacggattattggcgatcattgcagccatcatcatgttgattccaaagacaggaacagaaggtaatcaaagtgatcacattcgctttccaaagatattaacctcaatcatgacttttgtggtcggtttggcttcaggtatagtcggtgcgggcggagcttttctgcttgttccgctcatgttagtcattataaaaatacctgcacgaatcacaatcgcaacatcactcgcagttacatttatttcatcgattggaacaacagctacaaagctcgtcattggacaggtgcctattatgccggctttggttgtaatggctgccagtctgattgcatccccgctaggtgttttcattggcaagaaagtgaatgctaaagttcttcaaggtattttgatattcgttatttttcttacaacagtgaaaatttgggttgatatctt

SEQ ID NO: 2420 - DNA, 671 bp, Bacillus licheniformis
atgaaagcggtcatttttgacttggacggcgtgatcacggatacggccgagtatcattatctcgcatggaaacatactgcagaacaaatcggcattgagattgaccggagctttaatgaacggctgaaaggcatcaacagagagcagtcgcttgataagattttgattcacggcggcgcggccggaaagtttcaggaggcggagaaacaagagatcatgcgccggaaaaatcaatactaccaacagctgatccaaaacttgactccgcacgacctgctgccgggaatctccgtgctttttgccgaattgaaaagagaacatataagcattgcgttagcttcgtcaagccgaaacgcgcctgctattttgcagcggctcggtgtcatggacgaatttcagggtgtcgttgatccggccgcacttgctcacggaaagcccgaccccgaaatctttttgacggccgctgcactgctcggtgtgcctccgtctgaatgtgcagcaatcgaagatgctgaagccgggatcgccgcgatcaaatccgcagggatgttcgcggtgggagtcggtgatgagacatcgctgcgcggagccgatttgatcgtgcacaacacaaacgagctgacgtttgagctgctgaatgaaggatggcagcgctattgctgtataagaga

SEQ ID NO: 2421 - DNA, 577 bp, Bacillus licheniformis
atgatgattttagaagcgaaaaaaatacgaaaaagctatggaaataagcacaataaacacgaagtgttaaagggaatcgaccttcagattcaaaagggggaatttgtcagtattatgggcccgtctggttcaggcaaaacaacattgctcaatgttctgtcctctattgaccaggtgagcggcggaacgattaacatcaaccaagctgagatgacgaatatgaaggaaaaacagcttgccgagttcaggaagcagcatttaggatttatcttccaagaatacaatttgctcgatacgctgacagtgaaagaaaatatccttctgccgctgtcgattacgaaaatatcaaaaaaagaagccggtcaaaagtttgaggaagtcgcgaaagaattaggcatcttcgagctgaaggataaatatccgaatgaaatttccggggggcaaaaacagcgcacatcagcagccagggcgtttattcatgagccgagcattattttcgctgacgaaccgaccggtgcgcttgattcgaaatccgcatcagacttgttaaacaagctgagccaattaaatcaaaagc

SEQ ID NO: 2422 - DNA, 579 bp, Bacillus licheniformis
cgttgtttattctcgacttcatcgctttcggaaacaatgggatgtcgtgttctaccggggcgggttggcgattgcggtgtctctcattgccgggctgatcatctcttatcaatttaaagggaatcagctgatcgaaaacgggacgcacggacatcaccaccatgtccatgagagccagtctttcctgcaaaagctcggcgggacgctccgccatgcagttgacgagtttttctcagtcggaaaatatttgatcatcggcgcatttgtcgcagcagcgatgcagacgtatattaaaacatcgactcttttggcgatcgggcagaatgatgtatcttcctccctcgttatgatggggctgtcatttgtgctgtccctttgttcagaggtcgacgcttttatcgcttcttctttcagcagtacgttttccctcggctccctcatcgcctttctcgtattcggagcgatggtggacatcaaaaatctgctgatgatgctcggcatcttcaaaaagcgctttgtgtttgtcttaatcccctacatcgccgttattgtcttagccggatcactgttggtaaaggg

SEQ ID NO: 2423 - DNA, 698 bp, Bacillus licheniformis
atggttgcacagcatttagtggatgccggttttgaaagagtgctggtacttaaaggcggtatgaaggcgtggagcaaatttttacatccagtcaaaatcggagacttgaaagaaggagggacgatctatcaattcgtaagaatggggaaaggctgtttatcctattttatcgaaaccgacggagaagcaattgtagttgaccctgctcgttctgttgatgcatatatagattttgcgaaagagagaaacgttacgattaaacatgtggtcgatacacacttacatgcggatcatatttcgggcggacgtttactgcgtaagcgtacaggagctgcatactacctgccgccaaaagatgcggaggaagtgctattttcatatgaaccgctagttgaagatgaaaatatttctgtaggaagcgcaggtatgaaagcagaacctatttactcacctggacatacgattggtagcacctctttaatgattgataatcgctatttgttaacaggagatattttatttgttgaatcgattggccggccggacttagctggaaaagccggggattgggcagaggatttgcgtaacacattgtatgtaaaatacaaacaaatatcaggtgacttgattgttcttccagctcacttttcgacagtcagtgaattaggcgatcaggggcaagtccaagctaagctgag

SEQ ID NO: 2424 - DNA, 500 bp, Bacillus licheniformis
atgagcctgcaatttagcgtacttgcgagcgggagtaccggtaatgctttatatttggaaaccgatgaccacgcttttttagttgacgcaggacttagcgggaaggcgatggaagggctgatggcgcaaattgatcgaaagcttgatcagctcgacggcatctttgttacacatgagcacagtgaccatataaaagggcttggcgtgctggcaagaaaatatgagctgcccgtttacgccaatgaaaaaacgtggaaggcgatggaagggcatatcggcaaaatggataacggccaaaagttcgtttttccaatggaaaccgtcaagtcattcggctcccttgatgtcgaatcgttcggggtatcccatgatgccgcagagccgatgttttacgtttttcattacaatggccgaaagctcgctttgattacggatacgggctatgtcagcgacagaatgaaaggcatcatccgctcggcaaacgcttttgttttgaaagc

SEQ ID NO: 2425 - DNA, 597 bp, Bacillus licheniformis
aattagctgtagttttttatagtatgggcggaacaaactatcaattagcaaaatgggctgcagaaggcgcaaaagaagcaggcgctgacgtcaaagtattaaaagtacaagaattggctccgcaatcagttattgaaggaaatgaagtatggaaagcaactgttgatgcaacaaaagacattccagtcgtaacctcagaagatatagagtgggcagacgctattatattcagtacaccaacgcgttttggcaatatggcatcccaaatgaaacagtttcttgatacacaaggcggactttgggcaaacggcaagacagttaataaagttgtaagtgcaatgtcctccgctcaaaatccacatggtggtcaagaagcgacgatcttgtccttatatacttcaatgatgcactggggagctattattgcttctcctggatacactgatcctgtcctatttggggctggcggaaatccatatggaacgagtgttacagtcgatcaagacgggaagatgattgaagacgtagaagccgcagtgaaacatcaagcaaaacgaacggtgaccgtagctgaatgggtcaaaaagggcaatcagt

SEQ ID NO: 2426 - DNA, 807 bp, Bacillus licheniformis
ttcacaccttgcagcaagtaaacaagccgaagtacgccgtattttgcgattttgatgagacatatttcgcccacagcatcaccgatgaatcgagaaaagcgctcatggaccttgaaacatttattcattcgcaccatcttgatcacaagattttgctcggctgggtgaccgggagcagcctgtcatccgttcttgcaaaaatgaagcggggaggctttcgatatcttccgcattttgtcgccggtgaccttggcactgaaatcacttatttctctgaagaaggccaagtctctgataaagattgggaagcccgattgcaagaatcaaatttctcccatgatctggtcgaagaaatcaagcagactctctctaaaaaatatgagattgcgcttgtgcctcagactcagcatggcttttcccgctataaaatcaactattactataaatcgttggaagagagcatagataagagggcgcttgaagccatcaggcggcttgcaagagagcatggaataggagtaaatatcaatcgctgcaaccctttggcaggcgatccggaaaacagctatgatgtggactttatccccttgcggacaggcaaaccgtacattgtggattttatattggataaattcgcgatagagagggagaattcatttgctttcggcgacagcggaaacgatgtggatatgctaaaaaaaaccggacatggttatctggtggggaatgcgacagcagaagccaagtcgctccattcccgtatgacagaaggcagctatacggctggaattttagaagtgctaaaag

SEQ ID NO: 2427 - DNA, 513 bp, Bacillus licheniformis
atggacatcctgttggtcgacggttataacatgattggggcttggcctcagctgaaagatttaaaagaaaacagttttgaagaagcaagggacctgttgattcagaagatggcggaatatcaatcgtatacagggtttcgggtaatcgttgtctttgatgcgcatctcgttaaaggaatcgagaaaaagaaggtcaatcatcgcgtagaagtgatattcacaagggaaaatgaaacggctgatgaacggatcgagaaactggtgtcagacttgaatagtattcagacgcagatccatgttgccacatccgattacacagagcagtgggcgatttttggccagggggccctgcgcaaatcggccagagagctgctcagggaggtcgaagcgatcgaaaggcaaattgaaaacagggtgaaacaaatcacctcagagcgtcccgcagggaaaattccattgtcagaagacgtcttgaggatcttcgaaaaatggcggcgtggcgacttggattag

SEQ ID NO: 2428 - DNA, 813 bp, Bacillus licheniformis
  misc_feature (1)...(813): n = A,T,C or G
caacggcctgtgccgtccgcgaagtcaccgtttatttgagcacaccggtcacggagaaaggaataacaatcgtcgatacaccgggagccagcagcatgaataaacggcatactgaacttgcgtttcaatacatgaaagatgctgatgccctgctttacttaacatactaccagcattcattttccaaagcggaccggtcgtttttgcgcaggctggggctcattaaagacgctttcagcatggataaaatgttttttattttaaatgcggctgacctcgcgaaaagcccggtcgaattacagacggttgaagactatgtaaggggagagctcttgaaagaaggcatccaaaatccgcacctgtaccatgtatcgagcaagcaggagctcaacaaaaaaacttcgccgtacaacgacttcagcaggctaaagcgggagctcgacgattttatcgaaaacggtttggccagaacagctgtcgaagagctgcttgatgaaggcaaaaaactgtgtgaaaccgtctttcagctccgcggttcactgcaccgttccgctgaagaaaaggaagcggagcaaaagcgcgtcgcaaaagcttatcaagaggctttggctgcgattgaagagcagagaaggggtcatcnatccctcaaagaacgaaaggatgggaagaacaatttaccccatgaacaacgtctggcctttttgccacgatttatttaaggctgcaatccccccgggcttcaaaaccgagattggcgcggcccaatctgcaaaccgctttgaaagcctgttaaagaatatgaattcaattttt

SEQ ID NO: 2429 - DNA, 610 bp, Bacillus licheniformis
atgtatcatttgtatactcacaacgacttggacggagtcggctgcggaattctcgcaaaagtggcttttggcgaacgggtcgaggtccgctacaattcggtcaccggactcgacatgcaagtcgggcgttttttggagcggacaaaaggcaaagaaaaacagcatgaaggcctgtttatcacggacttgtccgttcatcaagaaaatgaggaaaggctggaccaatatgcggaagcggggggaaaggtcaaactgatcgaccaccataaaactgcgcttcatttgaatgaacgcccttggggcatgataaaagttcaatatgaggatggcaggctcgcttcagcgacttctcttttctatgaatacttaatagacaacggccacattcgagagacaaaagcgatggatcagttcgtcgaactcgtacgcctctatgatacatgggaatgggaacagacgggcgctctcgaagcgaaacgcctgaatgacctgtttttaatggtatccatcgacgaatttgaggaaaaaatgatccggcgccttaaagaaagcgacgcgttttcatttgatgaattcgaagaaaaaatcttggatatggaagaagaaaaaa

SEQ ID NO: 2430 - DNA, 774 bp, Bacillus licheniformis
tcttgaataacagctggccgaccagggactgtccttaaacgatatcgaacaggtcgtcctgcaccgacagcacgctgatcactccggactgctgaacgaattcccggcagaggtaaaaatcattggccatccgttcaatgaaccgtatatcagtcaaaatcccgattttattgaaaaacaaaagtccttttttacatacctgtttcaacgattcggcgttcccggcgatatgaagccgccaggccataccataaaagcgtcgtaccggtattcatgtaatcggacattgacagagaccgtttcagaaggtgggcaaattgaagggcttgacgggtggcgggttcttgagacgcccggacatgccgcttcgcatattgtcctttataatgaagaacttggaagcatgctcgggggagacttgctgctaaagccgtcttcttcaaatccgcttctggaagtgccgcaaaaaggagggaaacgcccgactccgctgctggattacctggaatctctcggcaggctgcaggagcttccgcttcacatgatttatcccggccatggggaggaaatcacaaaagtgaatgagcttgtcgccaaaaggctggaaaagcagcgaaacagagccgaagaggtgtaccgcatcctctctgaaaaaccgcattcaccttatcagatatgtcgaaaactgttccctgcagtctatgaaaaagagctgttcttaacactgtcagaaacgattgggcagcttgacgatctggaatcccaggggaggat

SEQ ID NO: 2431 - DNA, 522 bp, Bacillus licheniformis
catgattgaagcgacaaactcggagcaaatcgaggtcagaaaatatcctctgatcgatgtaaccgttgacgggaccagctttcaatgtctaaatgaagtatccatccgttcaagcattattaaaacatttgtaatggacgtctatatagatgatcttcattttgaaacattccggggggacggaatgatcgtgtccactccgaccggaagcaccgcttataacaaatcggttgatggggcaatcgttgatccgctgattccatgcatacaggtgacagagctcgcttcattgaacaacaacacatacagaaccctcggctcgccgtttattttaagcgcggatcgaaagctgacattaaaaatcgtccaggacgggaacgactatccgatcatcggccttgataacgaagccttcagtacgatgaatgtgaaagaagtcgaagtcagcctctccggcaagatgatcaaaaccattaaattaaaagataattcgttctgggaaaaagtaaggcgcacatttct

SEQ ID NO: 2432 - DNA, 639 bp, Bacillus licheniformis
ggtttttgcctacggcggatctgtactactacggaccccgcggcgaaatgaatcctgaaaaggggaaaaccgctattgcggaacatgccatgtcaagaagaaatgccgctattatatgaggtggcaggcaggcgacccgcaggacgaccatgtcaagaccaatgaaagccagcatctgctctataccgattacaggcctgacgcgtgtattttcgatgaagaaatcgacatcgaggatacgtatgcagccgttttgaaatacggcaaaggggcgctgctgaattactccgttcatttttcagccccgtatgaaggctaccggcttgcaatcaacgggacaaagggaaggcttgaaacacaggaatatcatgctccggcaagagtcccatttgaagttcccgaacagaccatcgattattatccgctgtttgaatcgaaagaaacgattcgcgtcgtcaggcagcccggcgggcatggcggaggagacccgctgcttttggaggagctgtttggcggaggagaccctttgaggaattacgacattctggccggtgccgaagcaggcgcctattcaattgcagccggcgaggcattgtggcgctccatcaaagaaaaaaagccgataggaatcagtgaact

SEQ ID NO: 2433 - DNA, 687 bp, Bacillus licheniformis
atgaagaagaagatgacattgggcattttgaccgctatggttctcagtcttggttcgcctgcttttgcagctgagaaaaaacaggaggtaacagttgccgaagatgcgcccaacgttgcgattatgcttgatgcaagcggcagcatggctaaaaagatcggcggggtctcaaaatacgagcttgccaaaaatgaagcgttcagctttggttccaagcttgaaaatgcaaacgtgctcatgagagttttcggttcagagggaaacaataaaaattccggaaaagtgcagtcctgcaatgcaatcagaggggtgtacggcttccaaacgtatgacgagcaaagcttccgcaattccttaaacggcatcggaccgaccggatggacaccgatcgcaaacgcgctgcaagatgcaaaaaacgcgcttgaccagctggacaacaacgggaaaaacgtcgtctatctgctgacagacggtgaggaaacatgcggaggcaatccggtaaaagtcgcaacagaactgcgcaaatccaatgcggttgtcaacgtgatcggctttgattatgaaggagacttccacggacaattgaccagtatcgcagcagctggcggcggtgaatatttccaggcaaaaactaaaaatgacatcaaaagaatttttactcaggaagcaattgagctttctaaataa

SEQ ID NO: 2434 - DNA, 716 bp, Bacillus licheniformis
atgaaaaatccgtccagaagacaatttttaaaaggcttcttaggccttgccgcagcagggctctttaccgctgccggcggcttgggctatgcgcgctatctcgaaccgcacatgcttgaaacaaactttattcccattcggcatcggctcattcctaaagggtttgatcagtttcggatcgttcagttcagcgatacccacttaagcgaatactttacagcagacgagctttcaaatgttgtcagccaagtgaacgccctctccccggatcttatcgtattcagcggggatttaatagataaaccgcatcgctaccgggaacacgagcgtgctgtaagcgccttaaaaaagctttcagccccctatggaaagcttgctatattcgggaaccatgatcacggaggctatggaacaaaagtctatcagacgctcatggcatcggccggttttcgggtgctgcgaaacgatttgctgaagcttgaattgatagacggaagcgtaattgagatcgcttcactcgatgatttgatgctcggcagacctgactacgaaggcatcctgtcaaagctgagcaaaaaagccttttcgattttgctcgtccatgagcctgatgccgctttaacggcaaatcaataccccgtcaatctgcaaatatccggactcgaccgctgcggacaacttgatattcccgtgatccgtcgattgattacgcgacc

SEQ ID NO: 2435 - DNA, 1443 bp, Bacillus licheniformis
aagggaacatgccggtcttgtcggtgcaaacggagccggaaagtcgacattgctgcgcattttgacgggcagccttctgcccgatcatggaaacattgaatggcagccaaacattcgggtcggctttcttgaacagcatgccaagctgacggaaggcacaaccattcttcagtacatggagaaagcgtacggccggctgtttgaaatcgaaaaggaaatgaatgggcttgccgaaaaaatggccgatgccggagacaaccttgaagccgtcctgaaaagatacggagagcttcaggctgagctggaagcttcaggattttaccaaatcggaacgaaaattgaggatgccgcacaaggcctcggcttggcggaaatcgggcttgaccaggatgtcacggctttaagcggcgggcagcgtacaaagctgctgcttgccaaactgctgcttgaagagcctgatgtactgctgttggatgagccgaccaactatttggatgccgctcacattgagtggctgactggctacttgaaaaactatgagcacgcatttcttgtcatctctcatgacgaacgcttcttaaatgaaattacgacggttacattccatctggagcatcatgtgatcaaacgttattccggcaactatcaatatttcctgaaggagtatgcgcaaatcagggcacaggctgaagccgcatatgcaaaacagaacagggaaatcaaaaagttagaggggtttatcgaccggaacagagtccgaaaggcgaaacaggccaaaagcagtgagaaagcattacgcaaaatcaagcgaatcgaaaaacgacagattcttatgtcccaagctttgcatttaaaacgggggcgaaaccccggcgatgactgtactcaaaacggaaaatcttgaggccggctacacagttccattatttaagcctctttccctgaccgtaagacggggcgataaaatcgcgattattggagaaaacgggcgccggaaaatcgacgcttatcaaaacgctgctcggcgacctcaagcctcctgagcggcatcgtcacagcaggacagcatttacaggcggcctatttcaggcaggaaagcccagcttctcatgatacaccgcttgaaaaattgcgggcgttctatcctgatctaccggaaaaagacatcaggcagacgctcgcggtatccggcttgacgccaaagcatatcagccagcccctttttacgctcagcggcggtgaacaggcaaaggtccggctggcggagctgatgctttcaaacagcaacctgcttgttcttgatgaaccgacaaaccatcttgacgcatcggcaaagcatgcgttaaagcaagcgctctgcgactataagggaacgattttgctcgtatcccatgaaccggctttttatgaagactgggtgactcatatctggcagattgaagc

SEQ ID NO: 2436 - DNA, 565 bp, Bacillus licheniformis
atgtttatcagaacagaaaattttcagacgtttatcaggctctacccggtcacatccgccatattggccctgcagcttgccatttggattctttttttatttccgtttacggccgtacagatgtggtctgatttattgattggctttaactggggaatagcgaacggagaatggtggaggtttgtgacgccaatctttattcacgccggtttcggccacctgctctttaattcgatgtcgatctttttgtttgcccccgggctggaacgaatgctcgggaaactcaagtttctcatcgtttatatcggagcaggagtgattggcaatatcggcacatatttcatcgaaccgctggagtatatgcatgtcggcgcttcgggagccattttcggcttgttcggcgtgtacctgtacatcgtgctgtttagaaaagagctgatggggagcgccaattcccaaatcatcgtcaccatcctcgccatttcggttttgatgacgtttgtaaaccaaaatatcaatatgatggcgcacatcttcggtctgctgggcggactcgccttggctc

SEQ ID NO: 2437 - DNA, 1480 bp, Bacillus licheniformis
ttgtcattttcatatgtgcgctggtttcattcatcatatggctgaatgccggggatgaaaaattggggctctcagatgaagaagcagaggccgtcaaaccctctaaaaaaccggtcattgtcctgatcatcgactctttgatggatcagcctttgaaaaaagcgattcaagaaggccgcgctccggcattaaaattctttcttgaaaacggtcattatgaacctgaagtggcgagcgcgtatccgaccatgtcggtcgcgattgacagcacgctgctcaccggaacttatccgaatatccaccgcgttcccgggcttgtctggtataatcaggctggacagagaattgtgaattacgggagcgataaaaaagaaatcgccgcgctcggcctcaaacaaacgatcgaagacgggatatattctctcaatcaccgccatttaaaccgaaaggtgacaacggtacatgaagatttgcaaaagcaaggaaaacagtcggcatccatcaacgggctcatatacaggggacctgaccgccgcgaattaaacataccgcccccgctcaagaagcttagactgatgcctgaacatatgacggtaaacgggccggctcttttttcgtacggccgctttgcccagcttgatcccgacaactcctaccaccatatttggcagggttatggcgttaacgacaagttcacggcgcaggaaatggcttatttgattaaaaagaggaagcttcctgcgctgactgtcgcctacttgcccgatttcgaccacgatgcacacaaaaaaggcccgaaggatatggaaggcctcgaaaaaatggaccgtcagctgcagcgtatattgaatgcatatgattcttggcgcgatgcggccgaaaaagcggtgtgggtcgtcatgggagacggcggacagacatcgatcggacgcgataaagataaggcagccatccggctccattcgctttttaaaggatatcggatcgctaaaataaacgaaggcccagatcgaaaagaccagcttctttttgcggtaaacgacagaatggcatacatttatgtaacggatcaaaacacgccgctgcaagatgccgtcaatgaattgaaaaaagacggacggatcgctttcacagcgtggaaaaaagacggctggatatacgtcgattcgaagcgttccttaaaaccgctgcggtttcgtccgcaaggcggttatcaagatccttacgggcagtcatggacgatcagcggagatttttccttatggacattaaaacggacggtgcatcgatcatgtatggctgtttacccggtatctctttcccgcctgtatagtgtcatgcattctctatcgcggtcggtttgtaattgccgatgcgaaacccggattccaatttgcctggtttatagtctctctcctccatttggtggatgcggctatggctcactttataaaactgatatctttgctccgatgatcat

SEQ ID NO: 2438 - DNA, 451 bp, Bacillus licheniformis
ttgtgttaaaaaagttttttttgccggatgaatttgtaaaaaatatttttcatattacccctgaaaaactaaaagagcgcaatgtaaaagggattattacagatttggacaatacgcttgtagaatgggacaggccgagtgctacaccgcgtcttatcgagtggtttgaagagatgaaagagcacgggattaaagtgacaattgtctctaataataatgaaaaacgcgtcaaaatattttctgaaccgcttaatattccgtttatttacaaagcgaaaaaaccgatgggcagagctttcagaaaagccgttaaaaatatgggtcttaaaaaagaagacgtcgttgtcataggagatcagctcatgacagatgtgcttggagggaaccgcaacgggttccataccattcttgtcgtgcctgtggctgcttccgacggcttttttacgcgttt

SEQ ID NO: 2439 - DNA, 586 bp, Bacillus licheniformis
atgaaaaaatatgcgatatgcggtctgagcggccgcgcttttaacatgtttatcgagcctctggtgggaaaatacgggaaagaaaaccgcatcgctgcgctcttggacatcgatccgctgagggaggaagtctgcaaagaaaggtttccggcgcttcgccccgtcccgtttttcgaagagaaagcgtttaccgaaatgcttgacaaaatcaagccggacgccattattgtagcaggccgtgatgatacgcatgtccgctatatattgggcgctttacgggcagatattgacgtgatcactgaaaagccgatggtgacaacggcacgggatgcggcagccgtgttaaaagccgaagccgagagcaaaggaaaagtgaccgttacgtttaactatcgctacaatccgtaccaccgcaagatcaaagagctgatacttgacggaaagcttggcacgattacgtcggttgatttgaactggtacatcgatacgtatcacggcgcaagctattttaaacgctggaacaggatgagagcattctcaggcggtctttccgtccataagtcaacccatcatttcgatcttgtca

SEQ ID NO: 2440 - DNA, 511 bp, Bacillus licheniformis
atgatctacccttataaaaaaacggaacccgttattcatgaaacggcgtttatcgccgacaacgcggtcatcaccggagatgtaacaatcggagagcgatcaagcatctggttctcttctgttatccgcggcgatgtcgccccggtcagaattggaaaaggtgtgaacattcaagacctttcctgtctgcaccaaagccctgaacgccctctcgtgattgaagacggtgtgacggtaggccatcaggttacattgcacagctccgtgattcgaaagcatgcccttatcggaatggggtcgattattcttgacgaagcggagatcggggaaggcgcttttatcggggcgggcagccttgtcccgcctggcaaaaagatcccgtccgggcacctcgcattcggcaggcccgccaaagtcatccgtccgttaaccgacaaagataaacaggaaatggaaagaatacgcaaagaatatattgaaaaaggacaatactacaaatccttgcaaaaaa

SEQ ID NO: 2441 - DNA, 537 bp, Bacillus licheniformis
ctcttcgatcactcggcatccgcatggttcaagaacgcacccaaggctggtcgacgttcatacgcgtaacgcctcttcccgaccacatttattttatcgctcaaatgtcggggcaaagcgtcattcatattctttcgatcacagtaatcttcttagccggcgccttgatcaacggcgtttctttatccccattggaatggttcctgtgcggattgtgggccctgcttggctcgctcccgtttctggcgatcgggacattgatcgggatgatgaaaaaagtggatacagcagccggaatcagcaatgtgctgtatatggggctcgccgtatgcggagggatgtggatgccgcttgaaattatgccaaaaatgatgcagaatatcggccattggctgccgtcctatcattatggcagcggcgcctgggaaatcgctcgaggtcaaatgccaaactggaaaaatattctcttcctattagcctattcaatcgttattaaggcactatccaaatatataaggaggaaacaagaagcggtgt

SEQ ID NO: 2442 - DNA, 1419 bp, Bacillus licheniformis
atgatcgagatcacaaaaggcgtagaaacaggttacggctctattctcgccatttctgatatggaatccgccatgcgtgacgagcgaattaagaaaacaaaaaccgtctgcacctattgcggtgtcggctgcagctttgatgtctggacaaagggcagagatattctgaaagtcgagccgcaggaggaagcaccggccaacggcatttctacttgtgtaaaaggaaaattcggctgggatttcatcaacagcgaggagcgcttgacaaagccgctgatccgcgaaggcgaccatttccgtgaagcggaatgggaggaagcgttaacgctgatcgccagcaagttcacggatttaaaagaggagtttggcccggattcacttgcctttattacatcttctaaatgtacaaacgaagaatcctacctcatgcaaaagctggcgagagggatcatcggcacaaataatgtcgacaactgctcgcgctattgccaatctcctgcgactgccggcctgttccggacagtgggctatggcggtgactcagggtcgattgcagatatcgcgcaagcggaccttgtgttgattatcggttcgaacacgtctgagtcgcatccggtcttgtccactcgcattaaacgggctcataagctgagagggcagaaagtgatcgtagcggatatcagaaaacacgaaatggcagagcgatctgatctgtttgttcagccgcgtgccggatcagatatcgtctggctgaatgccatcgccaaatatttaattgaaaacggcaaggccgatgaacgctttttgcaggaaagagtgaacggacgggatgaatatgtgaaaagcctcacgccgtatacccttgaatatgccgaggagaaaaccgggattgatcaagaaaccctcatccaaatggcggagatgattggccaggctgacagtgtgtgcgcattgtgggccatgggggtgacacagcatattggcggaagcgacacgagcacagcaatctctaatctgctgcttgtgacaggaaactacggaaaaccgggagcgggctcttacccattgcgcggccataacaacgtgcagggagcaagtgacttcggaagcatgcctgacagactgccgggctatgaaaaagtgacggacgaacaagtccgccaaaaatacgagcaggcatggggtgtaccgctgccgaaggagccgggcatgaccaaccacgaaatgatcgaaaaaatccactctggcaagctgaaagcgatgtatgtaaaaggtgaagaaatgggtctggtcgattccaatatcaatcatgtacacgccgcatatgaaaagcttgatttctttgtggtgcaggatatttttcttttcacgtacagccgagtttgccgatgttgttcttcctgcgagcccgagccttga

SEQ ID NO: 2443 - DNA, 447 bp, Bacillus licheniformis
aaatctactagtttgcagacgaaaagctgcagatcaactttgcgatttctctgcacgcgccgaacactgagatcagaagccggctgatgccgatcaacagagcctacaagctgcccgatctgatgaaagcggtcgattactacattaagaaaaccggcagaagggttacgtttgaatacgggcttttcggcggtgtcaacgatcaggttgaacacgcggaagagctggctgaattgctaaaaggaatcaaatgccacgtcaacttgattccggtcaactatgtacctgaacgagactatgtcagaacaccgaaagaacagattttcgcctttgaaaaaacattaaagtctcatggagtaaatgtcacgatcagaagagagcaaggccatgatattgacgctgcctgcggacagcttcgtgcaaaggagcgccaggaagagacgaggt

SEQ ID NO: 2444 - DNA, 1413 bp, Bacillus licheniformis
  misc_feature (1)...(1413): n = A,T,C or G
atggcgatgattgtgacgtttatttcttttaacggtctgttcttatttatctcttttcttgtgtcgtctgngctcaggagcgagaagctgattgttctgttaaaagggaacaaaatctccaaaggggagccgaaagcatctgccttgcttacgctggttgctgctgtgctgcttgccggaggctattacaccgctttgattgtcaaagaaggaggcgttcttgtggcgatggtgccggtgacgattgttgtcattatcggcacatatctgctgtttacgcagctgagtgtttatgtgatccgcaggctcaaaaaacgggaaaccctgttttggcggaaaacgaatatgattttgttttctgatctgtcttacaggatgaaagacaattcgcggacgttttttatggtggccattatctctactgtcgcattcagcgccattgggacgctgtacggtttccaaactctggtgacaaacggaattaaagagatgaacccgcatacgttctcatataagccgccggaaacaaacaaacacatcgaaaaagacgtggctttcatcaatgacacactggatgaaagaaatatcaaaacagacaaagcttcagctgtccttcaatatttcgatgtcggcggcaatgacatgctgattgtgaaagaatctgactataacaagtttgccgatctcgtcggagccgaccacgtcaagcttgaagacggaaaagcggcggctgccgagtatgaggtcaagatcggcttagagggagatgatgaccagcagctcccttcgtcaatcccttttgcaaatggaaaacaactgaaggctgatcaaacgatccgttcaaaagcgttatctgaacccagctattatattgtgacagacaaagatttcgcacatttgaaaaaaccgaaaagcgaaaaccggttctatgcatggcaggcaaaagaagctgacggcatggctttagtgaaagccggggaggctttgcaaaagaaactggattacatgtatttcggggctgtagattatgaggtatataatataagcaaagggtatggcccgatattatttgtcggactgtttatcggaatcgtcttcttcgtttcagcaggaagcttcctctatttccggttgtacactgatttggacgatgataagcagaaattcaaatcgattgccaaaatgggcttaacagaccgcggactgcataaagtgctgaacaggcagatcggcatcttgtctcttcgcgcctatcgctgttgcccttgtccatggagctgtggcgctgaccgctttatcgcatgcctttcagtccaaccttttcaaggaatgctgcaatggtgctcggcgtgttccccgccattcaggtcatatatttcttcatcgtccgcttttaggagcgaagtcagataa

SEQ ID NO: 2445 - DNA, 516 bp, Bacillus licheniformis
atgagcaaaaaaattgcagttgttctgacagattactttgaggattcggagtataccgagcctgcgaaagcgttcaaagacgccggacaccagcttacggttattgaaaaagaaaaaggcaaaacgctgaaaggcaaacaaggcgaggcgcaagtggaaacagatgcgtccattgacgaagtcagcccggctgattttgacgcattgttgattccgggcggattttcgccggatattcttagagccgaccagcgtttcgtatcgtttgcaaaatcctttatggatgacaaaaaaccggtgtttgcgatctgccacggcccgcagcttttaatcaccgccaaggctctggacggtcgcggtgcgacaggctacacatcgattcaagtcgatttggaaaacgccggggtcaaatttaaggacgaggaagttgtcgtctgccagaaccagcttgtcacaagccggacgcctgacgacatccctgcgtttacacgagaatctttgaagctgctcggctga

SEQ ID NO: 2446 - DNA, 512 bp, Bacillus licheniformis
cacacggcggtgggagacaatccggagcgccttaaacaagtcattcagacagcgcagcaaaggtctgacttcatcattttttcgggaggcctcggaccgacgaaagacgatctgacaaaagaaacgatcgccgaagttgtcgggcgccctcttaagctcgacgatgaagccttcgaatcgattcaggattacttcaaaaaaacgaaccgggagatgtcgccgcacaaccgcaaacaggcgctgatcctcgaaggatccgatgttcggccgaaccgctatgggatggctccgggaatgctgcttgagcatgaatcgcgcttttatacgcctctgccgggacctccgaaagagctggagccgatgtttgaaaacgaagcgaagccgctgattttggaaaagctcggctagagggaaaagatcgtgtcaagggtgctgcgcttcttcggcatcggtgaatcccagcttgaaaccgatttggaagatctcaccgatgcgcagaataatccgacaat

SEQ ID NO: 2447 - DNA, 641 bp, Bacillus licheniformis
ttttgaatatcctgaatctcatactcgtcatacttttaattgcagctacggcttttttcgttgtcgccgaatttgcgatcgtcaaaatccgcggcacaaaaatcgatcagctcgttgaaagcggggataagcgggcgattgcggccaaaagagtggtgacaaatcttgatgaatatttgtctgcctgccagctcggcattaccatcaccgcattagggctcggctggctcggagaatcgacattcgaacagatcattcacccgctttttgagttatttggcctgcctgagtccgttttaagagtggcttcggttgttgccgcatttatcatcattacatttttgcacgttgtggtcggcgagcttgcgccaaaaacaattgcgattcaaaaagcggaagccgtcagcttatggacggcgaagccgctcattttgttttataaaatcatgtttccgtttatcaaactgttgaatggctcggcccggctgttaacgaagctgttcgggttccattctgttaaagagcatgaagtggcgatcagtgagggaagagctgcggcttatgctgtctgaaagctataaaaaaggggaaatcaatcagtctgagtataaatacgtcacaaaatttttgaatttgacaac

SEQ ID NO: 2448 - DNA, 618 bp, Bacillus licheniformis
gccgtcccgataaaaccggtgtagggacggctgttattgtcggcatcggttacgagaccgacgctccctttgaccgggggcggtattatgattttactctgccggaatcgggcgctgagctgcccatgaggcccgatggagcagactggccggaaccaggcggggcgaaagcttttctgtccttcatcgaacagcagttaaagccggagatcgaacaggaattcacgattgatgtgaaaaggcaggcgattttcggtcattccctaggcggactttttgtcctgcagaccctgtttacaaaaccggatctatttcagacatatatcgccggcagtgcgtccatccattggcatccgtcattttttgataaagagcatgactttgtttcgaagttgcaggaagctgatggcgatgtaaaggtattgcttggggccggagaactcgaaaagacgcataaaagcgggatgaacgacaatgcaaaaaggctggccgaccgcttggccgctttggaaagtcagggggttcgcgcggagtaccatgaatttaaaggggaaggtcatatatcggttctgcctgtgttaatcagcagagcgctgcggtttgccttcaagcctgatt

SEQ ID NO: 2449 - DNA, 627 bp, Bacillus licheniformis
ccaaatcattgacgcactggttcagacgattcaaatgacggttttttcgcttttattttcaagcgtgatcggcattccgctcggcattttgctggtagtcacaagaaaggggcatctgcttgagaatccggcagtttttacgtttgtcaatatgatcattaacattttccggtccgtcccgtttatcattttaatggttgctttaattccagtgacaaggctgattgtagggacgtcgatcggcacatcggcagcgattgttcccttgactttttatgcggggccttacatcgctagactcgtcgagaactctctgcttgaagtggatccgggagtcattgaagccgctgaagcaatgggagcgactccgagacagatcatcttcaggtttctgattccagaagcgctcggttcgcttgtgctgagttttacggtggcaacggtcggattggtcggggcgtcggcgatggctggtgcgattggtgcaggcggtcttggggatttggcgatcacatacggctatcaaagatttgacacgctgacgatgatcatcacggttgcaattctcgtcatcgtagtgcaaggattgcagacatccggaaacgttctgtcaaaaaaattgagaag

SEQ ID NO: 2450 - DNA, 549 bp, Bacillus licheniformis
ttccgtcattggatgaccttgtcagcgccgagcaccataaaaacgctcaaagccacatgaatactgaagacatcgaattcggctactgcacggagtttatgggaaagctcgacagcggtaaaagaaactttaatgaagttgcgttccgccaggatttaagccgcttcggtgattcggttctcgtcgtctcagacgaaaatatcgccaaggtgcacatccatgccgaatatccaggggaagtcatgacttacgcgcaaaaatacggcagcttaatcaacatgaaaatcgaaaatatgagagatcagcacagcgcgattctcagccagaacaaacaggagacagcaccggcagaaaaagcgccggcagataaacagccgtacggcatcgtcacagtggccatgggtgaagggattgccgagcttttcgaaagcatcggcgccacaaaggtcatagaaggcggccagacgatgaatccgagcacggaagacatcgttcaggcgataaaatacgccaatgcggacacggtcgtgattctgccgaataattcat

SEQ ID NO: 2451 - DNA, 525 bp, Bacillus licheniformis
ttccgggtgagcttgcgaaaccttatatttcaatgtttctgcttgttctcggcgtgtatgtgctcattcgatttctattcatgtttaaaataggagagcaaaaaaacaatatcagcctttcgagaaaaaaagccgttcccctgggattgatcgcgggttttgccgatgcaactggttggggcggctgggggccgattgccactcctgttttgttatccaaaaaaggcgtcagtgcgagaaaagtagtgggaactgttgacacaagcgagtttgccattgccgtttcggcaacgttaggatttttcatttcgctcggctgggaagaagtcaattggctgtgggttggtgcattgatgattggcggaattattgcggcaccgattgccgcctggctggtgcagaaggtgcatgcccgattaatgggcgttctggtcggcgggctgatcatcctcgtcaacacaagaacgcttatccattcgtggatcgatcaaacagcattatatccggttatttatattggattat

SEQ ID NO: 2452 - DNA, 746 bp, Bacillus licheniformis
ttgaaccaatcctatctcacagctgcgcttcgggcagtgtatgtgctgtttttgaccgctgtttgcggagcggtcggctactactcttttccgttaacctatccttttgtgattgcgcttattctcgccatcatgatcaatccttttgtggaatggctcgataagctgaccgggttcccgagaggcgtcaatgtcggaatcgttctgttcggctttttgaccgccggagccggctttttgacactggtcgttgccgagatcgtctctggaacggcctatttggctaaaatacttcccctccagtttaataaagccgctctttatatcgaatcgttttttacgaatcaaatcatgccgctgtataatgagctggccgctttttttgacggccttgaagccgcccagcaggaatcgatcattacacaggtccaaaatttgggcagtgaacttgcttcaggcacggctttattgctttcaaaaattcttgagacggtgcccctttttttcgcctttctgccgaatatggcggccgtgctgatcttttcgctcctggccactttttttatcagcaaagatctgcataaaatacaaaacaaggcacggtctgttcttcctgatcgtctgatctcgggtgcagcggctgtctatgcagaattgaaaagagcactggcaggctttgtgaaggcccagcttacccttgtggcgatgacgatggtgctcgtgttgatcgggctttccgtggttga

SEQ ID NO: 2453 - DNA, 897 bp, Bacillus licheniformis
tcattgatatgaagaggaaagaccaatgaggaagacagagaatacgaacgacaaaagcacagcacttgatgaaatgaatgctttagatatcgtcaccttgatgaatgaggaggatcacacagtccctcgcgccattacgccctgccttcccctgatcgctgaagcggcggagacgattgtcagccgttttgagcaaggcggaagagtgtttaccgcaggcgccggcacaagcggcagaatcgcagttcttgatgccgcggaactgccgccgaccttctctattgacgagagccgttggaccggcctgatcgccggcggatatgacgcaatgtggatgcctcttgaagaaaatgaagatgaccgtgaaaaaatcgtcgctgacctgaaagcgcaatcattctcgaaagatgacgtcttaatcggagtcactgcgagcggttcgaccccttatgtcctcggcgctttatcctatgccaaacagatcggagccgcttctgtttcgatcagctgcaacgcggatacagaagcgggcaaattaagcgatatcgcgattgaggttcaaacaggaccggaaattatccgcggttcaacgcggctgaaagcaggaaccgctcagaaaatgatcttgaacatgctgtcaacagcggcaatggtgaggcttggccgcgtctatcaaaacgagatggtgaatatgaggctgctcaatcaaaaattagccgggcgcgctgtcaccattctgatgaataccaccgggttatcggaggatgaggctctgcaagctttaaaagaaagcggcaatgacatcaaggcagcgatctttatgacgttgacaaacggaacgcttgaagttgcccgccgctgtttatcccatgaaaatggacatttgaaaaaagcgat

SEQ ID NO: 2454 - DNA, 558 bp, Bacillus licheniformis
tggtattgctttcacgattcaatcagattctcggcgctcgccttttgacgcacttttggtggtactggccgtacatgcggggcttactgtgggaagttgggaagtcatcattgctctgctattaataggctgcaattcggttttaaaaagacaaagaccggaagtttcggggctgctaacagcgtttataaccggtatcggcattgacatgtggctttttttgctgcatttttttgtgacaccagaacaatggtacagcaaagcggtttgttttgggatcggcttggttgttacaggattaggaaccgcgacatacttatacacaaattttgcttcgatgccaattgaccgtctaacattcatcataaaagaattaacaggaaccaatatatttttttcgagaaccatcatttaccttgtcttcttgacagcggccgtcatgttaaaaggaccgattggcatcggaactttattaaccgtttgtttaggagggctggcccttcatttgtttatgccgtttgctggaaaagtgttgggtcgctttacagacgctcgtac

SEQ ID NO: 2455 - DNA, 498 bp, Bacillus licheniformis
aaaatttttcataaagacacaaagggaaacagcaggctataacatttttaatgcctcctcatatttgagcattgaggaaagcggagctattgcgctttccgaatcctttgtccaggatgtgaatgaaattctggtccgcaacggtttgaaagacgagctgaccgtcgacctttctccgaagtttgtggtcggatatgttgaagaaaaagaaaagcatccgaatgccgataaattaagtgtttgcaaagtgaatgtagggagcgagacgctgcaaatcgtctgcggagctcccaatgttgaagccggccaaaaagtcgtcgttgccaaagtcggcgccgtgatgcctagcggtatgatcattaaagatgcggaacttcgcggagtggcgtcaagcggcatgatttgttctgccaaggagctgaatctcccagacgcgccgaaggaaaaaggcattcttgttcttgacgacggccgtaaagcaggagaagcctttacatt

SEQ ID NO: 2456 - DNA, 444 bp, Bacillus licheniformis
atgattagtttgcaatcagatgaacttcttgaaacgacagtaggtcagtttatgatcgatgctgataaagtagcccatgttcaagtcggaaacaatctggaacatgcccttctcgttttgacgaaaaccggatataccgcgatccctgtacttgatgcttctttccgtttgcacggattaatcggaacgaatatgatcatggataaaatcttcggcttggaacgaatcgaatttgagaagcttgataagattcatgttgaagaagtcatgctgacggacatcccccgcttaaaaattgatgatccgattttaaaaggattcggactcgtcatcaacaacgcgtttgtatgtgtcgaaaatgaagagcaggttttcgaaggcatttttacaaggcgtgtcgtattaaaacagctgaataagcatttgaggacgttgaataaatag

SEQ ID NO: 2457 - DNA, 645 bp, Bacillus licheniformis
atgattgttgaaaaaatcatgaaacgggatgttgtgacactatccagaaccgatacgattgaagaagcgatcaaacgcatgcgaacattccacataaagcaccttcccgtcatcaatgaacggggaacggtcataggcattgtcacggacagggacgtcaaaacagcaagtccgagtatctttgcccaaaacagatctaacgaagatttaaaaaagccggtggaactgatcatgtccaaagaagtgatcaccggtcacccgcttgattttgccgaagaaatatcagccgtcttttttgaacacgaaatcggctgcctcccgatcgtaaaaaacggaaagcttgtcggcatcgtgacaaaatccgatttgctgcatacgttcgttcagctgacaggagcccattttccaggctcccaaatcgaaattaaaaccgatcatatcgcccgaagcctcgctgatatcagcgccatcttcagcaggcgccaaatcgccatattgagcgtgctcgtatatcccggtgatgaagatgattcgaaaatactcgtgtttcgcgttcaaacgatgaatcccgcctctatcatcaaagacgtaaaatccaaagggtatcaggttctttggccggctgttcaaagggatttgccatga

SEQ ID NO: 2458 - DNA, 534 bp, Bacillus licheniformis
tactggacggagagctttatcatgcttctgatccggtgctgtgccatgacagactcaaggcgcgcaaaattacgaatgaattcaaccattcgaacgaaatcgacgactataaaaggaccaagctaatcaaagagctgtttggatcaacaggggaaacgatcctcatcgaaccgtcgtttcgctgtgattacggctttaacatacatgtcggggaaaatttcttcgccaattttgactgtgttttcctcgatgtatgcgatatccggataggcgatcattgtatgctcggaccgggtgtccatatttatacggcgtcccatccgctcgatccgtccgaaaggataagcggtgcggagtacggaatacctgtcatcatcggccggaacgtttggattggcggcggcgcggtcatcaatcccggcgtcaaggtcggcgacaatgcagtgatagcttccggagccgtcgtcacaaaagatgtcccggataatgccatcgtcggcgggaatccggcgaaaatcattaaatacgttgata

SEQ ID NO: 2459 - DNA, 622 bp, Bacillus licheniformis
gtgaaggaactgactgctactggacgtaccgtcgatgaagcagtgcaatccgggcttgaacagctgggccttcatgcagatgatgtcgaagtcgacgtagttgatgaaggaaaaaagggattattcggcattttcggtcatcggtctgcagtcgtgaacattcgggaaaaaatagacccggttaaagaagcaaaacaatatttggaaaatgtaatttcgaatatgggaatacaagcccaggtgacggcagaagaggagtctaaacgagtggtttttcagttgaaaggagacaaaacagctcttttaattggaaaaaggggacaaactttaaatgcccttgaaacgctgacgcagctcgtgctcaatcgtcattccgacagatatatccaagcggtggttgacgccgaaggataccgcgcaaagcggaaggaaacacttgctcagctggcattgaagcttgctgaccaggcggccaggcagaaaaaagacattcacctggagccgatgccttccagtgagcgcaaggtcatccatgatacgcttgcgggctactcgcagcatatcgaaacttactctaccggtgaagaccataaccggcaccttgtcatctcatataaaaaat

SEQ ID NO: 2460 - DNA, 549 bp, Bacillus licheniformis
cccagacgctgatgctttttaccgcattattgatgggcatctttttatttgatgatgcagacgcttttctatcgctttggaatccatcggacttgagcatcctgaagtacggggcgccgctcgcggctctcgtgatcatcgccgacctgatggtgatgaaatgggctcccaagcatatgtatgacgatgaagggataaatgaaaagctctttcgtgaacgctcgtatccgcatatcgtgattcttacccttttcattgcatttgcagaggaaatattgttcaggggcgttatccagacgcatttcggtctctgggcggcgagcattattttcgcgatattgcattttcgttatttaaaaaaatggctgctgtttgtaatggtggtgtccatcagctttttgctcggattgagctttgaacggacagggaatttatttgttcctgtcacggcacattttttgatcgatgttgtatttgcgtgccagattcgttttcaacacgtaaggaggagttcacatgacggagatgtcaagaatagagaggaagaag

SEQ ID NO: 2461 - DNA, 594 bp, Bacillus licheniformis
cgaaacaaaaagtaagaaaagaattgcggacagaaagaccgtccatctattcttttgaaatagaagaactgaaaagctggctatcggaaaacggcgagaagccattccgcgccgcgcaaatattcgaatggctatacgaaaagagagtcacgtcatttgaaaagatgacaaacctttcaaaagagctgcggacaaagctgaatgagcatttcgtattaacgacgctgaaaacggccgtcaaacagacttcccaagatggaacaatgaagtttttattcgagcttcatgacggctacacgatcgagaccgtattaatgcggcacgaatatggcaattctgtttgtgttctgacacaggtgggaggccggatcggctgtactttatgagcattgaccctcggcggctgaaagcggaacatgaaagcggcatacgatcgtcgctcaggttgtcaaagagcatgcgagtcgtttgatgtcggcagaatgaaagtgtcggtcctatagtcataatgggaatcgccaatctgttctatactggtcaagaaattgtctgcgttgtggtccatcatatcccatgagaaaggcgtgaatgtcc

SEQ ID NO: 2462 - DNA, 773 bp, Bacillus licheniformis
atgtctgagagcagcaagaaatcagtcgtcatgttgctgatcgattcattaatggatgaaccgctcaaagaagccgtgaaaaacggacaggctcctggactgcaatatttactggaaaacgggcgttatgtgcctgatatgatcagcccttttccgacgatgtctgtcaatgtcgacagcacattgcttacaggggtgtacagcgaccagcacaaagtgcctggccttgtgtggtacaacgcgaaggaaaaacggattatcaattatggcagccacattcgagagcttctgaaattaggcatcaaacaatcctccagagacgtcttttacaatctgaatcaggttcatttaagccaacaggtgaagacgcttcacgaagagcttgacgaaaaaggaatcgaaacgtgctcgatcaatgcgctcttgcacagggggagccgggacggctatttgcagattccctttcttttttcaatgatttccggattaaaccggtcagtcaaaatcaacgcatcccagctgttttcgtacggcggtttttccaaagtgaatccggccaaccgctcgcttttcaaaaaattcggttttaacgaccgattttcaaccaatgaattggtctatctgattcaaacaaacaaagtaccgcctcttgcgctcgtctattttcccgatctcgaccagcacgtgcataaacacgggaggaacgacgcagcgggggtggcgaaagccgaccggcatgttcaaaggattttagacagtttttcgtcatggaa

SEQ ID NO: 2463 - DNA, 627 bp, Bacillus licheniformis
taccttcggtgccgcttgatcggaaacgggcagaaggaattcttcgatggcttgaagaaaataactactattatgaggtgttcagcgatgaagcaatcttcacgccgcaaaacggccgcgagctgcttgacattgagctggaccgcttgaaaagcgcaaatcctgaggcagacctatcaaggctggaactcgcggctgaacagcagctcagccaaaacggatacgcgtacatcagctcctataccgatctgtttttagccggaaaggatgttaatgtatataacatattagctttttcttttcataaggaaaagctggaaacgggctggaggcaatttgaagatgcacaagatattacgcttgtcacttcagccgagcacaactttgaaattgagcatcttcaggcgtcaaaagggctggcattggagaagctttcacacaagctcggcatttcccttcaggaaacagctgccgttggagacagcctcaatgatttttcgatgctgaagatcgcggggaaaagctttgccatgggcaatgcgcgcggagacattaaagagatggctgatgaggtgacgctcactaatgatgaaaatggcgttgctcacatcctgcatcagctgattg

SEQ ID NO: 2464 - DNA, 683 bp, Bacillus licheniformis
ttgtttaatttgtgcagcgcctcttttacattctctctcatggcattcttttttctttttacgatcagaagagaaaatatgcagggaatgtaaagagaactttatcgagatcaaaggaaccgtatgccctaagtgcggacggccacaggggagcgaagagctgtgcggtgactgcgcaaaatgggaggccaatccgttaacccgctctcttttgaggcaaaaccgctctgtttatctctacaatactttcatgaaagaagtccttgcccgttttaagttcagaggtgatgctgaactggtcttcgcttttgccccttcatttatcagcgcttttcaacaatacttccgccgcagcccgtctgttttagttccgatacctctcagtgaagaacgtaaagcggagaggggatttaatcaggcggagcgtcttgcttccttattacaaatacccgttattcatcccttgatcagaatcgaaaatgaaaaacaatccaaaaaaagcaggaaagagcgaattaagccaaaaaccgtttttagaaccgaaaaggggtcagtaaagaatctggatgtcatattgattgacgacttgtatacgacaggagcgacccttcatcatgccgctgattgcctgatgacatccggagaagcaaaatctgtatcatcatatacattaattagaagct

SEQ ID NO: 2465 - DNA, 708 bp, Bacillus licheniformis
aaagggcggagcgcctgagagcagcatcaggtcagcgaaagctctcgatattgaatgtctatttgtcgcaggaagcgcctgtagatgagtgggaagatgttgtcggtcatccggtcgcagataagcggatcagcatcgtgccggtttttattgatcacgcttcggctgaagaaggattacgcaaactcgccgtggctttaaacatggagccggatgagctgacaggccaaatgcaggatgccggatacgaaaatgtggaagagaagagagccgaagtattggcagcggctaaagcaagagaagaagaaaggcggcgggaagcggctgtatttgagaaaggcaaaccgatgtttacctggattttcgcagtgcttcaagtcttcatgtttctgcttctggaaatgtcgggcggcagccagaataccgaaacgctcgtccggttcggggcgaaggaaaacagcctcctgttagccggggaatggtggcggctagtcacgccgatcgttcttcatatcggattggtccatctcatgtttaatacatttgcattattgtctgttggagccgcagcagaaagggtgtttggatcattccgctttcttgtcatatacatatcagccgggatttttggatcgatcggcagctttctgttcagtccgtatccgtctgcaagagcttccggagccatcttcgggtggcttgggagcc

SEQ ID NO: 2466 - DNA, 1050 bp, Bacillus licheniformis
ggttcattttggtttaatcggctgcggctatatgtcaagaaaacatcttcaagcactggccgagtgcgatgatgcaaagttgtcggccgtcagtgatttgcaggaagaaagaatgaaggaagcggaagaatactatgcttccctcgccggtgaggaaagccgaatgacccgctatccgcagtatcaagcgctgctttcagatcctaaaattgaagcggtcattattgcggcggtttcgggactgcacgccgaaatggccaaacatgcgctgctggcaggcaagcacgtcatcgtcgaaaaaccgatgaccttgtcattacgggatgccgatgagcttatagaactggcggagcagaacgggctgaagctcatggtctgccaccagatgcgccaccggccgatcatgaaaaaactgaaggaaacgattgaggaaggaaagctgggaaagatctacttgggcacggtatcgctccgcttaaacaggtcccccgcttattatgaagcggcatcctggcggggaagctgggaaaaagacggcgggatgctggtcaatcaagggatacatctgatcgatctgctgcaatggtttttaggtgatgtaaaaggcgtttacggagatatgctgggcggctccggagctaaagaaacggaagatgttgctgtcggtattctgacgtttgccagtcaggcgaaaggtgtagtagaagcgaatatcgtcacacagccaaacaatatcggaagctctctctcgatttttggagaaaatggaacgatttcattggaaggtccggcattaaaccggatcagccgctggtacatccacggggagaaggcggatgctgaagaagcggcaaagctgattgacatcggcggcgaacaaaccgcaatgtatcaaaactttataagcgccctcaagcgccaagacacgctattggttgacggctatgaaggaaaaaaggcgattgaaaccatctttggaatctatcaatctgtgctgcagaagcaaccggtgcagctgcctctttcttcatttcaaacaactgatatgaa

SEQ ID NO: 2467 - DNA, 584 bp, Bacillus licheniformis
atgaataataaaaaacttcgcgccggcgatatggcgcttgtcggaatgtttgccgctctgatggggatcggcgctaatatcacttcgtttgccccgtttctgcaaatcggcggtattccgcttacgatgcagcctttcttctgtttgcttgccggacttttgctcggccgtaaattaggtgcgctgtccatgattgtctatgcgttagtcggctttattggcgctccggtattcgcttctttttcaggcggtatttccgttctttttaaaggaagcgcaggctttattctatcctatattcctgccgcatatgccgcgggctggatcacggacaaactatccgaaccgaaaacaggccactttttcgcagcctcattgatcggtacgctgatcatttatctgatcggcgtcaactatacgtatctcgctttttccacttggctcaatacaccgatgtcatattcagccgtttggaaaatgatggcctggttcttcgtgaaagacttggcattctccgttctgctcgccgcgctcgcctcaaaggttttccgggcggttcaaaaaggcgcaggcttcagaagaaa

SEQ ID NO: 2468 - DNA, 448 bp, Bacillus licheniformis
atgattgagctttccaaagtgaaaaaaagctaccaaatcggaggagaaaccattgatgttctcagggagatcgatatgaaaatcgagccgggagaatatctgtccatcatggggccgtccggttcgggaaaatcgacgatcatgaacattatcggctgccttgaccgcccgacatcgggtatttacaggctggacggcgaggatatttcatcatacggcgaaagggagcttgccggtgtcagaaaccgtttaatcggttttgtttttcagcagtttcagcttctgccgcgcttgaatgccataaaaaatgtggagcttccgatgatttacggcggcgttccaagaaaggagcggcgggagcgggctgaacgggcgctcgaaaaagtcgggctcaaggacagaatgcgccatatgccgaacgagctttccggcgggcaaaaacagcgtg

SEQ ID NO: 2469 - DNA, 722 bp, Bacillus licheniformis
atgaaggtgacagtcatcggctgctgcggaggatttccggctgcaaatgaagcgacttcaggctatctctttcaatccggggactattccgttttaatcgactgcggcagtgccgttttatccaaacttcagctgtttctgcccgttgaggagctagatgccgttatattatcccattatcatcatgaccatattgcggatgtcggccctttgcaatttgccaaactggtcggctcattcctcggcaagggagcggatgcccttccgatatatggacatccttttgatgaagagcagttttcaaagcttacatataaaacgcataccgctggattggcgtatgatccgacacagcctttggctatcggaccgtttacgttcacgtttttaaaaacggttcaccctgttgactgctttgccatgagggtgacggacggtgttcattctgtcgtttatacggccgactcgagctttcaggaagcctttattccgttcagcgaaggagccgatctcttgatctcagagtgcaacttttatgcggatcaggatgggaggagcgccggtcatatgaacagtcttgaagcggggcggatcgctgcggaagcgggtgccgggcagcttctcttgacacacctcccgcatttcggggaacaccaaaaactgatagaagaggcccaaaccgtttataaaggtgcggttgttctggcgcacaccggttatgt

SEQ ID NO: 2470 - DNA, 490 bp, Bacillus licheniformis
  misc_feature (1)...(490): n = A,T,C or G
atgaaaatcggtattatcggtgcaagcggtaaagcgggcagcatgattttaaaagaagcatcagaaagaggacacgaagtgacggcaattgtcagaagtgcgtcaaaaatggcgaacagcgatgcagctgtcattgaaaaagacattttcaacctgacagcggcagacatcaaaggactggatgttgtcgtcaatgcattcggcgcggccccagggcaggagcatctccatgttgaagctggaagaaagctgattgaactgtttaagcaggttcctgaaacaagattaatcgtcgtaggcggtgcaggcagcctttatgtcgatgaggaaaaaacaacccagctgtacgatacgcctgagtttcctaaagaatacttgccgacggctaaaaatcaggngcagaaccttcaggatttgaaagaagcagatggactgaaatggacgttcatcagccccgcggcattttttaatccggaaagaaagcgaacaa

SEQ ID NO: 2471 - DNA, 620 bp, Bacillus licheniformis
atgcaaaacgtggtgatcatcggagccggcggccatgggaaagtcgttcgggaacttgtaaaagagcggccggatacggagcttgccggtattcttgatgaccggtatgcggagcttcatgttgagaacggtctgtatcgagggccttcagctgccgcagaagaacttgcgcggcttcatccggacgcgaagttcgtcctggctgtcggccaaaacagcatcagacagcagctgtatgaacgcattggtcttccgcttgaccggtatgcggttttgattcatccctctgctgttgtcagcggttcggcccggattcaaaacggcgccgttgttatggcatcgagcgtcatccaagcggatgcagacgtcggcatccacgcgattgtcaacacaggtgcgatcgtcgaacacgacaatcggatcggcgattacgttcatctttcgcccggaacggtgttaaccggcggcgtgacagttatggaaggcgctcatctcggcgcgggaacggcggtcattcccggaaagacagtcggacgctggagcgtgacgggagcgggggcagccgtgattcacgacattcctgataattgcaccgcagtcggagtccctgcaagaatgat

SEQ ID NO: 2472 - DNA, 1233 bp, Bacillus licheniformis
atgagtccgaatcatcacaaactattttacaaagatccctatctaaaaacgtttgaaacgaaaatcttgaaacaacaacaggacaaaaaaggtgatgtttatattatcctagaggaaacagccttttatccaacaggcgggggccagcctcatgatacaggaacattgaacggagtcaaagttttaaacgttgatgagatagatggagaaattcgtcattatgtagaaaggcctttgccgcatttaaatgatcaggttgttggggttattgattgggagcggcgttttgatcacatgcaacagcacaccgggcagcatattttgtcggcggcattcgcgcagctgtatgatcttcatacagttggattccatcttggaaatgatacggttaccattgaccttgatgtatcagaattaacagaggaaatggcaggcaaagcagagaagcttgcaaacgagatcataacggaaaataggtccatagtcgcaaagtgggtagaatatgatgacttagtaaattatccgattcgtaaactcccatctgtaaaagaaaatattcgtcttgtcatgattgatgaatttgattacaacggatgcggcggaacacacccgagcgctacaggagaagtcggagcaataaaagtattgaattgggaaagacagaggaaaaaaattcgtctgtattttgtatgcggtaatcgggtcataacccaattcgatcaaaaacaaaaagcaatcgttgaattgactggattacttaatcgtcctgaaggggaattaagcgaagctatcaaacggttgcttgaaaatgtaaagaagctagacaaagcgcttctagaatcttatgaaaaaaaccttcagtatgaagccaatgaattattagcaaaaagcgcaattcaaaatgatactgtaatggtgatagaaacgttttcagatcgatcgattcaagaacttcaaaagctagcaaaaatgattgctgatcgagaaaaacgggcccttatttttttcttgtcagagaacgatcatcgcttccaattggtttgcgggcgaggtgaagcaaataaaatgaacatgagagacctaatgcaagaagctctttcccttattgatggaaaaggtgggggaaataaaatgttcgctcaaggtggagggactgcttcattcacaaaagagaaatttatgaaaaatgttatgaacattatagcaatacaaataaactcagaagaaaattaa

SEQ ID NO: 2473 - DNA, 714 bp, Bacillus licheniformis
tgcgctaccttactccggtccatgaaatgaatttatgcggacatgcgactgttgcttctctttatgcgcttttggaaaaaggcgcgattgaagctggcgcggacgtgaaggtcgaaacaaaagcgggcgtcctttctggtggtataccgcctcagacggcaatcggcgttttttggtgacgctggagcaggcgcccccgtgttttcagtctttcacaggaagcagaagccaattggcggaacgctggggatcagcgaaggagctttcatgaagcattgcccgttgtttatggaagcacaggtatatggacattgcttgtgccggtgagagatttggccgcaatccgcagatgtaagcccgttcaagctgaatttccgaacgttttaaccgagatgccgcgagcatctgtccacccgttttgcctggagacgatgcagcgggattgccagcttcacggcaggcatttttcatcgccttattccggaacgagcgaatatcctgtcacaggaacggcatcaggagtgatgggcgcttatatgaaaacgttcggaaaggaattctgtgaagagggccagactgattttcagatcgaacagggccaggaaatggggaaagacggaaaagtgaaaatcgaagttgcggaacaaaacggcatcatgaaagtgcgcatgacaggaaccgctgtatttgctgaaaagcaaagctttgaagtgt

SEQ ID NO: 2474 - DNA, 888 bp, Bacillus licheniformis
aaaagctgccgaaaacgctgtccattctgctgatctatttggtgtttgtggcattcatcgggtttgtattgtcagcagtcggtcctgtatttacaaagcaggttaccgatctgttcaacaacatcccctcctatgtgaaacagatccagattttcattaagcaaatgtcgaattcgcagtggttcacttggataatgaatcaggacttcgtatcggttgccaaaatcgaaagctcaatcggcgaatatttgacgagcctgcctgaaaatattacagggagcctgacttctgtattcggcgttgtgaccaacattgcgctcacggctgttaccgtgccgttcatcctgttttatatgctgaaggacggccaccgtttcccgaatttggctgtcaagatcctgcctgacaagtataaaaatgaagggctgaagatttttaaggatttgtacgagacgctggcggcttacattcaaggacagctcattgtttgtctgttcgtcggaacggcgtgcttcatcggtttttggatcgccggtgtgaaatacgcgctgattctcgggttgatcattgccgtgacgaatattattccatatgtcggaccgtttcttggagcggcgccggccgtcattatcgcatttctcgactcgccgacgaaagcattgatcgcgctgatcatcgtcgttgccgttcagcagacagacgggaatctgctgtcgccgctgattatcggccgccgcttgaatacgcatccgctgacgatcatccttttattaatcggcgccggaagcttcggaggcattctcggcatgatcctggccgttccggcttatgccctgctcaaggcttttacattgaatatcgtccgccttgtccgtttaaggcagaggt

SEQ ID NO: 2475 - DNA, 477 bp, Bacillus licheniformis
aaaaaaccatgatgtttttattcatttttatcatcatcttagctgcggctgttttattgttcatcaatttacatcctgtgtttggaggaaatccaagcaaggaacaaaaaaagctgtatcaaagctttgacaattatgccgatggcaaatttcttaatcaaacacaagaaaagatggatatgggcggaatatccggagttttctcaatgatgagagacgctgtttccggcggcaaggagcgcaatccttccgatcaaatccctgtttctgagattgattggaacatcgttaaaagtaacgaagacagcttaacatggtttggacattccgcttttttactgagcatcgaccgcaaaaaaatactcgtagaccctatgctgggtccaattgcttcacccgtatcattcatcggaagcagacgctacagcgaagacatcctgcatacggtcaatgatatgccgccgattgacgccgtct

SEQ ID NO: 2476 - DNA, 509 bp, Bacillus licheniformis
ttgagggaaaaaagagatttccttcgggatatattattgatattgatcagcagttttgggggatttcttctctcattgaccggcatgacaatcggctggatggtcggaacaatgaccgccgccgcttgtctgtcgctgtttcgcccgtcaccgttgaaagcggcggtcagacaaaacggcatccaccatggatggcttcagttcggccaaatgctattgggaattgagcttggccaaaaaatcaacatgtctgtgatttcgatctttaaggaaaattggctgattgtcggcgtcatgcttctcctttccgtcgtgttcgccatgctgtcgggctttgtcttgtggagattcagcaagacagatatgctgacgagctttgtgggaacggctcccggcgggctttccgcgatgccgggcatcgctcaggaagtcggagcgaactcggcaatcgtcagtctcgtgcagatgatacgtgttcttctcgtcgtcatgaccattccctttttcgt

SEQ ID NO: 2477 - DNA, 621 bp, Bacillus licheniformis
acatatgaaactgcttgatcatttaaatatcaagaaagttcatgtggttgcggtgtcagccggcgggccaagcggaatatgttttgcatccaaatactcggaaagagtagaatccttaattttgcaaagcgctgtcacaaagcagtggctgacagcgaaggatattgaatataaagttggtcagatcatctttcggccgcctgttgaaaaggccgtatggaagctgatatcggcgcttaacaatcgatttccggaatggatctttaagaaaatgctatcctcctttactacacttcctgctgatcaggcgatgctgaaagtcacggagggagatattgaagaaatgagaaaaatgaacaacagacagcgttcaagtcgagggttcttgcttgatttaaaaaatatagacgatttatctttccatcatttgaaggagatttcttgtccggtattaattatgcattgccgatatgatcgtgttgttccagccgagcatgcttttcatgcaaaaaaactgattcctttttcagaagtctatcaggcagacagctggggtcatctcatttggctgggaacagagggtaaatctgtctcacagaaggtcatcagctttttaaaaac

SEQ ID NO: 2478 - DNA, 395 bp, Bacillus licheniformis
atggtcaatataatctgggtcggcttaacggtgatcggtatggtgtttgcgcttttcaacggcacggttcaggaagttaatgaagctgtatttaaaggatcgaaggaagccgtcacgattgtgatcggactgatgagcgtccttgttttttggctgggggtgatgaaaatcgctgaacagtccgggcttctcgaaaaattcagcaggctgtgccggccgttcatttcgaagctgtttcccgagatccctccggatcatccggcgatgggatatattttatccaatttaatggccaactttttcggattgggcaatgcagcgacaccgctcggtattaaagcgatggaacagatgaaggcgctcaaccggaaccgcagggaagcgagccgctcaat

SEQ ID NO: 2479 - DNA, 510 bp, Bacillus licheniformis
gcaagtatgaattgatgcccgatgcaaatttgctcggggtcaggggaaatgtgctggaaaacggaatgccccgttttttcaggcggctgagagaaggggtgtttgacgaaaaagatttgatcgaacggacggatgaattaaaaacgtttctagatgaagcagccaaggaacttcactttgacagaagccgggtggtcgcaatcggctattcaaacggcgccaatatcgcgggaagtctgctgttccgtcatgaacatgtactgaaaggggcgattttgcatcatccgatggttccgtttagaaatcgcaagctccctgatatgacaggtctgcccgtgtttatcggggccggcaaaacagatccgctctgtccgccgcaggaatcaagcgagcttgccggctatttcacaaacgccggcgccaaagtgctccttcactgggaaggcggaggccatcagctgacacacggcgaaattgaaaaggcgaaaatctggtatgaaaagcatataa

SEQ ID NO: 2480 - DNA, 773 bp, Bacillus licheniformis
atgggatattttatcgaggcagaaccaagcgttaatctgtacgttgaagacatcaatcctcaaagcggcaaagccattgtatttttgcacggctggccattaagccatctccagtttgaatatcaatttgacgatctttcgcgaaagggataccgctgtatcggcattgactggcgtggattcgggcgttcggataagccggcgacgggctataattacaaccgtttggctgatgatatccgcgctgtcgttgaggcgcttcaattaaacaacttcacgcttgccggtcattcaaccggcggcgccatagcactccgctatatgtcccgatataggggcgctggggtctcaaagctggttttgatcgatgcggcggcgcctgtgggatttactgaagaaacggcagccaaattgcttcagcaagcgtctaacgatcgtcccaagatgatgcgcgaagtgaccgacacgtttttctttcaatatattacacaaccgttctcagactgtttttttcaattgggattgcaggcggcaggctggtcgacaaaagcggtcatcgaaatgctgagagatgagaaactgtatgatgatccggaaaaagtcgctgctccagccttaatcattcacggtattcaagacaaggtgattccgtttgcacaagcaaaggagctcagccgcaaaatcagaaattcatatcttgttccgtttcaatacagcggacacggtccattctgggaggaacgcaaaatgttcaatcggattttaacgcaatt

SEQ ID NO: 2481 - DNA, 598 bp, Bacillus licheniformis
atgctgaaaaaaccgctgcagcttttaatgtgggtctcgatctttatgcttttgctattaaccgtctatatctttttgcagctgagaatgatttgggagcctgtctgcgtgctgctcaagtcgattctgatcccgctggcgatcgcggtttttatcacctatctgcttttgcctgtcgtggaaaagatacaccgggcaggcgtgccgagaacattgagtattttgctgatttattttctgttttttgcaggtctcggctacgctttttacaaaggggtgccgatcctcattaaacagctgacagagctttcagagggaattccggttcttgccgcatcatacgaaaacatgctggatcagctgcatcatcatacagacggctggcctgacggcatgcacgacagagtcgacaggttcgtcaatcagacggaagaattcgttgcaagctgggtagaacggacgatacgaagcatccgattcgtttttgattatatgctcttggcggcgatcatttcgtttttagtattctacatggtggaaagatattgataccatgaaaaaagcgggatgggaattggacgcccttcttcatggaaaa

SEQ ID NO: 2482 - DNA, 942 bp, Bacillus licheniformis
atgagggtcttgaaaaatgaactttacaggctgatggtgacgaaaagtacctggattgtgttaagcttgctgcttgtcatgacaatcgctgttgcatggatggtcagcaatggcgaaaaggagaaggagacaggtaactggaaagagcaattaaccgttcaaaacgctcagtatgaaagagaaatgagagagctgagcccagcggttcccaaataccaatttttaaaagaagagatcgcggtcaatcaataccggcttgagcataatttgccgccttctgcgaaatacaatgtttggacgatgctgaaggagttaaaaccgatcacaacattaatcgcgttgattgcaatcgtgctggcagcgaactccatcgcgcttgagcacagcaaaggaactattaaatttgcgattgcaacaccggtcaagcgttggcattatctattggggaaatacttgtcgatcttgctcaacactgtatttatgtttgctgcgacacttttatttgcgtttgttttagggtatgccctgctaggtttggagggaagccaatactatttgtcctatcgaagcggcgaagtgataaagatgtcaatgctgaagtttttagccttagactatggagccgctttattgaatattattgtgctggccacgctggcctttatgatttcggtcatcctaagaagcgcggtcgtctctgtcggtctttcgctgttcgtcttttttacagggtctgcgattactcaatttttagcggcaaaatttgattggaccaagtatacgatctttgcaaattcagatctcagtcaatacattgatggggagccgtttattcaagatatgactctttcattttcagcggctgtgattgctgtttattttattctttttctggctgtctccttttgggtttttcaaaagcgggatattgtcacgtcataa

SEQ ID NO: 2483 - DNA, 735 bp, Bacillus licheniformis
ggggttgaccatggcaagacatgctcgttattccattgtcattgtaggagccgggactgctggcatctctgtcgccgcccgtctcgtaaggatttctaaaaaactcaaaggacaaattgccatcattgacccgcaaacaaagcactactaccagcctttgtggacattagttggaggcggcgcagcgaagaaggaagagtccgagcgagatctggcttctttaattcccgctggtgtcgacttgatcggcgatgctgtaacggagtttcggccgaatcagaacacacttcttacaaaacaaggaacgatcgtttcctatgattatcttgttgcagcagccggtttgcaaatcgattgggacggggtcaaaggcttgaaagatgcggtcggaaaaaacggggtttgcagcaactattcatatcatacggtagacagcacttgggaaaacatccgcaattttaaaggcggaaccgccattttcactcatcctgattctcccgtaaaatgcgggggagctccacagaaaattatgtacttagcagacgactatttccgcaagtcaaatgtccgccatcagtcggagattatttttgcatcggcgaaatcgatcatttttgatgtcaccaaatacgcaaatgcgctcgaaaaagtcgtcctgcgcaaggatatccaaacgatgtacaagagaaacttaatcgaaattcggcctgattcaaaagaagccttgttcgaaca

SEQ ID NO: 2484 - DNA, 825 bp, Bacillus licheniformis
tgaaggagaaagaagaccttttcaaaaaaatggtcaggcgtccaaaaatcatttttttcgtcaaaccggatttggaccggtttttgaattctgtcgttgagcacctttccggaacttaccggacaaaaaaaatcgtggttcatgacctgaatcaaatcgacgctggcatgcaatgggcggatatttgctggtttgaatggtgcgatgatttattgatccacgggagcaaagtcccttctgcagcggctaaaacattaatatgcagactccacagctatgaagcatttactttttatattaaaaaggtatattggcaagcggtggaccaagtgatttttgacggagagcatttgcgggaatacgtattggatcaagtcaaggcgttgaaaaaagagaaaacggccgtcgttccaaatggaatcaagctagatcaatacacttttaaacaaaggcaaaaaggctttcacatcgcttatgtcggctatatcaactataaaaaagggccgatgcttttgctgcaggctttcaaagcactgattgacaaagacccaagatacaaactgtttatcgccgggacgtttcaggacgcccgctatcagttgtacttcaagcaaatgattgatgaactgcggctgactgacagcgtccaatttgacggatggcaggatgatatgaatcaatacttggaagataagcattacctgatttgcacgagccttcttgaaagtcagcatatgtcggccatggaagcgatggctaaaggcataaaaccgctgattcacaatttttacggcgcaaagacgatatacgatgaatcagttgttg

SEQ ID NO: 2485 - DNA, 502 bp, Bacillus licheniformis
ttgaatttttacattacatacggaactgtcgattttttaaaaaagctcgccaaacagcacggtcttgaaaacatgttatttatgaaaagccacgattccgccattctctttcacgaaaccgacggagaaagcgtctttcattctcctcaccgctacgaaatcatcgatcagtcgggatctttggaacattccggattcaccgtcctcaacaacatccctgtcacaccggaaggaaggccgcttttcgaagcccgttttaaaaacagagccggaaaaatcgaaaatcagcccggctttaaagccctcagggtgctgaggccgaaagacagcgatacgtatatcgtattgacactgtgggacagagaacagtcatttcaagactggaaaaactccaagtcgttcagcgaagcccaccaaaagaaggaatcttccgcaggaatcaaccaaggcggaacgattttttcccgcccatcctatatttcttcgtatcattctgtcgaat

SEQ ID NO: 2486 - DNA, 689 bp, Bacillus licheniformis
ttgaaaaagaggtttgctctgttgacaacgttcaccatgcttttgtcattggcgccggcagcagcttttgcggctgaaaacggaaatgcggacaacagcaaaaaagatgtcaatgttgcagttgtgcttgacgcaagcggcagcatggcacaaaaggttgaaggagaaagaaaatttgatattgccaaagaatccgtaaccgattttgccgacctgctttcaagcgatgcgaatgtcatgctgaatgttttcggacataaaggcaacaataaaaactcaggaaaagaagtatcctgcggtacgactgaaaccgtctatgatctgcagccgttttctttcaattcattcgaaaacgctttaagcggaatcaagcctacaggctggtctccgattgcaaaatctctttatgatgtaaaagatgatcttgccgataaagatgggaagaattatgtctacatcgtgacagacggtgaagaaacatgcggaggggatcctgttcaggcagcaaaagatctgcgcaaatccaacattaaaacgatcgtcaacattgttgggctggatgtaaaaaccgtgaaagaaaaagcaaagcttaaaaaagtagctgacgccggcggcggaaaattgattgaagccgactcagcttctgattttaaaaaggtatggaaagaagaaggcgtaaaactgtctca

SEQ ID NO: 2487 - DNA, 1146 bp, Bacillus licheniformis
atgaaagaaatgctatggcttgtcaaaaacacactgaatgtcacttttaaaaagaagatcaatatctttctgtttgtatgtctgcccttgctaggcatattcgtatcgcttttgacagagggaagcatggaaaagacggatttgcgcgtcggaatcatcaatcatgacggcggacgaatcgccgaagatactaaggattttttgaaggggatcgagaatgtcaacatcagtgcggtcagtgaagcagaagggaaaagtcaagttgcggcaggggagcttgattgcgtcattacgtttgaacaaggcttttctcaaagcgtgcagagcggcgaaccggctcacatcgcaatcgcatctgtcaaaggcgctgaaatcaccggattcgtgaaatcgtatgtctatcattatattgataatatcgccgcaatcggcaaatcggcgcaggggaatgaaaagcgctttgaggaaatgtataaaaattaccggaattctgaaacgagtgtcaaaacatctacgattgaagacacggcgaaaaatagaaacatgacggagcggacggtcggttttcttctgatggcgatgcttttttcagcgggaagcttgaccgaactgttagtaaaggaaaaagagaacagaacgtatttcaggcttttgaccacaccgataacggcaaggcagtacgtcatgtccaatgtggccgtcagtatgtctgtcatcacatgccaaacctttttaacattgattatggtgaaatatgttttccggatggaaaccggcatctcattttgggagatggcagcggtgctgctgatctttgcgctgagcgcggtcggcctggcattgatcacagtcgtctttgcaaacagctccaggtcatccggggtattgcgaaatttgatttttatgccgacgatcatgctgtcgggatgtttttggccggttgaaatcatgccgtctttcgcacagcgaatcgcggactttcttccgcagcggtgggtgttggatacgctggcaaaattgcaggagggacagcagcttcaaggtctgtatttgaatatcatgattctgtttgctttcgctgctgtctttttcctcatcgtcatttacaaattcaaacgcaataatgatgtgagaaacttcgcttaa

SEQ ID NO: 2488 - DNA, 603 bp, Bacillus licheniformis
ggcagccaagtgatgtgccgcgggaacatcggcatttgaagcgcctcatatcgcatggactgcgttgatcgtgctgggcggattcggggtatgcaaagctatgaaagcactgcggtttcctgcgccatggctgctcggaagcatgaccggcgcgaccgttctgcaaatcgcgggcgcctcaatgaccggactcagcacaaccgcctggtggccccacggcttttcagtgctgtcgcaaatttgtctcggcgcaacgatcggttcaaagatcagcaaagatatgtttatcggcgtcagaaaaacgctgatcgtcgcacttgccagctccgtcggactgatcattgcaatgattttaagcgccgccgtcaccgccaaagcggcaggcatttcgctgacaacggccatattggcgtttgctccgggaggaatcgcagaaatggcgacaacgtctgtcacgcttcacgccgactctacgttcgtcgtcgctgtccaagtgttgagggtggtgctcgtgatcgcaatgcttcctccattcttccgattgcttcatcaaaaatcggaaaaatatacacaccctcgcgtgaaaaaagccagagttgaagg

SEQ ID NO: 2489 - DNA, 1134 bp, Bacillus licheniformis
atgaatcaggtggcaagcacttttatctcctattcgaacgcagccgcaagctttctgcttgtcattttcacgcctttattcggagtgctgatcgaccgaacgggcagaaagaaaaaatacatcggcctgtttacgatgatttgtgtttcatgcaccattttaatgggggtttttgccggggcttcgtttcagaaggacatatacgggcttccgctatccttgatccttgtcgtcatcatgtttgtgaccgcaaagtttttctatcattcaagcttggtgttctatgatacgattttggctgacttggggacaaaagaagaaatcccgctcttatcaggtttcggaattgcaatcgggtatatcggcactttagccgggttaacggtataccttcttgtcggcaaccaggattttcaccgcgcattcatcccgtcggctctcttgtttctgtttttttcacttccgtatctgctcttcacgaaagagaaaagaaaaccggaaccgaaagaaaagaaatcgtttttcagcggatactgggaaattgtgcagacattcaaagacattcgtctatataagccggtcttcttattcatgatcgcctactttttcctgaatgatgcgcttgctacagcaatagccatgatggcggtttattcaaaaacggtcatcggttttacgaccggacaattcgttttgctttaccttgtttctactgtatcaagcatcatcggttcatttctgctcggctttgtgacgaaaagaatcggcgccaagcacgcggtcagccttgtcgccgccattatgatcaccgctttgacgattggagcatgcacgacgtcaacgctcttgttttggattgcggggagcttgttcggcatttcgcttggaggcacatgggtcgcatcaaggacactgattatcgagctgacgccagaacataaaagaggcgaatttttcggattgtttgctttgtcggggaaaatctcttccattttcggtccggtcctctacggatcgattactttgctgttcagggatctcgggaacatggccagccgaatggctttcggatctttagtgttattggcggcgatcggcctgatcattcatcaaaatgttaaggcaaaagcttga

SEQ ID NO: 2490 - DNA, 420 bp, Bacillus licheniformis
  misc_feature (1)...(420): n = A,T,C or G
tgcgagtggaagacctgacggtaagctatcaggaccagcccccgcttctccgttcactggattttcgcattacccgcggggaaagcgttgcactagtcgggccgaacggaatcggcaagtcgacccttttgaaagcattgatccaaaagctgcagccggtgtcgggaacaatcgcgacgggctctcacgtctcaatcggatactacgaccaggaacaggctgaatngacgtcttctaaacgcttttttgacgagctcngggacgattatccggagatgaatgaaaaggatatcaggacctgcctcggcaacttcttgttctcgggagaagatgtattaaagcctgtacatgcattaagcggtggcgaaaaagccaggcttgccctcgccaagctgatgttgcaaaaagcgaacttcctta

SEQ ID NO: 2491 - DNA, 363 bp, Bacillus licheniformis
tttccgaagcagctgaacagctggggatcggggaaatcaccctgaaagacatttgcgcccagctgacgaggcctgagcgcgatccgagggatgaagtccctaaaccgctcttaaaaaccgatgtgcttcaattggaggacttaaaagaggggatggaacttcaggggacagtgcggaacgtcgttgacttcggggcgtttgtcgacatcggcgtgaaacaggacgggctcgtccacatttccaagctcagccattccttcgtcaagcatccgctcgacgttgtgtcggtcggggacatcgtcaccgtatgggtggaagatgtcgacgctgcaaaaggaagggtctccttatcgatggtaaaag

SEQ ID NO: 2492 - DNA, 459 bp, Bacillus licheniformis
atgaacacgcaaatggtcatacgcgatatgaatccaaaggatttggaccaggtttttgaaattgaaaaaagctctttttcttctccgtggaaaaaagaatcttttcatcatgagctttttcacaatatgtatgctcattatctcgttctcgaagttgaggagcaagtcgtcggctactgcgggatttggatcgtaatggatgacgcccagatcaccaatattgccgtttcacctgcataccggggccgccgcttcggtgaagctcttttgaaggcggccatgaagctttgccggatgaaaagggcggttcagctttctttagaggtgagggtatcgaatcatattgcacagagcttatacaaaaagctcggctttgagccgggaggaattcgcaaaaattattataccgataatggggaagatgcattattaatgtgggtgagactaaatgaatcataa

SEQ ID NO: 2493 - DNA, 337 bp, Bacillus licheniformis
atgggacaatcgtttaacgcaccttatgaagcgattggagaagagcttctatcgcaacttgttgatactttttatgaacgtgtaaagcggcatccgctgctctacccgatttttccggacgacttaacggaaacggcaagaaagcagaagcaatttttaacgcaatatttaggcggtccgccgctttatacagaagaacacggacacccgatactgagggcgcggcacctgccgtttccgatcacaccggaacgggcggacgcatggctttcgtgtatgaaagaggcaatggatcatgtcggtttaaagggcgaaatcagggaatttacttttggta

SEQ ID NO: 2494 - DNA, 383 bp, Bacillus licheniformis
gtgaaaacggtatgcgtatattcaggatcaaatatgggggcggacccggagtacaagaagaaagctgcagagcttggcgtttatattgccgagaaggggcttcgccttgtttacggaggatcgagaatgggattgatgggcgtgattgcggataccgtattggaaaacggcggggaagtcgtcggcgttatgccgaaaggcctttttacaggggaaatcgttcatcagcagttgacggagctgatcgaagtgagcggcatgcatgagcgcaaagcgaaaatgagtgaattagctgacggctttatcgcgatgcccggaggcttcggcacgtttgaagagctgtttgaagtgctctgctgggcgcagatcggcatccatcaaaa

SEQ ID NO: 2495 - DNA, 607 bp, Bacillus licheniformis
atgaattcattttttatgttatttcaaaaagaatggacggaaagatggagagacggaaagctgctttggctgcctgtcattttgatccttctgggcttgattcagccgctcagcctgtattatatgcctcaaattatcgatatggccgggaatttgcctgagggatccgtgatcgacataccaaggccgagaggtgaagaggtaatggcgagcaccttgtcccagttcggcacggttggtacggcaattttcgttttcagtgtgatgggcagcattgtccacgaacgaaaccaaggatccctttcattggtgatggcgagacctgtcagcccgcttcagtatatcggcagcaagtggcttcagcaggtgctgctcgtattggtttcgtttgctgcaagctacggtttggctttctactatacaaatctgctattcggcaaggttgaatttgaccggtttttatttagtttatccgtgtacagtatatggattatatttgtcatgtcggtcacgatgtttttcagtgctctgtttcgccatatcggggggattgccggcatgagcatctgtttcatcgccttcgtttcattggcgggatccttatttc

SEQ ID NO: 2496 - DNA, 744 bp, Bacillus licheniformis
tcttttttactacggtcaccgcagccgatcatccgctcaacgaattcaaccggctccgtgctgagctggaaagactgcagcatcaatccgaacagcagctgcaggcatatacggagcaaaaaatcagcagcttgattcatgaacatatcaaaatgctgatcagtgacgaagatacggctctgtctgaagaaaccgcttccttaagagaaaccgtcgagactttaaaatcacagcttgccgatttgacagaacaggaaaaacgggcggaggaacaaatcaaaaaagacatccaaacgattgcccaaaacgcaaatataacgccgtttgagatgagagagctggccaaatcgtatttggaatcaatcgaaaagggctttaaaaaaggaattcttttcagtaaggccaaaacgcttgaagaaaaacaaaaacgaaaagaagcttttcttgccgacgtccaaaaaagggttcaagccgaaatcgattggcatgtcattgaagcaatcaaggcattcatgaaatgctttaacgtccagaatgatgaaatgcttcgggaagttcttcaatttcggaccgtgatagatgaaaacgacctgcttcgttcccggaaaaaaggggctgagcttacaccggaatacgtgctgaactacacgaaagaactggctgaaaacatcagaagaaaggcgaagagacaagcgcagccgctcatcgaccagctcaaaacctttataaagaaagaagcgtcct

SEQ ID NO: 2497 - DNA, 699 bp, Bacillus licheniformis
cttttgacctgactatgaaggccattcgctacattcatgaatgtcagctgcctctgcagattaataccgtcatatcctcctataacatcgattacctggatgaaatggcaaagctgatcaaagaattgaactgcgtactatggagtgtgttttttctcgtcccgacaggccgcgcgaagcgggaagatatgatttccccggtggaccatgaaaaagtctttctctggctcagccgtttggcaaaagaagcgccttttgacatcaaaacgacagcagcccagcactaccggcgggtcgtcattcagcaaaaaatgcgggaagcgaaagacccccacatgaaaatccgctatgaacacgcattgcagaaaggaaaaatggatgccatcggcggattgggccgggctccgaaaggtgtgaacgatggcaacgggttcatgtttatctcccatatcggtgatgtatatccaagcggactcctgccggttaaagccggaaacatccgcgaacagccgctggctgagatttaccgcgaatcaccgatctttaaggatcttcgaaatccggacggatttaaagggaaatgcggcgtctgtgaattccgtcatgtgtgcggcggttcgcgctcgcgtgcttatgctctgacaggcgattacctagaaagcgatccgagctgcatttatattccgaaggctttgcgct

SEQ ID NO: 2498 - DNA, 564 bp, Bacillus licheniformis
agccatcgcgcgcgaaaaccgggtgttgaaggctgaattttcactcgggcgcctgaaaaaggaattgaatgtcttttttatttcagatattcataggcggacagtcagcgaagacattatttgtgaagtgaaagaacgcggggttcagctcgtcatcatcggcggcgacttagcagagggcggcgtcccttatacgagaattgaagaaaatatcaaaaggctttcaagtttgggaaaaacgtattttgtatggggaaataacgattatgaagttgatcaggaaaggctgctggaaatattcaagacatacggtgtaacgcctttgcgcaatgcttcggtattgcatgaccatcaaggacaaactgtcaatatttgcggagtggatgacatcagactcgaattggatgattacccggcagctctcggcggcgtgcagccgggttttccgactgtccttgtgtcacataatccggagattcatcatcaaatacaggaggcggacggtattgacctgatattgagcggtcatacccacggaggacagattcgcttcggcagattcgg

SEQ ID NO: 2499 - DNA, 1056 bp, Bacillus licheniformis
atgaatgtggcaaaagaaatctgcgacaaagttgcggtaattgaaaaaggaagaatcattgaatccggcagtgtgtttgacgtattttccgcgccggaaaccgaaacggccaaaagctttgtcaaatcagccatcgaccacgagatacctgaatcgattcaaaaattaaatctgaagcacctctaccagcttcaatttgtcggcgaatcttctgggaagccttttctttctcaagtgtcaaagcggtatgacgtagaagtcaacattctgcacggaacgattacagagcttcagggaattccgtttggcagcatgacggtcgagctgcagggggaagatggtgaaatcgggcgggcgcctcgaatatatacgcagggaaaacattcgcatcagggaggtataagcatgctagttacatatgaccaaatcattgacgcactggttcagacgattcaaatgacggttttttcgcttttattttcaagcgtgatcggcattccgctcggcattttgctggtagtcacaagaaaggggcatctgcttgagaatccggcagtttttacgtttgtcaatatgatcattaacattttccggtccgtcccgtttatcattttaatggttgctttaattccagtgacaaggctgattgtagggacgtcgatcggcacatcggcagcgattgttcccttgactttttatgcggggccttacatcgctagactcgtcgagaactctctgcttgaagtggatccgggagtcattgaagccgctgaagcaatgggagcgactccgagacagatcatcttcaggtttctgattccagaagcgctcggttcgcttgtgctgagttttacggtggcaacggtcggattggtcggggcgtcggcgatggctggtgcgattggtgcaggcggtcttggggatttggcgatcacatacggctatcaaagatttgacacgctgacgatgatcatcacggttgcaattctcgtcatcgtagtgcaaggattgcagacatccggaaacgttctgtcaaaaaaattgagaagaagatag

SEQ ID NO: 2500 - DNA, 617 bp, Bacillus licheniformis
ttgaagattgcgctttttggaggtacaggccgtgtcggacaggcctttctcaattttgttgaagaggatgggcaccattccgttaacgcacttgtccggaggacggaaggcgcccgcattccggatttatgccaagcacatataggaaacgccaggaaccggcatgacgtcgagtctttaataaaagattgcgatatcgttgtcagctgtttaaacacagatggagacgatacattgaccgtctccatcgaacacatcataaacgccatgaacgtacatcggatcaaacggctgattaccatcggaaccgccggcattttaaacgcaaggcagaacccggccctttaccgctttgaaacaaacgaatcaaaacggcgctctacgcgcgcagctcaagaacatgcccgtgtgtacgaacggctccgcgaatctgatctggattggacgatcgtctgcccgacgtatctccccgatgggccggcattgaagacataccgttttgaacaggatgttctgccgcccggcggaagagaaattccaccggcgacaccgcccattttctttttactcagctagagtttttccagtttgtcaaggcatagggtggggctcgctta

SEQ ID NO: 2501 - DNA, 526 bp, Bacillus licheniformis
  misc_feature (1)...(526): n = A,T,C or G
atgttagatatcatcattatcattttgcttttgtccggtttgtttattggactcaaaagaaggtttatccgccagtttatccgtttggttacgtttatcgcagcgatcgctgtggccgcaacctattacggcgaccttgcgcctaagctcggctggattccgtctcccgactttacgggcggccangctgcgctggcgtttgtaaacggaagccttgaaggcgcttattacaatatgattgcgtttttgattctctttatcctgacgattatccttttgagagttgccgcatcgtttttggatgccgtcgcaagcataccggttctcaaacagatcaaccaaatactcggagccgtgctcggttttgcggaaatctatctgtccgtgtttgtcgtcctgtccatcggaacgcttctgccgattgatgtcctgcaaaacatgatggccggttcattcatggctgatttgatcatccataaaacaccgtttttatcaaacatgttaaacaatctgctgcatcagtacg

SEQ ID NO: 2502 - DNA, 1053 bp, Bacillus licheniformis
atgctggcatttccgattgtactgattatgattttaggcactgcgctgacgaatgctttcgatcaacaagcagcggtcggcgaggttcgtgttttgtataaagacaattctgacggagcgttttcgcaaggctttaaaacattcgtaaaggaagcgaaaacatccggcgttcattttaaaaaagtgttgtccgatatggatgaaaaacaagaaatcaaacaggggaactacgatgcttatcttgagatcgaaaacagcggcatcaagctttaccaaatggataaaaacagtatgaaaaacagcattattcaaggaatgctgaccgcgtttgcaaaccggtacaatgccgcagcggagatcatcaaagctgctcctgagcaagcgggcgccgtgctcggggacgcaccgggcgacaattatatcaaggagacgtcgctcagctcagacagaaagcccagctccatggattattatgcggttgccatgaccactctgatcgcgctttacagtgcattaagcgccagctatttaataaggggggagcggcttagaaaaacagccgaccggctgatcgcggcaccggttcataaaggcgagatctttgcgggtaagctgatcggcaatcttgtgacaaacggattgtgtatttttgccgtcgtcgcagtcagcaaatacgtatttaaagcgtactggggagagcatcttgggcttgtagcggccgtgctgttcagcatcgtattgtttgccgtatgcctcggcctcggcgtcagttatttgacgagaacgggggaagcggcagtggcgatcattaacgtgttgattccgctagttgcatttttcgggggcgcttattttcctgtcgacgatgcggaaggtgttttagctttgatcacagacctgtctccgctcgcctggacgaacgaagctattatgaacatcatatttgcggacgatttagcggcagggctgcctgccatcttgctgaacatcggcttatccctgttatttctgctgattgccgttgtctcattgcagagaagggaggggctgtag

SEQ ID NO: 2503 - DNA, 406 bp, Bacillus licheniformis
ttgacgacaatcagcaatgcgatgtctagacaagtggcgacaatttcttccaatcaaacggttcaagaagcggctgagttgatgagccgccataatgtaggtgcgattccggtcgtagatcaaggcgtattaaaaggcatgatcacagaccgtgatatcacgctcagaacgacagcggaaggccaggacggacagacacctgtttcaaacgtcatgacaacaaatgttgtttcaggaaatccgaacatgagccttgaagaagcatcacagctgatggctcaaagccaaatccgccgtctcccgatcgtcgaaaacaaccatttagtcggcattttggcgctcggggatctggcggtaaacgaattgtccaatgaatctgccggacaggcgcttgcgaacatttcca

SEQ ID NO: 2504 - DNA, 1044 bp, Bacillus licheniformis
atggggcttttttggtcaatgcaggctgttgaatcttcctgctcgttttacaaaaaatcggttcatccgtccgcttaccgtattgaagtgaagcaaaaagaacgcatcatcttgagtaaagaaataaaacgagtgctgctttctgaaacagttgatagactggaagtaaacgaagatgggttgtgcggcactttttttcgcccgcttgccgttaaccgccctcccgcaatcattatattagggggatctgacggcggccttgacgaaacaatggcaggcatgttagcaaattacggatacgcaacacttgcaatcccttattttcaatacaaacagctgcctaaaaaactggttgaaattccgcttgaatactttcaaaaagcgatcgattggctcggtcgccaggaaggacttcatcatcgtcagatcggaatatgcggacggtcaaaaggcggcgaactggcgctgttaataggttctcattttcctgaaatccgctttgtcgtttctcatgtaggcggcggagtcgtctttcaaggggttggattaaaaaaattccggcagacatcttcctggagcctgaacggcgcaccgctcgcctttgcaccgctgccgatgttttcgcttcctcagctgtggaatatgatgaaacataagctcacaagacagcctcatgcttttcttgatctttaccaaaaggctttacgaaaagtgaaagatgatcatcctgcaatcattaaagcggaacttattaaaggtcctatactgttaacttcaagcactgacgatttagtatggccctctgcctcaatgaacgagaaaatcgaagaacggctgaaaaagaacagattctcttattctgttaaacatctgtattttgaaaaagccggtcataatatcaggcctccatactttccgacatccggaagaaaaagcagaaaaatagcctatggcggaaaaactgaatacgatgccattgcagctcaaacattttggcaggaactgcttttgtttttagaaaaagcaactgcacccggcaattaa

SEQ ID NO: 2505 - DNA, 601 bp, Bacillus licheniformis
ctgtccattgatccgcttacaaaaacggaaagagagaactacaagtttttaatcgggagtatcataccaagacccgtggcgtttgttacaagcctgtcagaggagggcgtcttaaacggagctccatttagttattttaatattgtatcttcaaatcctcccatgatctccctgtccatacaacgttctgaagggagccaaaaagatacagcgagaaacattctgaagagcaaagaatttgtggtccatatcgttgatgaacaaaatgttgaaaaagtgaatgcaacggccgcgagcctacctccaagtcaaagtgaaattcagttagcggagttaaccccggttgaaagtgtgaaagtctcggtaccgggggttaaagaagcgaaagtgcgcatggaatgtgttctggagtattcattagagttgggagataaacactctcccggctgcgatttcatgataggtcaagtcgttcaatatcatatcgagagcggcatttatgaaaatggaaaaattgatccgagaggcctcggagccatcagccgattggccgggcatgattacgcaaagattggtgaaatctttaccagggaaagaccga

SEQ ID NO: 2506 - DNA, 321 bp, Bacillus licheniformis
ggctggttacggtagaagacatattagaggaaatcgtcggagaaatcagggatgagtttgatcaggacgaaatgccgcacattataaaaaaaggcgaacatcattatattatggacggaaaagctttaatcgacgaagtgaatgacctccttcatatcgcgatagaaaacgaagaagtcgatacgatcgccggctggcttttgacgcaaaagatggagctgaaaaacggggacatccttaaaactgaggggtgcgaatttaaaattcttgatgctgaagatcatcatatccgtttcatcgaagtgaaaaaaacggattttt

SEQ ID NO: 2507 - DNA, 1020 bp, Bacillus licheniformis
atggtctctgggattgggatcagtattttcgccgtcagtctgattgtcagctatttgtttgttttgccgaaccggagcacatatgaagaaacttttttcagcggactcaaacacggcgagatcatcgatgacgtgtttgagtcccacgacaaagaagagctgtttttgacagcaggggatggatgccggctgcatgcgctgctatttcccgttcaaaagagcaggaaagccgtcatcatctcccacggcatcaagtggtcgctgtttggcgggtataaatacgtcgagctgtttcagtccatcggctacaatgtcctgctttgcgacagcaggtgccacgggttgagcggcggttcacacgtttcctacgggttttacgaaaaggatgatttggcgaggtgggctgacgagcttgagaacaggttcggcaaagatctttggatcggggtgcttggcgaatcgctcggagcggcggctgccatcgagctgatgaaacaggatcggagaatcaagttttgtattgccgattcctgcttcagcgatttaacagagctatgccgctttcagctgaaagccgccgtcaaattgtccgtgccgtttctcatcccgttggcaagcgggctgatcaagcggcgccacggctggagccttgctgatatatcgccggtcagcaaccttgagcagtcagacacgccgctgttgatcatccacggcacaaaggatcagcttgttccgccggaaatggccaaaagcctgtatgagaggaaaaagggattcaagaaactgtactggattgaaggcgccggacatgtcggcggatttcgccacaatcctgaggcatacttaaataaaatcaaagtactttatcttgaaaatcgagccggccaattagccttgcgattcccgtttttcagcggctgccgatctttggcgcgcttccttgattttgccggcgtaggacgttccccaattcatcatttgccggatgatcgggatcagcgtcttgccgaactcggttaa

SEQ ID NO: 2508 - DNA, 582 bp, Bacillus licheniformis
agaaaagctggcagaaagaatgattatggagattgttgaaggaattagaggaacagatgccaatgccgaggtcatcggtgaaattggaacaagttacaataaatggacggaaaccgaacaaaaagtttttgaagcggttgttgtggcacataagcaaacaaaaaaaccaatatcaacccatacttccataggaacattaggacatgaacaagtagaattttttaaaaaacatgaagttgatttaaaccgagtggtgatagggcatgttgatttatctggggatgccgattatatattgaaaatgctgagagaaggtgtatatgtagaattcgatacaataggtaaagaaaattatatgcctgatcgtgttcgggccgaaatattgaaaaaaatacaggataaagggtatatagacaaggttctgttgtccatggatatcacaagaaaatcacatcttgtatataaaggcggggtgggctattcatatttgatagacacgtttatccctctcttgcaaacctatggaataactggtgaatcaattgataagatgttgattaaaaatcctcgcgcttttatgaa

SEQ ID NO: 2509 - DNA, 693 bp, Bacillus licheniformis
agcaatgattcatgaaactgcaaagatcggaaagaacgtggtattgggagagcatgccgttattgaagaaaatgtggtcatcggggacaacgtaacaatcggtcatcatgccattattaaaaaggacactcatatcggcagcggggtgaaaatcggcgatttggccgtccttggcaaagcggcttcttcaaataaaaaaatggctcgccagccgaagcaggcaggagcccctttgcggatagaagatgatgccatagttggagcaagcgctgtgatttaccgagacgtgctgttggaacaaggcgtcttcgtgggggatatggcgagcattcgcgaaaatgtcgcgatcggcagagaaagcattataggacgcaatgcgatggttgaaaacaataccagaattggaagtaaagcaacaattcaaacgggctgctatatcactgctgatatgacgattgaggatgaagtgtttatcggtccctgctgttccacgtcaaatgataaatatatgggaaagggaaactacccgtatcaaggtccaactattaaaagaggagcgaaaatcgggaataacgcaacattgctgccggcggttgtcgtcggggagggggcggtcattggagcgggtgccgtcattacaaaagatgttcccgcaggcaaaacggctgtgggcaatccaggccggttgatgaa

SEQ ID NO: 2510 - DNA, 561 bp, Bacillus licheniformis
atgtttttgatggcgaaaaagattttaatcgtaacgggcgatgcagttgaagcgctggaagtgtattacccttattaccgctgtcttgaagagggctatgaaacgacgattgccgcaccgaaaaagaaaaagattcatacggttgttcatgacttcctggattgggatacatacaccgaaaagccgggctatttaattgacgcgcatgcttcatttgatgagattgacccgtccgaatacgacggcatcatcattcctggcggacgcgcaccggaatttatccggatgtacgattccctgctgaaaatcgttgctcatttctttgaggaaaataaaccggtcggcgcgatttgtcatgcgagcctgattttcacaagcctgagagaacatctgaaaggccgggagctgacggcttacatcgcctgcaaaccggaagtcgaagccgcgggcgcgacttatgtcgaggagaagcttcatgtggacgccaacctggtctcaggtcatgactggtccaatctgccggagtttatgagagaattttttaaagcgttaaacaaataa

SEQ ID NO: 2511 - DNA, 535 bp, Bacillus licheniformis
atgattatatgcagtttgcaacatgtcggtcaaacttacggaggacatacgattttcaacgggctgtcatgggacctgcaccaaggggagcgcgtcggtctgatcggacgaaatggggaagggaaaacgacgttgttgaagctgatcagcggccaaatgaaacctgatgaaggtcttgtgacatggaaaaaaggattatcaacagggctcttggagcagaatcccgcatgggacggcagcaaaacggtaaaagagctgctgtatgatgttttttcatcattatggaacacacagcagaagctttcccggatcgaacgtcaattggcggttgaaaaggacgcggaaaaactcagattccttttggaaaagtacggggctttgcaggatgaatttcagcgaaaaggcggctacggcatcagcgcgcaaatcgaacgggtggcgcacggcttgaatatcgagcggctattcgatgccgagtggcgggagttaagcggaggcgaacggacgaaagcgggtcttgcaaggcttctcctgt

SEQ ID NO: 2512 - DNA, 377 bp, Bacillus licheniformis
gtgtctatacgaaatctggatggaaaagcttttgcagatatgattctgtacggcgcacaccatctgtctcaaaacgcaaatgtagttgatgcgttaaacgtatttccggttccggacggagatacgggaacgaacactaatctgtcgatgacatccggtgcgaaagaagtggagcaaatcgacaccgccaatatcggcaaagtggcacaaagcctgtcaagggggcttctgatgggggcgcggggaaactcgggcgtcattttatcccagctgttcagaggctttggcaaatcgattgaacagaaatcggaaattaacgcgaaagaatttgccgccgcgttccaggccggagtggacaccgcctacaaggccgtcat

SEQ ID NO: 2513 - DNA, 341 bp, Bacillus licheniformis
aaacccgacctcctcattttggacgaaccgacaaaccacttggatatcgacaccctgacatggctcgaacaatatttgcaaagctacagcggagcgattttaatcgtttcccatgacaggtactttcttgacaaagtggttacccaagtttacgagaataccaggtcccaaagcaaaaaatatatcgggaactacagctcttatgtccaattaaaagccgagcagctggaaagggaaacaaagctttacgaaaagcagcaggacgaaatcgccaagctgcaggatttcgtcgatcggaacttggcaagggcttcgacgacgaaacgggcgcagagcagacg

SEQ ID NO: 2514 - DNA, 303 bp, Bacillus licheniformis
tgatgatgatcgaaccgaaaatcgcgattcttgacgaaatcgattcaggtttggatatcgacgcccttaaagtcgtttcaaaaggaatcaacaaaatgcgcggcgagaactttggctgcctgatcatcacgcactatcagcgcctcttgaactacattacgcctgaccatgtgcacgtcatgatgcagggccgcgtcgtgaaatccggcggacctgaacttgcacagcgccttgaggctgaaggatatgactggattaagcatgagcttggaatcgaagacgaaactgtcggtcaagaagcgt

SEQ ID NO: 2515 - DNA, 627 bp, Bacillus licheniformis
cttcggccaatcagaaaaatccagcacctttgtgtatacctatcaaaacatggccagggtggtcatcgaactgatcgaaaggctgaagattaaagacgccgtgcttgtcggtcattcgatgggcggccagatttcactttatgcgataaaggaaaggcctgaactgttcaaaaaagtcgtcctgctgtgcagctcaggctatttaaagcgttcgccccgctcgcttattttcgggagccatattccttatttttatttgtacatcaagcgctggctgtcaaaacagggcgtcctgaaaaacctcatgaatgttgtctacgacagctccctgatcgatcaggaaatgatcaacggctacctgaaaccgtttctcgatgatcaaattttcagggcgctcgcacgtcttatcagacaccgggaaggcgatttatcaccggatgatttgaagaaaatcgagacgccttccctcttgatctggggcgaagaggaccgcgtcgtcccggtacagatcggaaaaaggcttcatcaggatctgcccaattccattttctactccctgcaagaaaccggacacctcgtccctgaagaaaatccggattatgtatcagacaagattgccaatttcat

SEQ ID NO: 2516 - DNA, 390 bp, Bacillus licheniformis
taatctgctgacgaaaatgcaaaaagagcgaattcacattgctatcttattggatgagtatggaggtacgtcgggtttagtaacagttgaagatatccttgaagaaatcgtgggagaaattagagatgaatttgatgttgatgaaattccggatattcgaaagttaaaggatggtcactttataataaactcaaagctgctaattgaagatgtcaacgatcttttggatatcaatttatctcatgaggaagtggacacaataggcggctggttcatgactcaaaacatggatgcagaagctggttctgaactagaagctgatggttatatttttaaagtgcaaaaaatagatgggcggcagattcattttcttgaagttaaaagagaaaa

SEQ ID NO: 2517 - DNA, 594 bp, Bacillus licheniformis
ggaacaaacagaacagatccgcttgatgtccgaatgggtaaaagagaagctttctgccgaaggcacaggtcatgactggctgcataccgaaagggtgaggaacgtaagccttcagatcgcaaaagaagagggtgcagacctgtttatgaccgaagcttgcgcacttctccatgatgtgattgatgaaaagctgtccgatgagcaccgggttccgctgcaggagctgaaaaggcgcctgtccgaagaatggaaggtcgatccggaaacggttgacgggatttttgctatcatcacaagaatttcattcagagacagagagaaatataaagacgaacttctttcaaaagaaggaatggctgtccaggatgccgatcggcttgatgcgatcggcgccgtcgggatcgccagggctttgatgtatgcgggtgcaaagggccatctcctctatgggggcggcaatgcacctactgcagtcggccacttttacgagaagcttctccttttaaaagatttgatgaatacaaagacgggacggatgctcgcagaaaaaaggcataagctgatgctcgaattcctcggcgaactggaaaatga

SEQ ID NO: 2518 - DNA, 417 bp, Bacillus licheniformis
cgatgaaagcaccttcatgtataaaagaaagcgcattggcggatgccggcggctgggtcgatgttgatccgtacactctgcagcacaaaaagtttgccaatgttttcggaattggtgactgtgccaacctgccgacgtccaaaacaggggcggcagttcgcaaacaggctccggttgtcgtgcgaaatctgatgtccttgataaaaggctcttcattagatgcaaagtacgatggatatacctcgtgccccttggttacagggtacaacaaactcgtgctggccgagtttgactatcacaaggtgccgcaagaaacgtttccatttgatcagtccaaggaacgattcagcatgtacctgttaaaaagaagactgcttcccatcatgtattggaatggcatgttaaaaggactgatgt

SEQ ID NO: 2519 - DNA, 307 bp, Bacillus licheniformis
gtggatgaagcattaaaagaaaacatcatgggcgcccttgaccaggtcgttgaccctgaattgggcgtcgatatcgtcaatctcggccttgtatacgacgtagatatggatgagaacggcaaaacagacgtgaccatgactttgacttcaatgggctgtccgttggcgccgatcatcgtagatgaagtcaaaaaagcgctcgcagatattccggaagtcagggaagttgacgttcatatcgtctggaatccgccttggacaagggacaaaatgtcgcgatatgcgaaaatcgcacttggtatacaat

SEQ ID NO: 2520 - DNA, 532 bp, Bacillus licheniformis
atggggatagcagcaatctgcggaagctcccgcgaaaacggaaatacggaagagttggtgaatcgattagtagacggacttgatgccgataagatctacctgcgaaactatcacattgagcccgtatcggactacaggcacggcaatacagcccctttgtatcctgatgatgactacagagacctgatcagccgggtgctggagaaggatatcctgatttttgccactccgatctattagtacggaatgtcgggtttgatgaaaaactttattgaccgctggtcacagacattgattgagcacgggagatctgcatttaaacagcaaatggcgaaaaaaacggtctacgtcgcggctgtcggagacgatgatccccgcttgaaagggctgccgcttattcaacagtttcaatatatctttgattttatgaacatgacattcgacggctatttgctcggcaaagggaacaagcccggcggcgtggtgacagaccggacagcgattgtgtctgcaaatgaactgagaaggaagc

SEQ ID NO: 2521 - DNA, 621 bp, Bacillus licheniformis
tcattaagaatgaaatcgaaactgaaccatcttctaatgtcattttaaatgtaacagcaggcgcaataccggtgacgtttgaaaaaggtgctgatcaaatcatttggatgaagcaaaatccgcccgtgtttaaccgaacctttgataaagaaatgatggcgggggtaattggaatcgacacatctgatatggattcgaatttcccgatacaggaggtttctacagggcttccagcggttatcgtaccgttaaactcgttaaatgcagttaaaaaatgcaaaatcaacaaggatcggtttgaagctttcatgaaagaaacagaagcaagtctgctcgtttttactaccgaaacatatcatgaacaaaaccacatcaatgcacgagtatattgcgactgtttcagcgttcctgaagatccggcaacaggaagcgcaatcgggggtctcgcagggtatttactgcatcacggctattttaatcaacactacctcagcataagggctgaacaaggatttgaaataaaccgcccttccctgcttcatcttgaagcccaaataacggaaaacagcacagaaattcacgtcgggggaaacgtccacctgatcgctaaaggaagttggc

SEQ ID NO: 2522 - DNA, 360 bp, Bacillus licheniformis
cgccgatgaccttacatatgggctgaactgcaaaaacaatggaagaggaaaacctgcaggcccgcatcgtctcattcagcgttgatcccgaaaatgatacgcctgaaaaattgaagaaatttgcggccaactacccgctcagttttcaaaattgggactttttaaccggatactcgcaggaagaaatcgaaaagtttgcgctgaaaagctttaaatcaatcgtgaaaaaacctgaagatgaggatcaggtgattcaccaatcgtcattttatctagtcgatcaaaacggcaaagtcgtcaaggattatgacggtgcaagaaatacgccgtacgatgaaatcatcgccgatattaagacgc

SEQ ID NO: 2523 - DNA, 915 bp, Bacillus licheniformis
  misc_feature (1)...(915): n = A,T,C or G
ngaaaaactcaagctgatcgacattgtatacgaactggtcgacgccagaattccgatgtcttcaagaaacccgatgatcgaagacattttaaagaacaagccgagaatcatgctgctcaacaaggcggataaagcggactcctccgtgacaaaggcttggaagcagcactttgaaaaagacggaattcctaccctcgccatcaactcggtcaacggacaggggctcaatcaaattcttcctgcatcaaaagagctgctgaaagaaaagtttgataaaatgaaagcaaaaggtgtaaagccgcgcgcgatcagagcattgatcgtcggtattccaaacgtcggcaaatcgaccttgatcaaccggcttgcgaaaaaaaacatcgccaaaacgggcgacagacccggagtaacgactgcacagcagtgggtgaaggtcggaaaagagctggagcttctcgatacaccggggattttatggccgaagtttgaggacgagcttgtcgggctgaggctcgcggcaacaggcgcaattaaagattcgattatcaacttgcaggatgtcgccgtctacggtttgcgctttttggaagagaattaccccgaacgcttaaaaaagcgctatgacctggaggagattcctgaagaaattgcagcgctttttgatgagatcggaaaaaaacgcggctgcctcatggccggaggcgagatcaattacgacaagacgacagaagtcatcatccgcgatatccgcaccgaaaagttcggcccgctttcttttgaaaagccggaggatatgtaaaaaggcgcgcttttaaaagagcgggcctttatttttgcagaagatgcgccgataagaacattaggggagaagagaaagtgaaaacattaaccgtcaaagaaattaaagaacatctt

SEQ ID NO: 2524 - DNA, 417 bp, Bacillus licheniformis
gataacttcgtttgtatacgaagcgcgccgtgcttttcatacagagcggttttataactggattcattcgctgccggaaaacgtcgtcagggcgaaaggaatagcctggtgtgcgacgcgcaacacccttgcccttttgatgtcgcaggcggtcctttccgtgtcgctggaaccgatctcttattgggtggccgcactgtccaacccggaacaggaacaaattctcagacagaaccctgagcttttaaaagaatggaatgaagaattcggagaccgccatacaaagctcgtctttatcggattggatctgtcgccgtctgaaattaccgcagaagcggatcgatgccttttaacagattcggagatggcggccgactggtcgcttttatctgacccgttcgattggcagattgaaag

SEQ ID NO: 2525 - DNA, 576 bp, Bacillus licheniformis
  misc_feature (1)...(576): n = A,T,C or G
aaaaaaatacagaaaatattagaatcatcgccttaggaggcgtcggagagatcggaaaaaacctctatgtcattgaaatcgattcagacatattcgtggttgacgccggcctcatgcatccagaaaatgaaatgctgggtatcgatgtggtcatccctgacatttcttatttaattgaacgatctgaccgcgtaaaggcgatttttctcacacacgggcatgaagaaaacatcggcggcgtattttactgcctgaacaagctttctgtgcctgtttacggaacgaagctgacgcttgcccttttaaggaaacgctgaagcagtacggtgtaaacaaaaagcccgatttaagagaaattcattcaaaatccgttattacattttgaatcgacaaaaggtgtcnattcttcaaaacaaatcacagcatcccggattttcgtcggtgtcagctttaaaacatccctcggatccatcgtgtgcacaggcgaatttaaatttgaccagacacttgtgttaaaccagacagcgacatcgcgaaatgccaaatcgcacaacggggggctggggctgctttcga

SEQ ID NO: 2526 - DNA, 603 bp, Bacillus licheniformis
atgtcagccccaatatcacggcgtcatttaatcaagaagcagatattccggacattgatgcgtcctcttacatccatcatttcgcctcggtcatcggcagtgtggtcatcgggcgcaacgttttcatcgggcctttctcttcgatcagaggagacgtgggattaaaaatcttcatcagccatgactgcaatatccaggacggagttgtcttgcacggattgaaaaactatgaatacaacagccctgttactgaacattccgtttttaaggaccgtgaatcgtattccatttacataggcgagaaagtgtcactcgccccgcaatgtcaaatttacggccccgttcgaattgacaaaaatgtttttgtcgggatgcaaagccttgtttttgatgcctatatccaggaggatacggtgatcgaaccgggagcaaaaataatcggtgttacaatccccccaaaacgatttgtctcggcgggtcgtgtgatttcaaaccaggaagatgccaaccggctgccagaaataaccgattcctatccatatcatgatctcaactccaaaatgacatccgtcaaccttgaattggcaaaaggctacaaaaagg

SEQ ID NO: 2527 - DNA, 495 bp, Bacillus licheniformis
gccctgtcgaatgaaagattctcgtttctaaatacgtgacgagcgtgctcgcaagcatttggctttttattatttactacggattttctatattgttcggcctgctctttttcggcgtgaagctcgacgaaaaagcggagccgctctttatcaatacggtgaaaatgatcgggacgcagtggtttgaagtatggatgatggtttcatttgcgtttttatgctcggcattattcaaaagcagcgcgctcagcatcatggtgtcgattgtcgtgctgtacggcgccaaaatgcttgtgacgattatggcgtatttggaaaagccgctcggcaagtttttattgttcgccaataccgatttaacgcagtacgccggagaggcaaagccgctttttgccgggatgacgcctttattctcgctcttcatcgtctttatccatctcgtgttttttctcggaacggcatggtggggcttttgcaaacgcgatatgaaggtat

SEQ ID NO: 2528 - DNA, 376 bp, Bacillus licheniformis
atgaattttttcaaacgagccttttggagcatgaaagcgaaaaaaggaaaaacacttttacaattgtttgttttcacgatgatttgcgtgctcgtgctgacaggaattacgatccagtcggcagccgtgaaatcgagcgaactggcgagggaacagctcggaggcagcgtcacgctcaaagttgacagggaaaaaatgatgaaagaacagcaggactcaggagaccggaaaaggtttgaatcgacccccgtttctctcaaatcagccgagaaacttgcgagcctttaccatgtcaaaagctataacttcatctcctcaacatctgctttagcggacaacttcgatccgatcgaaagcggtgacgaggattcaacgg

SEQ ID NO: 2529 - DNA, 879 bp, Bacillus licheniformis
  misc_feature (1)...(879): n = A,T,C or G
atgttcccattcatctgggcgctgaacggatcagcaaggctgttgacgaaagcgtttggccttgaagcggtttctgaaaatgaaatggcgcactcagaggaagagctgcgaattattctgtcagaaagctataaaagcggcgaaatcaatcaatctgagttcaaatatgtcaacaaaatttttgaattcgatgaccgtcttgccaaggaaatcatgatcccgagaacagaagtcgtcagttttccaaatgatatgaaaatcgccgagatgattgacatcacgaaggccgaaggctatacccgctatcccgtcgaagacggtgataaggacaacatcgtcggcgtcatcaatgtcaaggaaatactgacggcctgcatcagcggagaatgctccaaagaagacacgattgaacagtttatcaatccgatcattcatgtgatcgaaaccgttccgatccacgatctgcttctgaaaatgcagaaagagcgcgttcatatggcgatcctttctgatgaatacggcggaacggccggactcgtgacggtcgaagacatcattgaagaaatcgtcggcgaaatccgcgacgaattcgatattgatgaaattaatgaaatccgcaaaatcggcgaaaaccactacattctcgacggcaaagtgctcgtcaaccaggtcaacgatttgctcggcattcagctcgacaatgaggagattgacacgatcggcggatggttcctgacgcanaaatatgacgtccaaaaaggcgacatgatcaccgagcagggatttgaattcacgatcaacgaaatcgacggccaccatgtttcatacgttgaggtgaaaaaagctgcggaaacgccgctgcttgaagaagcggaataa

SEQ ID NO: 2530 - DNA, 552 bp, Bacillus licheniformis
atgaaaaattttttaatcatcaacgggcatgaagcctatccccatgcaagaggacagctcaatcacactatttttacagcgatggcggacaagctgagcgaaaaatatgaagtgaaaaaaacagtggtggcagacggctatcaaatcccggaggaacacgagaaattcaagtgggctgatgccgttatttatcagacgcctgtttactggttcagcgttcctgctttatttaaaaaatatattgatgaaatttatgagtacgggcttttttatcaagggtctgaagactacggaagaggcggactgtttaccgataaaaagtatatgttttcaaccacatggaacgcgccgaaggatgtattctccaaggcggggacattcttcgaaggtaaaagccttgatgaagcgctgtttcatttgcacaaaatgcaggaattcatcggcatgaagcctttaaaaacattctctgtccatgatgtaatcagcaatccgcaagtggatcaatatttagctgatctggacgcccatttaaaagaagtattttcgatttaa

SEQ ID NO: 2531 - DNA, 688 bp, Bacillus licheniformis
atgatcagtgtaaagcatattcaccactcgtttaaagtcggcaaaaagggaagggaaaatgaaattaaggtgttaaaggacgtctcgcttaccgttgaaaaaggagaaatcgcctgtattgtcggacggagcggctccggaaagtcgacactgctgaacttgatttccggctacatcgccccgacaaaagggaagatcatgattgacggcacggatgtcacgaagtacagcgagaaagaatgggccgcattcaggcttgaacatttcggcttcatctttcaaagttttcagctgattccgagcttgacgactttcgaaaatatcgaacttcccctgactttaaaaggtgttcatccgtcggagcggaagcagcgcgtcaacgagatgttccaccgcgtcggccttgaaaaccacgccggccactatccgaatgagctttcaggcggacagcagcagcgcgtcagcatcgcccgcgctttgattttgaatccttcaatcattttagccgacgagccgaccggaagcctggattccgaaacagagcaggaaatccttgaattcattcggcagctgaacagggaacgcggcattacatttgtcatcatcacgcacgatgacgaggtggcatcgatcgccaatacgaaatttcatttatctgacggcgtgttagagaaaggggaagagactg

SEQ ID NO: 2532 - DNA, 627 bp, Bacillus licheniformis
ttctgacaggtccgctgatcagtcccattgtcgtcttatccacttatatggcttttggcaatgacttgcgaatggccgttttaagggttgccgtcggttttgccgcagcggtcatcatcgcttttgcgatcagcatgatgttccgctcgagccagctgaaaacggaaagccggcagacagctgcacactgcgcccattccggcagacgatcccctttttcggaaaagctctttgatatgctgaaacatgctgttgacgaattctttgatatggggaggtttctgattatcggcgctttagttgcagcgcttgtgcaaacatacctcccgttaaaatcgctgtttgtgttcggagggggcatgcttgactcggcattggtcatgatggggctggcttactttttatcgctgtgctctgaagcggatgcatttatcggcgcttccttcaccaatttgtttccttcctcatccatccttgcttttctcgtttacgggccgatgctcgacttaaaaaatacggtcatgatgctgcatgcgtttaagccgaagttcgtcatttgtttgtctgtcctgatcaccgttgttgtctttgtttgtatcaaagttgtcagtttgctgtagaaaggag

SEQ ID NO: 2533 - DNA, 660 bp, Bacillus licheniformis
tttttttcccgcacaatatttccgtgtcaacctgttaattaagccggatgcaacaactcgggtttaacatttaattgactcagggattccggatcagcaaactcgggtatttaaaagccttcggatcacctccgcaagccgattaagcggattttgttgacccatgcccacagcgaaccatgtcggttcgcttgacgcgctgtaccacagccttccgggtgtgaaggtgtcaatatctgaacggtatgcacgtctgttaaaaggcgattcaaagatgttggaaggggagcgcggaataatcaaaggaggcgttccgaaaaacatcaagacaaatcctgatatctttttaaaggaagtagacagaatcggttcattgctgactgtttcatcacccgggcatacgcctggcagcatttcgttttttgatgaaagaagcggccttctcatagtcggtgatgcgtaccatacgcgaagcggcatgacggtatcggggcatttaaagctttcatttccttttccggctttggccacatgggacaaagaaatcgctttagaaagcgcacaaaagctgttagatttaaaaccaaaggcgcttgccgccggccacggcgatctgtcccatgatccggctcaagcgatgaaaaaagcggtaaacgaagc

SEQ ID NO: 2534 - DNA, 354 bp, Bacillus licheniformis
gatccccggtgaaggaacagtgctgttaatttacaaggagcacgaagccgtactgatgcactcgaaaatctcaaattccttcatcccggctgaaattcaaggagaagaaggctctatcgtcatcgataaaatccaccgccccgaacaagtcgacatccgctatcgggacggtcgggttgaacatcttacgctgcctgatgacaaaccggccatgttttatgaaacagaggaattcatcaatttaattaaacaagggcggatcgagtcttcgcttaacacgtttgaacgttctatagacacattggcggtcatagatgaagcgcgcaaacagatcggtctcgttttccccgctga

SEQ ID NO: 2535 - DNA, 310 bp, Bacillus licheniformis
atgaaggttctgattgtcagcgacagccacggccttgaagacgaactggaaatgatcgctgagcggcacgggaaggaaacagatctcatcatccattgcggggattctgaattggacccttcccatcccgcgctttcctcttacttaacggtaaaaggaaactgcgatttttacggggagttcaaagacgaaatcgtcgttcccgccggatcgagaaagctttttttcacacacgggcatttatacggcattaaacagtcgcttttaaatgtgtactaccgggctgaagagctcggcgccgatatcatcg

SEQ ID NO: 2536 - DNA, 585 bp, Bacillus licheniformis
aaatgcttgcgctgaatatagacggaacgctgcttcggacaaacggacggcttcatcccgcaacgaaggaagcgatcgaatatgcaaagaagaaaggtgtatatgttacgcttgtgacgaacagacatttccgctccgctcaaaaaatcgccaaatctttaaagctggatgcgaagctgattacgcacagcggagcgattatagcggacaaaatcgccgaacctttattagaaaaaaggatttccgaagaacagacatttaaccttgttcaaatactggaaagctatgattgcaatatcagaatcctccatgaaaaatattcgattggaaatcggaaaaaaacgaattcaaacctgctggggaaaacgatgattcacccgtctgacccgattttttatcccgtccagtttgtcgattcgctgagcgacatgctgatggatgaaccggtcagcgcgccggtgatcgaagtttattgctcaacaagtcagtccgaagaaatcaggcagacgatcacaaatgcgttttctctcgtcgacatcattgaagcgggagaaaaatgctgattgtccataaaggatctttcaa

SEQ ID NO: 2537 - DNA, 333 bp, Bacillus licheniformis
atggcaacaatcgaagattttttaaagcttgatattcgggttggaacagttttaaaagcagaagagtttccggaagcgaaggtaccggccattaagcttgaaatcgattttggcggagagattggcgtcaagtgttcgagcgctcaaatcacaaagcgttatacgcctgaaaagcttgtaggccggcaggtgacggcagtcgtcaattttccgccgcggcggattgccgggtttaaatcggaagttctcgttcttggaggcgtaccggaaaaaggcgatgttatattgctggcccctgatcaagaagcgcccaatggaacgaagatcagctga

SEQ ID NO: 2538 - DNA, 316 bp, Bacillus licheniformis
ttgtgacagaccgccgaaacatttatttcttttacaaaaaaagcgaagaaaccgacgagcagtgcaaaaaactgaaacagcttgccgaagaacacggatttcgcgtcgttcaccatcacaatgaagccaatattatcgcaagcatcggcggcgacgggacatttttgcaggctgttcgaaagacgaacttcagggatgactgcctgtacgtaggcgtggccaaaaaggggaaagctcatttgtatgcggattttaatatatatgataccgataaaatgattgaagcgacaaactcggagcaaatcgaggtcagaaa

SEQ ID NO: 2539 - DNA, 440 bp, Bacillus licheniformis
atggagatggctgaacagaaaaaaatcacaataaacggcgttgaaatggaagcgtccgaggaacagacggtgcttcagcttttgaataacagttcgattgaagtgccgcaaatttgctatcatcctagcttagggccgattgaaacatgtgatacgtgcatcgtcagcatcaatggcgagctaaagaggtcgtgctccgctgaagtaaaggatggagacgtcattgatacgctttcacctgatgtgaaaaaagcgcaggtcattgggatggacaagattttatataatcatgagctttattgtacagtttgcgattacaacaacgggggatgcgaaatacataatacggtgaaggaaatgaaggtcaatcaccaaagcatcccgtttgatcagaagccttaccataaggatgaatcaaatccgttttaccggtacgatcc

SEQ ID NO: 2540 - DNA, 774 bp, Bacillus licheniformis
ataaaattgaagacaatggcctgtctgcagaaaaaacggcggtgtttttgcatggctttacaggaagcgcggccacatgggacgggatagacggctattttcaggggatgcgtctgatcaagctgaatctgctcggacacggcggaaccgactcgccatcggacagccggcgctacacaacagagaagcaggcagcggatctcatcgaaatttttgatcgtttaaatgtaaaacaggcttacctcatcggttattcaatgggcggccggcttgccttatccttggcgatgattcaccccgagcgtgtgtccggtcttgtgctggagagcagttctccggggcttgattcgcctgaagaaagaaaagcgcgcagggagcaggacagccggctcagcaggcggatacttgaagaaggaatcaagtctttcgtagattattgggaaggcattccgctgtttgcatcccagctttcaatggacccttcaaaaagaaaaaaagtgcgcgaagaacgtctgaacaacaatccgatcggccttcgaggcagcttaatcggaatggggaccggatcacagccgtcttggtggaacaaactgagcgggatcaattatccggtgcttctcatcgcgggaagcctggatcagaaatttgtcgccatcaatgaaagcatggcaaagcggattccagccgcccgcctcgagattgttgaacataccggtcatgcggttcatgtggaagagcccgatttttttggtagaatagtaagtgagtttattt

SEQ ID NO: 2541 - DNA, 450 bp, Bacillus licheniformis
ggcgtgaccatgcagcatgtgaaacccatggcgcactatataatatggccgcgcaaagccgggaactgtcggatgcgatcgcgcgcgcagtttatcaaacagacccggaactgattttattcggtttggcgggaagcgaacttgtgcttgccggtgaaagagccggtttaaaaacggctcacgaagttttcgccgaccgtacatatcaagaagacggaacgctgacttcccgccgccagaatgatgcgctgattcaagatgacgatgaagccgtcggccaggtgatccgcatggtgaaagaaggcaaggtccgcagcctgcagggaacggatgtcagccttaaagcagatacggtgtgcattcacggtgatggtgcacacgcgcttcattttgcgaaaaaaatccgccgcgaactcagagcagcagatattaaagtacaagctttttcta

SEQ ID NO: 2542 - DNA, 783 bp, Bacillus licheniformis
atggcagatagtcagtggtttactgtgacagagcttgatgaatccacatatgcgatcagcgaatacgggcattgggaaaaagtacactcttatttgcttataggggcgaaggatgccgttttaattgatacgggtcttggcatcggcagcatgaagacggtgacggacggtctgaccgatctgccggtcagcgtcatcacaacccatgtccattgggatcacatcggaagccacgatgaatatcagcgcatttacgtccatgaagctgagagagaatggctgacggacggaatcaaaggacttccgatcgagcaaattcgccgcgatgtctcgagagatatcaccaagcctgttccggccggcttttccgctgaaacatacaccccgttcagaggcgaaccgtcgggaacgctgcaagacggagatacggtcggctgcgactcaaggccgcttgttatttatcatacgcctggacactccccggggcatatttgcatctttgatccagcgtcaggctacttgtttaccggcgatctgctgtataccggagctccaatctatgcattctatccgacgactgatccggctcaactggttcagtcgcttgaaaaagtttcggctatcgggcgcgtaaaaaaggttttcggcgggcatcatcagctcggtcttgctcctgacattttagaggaagccggacatgcggcacggcacttgaagaaacacggactggcacagcacggcacaggcatgcaccgatttaagagcctgagctttcaattttaa

SEQ ID NO: 2543 - DNA, 774 bp, Bacillus licheniformis
atgaagccaatcagttttttgtccttgacgacgacgagctttacaaaaagaaacgatcataaaaaacacacctattatcatcactcaacggctgatgataatttatttttgcctgaaagctacatcgagcagctggaagacctaaaaagccacgatccagacctttaccgcattgcccggaaaggtcgttttggcgttaacggaaagcttgtcctgccgcagttcgaagtgatggagcacgaaaaggttatgaatgcgatcagagcaatcgacaggccgatcttaaaaaacggtatggactttggtttcgttgattcatataacgccttggttcgcatggcgatcgaccacaatcaaaagattctatatatctactggcagtattacaaaaacgatacgacagacgacaaaacagcggaagacctgaaagaccttaaacgcgttctgatcaaagctgatagcgcggagcctaagacaattcgattcttccggcaacaggggttccgtatgaaggccgcaaagaaattccaaggctcacgactgcaatacaccaagaaggtgaagcggttcaaaaagattatctgctccgatcaatgccctgacgttattagggagctgaaagatttgactttcgcagtggataaagacggaaacgtcattgaagacgaattcaacatcgatccacatactttctcggccatctggtacggcttagatgattatgaggtatcaagtctcaaggggcacggggtaacaaggaggtttagagattga

SEQ ID NO: 2544 - DNA, 540 bp, Bacillus licheniformis
aaacgacgcttctcaatatcatttcgacgattgaccgcccggattccggcgacattttaattcgcggagaagacccgcatcatttaaaaagggcgaagcttgcccactttcgccgcaggcagctcgggttcgtattccaggattttaatttgctggatacactgacgatcggcgaaaacatcatgctgccgttaacgcttgaaaatcaaccgctttccgtcatggaagataaacttcaggcgattgctgaaaaactcggcattgaacaacttttgaacaaacggacgtttgaagtatccggcggacaaaagcagcgggcggccatcgcaagagccgtcattcatcagcccgccctcatcctcgccgacgaaccgacaggaaacctcgattcgcaggcatcaaaagacgtgatggagacgatgcagcatcttaatgaaaacgacaatgccacgatattaatggtcacgcacgacccagttgccgcaagctattgccgtcgcgtcatttttattaaagacggaacattattcaatgaaattt

SEQ ID NO: 2545 - DNA, 363 bp, Bacillus licheniformis
cttaacgtttccgctcatcaagctgcttcaaggcagcgggtcgattttggcaacggcgctcggctattcagcttcactcctatacggatttatcatgattaaacgccatgccggctattcgtatcgcaaactgtttaaacggtttttgctgatgctgatcctgacggcggtcatgggcatcattttgctgcttgtccaggcgcttctaagtatttttatttcatacgaaggcgggcagatcaggtctgctgtcgtcattttcatcacaaccgcagtgggcgggtcagtttatctgtacttggcttaccgtgtgaaactgctcgaaaaaatcttcggtcagcgattgaatcgctttttcaaaag

SEQ ID NO: 2546 - DNA, 333 bp, Bacillus licheniformis
gtttccgctttattggtacagctcgccgcctctcttaaaaaaatggctggaccacgttcttctctacggctgggcatacggaacaaacggcacagcgcttcgcggcaaagaattcatggtcgctgtatcggcgggcgctcccgaagaagcctatcaggccggcgggtcaaatcattatgcgatcagcgaactgttacgcccttttcaggcgacaagcaacttcatcggtactacataccttccgccttacgtcttctatcaagcgggcacggccggaaaaagcgagcttgctgaaggtgcgacacaatacagggagcatgtgctgaagtcatt

SEQ ID NO: 2547 - DNA, 331 bp, Bacillus licheniformis
atgaatatgatttcaaaaacgccggagccgccgtattacgcggtgattttcacatcggtcagaacgaatggggataacggctacaaagagacggctgagaacatgctaaagcttgccgcagaacagcccggctttttaggagcagaaagcgcaagggacatgaacggaaagggaataacggtctcctattgggaaagccttgaagcgattgaaaaatggaagtttcacggcgaacaccggcaggcgaaggaaaaaggccgaacagaatggtactctgactttgccgtacggattgcaaaagttgaagacgccagaatttcggagcgttccg

SEQ ID NO: 2548 - DNA, 531 bp, Bacillus licheniformis
agagtcgattgcgagtccttgtgtgacaggaacactcgcgaaagatggcacagctgcctatgctgatatcaagtatgaatcatcaacagatgatattaacgattagtctatcaaacacttaaaatacagcctgaaaatggctgattctgaaggattgcaaactgaactaagcggatatgcaccaagagctgatatggagatacgcgggatctctgaaattagaggcattattttggccgttatcggtttggccattacatatggctctctattaatagacatgttggccgattataacagcactgatgggactatgtgtaagctttgtgcttgacctgattgggacacatatgttccattcgattgcggcagtctatcattaacgcgaatgattggccttgcatgtggaaatgaccatgctctatttttcgtacgaagcaccaggcagatctacggctacgtatacaaacaaatgatcagatgccagatctacatgaactccgggcgtgcattcgtttctgcccgacttac

SEQ ID NO: 2549 - DNA, 756 bp, Bacillus licheniformis
atgcttagcaaaagaagaggcgggatgattatgaaatttagcatcatgacgtttaatatccatcatggaaaaggaagggaccgccgcgttgatttaggtagaacagccggtgtgatcgctcaaagcggctgcgacatcatcggcctgaatgaagtggatcggcatttctcaaatagaagcgattacgaagaccaaatcggccggcttgcagaacaattgaacatgcactatgcgtactgcccctccctttcattgagttccggcgattcttctgagaaaaggcaatacgggaacgctctattaacgcgttttccgattaagaaagaacggcatcattcattcaattttgtcaaagggctgatcgaaggaaggtctcttcttgaggctgatgtccggatcggtgaccggctctttcgcgtttttgttacgcatttgagcctgaatccgtggcttcacggcaagcagacggattttttaatcgagaaggttcaagagagcgatctgcctgtgatcgtcacgggagactttaatatgaaaccttattcacggggatggaaaaaggtcgcggaaaaactggccgacctgtgggatgaaagtcaatacggacaggggttcacccacccttcccaccgcccgagacggcggttggactacatctttctcagtccgtcttttcatgtgtcagcggctgaaattgtcgccgttgatccgaacgcttccgaccatctgccgcttaagggcagcatcacatattaa

SEQ ID NO: 2550 - DNA, 444 bp, Bacillus licheniformis
ataacgtaaagcatagaaagaagaaatgtggcaacttggaagcgacaacagagtggccagactggcccccagggagacaagtagaacggcaggaatcaaaaaccggcaatgcatttgttccaaaaaaaaaaaaacggataggctttaataaccttaaggagaaatttaaagccggcggatttacgaccgcggattccttgacagtgaaacctgaaagagtcgccgattgcccgcttcaaattgaagcggaagctgtcaacattcgcattccggaacattccccgtattttgccgtcattgaaacaaaagtgcttcatgtgcacgcacatgaagcgattttaaaaggggaacaccacatcgatcctcaaaaatgggaacctttgatttatcttttcagacactattttggcttaggaggagagcttggcaaaacgttccgcgcct

SEQ ID NO: 2551 - DNA, 309 bp, Bacillus licheniformis
cagcaaaattattcagccaagcattttatattacggaacaccagtcattttactcagcacaatgaacgaagacggttccacgaatctcagcccgctgtcatcttcttgggcgctcggggattcgatcgtactcggtattggaaccgaaggtaaagcattggaaaatttagagaggcatgctggatgcgttatcaatgtgccggattcatctttatggagaaatgtagaacggctggcttcctataccggcaaacgattcgttccggaagaaaaaaagcggctcggctttacttaccttaaggagaaatt

SEQ ID NO: 2552 - DNA, 556 bp, Bacillus licheniformis
ttgtgatcataaccggaatgtcaggggcaggaaaaacagtggcgattcaaagctttgaagatctcggttttttctgtgtcgataatctgccgccatctttgctgccgaaatttttggagctgatgaaggaatcaagttcaaaaatgagcaaagtcgcccttgttatggatttgcgcggccgcgagttttttgacagcctgattgaagcgcttgatgaaattggggaaacatcctggattaccccgcgaattttatttttagatgccaaggattcggttctcgtttcaagatataaagagacaagaagatcccatccccttgcgacaacgggcctgccgcttgagggcatccagacggagcgggagcttctcgaagagctgaaaggccgttctcaaatcatctatgatacatccgatatgaagccgaaagacctgcgcgaaaaaatcgtccagcattttgcggcagatcacggacatacctttactgtgaatgtgatgtcattcgggtttaaataccgattgccgatcgacgctgatctagtgttcgacgcaagatt

SEQ ID NO: 2553 - DNA, 414 bp, Bacillus licheniformis
cgtcgtgccactcccgattatcggccggctgatcgtacaatttttctttaaaaaacaagtgaaaaaagctgtacaggtgctcccgcttgtctccgttctcggcatcgtcgccatcgtctccgcagtcgtcggaggcaatcgggaaaacattattcaatcagggctgctgatttttgcggtagttgttcttcataatggcctcggacttttcctcggctttgttttggcaaagtgctttaaaatggattatgcgtcgcaaaaagccgtgtccattgaggtcggcatgcagaattcgggtctcggcgcggcattggcgacggcgcacttctccccgctttcagctgttccgagcgctgtgttcagcgtctggcataatctttcaggttcatggcttgcgacatactgggccaaaaa

SEQ ID NO: 2554 - DNA, 213 bp, Bacillus licheniformis
aatcaatgaatatgacggtactgatgtgatactcagcggacatacccatggaggccagatcaggtttggaaaattcggtccttatgaactggggaaaacaggtattgttaaaaacgcggcatatctgatcagcaacggctacagcacgacaaaagtgcctcttcgtttaggtgctgagcctgaaactcacattgtgactctttgcgggccaga

SEQ ID NO: 2555 - DNA, 567 bp, Bacillus licheniformis
atgcgatgtggccgttgaaacggaacgactggcattatttgaatggatcaaagaacatcatccgggagtaaacgtacttgtgaataatgcgggcatacagcagcgctaccacattttaaaagccgatgttatagacaattgggctgactacaataaagaaatcaccgtcaatatggaggcgcctatccatctggccatgctctttagccgatactttgccgaaaaagccgggaaaactgcgatcatcaatgtgtcatcagggctggcgtttacaccgatggcggtcgcaccaatctactcatcgacaaaagccgctctccactcctttacgatgagtttaagacaccagctttccgaggccggcgttgaggtcatagaagtcgctcctcctgcggtcaatacggatctgggcggtgtcggactgcatgattccggagctcctttggatgaatttgccgatgcgatctttaaagggctggaagaaggccggttggaaatcggctatgccgtatcggaaaaagccttgcggatgtcaagagatgaaatcgatgaaagcgtcagccaatt

SEQ ID NO: 2556 - DNA, 508 bp, Bacillus licheniformis
ctggaaggcaagaaagtgatcgcgcttgtcagcgatgaattcgaagatttagaactgtggtatccagttttgaggttgaaggaagaaggagcgatcgtacatttcattggtgaaaaagcggatcatgaatacaagggcaaatacggagtgcccgctgtctcagattatgagctgaaaagcgtgaacattgaggaatacgacgccgttctggttccgggaggctgggcgcctgacaagctcagaagatatcccgaggtcctggagatgattcggtggttcaacgaaaggaagaagcccatcggacaaatctgccatgccggctgggtgctgatttctgcaggaatattggaaggcaggaaggttacaagcacaccggggattaaagacgatatggaaaatgccggagccatatgggtgaatgaagcagcggtcgtcgacggccatatcgtgtcaagccgccgcccgccggacctgccgatctatgtcaaagcctttgccgatcttttgg

SEQ ID NO: 2557 - DNA, 301 bp, Bacillus licheniformis
  misc_feature (1)...(301): n = A,T,C or G
ttgagcgcatccggatttgtccgacaaatcaataaccagcttgatgcccactacgatgaaatggtcaaattgaggcgccattttcatcagcacccggagctttcttttcaagaaaagaaaacagccgcatttatcgcctcttactatgaagcgctcggtattcctatccgcaccaacgtaggcggaggcggagttctcgcctacatcgaaggcggatctcccggccccgtcattgcgcttcgagccgattttgacgcggtgcccattcatnagaaaaaaacgcgctatactgcatcaaagg

SEQ ID NO: 2558 - DNA, 381 bp, Bacillus licheniformis
  misc_feature (1)...(381): n = A,T,C or G
catcggcttgggagcgagcctgtcattttggttttttgacctgcccttatccgctgatcctcgggccttgtcatcggcggcgacaanatgtcattcccgtatttcggnccctgtcatcggcgcgattccggctgtcatggtagcagccgctttatcgacgaggctcgttttcgtggtgatcattacgattttgattcttcagtttattgaaggcaatatcctcgggccccttgtcgtcggcaaaagcctgcatatgcatccggttgtcattatgcttggattgctggcgggcggggagcttgccggcatcatcggcatgattctggctgtgcctgtcatggctgttatcaaagtgatgctcgtccattttttagcggcaag

SEQ ID NO: 2559 - DNA, 399 bp, Bacillus licheniformis
tgaaggacatcatgacaaccaatgctgaatgctgcgagccttctgccccgattgcggaaattgccggtaagatgcgtgattacaatgtaggttcaattccggtctgcgagaacggaaaattgacggggatcgtttcagaccgggatattgttatcagatgtgtagctgaaaatgaaacagatgcggctgctcgggatatcatgagcacacagatggtgacagggcgcccggatatgtctgctgaagaggctggtgatctgatggcggaacaccaaattcgcaggctgccgattgttgaagatgaccgtcttgtcggaatcgttgctttgggggatctctccgtctcacatgcggatgagaaagcgggagaagctttaagcgaaatttcaaaaccggctt

SEQ ID NO: 2560 - DNA, 687 bp, Bacillus licheniformis
atggaatggaaaaatccttggaacaaaaagcagctggtctgcttgtttttgatcgcatttgcagccgtgccgattttcattgaatatttattaaagaatgctttggatctgcttttaggcgaaggcatgctttcagccatgttgatgagtatcgcaatggcggccgtttttattctaagcttgtactatatcgccttaaagccggaccgtctgtcttggcgggaaatcggaatctcccggttcgcccctgcatacttgattcaaatagcgggatggacggtttttttaatcgtgatgacgtttgccgttatggaaatcctgatttggttcggcgcaggctacgaaaatacaaaaacaaaaacgatcactgccgatccttcatggttgagcattgcaatgtctttcgcttctgcctgcatcgtttctcccatctacgaagaattgttttaccgcggttttctttaccgctggttccgcgctgaattcggggttgtatgggcacttgttgcaagcagcgccctctttatgatcgctcatatccccacatacaacaccctggccgttaactttggaacagggctcgtgtttgcctggacatacgaaaaaacacgatcgattatacctgcgatgatcatccatagtttatttaacgcgattttgctgtttttcacaatcttactcacataa

SEQ ID NO: 2561 - DNA, 550 bp, Bacillus licheniformis
ctgctggtcggagtggctccaaaagacagggaaagcgaatacacgccttttcccaagcggcatttgctgccgaataaacgggagtacggcgggaagggcaacgaatatgccgcttttttggccaatcggctcaagcctcatatcgaccggcactaccgaacaaatccgagccgtgaacaaacaggaatcatcggaaagtcgttcggagggttgatctcggtttacacagcttttctagcatcggagacctttggaaaaatcggatctttgtcaggttctttctggtttgaaggaataaccgagtttatgaagaataaccgctttgagaataagcatctgcgcatttatatggatgtcggaagcacggaagggacagacagggataatctgcagaaagagatgataccgaggacaaaggaagccttcagcctgttaacagaaagcgccgcctccgaaaaagaactgaaatttgtcattgatgaaggtggctcacatcggcttgagcggtttgcgaagcgttttccggaagccgttaaatggctgtttggct

SEQ ID NO: 2562 - DNA, 339 bp, Bacillus licheniformis
  misc_feature (1)...(339): n = A,T,C or G
acgggagtgtataacttatgacaatcacagacgcggagcaatggacaaaggcattttacagggaaagaggatggagcgaatacggacctttcatcaggatgggatttttaatggaagaggctggcgaactggcgagagcggttagagcatacgaaatcggaagggaccgtcctgacgaagcanaacggccggctgctgaactgaaaaaagactgatcgaagaaatgggcgatgtaatgggggaatttgatcatgctttgccggctatacggtgtttcattggaagacatgatggatgcccatcgctgcaaactgacggaacgatttgcaggagagcatc

SEQ ID NO: 2563 - DNA, 418 bp, Bacillus licheniformis
  misc_feature (1)...(418): n = A,T,C or G
atgaatattcaacaaattcgaaatgcaacattggccgtcaaatatgcgggcaaaacatttttaatagatccgatgctggctgataataggcgcttacctcctttcccgaactcagcaagacaagatcaaaacaaccctttggtcagcctgcctgtgccaaccgacgagctcgtcaagaatacagacgcagtcatcgtcactcatctgcaattagattcatttgacgatgcttgcaaagatctgcttccgaaagatatcanactgtttggttcanaatgaaacaaatgctgaagaagtgagaanagcnggtttcaanatatagatgtctnnacaaaagatacggtgtttgagggaattcaatnaatcnataccnaaaggcaaacatgggaaggggagantatatnataactngccggaa

SEQ ID NO: 2564 - DNA, 212 bp, Bacillus licheniformis
atgaaagtggcatatcatggtcattcagtggtaacagttgatacgggagatcatcagttgatcttcgatccgtttattacaggaaactcattaaccgatttaaagcccgaagatgtcaaagcggacgtcatcttgctgactcacggacataacgatcatgtcggcgataccatcgaaatcgccaagcgaaacaattcgctcgttgtagctcc

SEQ ID NO: 2565 - DNA, 648 bp, Bacillus licheniformis
atgaaaaaagcgataatcatcggcgcgagttccggaattggcaatgcgcttgccaagcagctgtcagccggaggagtggaggtcggtcttgctgcaagacggtatgagctgctagccaaattgcgcgacgacctccctggaccttcatacattaaaaagatcgatacagccgacagcgaacactcgcctatactgttgaaagaactgcttgatgagatgaatggggcagacgcagtcttcatctgttcaggtgttggatatttggaaagcgaaatggattggagcaaagaaaaggaaacgatcgatgtcaatgtgacgggatttgtgtcctgctcgaacgtgttgatggagcattttatcaaaaacgggagagggcatttagtcggcatttcatccatcgccgcgctgagaggaaacggaggggccgtcacctacgccgcttcaaaagcattcgtttcaaattatttaaaaggacttcgtcaaaaagtgaaaaaactcggttgcgatgaaattgcggtcaccgaaattcagcccggcttcgtggacacggctcttgcaaaaggtgatcatctgttttggacggcttcgcccgaaaaagcggctgcacaaatcatcagcgctgtgcagaagaagaagacgcacgcataa

SEQ ID NO: 2566 - DNA, 451 bp, Bacillus licheniformis
atgacaggaaaaacacacatcatgggaggggtcgcttcttgtacggctgctgcttatttttacggatatgatccggtgttcatgacagcctcgggcgttatcggagcattgattccggatatatgccatacaaaaagcaagataggcagaaggcttccgattttatcagcagtggtcagttctgtcttcgggcacaggacgtttacacacagcctgctctttttgctcatcacggcattcgcggcacatttatattttgcagatcagagcatacttgtcggattgatggccggaatggcaagccatctgctcctcgatgccgggactgtaaacggcatcaaacttttctttccgtccgccattaaggttcgtctgcccctttacattaaaaccggcgggaaggcggaacaagtcgttcttgctgtgctcaccgttgtttcgtgctatttta

SEQ ID NO: 2567 - DNA, 547 bp, Bacillus licheniformis
atgaccaaagcgtatgtttttttaatcgacggattcgaagtaattgatgcgatagcaacaattgatgttttacgaagggcagaagttgagaccgtcaccgtctcgcttgatccatcgcgcagcgtgaaaggcggacatgacattgtcgtcgaggcagacgtcatgtttgacgatgctgattggcaagaagcggatatgctgattcttccgggcggaaatgtaggcagcaaaaaaatgctggagcatcaagctctgcataagatgctgacagaagcggcaaatgcaggaaaatatgttgccgccatttgtgcggcaacgatgacgctcggaaaaacggggcttgtcagcggaaaaaaagcgacctgctatccgggagttgaagaacatttaacaggggcggatgtcaccgcacatgaaaacgtcgtcgttgatggaaatatcattacttccagagggccggcgaccacgatcccgtttgccctcaagcttgccgaactgctgaacggcaaggaaaaagccggtgcagtcgccaagggaatgctcgtct

SEQ ID NO: 2568 - DNA, 510 bp, Bacillus licheniformis
tcatcatcctcaataaaacagatttagtatcgaataacgagctgaaatccttggagcaaagacttgtcaacattaatcctacggctaagaggctgtatgccagagattgcaaggtcaatttaagagatatactggggatcaatacgttcgacgtcaatcgaaaaattgaaatcgatcctcattttctagaagatcatcatcaccaccatcacgatgataaagtgtcttctatcgcttttcgggaagagaagcctcttgatttggcaaaggtggatcattggatgagttatctcgtacgggaaaaaggagaagatttattgcgttataaagggatcctttatattaaaggcgaagaatatcgaatcgtattccaagggcttcatatgctgttttcaggacgtccggaccggaagtggaacgaaaacgagaaaaaacaaagcgaacttgttttcatcggaaaggacttggacaaagaggaactggagcggcaatttaaaaattgcatcgcaa

SEQ ID NO: 2569 - DNA, 609 bp, Bacillus licheniformis
atgacagccctcgttggtccaagcggatgtggaaagactacacttttgcactgcctcgggctattgctcccggttaatcagggacgcatcttgatagacggacacgatgtcacaagctacggtactgcggcgcggcggcggttttggcgtgatcatgcggcgttcattcttcaggattacggcattatggatgaggagtcggtggcattcaatgtcaccatgcaggcgagcatccttgggcggcgtgtcacgggaaaccaagagcggttggcgcaggtgctcgagcagacgggtctccagggtcgagaaggcgagttggctagccaccttagtgggggcgagaagcagcgactcgcactggctcgtgccatctacaaggacgctgcattcttgtttgtcgatgagccgaccgcctcgcttgactcaaccaatcggcgaaaggttatcgatctgtttgcggacttcgctgcgcgtggccgcacggttattgtgtctacgcacgactctgagatgatcaacgcgtgtggtgctcggcataaggtcggttccagcagttcgtcaaaaccattgtcgaccaacgatcccggcaacttaggaggtaactcatga

SEQ ID NO: 2570 - DNA, 735 bp, Bacillus licheniformis
atgaaaacccgctttgcgcaagcaatcgaagagggagggaataaactgaattgtttaatttgtgcagcgcctcttttacattctctctcatggcattcttttttctttttacgatcagaagagaaaatatgcagggaatgtaaagagaactttatcgagatcaaaggaaccgtatgccctaagtgcggacggccacaggggagcgaagagctgtgcggtgactgcgcaaaatgggaggccaatccgttaacccgctctcttttgaggcaaaaccgctctgtttatctctacaatactttcatgaaagaagtccttgcccgttttaagttcagaggtgatgctgaactggtcttcgcttttgccccttcatttatcagcgcttttcaacaatacttccgccgcagcccgtctgttttagttccgatacctctcagtgaagaacgtaaagcggagaggggatttaatcaggcggagcgtcttgcttccttattacaaatacccgttattcatcccttgatcagaatcgaaaatgaaaaacaatccaaaaaaagcaggaaagagcgaattaagccaaaaaccgtttttagaaccgaaaaggggtcagtaaagaatctggatgtcatattgattgacgacttgtatacgacaggagcgacccttcatcatgccgctgattgcctgatgacatccggagaagcaaaatctgtatcatcatatacattaattagaagctaa

SEQ ID NO: 2571 - DNA, 401 bp, Bacillus licheniformis
agctttacaggcgggcttttttccagctggctgacggaaatgagcggcgcttccgaatatttcaaaggcggcgccgtctgctacacaaacgaattgaaagtgtcagcggccggcgtttcggaagacacgctgcagcgctatggtgcggtcagcgcgcaatgcgctaaagagctcgccgcaggcatcagagtcaagacaggaagcgatatcggcatcagcttcactggagtagccgggccgaatacgcaagaaggccatccggctggaaaggtgtttatcggcatctccgtgaaggaccaggctgaggaagcgttcgaatttcagttcgccggatccaggtctgcggtgcggaagcgttctgccaaatacggctgccatctgttgctgaaaatgatggaaaa

SEQ ID NO: 2572 - DNA, 237 bp, Bacillus licheniformis
atgaagccaattgaagtattaagatatgacgcattttcaaagactgcgggtcaaggaaatccggcgggcatcgtgcttgaagcagacgggttgaccgattgggagatgcagaagatcgctgaacaggcaggctataatgaaacggctttcctgctgccgagcgagtcggccgacataaggatccgctactttacgccgggccatgaaatgaatttatgcggacatgcgactgttgca

SEQ ID NO: 2573 - DNA, 177 bp, Bacillus licheniformis
aggcgcgccacgatcatatgattaatacggatagcgcaaacatcatctacaatgaagttgaaacggatgataagcagctgaaatggtatgaagaatcaggtcatgccatcacattggataaagaacgcgaaacactgcacaaggatgtgtatcaatttttagaaacgttggattggc

SEQ ID NO: 2574 - DNA, 165 bp, Bacillus licheniformis
taacaacggattccatcacgaagactgcatgaacatcatcatgaacgatttaattgagctgatggacccgcgctacatcgaagtctggggcaaattcacgccgaggggcggaatctcgatcgacccgtacaccaactacggcaagcccggcacaaagtataaaaa

SEQ ID NO: 2575 - DNA, 168 bp, Bacillus licheniformis
acaggattaataacgagaagtcgccatacctactccagcatgcacacaaccccgtcgactggtacccgtggggcgaagaagcctttgaaaaagcaaagcgcgaaaacaagccggtacttgtcagcatcggctattcgacttgtcattggtcaatggttgtattccata

SEQ ID NO: 2576 - DNA, 157 bp, Bacillus licheniformis
atgccaaacaaaagtaaacccaatagattaatcgctgagaagtcaccgtacttactccaacatgctcataaccctgtggactggttcccttggggagaagaagcatttgacaaagcgaaaagcgagaacaagcctgtactcgtatctattgggtata

SEQ ID NO: 2577 - DNA, 546 bp, Bacillus licheniformis
atgctgaaggagggcaaatctttgaaaacgctagttatcgttgcacacccaaatttagaaacatcagtggttcataagcgctgggtagaggaactcaaaaaatatccggaaaagtatacggttcacgaattgtccgacgtttacccggatggaaacatagacgcggaaaaagaacaaaaattggtggaatcgcacggcaatcttgttttgcaattccctatctattggtttaactgtccgcctcttcttaaaaaatggcttgatgatgtattagcttacggctgggcttatggttcaaatggaggagatcgattaaacaatcgtaaagtggcattaggtgtatccgccggaattaaagaggaagattatcgtgaaaacggaaggtaccggtatacgcttgaacaaatattagttccatttgaaacgacattccggtattgccgcgcagattatcgttcattttttgcattttacggcaaggaaaaagagcctggcggaaacgaggaagaagaaaatgagccgggagcaggtgaattgcagaaatag

SEQ ID NO: 2578 - DNA, 301 bp, Bacillus licheniformis
atgaaaaagctgattgtgtttgtcttgataggattatttgcgcagctgatagatggcgccttagggatggcgtacggggtgacatcgtcatcattgctgcttgccttcggcatcgcaccggcgggtgcggtagcattcgttcacctggcgggagtcgttacaaccggagcatctggtgtgtcgcatataaagtttggaatcgtggataaaaaacggtaaacgactcgtaattccaggatcgatcgggcatttcattgggcttcttttaagcaacatccgggggagctggaaacctaatatt

SEQ ID NO: 2579 - DNA, 252 bp, Bacillus licheniformis
tgagaaggttcagcggcacgacgcttctacacgatgaagccatttatgtgcatcaaggcatccaataccacgtggaaaagcttgactgggatgagaaaaatgcgtttgtccgcgaggttcaagttgattactataccgatgccaatcttgccgtcttgctgatatttctcgaggttgacaaggagataaatacggaaaccgcatcgttcggttttggggatgtgaccgttcaggcaaaatctatttattttt

SEQ ID NO: 2580 - DNA, 243 bp, Bacillus licheniformis
tcaaagggaaggaagtatatctgccaatgaacgattcaggagaagcagcgatcaacctgttaacaggcagccatgctgataaggataccgatacgcctgcgtacaaagaaacatcagccaagatggaaattttgaagcgcgacggaagcaatccgctgcctaagatcaatcaccgcaacggcaatccgcagccgcaaatcggtgtgcaggtacaaaagaaatgggcgcggaaggattatattt

SEQ ID NO: 2581 - DNA, 184 bp, Bacillus licheniformis
atgccatacgtaactgttcaaatgctggaaggccgcacagatgaacaaaaaagaaatctcgttaaaaaagtgaccgaagccgtctccgaaacaacaggcgcacctgcagaaaaaatcgcggtcatcattgaggaaatgaaaaaggaaaactacggtgtcgccggcaaacgaatgagcgatatgt

SEQ ID NO: 2582 - DNA, 574 bp, Bacillus licheniformis
atgcagactgccgttatatatgcacacccaaatccaaacagtttcaacggagccattttaaatcaagtcataaaggcgcttgaggacggtaagcatttttatgacgtcattgatttgtatagagaccggtttgatcccgttctattatttgatgaaaagaaaaggcgctcagatatgaatcgcgatccggaaactgccgaatatcgaagaattgtcaaaaacgccgaccatctgattttcatttatccgctttggtggggcggaatgccagcgatcatgaaaggctttattgaccgcgtttttgccgccggagaagcctatacatatcaaggaaagctgccaaaaggcctgctgaaggcgcgcacggcatcagtttactacacggctgacgctccgtcttggtatttgcggttttggcagcgggatgccgactgggtgacggttaaagatgtgatgttgaagttttgcggcgtacggcgggtaaagcgcctgctgtttgccggcgtgaaagacagctctgaagaaaaacgcacgcaatggcttgaccgtgtctaccggtctatagctcctgcag

SEQ ID NO: 2583 - DNA, 2879 bp, Bacillus licheniformis; identical to SEQ ID NO: 2331
  misc_feature (1)...(2879): n = A,T,C or G

SEQ ID NO: 2584 - DNA, 234 bp, Bacillus licheniformis
atatttaattgcattggacttagacggtacattattaaaagacgacaagaccatctcggaaagctccagcgaagtcatccgcaagctgcgggaagatggacattacgtgtgcatttctacgggaagaccgttcagagcaagctccatgtattatgatcagctccagctcgatacgcccatcgtcaatttcaacggcgcgttttgtccatcaccctaaagatgaaagctggggac

SEQ ID NO: 2585 - DNA, 480 bp, Bacillus licheniformis
atgaaaacattgaaattgccgggatatatcgaagaaccgtttgacacatggtgtcagtcattttctttttttgatgaagtttccgtccgtttttcagaaacggacatgttcggtcatatgaacaatgtcacaccgtttgtctacttcgaagaagcgaggatttcctatttcaagcacctgggcgtcatggaccgcctttcagacgggaagagcgcggccattcccgtcgtggcgagccagcaatgcgactattttcagcaggtcatgcttcatgaacgtttaaaaatcggcgtcaaaacagcatctgtcggcaacgcctcgctcaccctccattacgcagcgaaaaatggggaaggcggcctttgctttacaggactggcggttatggtgcaaattgcgaaagatacgggtaaacccgtgaaatggacagacgaacaaaaagcaaaactgcttggcaataactcatttcctgagaaataa

SEQ ID NO: 2586 - DNA, 447 bp, Bacillus licheniformis
atgaacttggttggattttacatcgcgaaaggagaagcgccatgcgtgaacataaaggatgtatcaagtgcggaagcacagatgcggggcaaaaagaaatcgcgacgaccggcaccggcctgtcaaaattgttcgatgtgcagcataaccgttttctcgtcgtttattgcaaaaactgcgggtattcagagctgtacaataaacaatcttcaaccgccggaaacattctcgacctgttctttggaggatgacggctcgaaaggagaaacggttatgggggaaaaatacggttcattgattgccatatttattttggcattatgtgtgcactccaacattgtcgtagaacatgcgctcttacagacaatcataaaggcagtttcactttttgtgatgatcgcttcggcgcttgcagcatttgtcaaaggcatcagacaaccgtcataa

SEQ ID NO: 2587 - DNA, 227 bp, Bacillus licheniformis
atggagtggaaactaaaatcgtatgaggaattgtcgaaggaagagttgtatcgcatcatcaagctcagaatagacgtctttatcgttgaacaaaactgtccgtatcacgagcttgatcacttggatgagcgggcgcaccatttatttctgagccaagaaggagagatcgctgcgtattgcaggctgttcccgagcggcacagcataccccgaggcaacatcggctgg

SEQ ID NO: 2588 - DNA, 371 bp, Bacillus licheniformis
caaaccaaaatgtcacaacatcttttcctgttcttcatgcaggacatgttccggaatacgaagacctgtcaaaatggaatttgcaaatttacggacttgtcgaacagccgctcctgctgacgttggatgatcttcatgagatgccgcaaagcgaagtgtccaatgacattcattgtgtaacaggctggtccaagctcgataatgtttgggaagggatcaagacaaaggagatcgctgaaagagtaaagccgcttccggaagccagatttgtcatcttgcatgcagaggaaggctggacgacgaatgttccgctcgaagactttttgaaggattcgtctcttttggctcattgccataacggcgccccgctc

SEQ ID NO: 2589 - DNA, 336 bp, Bacillus licheniformis
tcaggtcgctcttttgtttttattcgcccgtttcatgaatctgattgtcgaggttcttcatataaacattcccggcagcattctcgggattatcgtcatttttgcgcttctccatttcaaaatcattaagctggaatggattgaaatcggcgcgctgtggcttctcgcggagctgcttttgttcttcgtcccttcagccgtcgggattatgaactacggagatattctggctgaattcggcacaagcattatactcgttgtcctcatcagtacattcgtcgtcatggtgtcgaccggaatgctgactcaattgattgccaaaagaaaggaaagaaa

SEQ ID NO: 2590 - DNA, 267 bp, Bacillus licheniformis
ccgacggactgaaggacactgcggagcaaatgctggagatgttcctctttccacagagcgagcgacacatcttgttccacatcctgcccggcttggatgacacgtccccctatctcttgaaactgctgatggaagagccaaacgtccgattcctcgatgagcccacaaatgacgatgatacgcagaccctccggatgctccaaaattatttgggaacaaattcgcggtgactgatcctcaccgtagcccgtgaccgatgtttccttc

SEQ ID NO: 2591 - DNA, 213 bp, Bacillus licheniformis
tcatcaccgcattgcctttgatggcgaacgtctcttatgtattccgcgcgattcttgaagaaatcattttcacacagatcattctcagtgcgatctatgaaaaagcgaattttttcgccgccgctctgtgcagatcggagctcttctcgggcgtccattaggattacaggcatctgctcatttatacggcaatgggattcacattcgcctttt

SEQ ID NO: 2592 - DNA, 408 bp, Bacillus licheniformis
atggatggaacactgttaaatgacgaacaaaccatttctgatgaaaacagaaaagcgattaaagaagctgaggaaaaaggggtttatgtcgtgcttagcaccgggcggacgctgatgacgtgccgggagttggcggagtcgctcgaactgtcttcttttttgatcacggcaaacggcagtgaaatctgggattcgtctttcaacctggtcgagcgccagctgcttcatcccgatcatgtccaaatgatgtgggatttgcgcaatctgcacaacaccgatttctgggccgccagtgtcgataaagtgtggagaggcgagtttcctgaggatatacaagcgtatgaatggctgaaattcggctttgatattccggatgacgacgtcagaaaccgggtctggaagagctaa

SEQ ID NO: 2593 - DNA, 409 bp, Bacillus licheniformis
atgaaaaaggctacacatgccatgcgccccaatataaaggccacggcgtgcctccagaagaacttctctccacaggacctggaagattggtggaaagacgtcatggacggatatgaatatctgaaatcggaaggatatgaacaaatcgccgcttgcggactgtctctcggaggggttttttcattgaaattgggttacactgtacccataaagggaattgttccaatgtgcgcgccgatgtacatcaaaagcgaagagacgatgtacgagggtgtgcttgattatgcccgcaattataagaaatttgaaggcaagacagcggagcagattaacgctgagatggaagaattcaaaaaaacgccgatgaacacgttgaaagcactgcaggatttgattgccgatgtcagag

SEQ ID NO: 2594 - DNA, 426 bp, Bacillus licheniformis
aagcatcttgatccgtttggaaacgattttgatctttatattgggattcggctgggcaaagccggtgcccgttaaccgcttttattttaaaaacccgaggctggccggatttctcgtgtcaatcgccggaccgatcagcaatctgatccttgctttcatcggttttatattgctgcttttgtccgtgaagctgtccgggacgctgcctgccggtttttacagcggtttgcttcaattttttacgatttgggtgaatctcaacctgcttttatttctgtttaatttaatgccgttcccgcctcttgacggttttcgggttatacaggatgtggtcgcccccgaagtgcgggcgaagctgtcgaaatatgaggcgtacggctcgatcgtctttctgattatcgtcattacaccgcttggccaatatgt

SEQ ID NO: 2595 - DNA, 182 bp, Bacillus licheniformis
atggcaaaaggtatcatgctgcacgaagttggcgagcaggtggatttgtacttgctcattaaatcgtcaacgaaaggaatcgcaagcaacgggaaaccgtttttaacgctgatgctgcaggatcagtccggagatatagaagcaaagctgtgggacgccaagcagcaggacgaagtgaccta

SEQ ID NO: 2596 - DNA, 129 bp, Bacillus licheniformis
acatccgtgaagaaatcgcagatattttgatctactctttcatgctgtgcaacgatcttggattggacgtgaaagagattgtggaagagaagattgtgaagaatgggaggaagtatccggttcatcata

SEQ ID NO: 2597 - DNA, 212 bp, Bacillus licheniformis
tcctgatggttcggtttaacgaataccggcgaacggatgttatagcggcgatgacggaatcgatgaaaaatatgggatcggttattatttcagccgctgtcatcttggcgggaaccttcgcggcgatgctgccgtccggcgttttatcgcttctgcaaatcgccacccttgcgctgacgggtcttttgctgtatgcattcgtcaagctgcct

SEQ ID NO: 2598 - DNA, 144 bp, Bacillus licheniformis
tcgaaatccggacggatttaaagggaaatgcggcgtctgtgaattccgtcatgtgtgcggcggttcgcgctcgcgtgcttatgctctgacaggcgattacctagaaagcgatccgagctgcatttatattccgaaggctttgcg

SEQ ID NO: 2599 - DNA, 216 bp, Bacillus licheniformis
tgtgaaagatatcatgacaaaggaaacattatattgtacggttcttgataatgtatacgaggctgccgtgaaaatgaaagacggggatgtgggagcgattccggttgtgcttgatgacggcttggaactggttgggatcgtcactgaccgggatttagtgctgcggggaatcgcagctaaaaaaccgaattcgcaaaaaattacaaatgtcatgac

SEQ ID NO: 2600 - DNA, 726 bp, Bacillus licheniformis
ttgatactgggcatttatccaagcatcgcgggcaatgcggaggatattgagaaaatgatcaaatcgatgccggaaggctttctcaatgcttttgggtttgaaaacggacttgggaatcttgaagattttatatctggagaatattacggattaatctttatcgtgatcttatcgatcttctctgtcatgctgtcgacaaagcttttggcaaagcgggtggatcaagggtcaatggcctatattctgtctgcgccgacaacgcgcggaaaagtggctttcacccaagcagccgtcttaacgacaggtcttttgatcattatggccgtgacgacagcggccggactggccggctaccatttgatgctgggcggtgattacgattttaatgtgtcaaggttcctcgttctgaacctgcttggctttctgctcttctttgcagtcggcggcatttcgttcctcttttcggccatttcaaatgatgaaaaaagagccctcggactttccggaggcatcacgttcttattcttcagcttcgacttgctaggcaaattaagcgaaaaaacagaatggctgaggagcctgtcggttttctctttattcagaccgggcgatattgtgaacggaagcaccgacatcgctcaagtgtctcttgttctcgccgcagtcggttttgccgccttcgcactcagcattctcatttttaaaaagcgcgacttgccgctgtaa

SEQ ID NO: 2601 - DNA, 354 bp, Bacillus licheniformis
atgaagatgcacggtctcaccaagctcgtcaacgacttccatgacttcaccgcgtttatcaggaggcagttcatccatttcggtatgcttgccgagaatttgtttgagctcactgttgaccacgccttgaagggtttgcgtcatcgccttttttgtcaccatttgaacggtctgcgacagctgcgacgtgtaaaccacctggtgaactcctccgcctgcgagagcgatcccttcgacttctttcatcgcctcctgatccatttcatgctcgtccataatcccaatcacattcacggtaattccctgctctttcgcaaaggcagccatggcctgcgggtcttcgccgcggtttga

SEQ ID NO: 2602 - DNA, 444 bp, Bacillus licheniformis
cgaaaatgtcgttatcgaagacggggtccgcatttttcatccggaaaacatctatatcggagataacgtttatatcggccatgacacgattttaaaaggctattataagcatgacctgatcatcggttcaaacagctggatcgggcagcaatgttttatacacggtgccggcggggttacaatcggagaatttgcaggaattggtccgaacgtccggatacatgccgcttaccataccgatcctgataaacccgacagtaccattttgttttcgccgcttacattcgctcctattcatattgaagaaaactgcaacatcgggatcggtgcgtctatcctagcaggcgttacgataggcgcccactccaaaatcggagcaaatgccgtcgtcaatcgcaatattcccccgtacagcatagcagtaggcgtgccggcaaaggtgat

SEQ ID NO: 2603 - DNA, 348 bp, Bacillus licheniformis
atgctgcatcaggcggcgaaatggtatgaagagggagagtatgaaaaagtaaaggatgctttgaaggaagcgggctcaaaaccggacgcttccagcgacactttaaggctgctcgcttattccgaaattcggctcggcgagtatgaaaacgccgagaaaaggtttgaggccgtcgttgaaaaagatccatcggaccacgcctctctctatagtcttgcctggctttatacccaaagaggcgagcttgccaaagccgagcagtccattgaaagagcgttggcagaaaagcctgatgaagagatgtataaaaagcttcgggacgaaataaagaaagaaagcgcccggtaa

SEQ ID NO: 2604 - DNA, 148 bp, Bacillus licheniformis
atgaaagtattagtgctcgcatttcatccgaatatggagcagtcagttgtgaacagagcatttgcagacacattgaaagacgcaccgggcattacattgcgcgacctttatcaggaatatcctgacgaggccattgatgtgggaaaag

SEQ ID NO: 2605 - DNA, 324 bp, Bacillus licheniformis
atgctccatttatcaggtccgtcggtaaattttttttgtatgacatccatcgcattttcagaaggtgtgtcaggtatggacatatcctccgaaaggcttggttttaacgtgatagcaaggcctatggaagcaaatagcgcatcgatccatgcgcatattacttttatgcgattgcgagctacccatcctcctaatttatataacatttttgacatgataatctcctttcacacattgcttgatacattctttctcattgtagtggacaatgaaataaaaaaaacgtacattcgggcatgtacgtttgggcaaattttaatttga

SEQ ID NO: 2606 - DNA, 321 bp, Bacillus licheniformis
atgatgcggttcggggtagtcggaacaaattggattaccgaccggtttcttggggcggcccgtttgatcgaagattttcaattaaccgcggtatattcaaggaccggagagcgcggacgtgaattcgcgcagaaatacggagccgaggcggtttttaccgatatcggagaaatggctgagagcgatgttattgatgcggtatatatcgcaagtcccaactctttacataaagatcaggcagttacattcatgaaaagcggaaaacacgtcctgtgcgaaaaacgcttgcgtcccatgtcaaagaagcggaagaaatggtaa

SEQ ID NO: 2607 - DNA, 126 bp, Bacillus licheniformis
ttatcaaccggcaaaagagttttgaccaaaaatcagacatgggtatgttatatctcgtaccgactcccatcggcaatttagaggatatgacatttcgggcggtttctgtgttaaaagaggcggaca

SEQ ID NO: 2608 - DNA, 261 bp, Bacillus licheniformis
tagtctgttaaaactccagcttgatttaggctttgaaaaacgccaagtcgtttcaggaattgccaagcactacaaacctgaagagcttgtcggccggaaagtcatttgtgtaacaaatttaaaaccggtcaaactaagaggagaactttctcaaggcatgatattggctggagaggacaacggcgttctctcgcttgcggcggtagacagttcattagcaaacggaacgcgaatcaaataaatgcaggcaaagggtgttcc

SEQ ID NO: 2609 - DNA, 768 bp, Bacillus licheniformis
cgcagccggccgtcttacagcaacgggtattaagcaaagtacataacggcgccatgatattaatgcatccgacagatccaactgcaaaaagtcttgccgttttgatacagaacctgcatgaaaaaggctatcaaatcggaactgtttcacagctgatgaatgaaaaaaggcttgttgaagaataggatgtgcggcccgttctttgaataggaggaacaaatttgattaaacggtatacttgtcaaaatggggtaagaatcgtattcgaaaacaatcccaccgtccggtctgtggccatcggagtttggattggaaccggatcaagacatgaaacacccgaaattaacggcatttcgcactttcttgagcacatgtttttcaaggggacaaaaacgcgcactgcaagggacatcgcagagtctttcgatagaatcggcggacaggtcaacgcgtttacctcaaaggaatatacgtgctattacgccaaagtgctcgatgagcatgcaagctatgctctggaagtgctttctgacatgttctttcattcatcatttgacgaagaagaattaaaaaaagaaaaaaacgtcgtctatgaagagattaaaatgtatgaggacacacctgatgacatcgtccacgatctcttgagcaaggcgtcatacggcagccattccctcggctatccgatcctcggcacagaggaaacacttgccgaatttgacggagattcgctcagaaaatatatgaacgaatattacacgcctgacc

SEQ ID NO: 2610 - DNA, 363 bp, Bacillus licheniformis
tgaatccccgttttagggactttctttttgattggtcgcagaagttttattttctcgttggcggttacggatcatccaagagctatcatgttgctctcaagctgattttgaagatgctacaggaaaagcggacagccttagtcgtccgtgaggtctacgacacccacagggattcgaccttttccctgctcgaagaaatcattaccgacttagggcttgaccataaaatccggtgtgtcagctcaccaatgcaaatacgattcccaaacggcagcaagatcatttttaaagggatggacaagccggcaaaactaaaatcgatcaataatgtatcaattgtatgggttgaagagtgttcagaag

SEQ ID NO: 2611 - DNA, 270 bp, Bacillus licheniformis
atgggtaactacttttttggcggataccgctcttttttcccttcaagtataagccggtcaattttagttgcccgcacttttacgatcgcaaattccgttgcaacaaaaaacgccgttaaagcaatcaataccgcaaaaataattaaattaatggctgtcaataagtcgtcttactttaaagtaagacttacacctcccataaaagaagaagcatttgataaagctaaacgcgagaacaagcctgtactcgtatctattgagtatagctag

SEQ ID NO: 2612 - DNA, 243 bp, Bacillus licheniformis
acagcagatgaaaatgattgcggtcgatttagacgggacgctgttaaacagtgaaagcaagatctcaaagaaaaatatcgatgcgattaaaaaagcgcgggaacacgggattgaagtagtagttgccacggggagagcatcctttgatgttcaaacgatatttgagccgacaggtattaaaacatggattatcagtgccaacggagcggtgattcatgatcctgaaggcagccttaccaaacg

SEQ ID NO: 2613 - DNA, 249 bp, Bacillus licheniformis
gaggggaagtttccgaatgttgaaagacggaatgacctatatgcatgaacatacaacgatagacctttccaaagtaaaaaacaatgaggattgtaagttggatgtatttcctgaaaccgtcagagaatttaaaagtttatacgaaaagggcgtacggaatattgttgatgttacgaatattggaatggggagaaatattacatacgtccaaaaagttgcaaaagaaacaggcattaatattgtcttttc

SEQ ID NO: 2614 - DNA, 204 bp, Bacillus licheniformis
atgaacgcattttataatccagaaggcgtaggcgatacgctgctcatctcattgaacgattttccacgtgaaagagatcgctttttgaccggacgggacaccgtgtgaaaatttttcataaagacacaaaggaaacaacgcggcttaaccattttaatgcctcctcatctttgaaccttggaggaaaccggaccttcggccctt

SEQ ID NO: 2615 - DNA, 225 bp, Bacillus licheniformis
atgaaacagcggaagagagccgtcacggtattctttgatgatggtaaaagtcgggctgctgacaacccgcttgatgccgatcccttcggcaaaccctttcgtaaaagtcgttttgcctgctccaagatcgccctccaatgtgatgacatcaccgggctgaacatattttgccgccagcctggcaatgttttttgtctcttcaggctctgtcgttttccactctaa

SEQ ID NO: 2616 - DNA, 162 bp, Bacillus licheniformis
  misc_feature (1)...(162): n = A,T,C or G
tatcgagaccattcaaggggtcaatatatattatgaacattacgagaatccaggcaagacatcgctcgttttaatacacggttttctttcttcctcgttntgctacagaaaaatcattcttcttctgaaggatgagtttaatttagtcgccgttgacctgcc

SEQ ID NO: 2617 - DNA, 210 bp, Bacillus licheniformis
atgccgccggagaaacaacaagatatcttttcttctcatttcactcatagtgtcggtatgaaaaatatcaaccgcaggctgaaacacttctgcggaagtgaactgaatatcgaaagtacgcctgatagcgggaccgctgtctcaatggtcatttctatcaatgaatccgcggacgtctcagactccgccatccagcgggcgcctctataa

SEQ ID NO: 2618 - DNA, 291 bp, Bacillus licheniformis
tccctttcccagacggcaaagccattctctatcctgtgcattggacagaacctgaagagttcggagaggaatatgatatccacgtcaacaatgggcggctcttggagcatttccacgaagggaacctgacctacaaatcaaaaggcatttcaaagaaaacaccggaagtgttcttagaaatttctcctgaactcgcggcagaaagggggattcaggacggaacccttgtcagactcacatcgcctttcggaaatgtcaaagtgaagtgcttgatcactgatcgtgtcaaag

SEQ ID NO: 2619 - DNA, 870 bp, Bacillus licheniformis
atggatttttatcttgtggatgtgtttgcagaaacaaaatatacaggaaaccagctcgctgtttttaaagcagaaaagaacctatcaagtgatgaaatgcaaaaaatagccagggaaatcaatttttccgagactacttttatattgggaaaacagggaaacggcgggtacgatgtccgaatcttcaccccggaaaaagaaattccgtttgcaggacatccaacgctgggcacagcgtttatcattaagaatgaaatcgaaactgaaccatcttctaatgtcattttaaatgtaacagcaggcgcaataccggtgacgtttgaaaaaggtgctgatcaaatcatttggatgaagcaaaatccgcccgtgtttaaccgaacctttgataaagaaatgatggcgggggtaattggaatcgacacatctgatatggattcgaatttcccgatacaggaggtttctacagggcttccagcggttatcgtaccgttaaactcgttaaatgcagttaaaaaatgcaaaatcaacaaggatcggtttgaagctttcatgaaagaaacagaagcaagtctgctcgtttttactaccgaaacatatcatgaacaaaaccacatcaatgcacgagtatattgcgactgtttcagcgttcctgaagatccggcaacaggaagcgcaatcgggggtctcgcagggtatttactgcatcacggctattttaatcaacactacctcagcataagggctgaacaaggatttgaaataaaccgcccttccctgcttcatcttgaagcccaaataacggaaaacagcacagaaattcacgtcgggggaaacgtccacctgatcgctaaaggaagttggcaaatttga

SEQ ID NO: 2620 - DNA, 2140 bp, Bacillus licheniformis; identical to SEQ ID NO: 2290

SEQ ID NO: 2621 - DNA, 1984 bp, Bacillus licheniformis; identical to SEQ ID NO: 2289

SEQ ID NO: 2622 - DNA, 3496 bp, Bacillus licheniformis
gtgggagcagtatttttatcaggcagatccgggagtgggaaaacgacctttatcctgaatgaaatcagagaaaaacttcgcgatgaaccgctcggaaaaccgatcatttttctagtcccggatcaaatgacgtttttaatggaatacgagcttagcaaaacaccagatttgggcggcaccatccgcgcccaagtgtacagtttttcacggcttgcctggcgagtgctccaacacaccggaggcatgaaccggccgttcttgacgggaacgggcattcagatgctgctgcggagactgattgaagagcataagggcgagtttaaagtctatcaaaacgcaagcgataaaagcggatttacggagcaggtggaacggatgctgaccgaatttaaacggcactgtctgccgcctcaaagcatccgggatatgatggaagggacaggcaagtcggaatacgaagatgaacggattctttccgataaattgcacgacttatatattttgtacagcaagcttgaggaaaatctggagaatcaatatgttcaatctgaagattatttgacccttttagccgaacagattccgtatgcggaagagattagaaacgctgccgtttacgttgacggatttcaccaattcacgcctcaggagatgagcgtactagaacagctgatggtacatgccgaagagatcacgttttcgctgacggcggataagccgtttacggcaaacagcccgaatgatctccatctgttcaggatgaccgggaaggcgtactatgacctttaccaaaaggcgaaggaactcggccttgatccgtctgaagtgcggctggaagaaacgaaacggcaccggcatcatccggagcttcagcatcttgaacgctattttgatgaacgtcctgcaaaaccgtatcccggacagacggaatcgctccgcatcatgcaggcgtcgaacagaagaaccgagattgaaggaattgcgcgcgagattcattctttaatccgccagggccggttccggcttagggatattgctgtcatcgcccgcaatgttgaagattataaagatacgataaaagaagtttttaaagactgcgaacttccttttttcatagacggcaaggaatcgatgcaaaatcatccgcttattgagctgatccgttcgacgcttgatatcattaaaggaaattggcggtatgaagccgtgttccgctgtgtcaaaacggagcttttattcccggaaggacagccgaaggaacggctgcgcgaacagattgaccagcttgaaaactactgtattgcttatggcattaaaggagacagatggacaagcaaagatccgtttgtttacagaagatacgcttcactggatgaggattttgccaagacagacaaagagattgaaacggaaaatatgctcaatgaactaaagggctggatcgttccgccgattcacaggctgcagaagcgcttgaaaaaagctgaaacagtaagggaaatggccgaagccgtctacctttatcttgaagaagccgatgttccgatgaagcttgaacaggaaaggcggctagccgaagaaggcggaaggattgccgagtcgcgccagcatgagcaagtatgggatgccgttattcaactgttggacgagtttgttgaaatgatgggcacagagcggatttcgtttgcgttatttcagcaaatgatcgaaaccggattggagtctttgaaattcgcgctgattccgcccgcacttgatcaagtgtttatcggcaatatggacctttcaaggatgtacggcacgaaatgtacatttctcatcggtgtaaacgacggcatacttccggcgaggcctgcggatgacggcgtgctttcagacgaggacagggagtggctgaaacgaaacggcgcacagctggcggcaacagggcgagagcagatattggacgagaattttctgatctatatgacgctttcaagcccgtctgaaaagctttatgtctcctatccgatcgctgattcggaagggaagacgctgcttccttcaacagtggtgaaacggctgaatgaactgttcccggacagcgaagaaaagatgctgattcatgaacccgagcagctggacgatgaagcccagcttgaatttctcgtgaataaaggcatcgccttgagccatttggcagggcagctcggcatctggacgaggcagtatgcgatcagcgatgtatggtggagtacatacaactttttaatgaatgagcctgaccgcatcttttctcaaaacatcctgtccagcctgtttttcagaaacaaggtcgaaaacctaaaccggcatgtgagccgcgatttatacggggagcacattcagggaagcgtgtcgcggatggagacgttcaaggcctgtccgttttcccattttgcttcgcacggcttaaagctgaaggaacgccaatttttcaagcttgaagctccggatatcggtcagctgttccactctgcgctgaagctgatttcagaccggcttcacgagcttaaactggattggcgcgacttaacgaaagcccagtgcgagactttgtcaagcgatgcagttgaacggcttgcgcctaaactgcaaaaggagattctgctcagttcgaaccgtcatcattatgtgaagcagaagctgcaaaaaatcattgccagggtatcgggcattttaagtgagcatgcaaaagcaagcggctttgcccccgtcggcatagagctcggattcggagggaaaggtccgcttcctccaatgcgtttcaccttgaagaacggttgcacgatggagcttgtcggccggatcgacagagtggataaagcggagagctcaaaagggttgctgcttaggattgttgattataaatcaagcgataaaggcctcgatttggccgaggtgtattacgggcttgccctgcaaatgctgacatatctcgatttgtcgatcacgcattcaaccgattggctcggcatgaaagcatccccggcaggcgtgctctattttcatgtgcacgatccaatgatccaggcttcagtgccgctcggccttgatgaaatagaaaaagagattttcaaaaagttcaagatgaaagggctgctcctgggagaccaggaagcggtcaagctgatggacaccaccctggaacaaggcaggtcgaatattatcagcgccggtttgaaaaaagacggctcgctccgttcggattctgacgttgttgcagaagaggattttcatgtattgaggcgtcatatccgccggacatttcagcaggccggcgaggagatcacagacggcaaagtgtcgatcgagccttacaagctaaaagaccggacaccgtgcacatattgttcataccggtcattctgccagtttgacgaatcgcttgaggaaaacgaataccgaatattaaaacctgaaaaagacagcgtgatattggagcggctgaaaaaggaggatgaggcagatggagatt

SEQ ID NO: 2623 - DNA, 3621 bp, Bacillus licheniformis
cgccgacacggtcattttatattacaagcagcatgacgaattgccgtatcgggcgattccgatggaagttgagccgggcagacagaacgcctatattgccaaattggaaagcgaatccatagcatccggcaaagtccagtactacattgaagctcaagtcggcgactcctctgtgaagacggatgtgtatactgtcgccctgaaaggcatgcgtacagatacacaaaagcttccggagctgttgatcacggaaatggtagtcgacacgtcaaacaccggtggaaaggacggctatgaatttattgaagtttataacaataccaataaagctgttcatctgaacagctacaaaatcaagtacagacatcctgaaaagggcaaggaatcagacgtcatctggccttttgagcacgatgatgtggcgattccttccggtcaaacacacgtgttttgggtgaaaaaccgctcaaacggtcatctgacggaaagtgatttcaatcggtattacggtgttcaccttcgtgaaggcaaaacgcttactgctctcaaagggggcggcatggagaatacggcgccgagagaggtgatcatctgcacaaacagcggagaagaggtcgcatccgcccgttatcaaagcgagccggataaaaccgatgtcgccaaaaataaagcgcttctgtatcgatatccgctggacggaacgaagcatatgaaaatcatatcggccggggaagaaaaaccgtcgcctggttcgcttctgaagacgcaggcaccttcacagacggtgacggttatgccggacagagaaaagccggagatccatgatatgacggatcatcaagctgtaaaaccgggtgaaacgatccagctcttagctgatatgaaagacaatcggcaagtgaagcaggcgcagtttttctaccgcatgaatgatgatgagcggtttaccgaagtccgtgttgaaaaaagccgcaatgacggcctgtaccgccacaatatctattttgccgaactcattggcaaagaaaaagtggagtactatatgcgggccggtgatggatcaaatgtttcgtcgactgaaaagaaaacgataccgctcgaacagcgcattttgaagggactcaggctgaatgtaagcgaaggcggaaccgtttccggaaaaatgctgttgaaagccacatcagaaaagccgccttctgaaacgacaattcgtattgacgggattgaacaaaaagaaggtgaaccggcgcttgaaaaaaaagcctactttgctttcgatgtcaatcaaacgaatctgtattttaaaaatgctgtaacgatcggcaggagagttcaaaaagtttttgacgattcgcgccgccggtatgcgacaattacggtcccggtttctccggatgaatttaaaaaaggaaagccgttttcgattaaagttcgttcaggcacgaaatcaacaccatttgaacaaactgcagaagaaaacagggatgattttgtcctcaagaacccccgcctcatactcgcggatgggaccatcatccgcgatgagcgatacgacgatccgaaagccgagcttccggccggtgacggccctggggcgcatgaatggtatgaattccgttttacgattccggaagccaagtttgcatcgcttgcgagtcaatggcatacacgcgcctggaacgaagggcagcacatcgttgaagcggagaatggcgaagaaaggctcatccgcagggtaacggtcgataacacaggtcctgagatcaaaacgtcattaaaagacggcaggacgtataaagggtcgtttgagatcaatgcggccgcacacgataaatggagcgggatgaaaagcataaaagcctttcttgacggcaaaaagattgcgcttccctatctcgtatcttctgcccgcctggatgcgggaaagcacgagttgaaaataaaagcggaggacagcgccggcaacctgtcaatcgtaaaaaaggcattttacattaaagaggaaaagccggacaagcccgctcgggtcaaaaatacacccggcagcacacatgctaagctcgccgtccgcgtcaaggacccgacaaaagataagatgaaagtgtcattccatcagggatttcagtacacagtaaaagacgaagagcatgttgatgtgtcagcgaacgaaagcgggacggaacctccgcaaagctttgcggtcaggggggaaaaggcgctgacaaaagaagagcgcagcggcatgtccgcacttgacggaaaaggttttgaaacctcatcaacaacaaagtttccgtaccatcgctttgatgtaaaagtggatgaaaatacggggccgaacgacaaggtggaagtgctgtggcgcgggagttcgcttcccggcagaaaagtctccatgttcgcctggaactgggccagcaagaggtgggagacgcttgcattccatgttgcaaaggatggcaaaccttttaccctcaaaggaagcataaaagccgccgattatatccgccaatccaaggcgagcatcatcattcaggatcaaattcagctttcgcaaaatgactatacatttgtgtggatgtctgatacgcaatattattcggaaagctatccgcacatttttgaacgtcaggtcaagtggatcgcggaacaaaaggacaagctgaacattcagtacgtctttcatacgggggatcttgtggatgaagcggatcagccgctgcaatggaagcgcgccgaccagttcatgaaagttctcgacgacaatcaagttccatacggcgtgctggcgggcaatcacgatgtcagccataaagaccggtcatatttgaaattcggcaggtacttcggggagaggcgttttaaacaaaaaccgcattacggcgggtcttatcagaataacaaagggcattacgacctcatttccagcgggggcaacgactatatcatggtgtcgatggggtggggaatcggaaaaaaagaactgcagtggatagatgatgttctgaaacgccatcccgatcgaaaagcgattttggcatttcacgagtttttgcttgtcagcggaagcagaagtccaatcggggagaaaatatttgaacagatcatcaagcggaatccgaatgtgattgccgtattgagcggtcactatcacagctccaacttaaaagtcgacaagcttgatgataacggggacggcaagccggatcgcaaggtttatcaaatgcttgccgactatcagggcggtcctgaaggaggccaaggttatttaagaattctccatgtggatccgaagcatgacacgatccatgtcaaaacgtattcgccatatcttgatgactataacttttatgatccgcaccaatttggcccgaaggacgagttcaacattaaaacggatctgaaaccgaggaagaaaaaggttaaaaccgattattttgagctgaatgtcttttcgaacaaggaaattgggaaagcaaaaacggtgaaaagcggaaagacggcttccgtgacgtggaaagatttgcagccgaatacaacctatttctggtacgccgcagcttcagatcaatacggcggcaacagcaggtctcaaatgtggagattgacgacaaaagacga

SEQ ID NO: 2624 - DNA, 1659 bp, Bacillus licheniformis
aacctttttctgtttcattaaagggtatcaaacggaaagaagtggaccggtttcccgatacatcgagcacaaactatcaggatgcagccggggatttgaacgccgttaaccaggtgcgcgccgttttgaacggcagggagcaggctccttctgaatccgtcggcgtattgaataaacaatataaatctgttccgctgcaaaaaccggccggagaaaaaacgcctgatggggtgtcatacacatacagcgccaatgatgcgagcgtaggcgaccttgatggagacggccaatatgaaatcattctcaagtgggatccttccaattcaaaggataattcacaggacggatacacgggagatgtgctgattgacgcatacaagcttgacggcaccatgatgtggagaatcaaccttggcaaaaatattcgcgccggcgcccattatacgcagtttctcgtctatgactttgacggcgatggaaaagcggaaatcgccatgaagacggcagacgggacgaaggacggcaaagggaaggtgatcggcaatgcaaacgccgattaccgcaatgcccaaggccgaattttgtcagggcctgagtatttgacggtttttaaaggcgatacaggcgctgagcttacaacggtcaactacgaacctgcccggggaaatgtagccgattggggagacagctacggcaacagggttgaccgctttctggccggtgtcgcataccttgacggggagcggccgagttttgtcatggcacgcggttattacacgagaacagtgctagtcgcttacaacttcagaggcggaaagctgaccaagctgtggacgttcgattcggatgctcccggaaatggcgcctatgccggtcaaggcaaccacagtttgagcgtcgccgacgttgacggagatggaaaggacgagatcatatacggagcgatggctgtcgatcatgacggaaaaggcctctactcaaccggctggggacatggggatgccatgcatacagggaacctggacccgtcaaggcctggactggaagtcttccaagtccatgaaaacagcaattctccttatggcttgtccttccgcgatgcgaaaacaggaaagatcatctggggagttcacgcaggtaaagatgtcggacgcggaatggccgctgatatcgatccgcgctacgaaggagcggaagtatgggcgaacggcagtctttatacggcaaaaggcgtaaaaatcggaaacacattgccttcatcaacgaacttcggcatctggtgggacggcgatctccaaagagagcttctggacagcaacagaattgataaatgggattatcaaaattcgcgaaccgtcaacttgctgacagcgtccggagcttcggcaaataacggaacaaaagcgacgccgtccctgcaggcggacattctcggagactggcgcgaagaagtggtctggcgagcggaggacagcagcgaactgcgcatctacacgacgacagacgtgacggagcaccgcatgtatacgctgatgcatgatgcagtctatcgcctcggtatcgcctggcagaatgtcggctacaaccagcctccgcacaccggcttttatttaggcgaaggcatgcagacaccggagaagccgaacatttatacacgct

SEQ ID NO: 2625 - DNA, 1485 bp, Bacillus licheniformis
atgaaactgatcaaaaacgcatcttttatcatttcttttttggctgcggccggcatttattttttattaggtacagtcgctgcttctgcggcaaacgaagattatccggaacagatgatcaggctggaaagctcatcaggcttaaatattacgcccgccgggaatcaagacaacgcaccgctaacagcaaaacagacgagcggagaaaaagaagaaagatggaggcttgatacgtctgacggcaaacaattcaaaatcagaaatatggatagcggcaaaattatcatccctgcccattacgcactgtcagacaataatccggctgtggtctactatgacaattcacggaaggaagagttgtggaatatcatcggggccgacaaagacggaaacggagattttatcacgtataaaatcgtcagtgcacaaaacagcagccttgcactgacactggacggcagcggagtgaagcttgccaaatatacgggcagctccgtccaaaagtggaagcttccaagcgacgggctcgaaggtttcgcaggctatgcaagggaaacgaacggcaagcagaaaacaggcacaaccggcggcctgcttggaaaagtcgtctatgtcaataatctgggcgaactgaaggccaatattgaagattcaacgccgcgcacgattgtcgtctccagcaatatcggcgcttcagccaaaacggtattaacggtgggcgccaataaaacaatcatcggctcgtatgaaaaacataagctgaataacatttactttaaaacaaaagcggactctggcaacgttattttcaaaaatctggtcattgcacatgatgcatccataaatgaaaacaatgacatccctgtttacattaccgattcgagaaactactggattgaccatgtcacattccaaggccacagctatacggcaaacggccacgatctcgacaagctcttatacgtcggcgctaaagccgattacgtcacactgtcgcacagcacattcacagaccacaggtacggcctgattctcggctggcctcaagatgacaagcaataccacagtatatataatggctatccgcggatgacaatcagccacaatcgctttgagaatctctatgtcagggcgcccgggttgatgcgttacggctattatcacgtgaaaagcaattatatcaacaattaccaccttggcttcacgattacgacattggcgaaaatatattctgaagccaattacttcggcacgggcaatgagaaaggcatactggatgattacggagacggcgcgtttaaagatgtcgggtcatatccggcgataaaggggcagaaatcgcctgagacaagctggacaccttcatccaactacagctatcggacgatgaaggccggcaatgccaaagcttttgccaaacggtacgcaggtgcgcagcgcaccgctctgtactatgcgaattacagccagtttaaaaaagactaa

SEQ ID NO: 2626 - DNA, 2458 bp, Bacillus licheniformis
atgatcatttttaagtcgtttctttttgagcaatacaaacaagggaacttcttttattcgtattctttcggtctcgggggcggcatctacagccagctcggctattatttcacgacttcttttgtcttcatcgcttcattcgcggccgtttttctgatgcagcttttgcatttggccggggatgcggatcctttgttttgggcgcaggccgccgtattcatcagtgtcatcaagctcagcctgatcattttagcggcagcgtatgcgttaaacggtatggtgaaaaacaagcttgccgcctttacgggtgcggttttgtatggcacatcggtaatctatttcaggcacacggtgttctgggaatttttcagcgacgccatgctgtggctgccgctgcttgtcgccggagctgagaaagtcatcagagaaaagcggacagcactgtttattaccgcttgttctttgacgctgatcaataacttttactttgcctatatcaacttgattttcattgcgatctatatcatcttccgctggctgatcaggcttgacccggaaaaggaggcgccgaggtggaaacaattcagaatgttcgccgcttcaggcctgatttctttcggaatcagcgcgatttcctttgtgcctgcagtttacggctttttaaacaatttgcggccgccgtatgaccaggctgtcgctgtatacgatctgacggacaacattctgttttccagccgcattgtcttgctgccggctgtctttatgctgttcttgttcgcattttccttctataaaaataaaacgttcaggctgtttgcctcaatcagtgtgctgcttgtgcttctgcattacagcccgcttgcggcaagcgcattcaacggtttctccgctccgcagaaccgctttgaatacctgctcgcttttacgatcgggggagcggcggccgcaggaatgaccgaactgaaaaacatcaggcggaaagagatgatatggtctatcctgcttgtccttctggtttatatcgcggtcatttggcggaaagacttggatttatcacttatgcaaaattggagcattattgtgcttctgttcctgacaatcgccatatttacggcggcggggtttcaatataagaaatcgcagctttttttgcacgtctgcattttattatcgtccgtcctcgtggcgaacacgtatcaaaagtatgttctgtctgagtcaagcggcattaaaaacgtcacgaaaagctatttgaccagcaatgagtacaatggcgaagaacagcgccgcctcctgaacaacattcgaaaagacgataagggtgacccctatacaaggatcgactggatgaacggcgtccgcaacaatactccgctgatgcaggattttaacggcttcagcgcctactcaagcattctcaatcgcgatcttcttctgttttattgggaagaccttcaaatcgatatgggaagggaaagcgtcagccgctacgcatcgatgggcgaccgggccaacttgtacagtctgctgtacggcaagtattacatgacggaaaaagacaatgccgccaatgttccgtacgggtttattcaaacggatgaatcagagcactacacagtttataaaaacaaatacaccttgccgtttatccggacggcgcgaacgttgtttacggaaaaagctttagcagatgcgccagttttagcgcgggagcatgcgatgcttgaaggaatcgtgcttgagaatggcggtaacggaaaagagcagccgccgagcgttcctgatttgatgaagcagacgaagctgaaaaccgagggggcgagctatcataacggcttcctcgacgtcaccgctgaaaacggaggcatcgatctcattcccgaaggcggggttccaaaagaaggcgactattatgtcggattttatttaaaaagccttgcaaaagaccagttcttcaacttgcgggtcaatgattatgtaacatcaagaaagtcaaaccagtcgatttacaaaacaggtgtttacgatttaacgatcagggtgccgaaaacagataaaatttcaatcaggctgccaaaagggaaatatcaattggaccatttgaggctgcaccaggaagactatcaattgctgaaaaaagccgccgccaaaaaaacgccggccgccgacttgaactggcggaacaatcaagtgtccatcagctttgacaatcaaaacggagaccgctacatggtgctgccggttccgtacgaaaaaggctgggaagtcactgtaaacggaaaaacgcaaaccgttcaaaaggcaaattacgcgtttattggaatccccatcgaaaaagggaagaacaacatccgtctcgtttattacccgccgtacttcaaagctaccttggcggttacagtcatcagcctcatcatcggaatctggtacagcagaaggagaaaaaagcttggctctt

SEQ ID NO: 2627 - DNA, 1812 bp, Bacillus licheniformis
aaccgaagcaaatggaacacttaaaccgcggccttgtggcggtaaaaacaaaaaagggggtttttctcagctggcggctcttaggaaccgatccggaagaaaccgcttttaatctataccgcaacggacaaagaatcaattcaacacccatttcatcatcgaccaactttcttgataaacacggaaatggaaaatcgctttattatgtgtccaaggttctcggagataaggaagtcgagacgtcgcccaaaacagctgtctggcagaagccttacttggaagttccgttaaacaagcctgacggcgggacaactcctgacggcgcaccgtatacgtacagtgcaaatgacgcgagcatcggagatctcgacggcgatggagaatacgaaattgtgctcaaatgggacccgtcaaattcgaaagataacgcgcacaacggctataccggagaagtcatcatcgatgcctataagcttgacgggacattcatgtggagggttcatctcgggaagaacatccgcgcgggcgcccattatacccaattgatggtctatgatcttgacggcgacgggaaagcggaaattgctatgaagacggctgacggaacagttgacggaaccggccgggtgatcggcgatcaggctgccgattacagaaatgaaggtgggcgaattctggccggccctgaatatttgtcgatttttcacggggaaacgggaagggaattggcaaccgtggattacgatccgccgcgcggaaggcttgaggactggggagatggatacggcaaccgcatggatcggtttttggcaggcatcgcctatttggacggcgaaaggccgagccttgtcatggcccgcggctattacacaagaacggtgctagtcgcttacaacttccgagacggcaagctgaccaagctgtggacgtttgacagcgacaagcccggaaatgaaggctatgccgggcagggaaaccatagtctgagcgtcgctgatgtcgacggtgacgggaaagatgagatcatctacggcgcgatggccgttgatcatgacggaacagggctttatacgacagggcttggacacggtgatgccatgcacgtgagcgatcttgacccggaccggccggggctggaagtctttcaggtgcatgaagatccgcgccttccgtacggcctctcatttcgcgatgcgggtacaggggaaattctctggggagtgccggccgatacagatgttgggcggggaatagccgcgcatatcgatccccgctataaaggagcgcttgtctgggcgatcgatccaccgggcaatgaaggaaaatcgtacggcctctatacgagtaagggagaaaagctcagcgatgccgctccggcttcggccaattttgcgatttggtgggacggcgatcttctccgcgagctgcttgaccacgattggaaagaacccgcaggcatccccaaaattgataaatgggactatcacagcggcaggctggtcaatctgctcaccgctgacggaacgctgtctaacaattggacgaaagggacgccagtgcttcaggccaatttgttcggcgattggcgcgaagatgtcgtgttccgcacagtccgaagcgatgctctgcgaatttacacaacgaccgagccgactgaacaccgtttctatacgttcatgcacgatcccgtctaccgcctgggggtagcctggcaaaatgtcgcttacaatcagccgcctcatcccgggttttatgtgggaaccggaatggacaagccgccccggccgaatatttataccgttccttgtaaga

SEQ ID NO: 2628 - DNA, 1932 bp, Bacillus licheniformis
gggtgtcccgtccatccggatcgtgcacacgatcttcatcgactgtaacgcagaaacggaatggatcaaaggactcggtttagagatgagcgcggttttgagcggagcgccaagaaacaggcatattcgctatgcagccgacggaggaatttacggagaggcttctcagctgcttgtgacgagaagatttaatgaaacaaacgggttctatgaacgacagatagccggacagcctgtcccggaagagtcggaagtcgtgcgtgatgcagagaaaaacgccgtctggaacgatttcaagctcattcaggattcccctgttcactggcgcttaaaaaagcgaaccggcaaagactgcgcctgggtggacgcgattcatggggggagagcgaaagggctgatgtatgcaggcggggaaaatggcggcatcgcgctcggcctcagaaacttctttgaaaaatatccatcatcgcttgaagcgcaaggtcttgccggcggcgaaacaaaattgacggcatggttctggccccctgaagctgaagcgatggacttccgccattattcaaaaggcactcacgttgaaagcgcatatgaagggtttgccgaaatgaggtcgacggctgtcggcattgccaatacgagcgaagtcaacctcgcctgtttttcaaatccgccgagtaatgaagagctgaacagagcggcggacgaatggcaaaatcccccattgcttatttgtgagcctgactattattatgacacccgcgctttgggtgtttggagcctgaaagataaacggcgcccgctctcagctgcgcttgaagatcagctggacgaggctctcaagttttacatgaacgaagtcgaacagcggggctggtacggctattggcattacggtgatgtgatgcatacgtacgatgccgtccggcatgtatggcggtatgacctgggcggctatgcatggcaaaacacggaactcgtaccgaacctctggctttggcagtctttttttagatccgggagggaagacatcttcagaatggcagaagcgatgactcgtcacactagcgaaatcgactgctaccatttcggggattataaaggcctcggttcaaggcacaatgtcctccattggggctgcggctgcaaggaagcgagaatcagcatggccggcctccacaagccttattattttttgacggcggatgagagaacgggggaagtgttaaccgaggtgaaagatgccgatcgagcgcttgagatgcttgatccgatgagagcctattatccggaaaaagagttccctgcccacgcgagagttggccccgactgggcggcgttctgttccaattggctgacggaatgggagcggaccggtgatgaagcgtaccttgataaaatcaaccggggaatcggccggctcaaagcgctgcctcttcgtctgctgtccgggccgactttcggatacgatcctaaagcttcagatctgcttcatatgggtgacgggaatcatggcggctatcatatggtcatcgcctttggcgccccgcaaacatggatggagcttgcagaactgctggaggataacgaatggaaggagatgctcggcgaattcggcgaattttatttgctggctgatgaagaaaagcgcaagaggagcggcgggaagcttcacgatgatttatttcactggccgatgttctccgctgccatggccgcttatgctgcgaggcttcaccaagaccggaagcttgccgaaaaagcatggcggctgttgctggacgaaaaacaaagccatacaccgctgccgatcgctccaaaacaagtccatgcgtggaacacgatcacggaaatcccttgggtcacgacaaactgcgtctcacaatggtgcctcaacacaatagccgtgctggagctgctcaaggatatgccgcc

SEQ ID NO: 2629 - DNA, 2319 bp, Bacillus licheniformis
taaatggagactggtggggagaaaaatggggatctcttaaagaaacagccacaaatacgtttttaaacggaaactggtgggctgaacaagccggctatctttatggtactttggaagctgcatttttagggccgttaagtaatgtttggggaaccattgcaggaacgatcagcgagacgatttttaacggagactggtggagcgaaaaatggaacaatgcagtaacatgggcgcagaatacgtgggacggagctgtctctgtttgggaatccattacaggaaccattaaagacaccgtttttaatggagactggtggagcgaaaaatggaacaatgcagtaacatgggcgcagaatacgtgggacggagccgtctctgtttgggaatccattacaggaaccattaaagacaccgtttttaatggagactggtggggtgaacaatgggacaacgcagtgacatgggcgcagaatgcgtgggacggagccgtctctgtttgggaatccattacaggaaccattaaagacactgttttcaatggagactggtggtctaaccaatggaatagcgctttggaaaggggcaagagtattttcgaaggcgcgaaaagctgggtcggagaaaaagttgaatattttcagaaaggtcgggaaagagcccataaggatcatggatttgaaggctatgccacaggcggctacatcacaaaaccgaccatctcctggatcggtgaagccggaaatgaattcgtcatccctacggaaaacaaccggggacgcgggaagatgctgcttgcccaggccgctaccaagctcggcatgcgcgttgttgacgacatgggggccgcggcgggagacgggggagcttcttctccggtttcaagcaccgcttcgtattcggcttctgtgtcgcctgctgtcggtgtcgggagtatagcagcagaggcgcaggctttcggccgggaattcaccggcggttttgacaaggggatcggctcaaacgctccttcccttgatcaatggaagcaaaaaaacatcagcaagccgtttagcagcctgccggcagaatcgtctaactacggaaaacagacggttgccgggttcgcttccgggcaaaatgcttccgcgaccggaaccggcggttttcttcaagcaaaagtaaatgcgccttatcaaacaacggtgaaaacgtcctcttcctggggtgcaaatacagtcaaaaactttgcaaccgggcaaaatgcaacaccgaccgggacgtcgcagtatgttgataaaaatatcaacaagccgttccttgattcgaaacagtcggctgcaggctgggggtcaggaatggtcggacactttatcagcggcatgaatggaaaaggcagcgaagtttctcaagctgcaaaaaacttggcgaaaaaagttgaaaaagcgttccgcgaagaactagatattcattctccgtcccgggttatgatgagtctcgggcgtttcgcgtcggtcgggattgtcaaaggtttaagctctgtcgatgtcaaaagttttgcggaaaaacaagcaggctcactggcagctgcgttttccggaatcggagccgtcggcggaaatgtaaagtcgtggctgatgcaggcgatcatggctaccggttcgccggtgtcgtggcttcagccgctttctgttattgctcaaaaggaatccggcggaaatccgcgcgcctataacggctgggacattaacgccaagcggggggacccgagcagaggcttgatgcagacgatcggccaaacgtttaatgcttacaaaggaaaaggaatgaatgatattttcaatcctgttcacaacgcggtagcggccatcaactacatcaaatcgcgatacgggtcgccatttaacactccggggattaaaagcatggcaagaggcggagcttataaaggctatgccaacggcggcctgattacgagcgagcagatcgcccgcgtgggtgaaggcggcaaacgcgaatggatcattcccgaagaacgcggcatccgcggcagatatctgcttcagcgggctgcaggcgcgctcgggatggaagtgcaagaccccgctgaagggtccggttccatatcaagtgctcaggcggctgcagccaccacgggcgggacccgatcccggcagcctgctgaaaatggcgccaaagaagtcaacatctatattaccggggacaatcattaccacagtgagcgcgaccaggaaacattgattgcgaaaatcaagcgcgctcttgtcgatgagcttgaacgggatattcatattgggacgaaaggaagcgtagcttatgact

SEQ ID NO: 2630 - DNA, 1731 bp, Bacillus licheniformis
atgaactgtaagcggctattacttctatacgcggctgtgcttatcctgtctgcggctttttatgttccggacagcgccgaggcaaagcagcaggagcacggcattctcatcgtctattcaacattggatggaaaagagtcagccgatgtgaaaattctcgaccttatcgccggccatttttcatcccgtgtggccgtcataaaagacgcggatgtcaaagcatcggatctcgcaacaaaagaccgcgtcatctattacggacaaacgaaaagaaagctgagcaaaaagctcgcgcagctgatcagctcctccaaaaaacctgtgatagcgatcggctttaacgccgggcagttcagccaatttgcaggtcttacgctcaaaagcaaagacaatgtgtatcagattcgcagcacaaatgaggaaaacgattcctctttagaaagcggagtccgtgtcctcgacgtatcaggattgaagggaaaagcattgtacacatacaaagctgacgaaggaaaagctcgtccttttggatggaaaaccggcaaaggaaacgtgtacatcgggttaaccgatttgctaaacaacagcctcctcgccgctaaacagctcagacaggcatttggtgaaacggccggcagcacgctgttatatttgcggcttgaggatatcagcccgatgtcggatgaaaaactgctgctccaagccggatcttatctgcataaacggaatattccttttatcctttctgtgattccggtatatgtcaatcctgaaacaggcgacaaagtctatatgtctgataagccgaagctggtcaaagtactgaggaagcttcaggatatgggcggaagcgtaattgtccacgggtatacccatacataccgctacagcgaaaccggtgaaggattcgagttttgggatgccaaagccgatcagccgatcacatcggaaaatgcggaagagcccgcgacccttttgcaaaaggaacagagctttccgaatgaagaggcatatcgaaactatttgaagccgttcagaaagaatgaagaaacttacacgcggcagaagctgacgaacgctattgaggatctcaccgcggaagggctgtatccgctcgcgtttgaagcgccgcactatacggtgtcagagcacggctatcaaatcgcctcacaatatttcacaagcttgttcggccaggttcagcttagcgatacaacatggaaaacgtcaggcgccggtccatttgttacgaatccggccatgctccatgggatgacgctctatcccgagacaatcggctatgtcgatcaatcggagcaaaatccgctcggcaaagtcgaggagcgcatctctcaaatgatcgattttgaaggcggagtagccggcgcattttatcatccttatcttggaatgaaatatcttcctgaactggttgatcaaatggaacgcattccaaacagcgaatggctcgatattaaaaagacaaagcaaactgttaacacagataaagtagaaattcacacaagcggagatggaacgattcaagtcaaaagcaaagtcagccccattgagacgtttttcgatcatcaccagcaaagcccgctggaaaaggcgctttggattctctctcttattgtgctcttgtttgttgtcatgtttgtgagctataccctttacttgagagccacattaaaaaaacgaatctttaaggagagaaaaagccgtgggtaa

SEQ ID NO: 2631 - DNA, 1903 bp, Bacillus licheniformis
gtgacttttttgaaatatatcatcatatgtctggcaagcttcttgctgatcacggcgacgggacaagcggctgcagccaaagacgttacagtagacggctcgatcctgggggaaaacagccgggaacaagccaagcagcaagtgctcacaaacgatctcttgactttatacggggcaaaagacagcgccgagctgacgtatcaaataccggcgggcgcctcctctacccatcagcagcttacacttaaatacgaggcctcagaccttttaatctcaccgtcttctttaacagccgagattgatggcgaaccggtcaaaacggttaagcttgaagggaataacgggaagaaaacgctgaagctctcgctgaacaaaagccagtcgtctccagggtttcacagcttatcactgaagttctacggagtggttcatgaaggcgtctgcgtcagacaggactcctccgggaactggatcaaaatttatccggacagtcgtctgaatatcggggaaaagaacgaatctaaaggagcggcgctcgaacattatccttatccgttcgcccagtccggcagctccgtggaaaaaacggcaatcgtcattccggaccatccaagttcggctgaaatcgaagcggcagttaaaacagaagcatacctcaaaacggttgacaacagcatcagcacgaagatcttgggtgaatctgacctggcgaagatcgacaggccgacgattgtgatcggcgttcaccatcactggagcggcaaagtgaaaaagctgttgaaacaagcgaaactcgaagcaaaagaagacaagcttttgcttgcgaaacggatgctcaaagcaaaggataagcagcagcctgtattgtttgcggccgcagcatctgatgatgtgctttctgaaaaaatcagcgtcatcaccgacaaaacgtatgccgcccagctcagcggcgacacgctggcaatcggcaaacttcagcagcatagcaaacggggcggcagcaagctgacacttgaggatttcggggcgggggatttgacaatcggttcgggacagacatcttccgagcatttttattatcccgcgccagctctattagacaagaatcagcctgcaaagctttcgcttgcgatgaaaaaatcgaaaacgattcaaaagcaggccggccaaagcgacttagctgcggaacaggcggagctgaaggtcatgatcaatggccagcctcattccgtcggacttgacgatataggaaaagaagacaaaaacggcttttaccatgtttctttaaaagtcgatccgaaacttttgcaaaaaagccgttacattgatattcaatttgccgcttcaggcttgaaagagaacaacccttgctacgcggtgaacgaggacaaatggatttttatcgataaacaaagtgcattgtcttaccatgtcagcgacacgtcagcttcagcagattttcaagcgtggccgcttccctacgcgggtgatcataacaataaaacgctgatgatcctgcccgacaatgcggatcagtcgaagattgatgagctttcgcttgtagtcggctccttcggcagcgaagcccggcaggcattcacagtaaaaacatcctcggaagtcaaaccggatgacgtgaaaggaagaaacgtaatcttcatcggaagcgtcgatcaattctctctgctgaaggaaaaaacagccgaattggctgttccgacggcgaaaaacggaacatttgatgtgtcatcttttcaaatgctgaatgaaacgacaaaacaagtcgcgtttactcaaacgtcgctgtgggattcaaattactcgatggctgttttcgcgccgtttaaagggcaaggcacagcagtcacaaaagaaatgatcaactttttgaacagcaatgatt

SEQ ID NO: 2632 - DNA, 4557 bp, Bacillus licheniformis
atgaaaagcgatacaaaaacggtcacagctctctttcaactcggagcaggcaagacacagcaagtgatcatacccgtgaatacaggctccgaatcggaaacggcgaaaaatgatcctccgtcatctgaggacgatcagtcagacgatcaatcaaaatcttcaggaggacaggaccaagaggaaacgaagaaaaaagctgccgacgctgagaacagcgattcaaaaccggcggcatcttccagactggcggcagccggaagccttgcgtccggtggcaatcaaatcacccaaaatattttaaccggcgtgacgctgacggatgagcacggaaagccttatgacaaaagcaatcgagccgacacgaattctccggcgaaaatctcaattacttgggacatcccgaatgagctcggaaagacgataaacgacggcgaccgctatgaatttgatctgcctgaagcttttatcatgtacaacgacattacgaatcagccattaagctcagacggcatcacgtacggctatttttcaattgatacaaaaggccacgttgtgatgacgtttaacggcgaagtgaaagaagattcgaatgtcaaagggacgttgtttgtcaacacccagttcaacgcacaaaaaataaaaggctcgacgactcaaaagattccttttccggtgaaatcagacactccggaagtaacggtttatttcaaaccaaaagtaagcaaaaccattgataaatcaggaactttcgataaaggcatcaaccccgggcaggtcacatggacagtcgacctcaacaaaaaattggatcaggtgaaaaatgccaagctgcagaactttccagaggggctgacctatcgttctgtcaaagtttatcagctggatgtcaacatagatggttcagtcagccggggagatgaagttctttcaggctacaccgtagacgcagatggaaatgtcacattcgacggtgagatagattcggcttaccgcctcatctatgtgacggacatcgatgactccgcaaaaccgaacgaaggcggaaacgctgcatttaggaacaaggcaacgttcggcggagacaatctggaaccggcttctgcagaggcctctgtcacggccaaatacgggaaaatgatcgaaaaatcgtcgacaggttataaaagcgattcacagacgttcagctggacgattttatataactatggagagaaaaaaatcgacgaatccaaagcgagcataacagactcgtttggttccgctgatttgcatcttgtttcagattccttaaaggtgattccgattactttcaatcagaacggcagtgagcaggctggaacgcctctaacggaaggcaaggattatacgctctctgataatggaagcgggtttgaaatcaaatttaaccaagatgttaccggagcttacaaaatcacgtatcaaaccgaggtcaacagcggagtaatcatcgataaatcaacaacctatacgaacactgcagtgaccggaacaggagaatcaaagaaagcttcaggtacagccgttcagcagaatttgataaaaggctactcaaacattgattacaagaagaaaacggtcgattggacgatcgcaatcaacaaaaacaactacacgatgaacaattggaagttggatgacaatttcgaaagcggcgggctcacgctcctcgacggatcattccgccttcaggatgtgacgaataacaaaacgcttgaagaaggcaaagactatacattgataataaaaccggatcatgaaggttttctcctggaactcatcggagattatgcgacaacgaacagccagcttaagatcacgtataccacgaatatgaatgccgacttttccaacgaaaatgtcaaaaacacggcagaatcaacgtggactgatcacagcagcactgaacgcaaaaataaggaagcgagcagttttacgccgaatcgccagacatcccacaacggcttcaaacacggcttatacaacgctgtttcaaaagaaatcacgtggaaaatcggcatcaactataatggagagccgtcaaaaaacccttatattaaagattctttagcagatgaccagcaatttgaaaaaggctcggttgtcgtcaagagctattcagttaataaagacggttccatcacagaaggagacatcctgcccgcctcccaatatgatgtggaagagccgtcggctgccaataaacaaactttgaccgtccatttgaaaacggacgattccgtcccgtatcttattgaatttaaaacatcgctaaaaggacaggtcattaagcacgatccttacaccaataaggccacgtaccataatgccggatattcagagcgtgagttgacggcatccgtttcggtcgcagacggaggaagcctcgttttcaaaggaggcaaacaaaacggaggttatgtcgattggagcatcaatgtcaacgcgagccagtcggtgttggaagatgtaaaagtcaccgatactccggataccaatcaaattttagctgaagattcttttaaagtttatcaggctaaatatgatgaaaaaggtgcagtcaaagacagcagcggaaatcttgtcccggatgatgttcagcttaagaaaggcgaggactatacactggatatcaagaccgacaatgcaaccggcgaacaatcatttgtcctgaaatttacaggcgattacaaaaaaatcgaccgcgcctatgttattcaatatcaatcattgatcaatattgccggcacgagcggccatgttaacaacaaagtgtcgatttcgggaacgaatgtccaggaacagacccaggaaaacaacagctcggtctttgttgccgtttcaagcggcggcggttcaggctcaggggaaagaggaagcctgacaatccttaaaacgggagaagacgggacgccgctttccggagcagattttcaattgcggacaaaagataatgagcagctcctgcggacaggaacgactgacgacaacggcaagctgacattcggcaatattcgctatggcacttacattttaaaagaaatcaaggcgcctgacggatatacgatcagcgacgcctatgcagacggggtctccgttgagattaacagcagctcttcaagtgccggagcgctttacaaagtcgtgaatgagaagaataaggtgacgcttatcaaacaagacgaacaaaagaatccgttggaaggagccgtgttcaagctggagaaaaaatccggcgatggcgcctttacgacaatacgtacaaatattaagagcgacaaaaacggaaaagttgagatcaacggtttgccgcccggcgattatcgtttgctggaaacgaaagcgcctgaaggttatctcttaaatacaaaagaactcggcttctccgtcaaaacgaatgataagaatcaagtacctgacgttgatttaggaacattgatcaactataaaggcagagcacatttaacgaaagaagatgcagaaggccgtcaattagagggggctgaattcaagctcattgatcatgaaggcaaaaccattcatgaaaagctcacctcagatcaagacgggaaaaccgcggtatctgaccttgcgcctggccgctatgcctttgttgaaaccaaagcgcccgagggctatgtgataaacagcaaggcaatcgagtttaccatatctgaatcggcaaaagaaaaaccggaatccgtggacgcaggcaaagccgtcaactataaaggttcggtttatttgacaaaagaggatgcggaaggccgtacgctgaagggcgctgagtttaagatcgttgatcatgaaggcaaaaccgttcatgaaaagctcacttccgatgaagacggaaaaatcgcagtttcaggcctggcgcctgggcgctatgctttcgtggaaacgaaggcgcccgagggctttatgttaaacaacgatcaaatagaattcaccatcccgggctcagctgaagggaaaccggagccggttgatgcaggcgccgctgttaattataaaggctcggttcatttaacaaaagaagatgcgaaaggccacaagcttgaaggagccgtttttaagatcgcagatcaaatcgggaataccgtacaggaggaactggtctcagatcgaaatggaactgttacggcttcaggcctggcgcctgggcgctatgctttcgtagaaacgaaagcgcctgatggatttgtattgaacagcgggaaaatcgagtttgtcatcccggattccgctaaaggaaaacctgaacatgtagatgcgggcacattcgttaactataaaggttctgtttacttggagaaaaaagatgaagacggcaatggattagaaggagccgtgtttaaaatcattgacagcgaaggcaaaacggtcaaagacgatttgatctctaaagaaggcggcaaaatcgaggctggcgatttggcgccgggaagctatcaatttgttgaaaaacatgcgcctgacgggctacctgctgtcaacagatccgatcccattttccattaccgggaaacacgaaggtga

SEQ ID NO: 2633 - DNA, 1408 bp, Bacillus licheniformis
ttgagcatacgggagcaaaaagagctgcagcgggcgattgaagaaattacggaaatcgcggaaggattcggccttgatttttacccgatgagatatgagatttgtcctgctgaaattatttatacattcggtgcatacgggatgccgacaagatacagccattggagtttcggaaagcaatttcacaaaatgaagcttcactatgactttggcttgagcaaaatatatgagcttgtcattaattcagatccgtgttatgcgtttttgctggacagcaattcattgattcaaaataagctgattgtcgcacacgtccttgctcattgtgatttctttaaaaataactgccgttttcaaaatacgaagcgcgatatggttgaaagcatgtcggcgacagcagagcggattaaacattatgaaacggtacacggttcaaaagaagtcgaagcatttctcgatgcggtgctggcgattgaagaacacattgacccttcgctcgtgaggccgaagctgtcgtggagcgtagatgatgaagaggaagaagaaaccggcgcgccggccactccttatgacgacctctgggaactggatcataaaggatcgaaagagaagaagaaaaggacgaaaaaaaagtttccgccgaaaccggaaaaagacattctgctgttcatagaagagcattcgcgggagctggagccttggcagcgcgatattttaacgatgatgagagaggaaatgctgtatttctggccgcagcttgaaacgaaaatcatgaatgaaggctgggcgtcctattggcatcagcgaatcatccgtgagcttgatctgacatcaagtgaagcgatcgaattcgccaagctgaacgcgggagtggttcagccgtccaaaacgggaatcaatccttattatctcggattgaaaatatttgaggacatagaggagcgctacaacaacccgacagaagacatgaaaaagatgggggtagagccgaactctgggagagaaaaaatatttgaagtcagggagatcgaatcagacatttcatttatcaggaactatttaacgaaggatcttgtgatgcgggaagacctctacttgtttcaaaaacagggaagggattataaaatcgtcgacaaggattgggaggctgtgcgcgatcagcttgtcagcatgagagtcaacggaggatttccttatttgacagttgaggacggagattacttaaagaacaatgaattatacatcaagcattggtatgaagggatcgaactcgatttgaagtatcttgaaaaagttctgccttacctccaccagctatggggaagaagcgtgcatgtcgagaccgtgctcgaagataaacccgtcatgttttcctatgatggaaaggctgtccaccgcagatatttat

SEQ ID NO: 2634 - DNA, 1822 bp, Bacillus licheniformis
atgatcagtctcgttcccggcggattcggttcgttcgacctgctttttttggtcggaatgagccagctgggggttgatcaggaaatcactctgacggcgattgtgctctaccggatcgcctattcgtttatcccttttgtgttcggtcttatttttgcagcagccgatttgactggaaatacgatgaagaggctcgaagaaaaaccgattattgccccggcaatagaaacgaccaatattctgttgattttacacagagcgctcctattcagactgctgaacggttcgctttcagtcatcgcattttgcagcggagcgattgtgatcgcatctgtggcgctgccgattgacaggattacattgataccgaatatttcgaagttcatgctggtgttttttaacggtttgtccctcagtttcggcttgattttgctgattctgccgcttgaactttatcggaggacaaagagatcttattatatgacgctgaccgctttggcgcttgcctttctgttcacgctttttaaaggctttaatattagcgccgtcttcatgattcctgtggtgtttgccctgtttgtattgctgagggggcagtttacaagggagcgggctgtctacacattcgggcaaatcgcatggggagcttttatcttcctctttactttattgaattacaatattatcgcttcacacatttgggaggcgctcggccatcttcttgtgaaagattatttcattcacagtgaacgccatgtcgacttcgcgacgttttttgcgttatttttcgttccgctgtatttcgctgttttcatctgggcgtttaacaggaaaacgaaagagatcggtgaagagcctgatccggagaaactggaggcattcttagaagaaaaaggcggcaacgctttgagccatttaggctttttaggggacaagcggtttttttattcaagcgacgggaatgcgctgattcaattcgccaaagtcggccagcgcctcgttgtgctcggcgacccgtccggccgggaagactcgtttccgctcgtgatcaaagaattccttcatgcggctgaccaaaaagggtatcttgtcattttctatcagatcgaacgcgaagacatggcgctctatcatgacttcggataccgctttttcaagcttggagaagaggcgattgtcgaccttgacacctttacaatcagcggaaaaaagcgggccggactaagggcgatctacaaccgttttgaacgggaagggtatacgttccatgtcgaacagccgccgttttcgagagaattcctcaacgagctgaggcaggtgtctgatgaatggctcggccgcaaaaaagaaaaaggcttttcgctcgggttttttcaagaagattatttgcaaaaggcgccaattgccgttttaaaaagcgaagaaggcgagatcgtcgcgtttatgaatatcatgccgatgtaccgcgaaggggaaatatccatcgatctgatgcgctattcgaaaaaggcgccgaaaggaatcatggatgcgctgttcatctatttatttcaatggggaaaagaacagggctacacggccttcaatatgggaatggcccctttatcgaatgtagggacaacgtttcagtcattctggacggagcggctggccgccgtgattttcaacaatgtcagctacatgtacagtttcagcggactgcggtcttttaaagaaaaatataagccggtttggcgggggaaatatttagcctatcggaaaaaccgatctctcccggtaacgatgatccttgtgacaaggctgatcggaaggagaacgaaat

SEQ ID NO: 2635 - DNA, 2547 bp, Bacillus licheniformis
cagcatataccgatacttccgtctacaaaattgaaacagcaaaagagtttaatagcgaaagcgaagcgctcaaagcagccgaacaactgaaaaaggacacgggatggaaagccgaggtcaaaccttcagggaaaaacggcacaacatacgttttgacatcagaaggtgtcgaaggggagagcagagcaaaaaatctgcttttgcagtttgaaaaagaaaccggtttgaaggcgtcctatggtccgattggaaaaaaagaaccgttttccaaagcggtatcaaaggaatttgccggtgaagaaaaagccaaggaatgggcgctccaatttgaaaaagaaaccggtctgaaagcaacctatacacttgcagggaacagggaagcatacgtgaaggttgccaccggaggaatcgaaggcgaagacaacacgaaagccatcctcgatcgttttcaaaaagcgaccggcctcaaagcgtcgtatgcaccatacggagcgggacaagcgatcgtcaagctttattctgcagaaatcgcagatgagagcaaagcgaaaagcctgcttgtccagtttgaaaaagaaacggcccttaaaggaacgatagagaccgtaaagaaacaacagcctaaatataaaattgcgacaagttcgatacaaggcgaaacaaacgcgaaaaacctgctgaagcagtttgaaaaagagctcaaagtcaaaggggcatatgaagccgccggtcagccggcacagctatacaatgtgaaatcgggatattttaatgacgaaaagagcgcgaaaaatgccgccggacaaattaaaaagaaaaccggtctcgcctcaagcacggaaaaggtaaaaggtacacgcttctggatcgtaagcatgaaaagcgtagacagtcaaaacctcaaaaaaatcgacgcctttttcaaaaagaaaacgtggcgttatactgctgcaaaggcggggaaaaagcagacatctttcagaatcgtttccgtcccgctttcagatcaaaagaaagcaaacgatggcatccggttttttaaaaacaaaaatattcaggcttctgcgcaaagcaccggcagcacgaccgtcagccgcttccggattgcgtctgctgaaaccgccgttcaagcgcgaatcaataaagggcttgaattctttaagaaaaacggtgcggcgggaacggccggatcaacaggaaaaaaagtgtacagccactatcagctgacaacggaatccgtatacgaacagaacaaagtgacgcaggcgctcaatttctttaaagaaacaggcattcacgcagaggccgtgaagaccggccaatattacagccgctacaaactgagttcggaagctctgatcggcacggaacaattacagcaggcgctcggatttttcagcaagcggaatataccgggcaagattgaacaaacgggtgagtacggctacaggcagtaccgggtgacgacaggtcgaatcacaagcaaagcagatctcgacaagggcttgaatgtctttaagaagaacaatgtcagcgcaacttaccaaacaaagacggtcagcctgtttcatatctcgatcaatgaacaatttacagggaaagaccgtgcggatgctgccgccaatcggatcaaaacgaattacggctggccggtgaatgtcgtcaaagtgaaaaacggcccgcaaatcacaacgactgactacggaatcacgctcagccagatgatcgataaacagatgaaagtcagcccgcaaacggatgcgccggcttatgtttcattgagctacatcaatacggcgaaccaaaccgtcacggctgatctgctgaatatcaggtcaagcccccttgtgacaggcggcaacatcatcggacagctgcaaaaaggggataaagtcaacatcatctcccaggaaaacggctgggcaaaaatcagaatgaattggcgaaatgccagcagggatgaagtcgagaaatatgtcaatccggaaaatttcacacaagacagctcggcatacttccaatttttaaaactgtcgcaaacggccggattgaatgctgccgaggtcaatgcaaaaatcctttataataaaggggttttgacaggcaaagggcaagcgttcatcgacgcggcgagagcatacagcatcaatgaactgtacctcatttcacactcgctccttgagacgggcaacggaacttccgagttggctaaaggaacgatgttcaacggcaaaaaggtttacaatatgtacggcgtcggggcttacgacagcaacccgctttactacggcgcaaaatacgcctatgaacaagggtggttcacacctgaggccgccattatgggcggagccaaattcatcggtgaaaaatacattcaccacccgacttacaaacaggacaccctctataaaatgagatggtctccgaatgcccttcaccaatatgcgacagatgtcggatgggcttgtaagcaggtggggagaatgtacagtctgtatacattgctcgatcaatatacgctgtactatgatgtgccggtttatcggt

SEQ ID NO: 2636 - DNA, 1695 bp, Bacillus licheniformis
tccacatgctcgatcacacccaccccgatgcaatcttcagcatctgctgctgcgataatggaaaagagatcgcagaggagatatacggcagccgatttgtatgggtgccttatgtcagaccgggctttgctttatcgaagatgatagcagaaggtgtgaaaaacaacccgaatgcagagcttgtttttatggagaagcacgggctcgtcacttggggggaaacgtcgaaagaaagctgtgatcagacgattgccgtgattcgcgaagcggaagcatatattaaaagccgttcggaagatcatcagccgtttggcggacagatggtcgagccgcttgcaccggaggagcggaaacggattttagccgatatcttgccggtcatccgcggcgctgtcagcggggaaaaacgcatgctcgtcacctggtgcgatgctgacgatgtgctcgaattcgcgaacagcaggcgcgcaccgtcgctttcacaggtcggcgccgcttgtccggatcacctcgttcatacaaagcgggtgcctgcctatattccgtggaatcccgctgaacaggacacagaagcgctggtcgaccggatcaaaaccgagattgctggatttaaagagtcgtatgccgcctattttcaacgaaaccggcacgaaggagacgagatgtttgaaccggcgcctcgcgtgatgctgatcccgggaatcggcatggtgacagcagggaaaagcctggcgatggcgaaggtcagccgagatttataccgccgggcgattgccgtcatgaagggaacggaagtccttggaaactttgtatctctcaatgaggaagaatcctacaatgttgaatattggccgcttgagctttataaattaacgcttgctccgccggaagccgaattttcgcgcaagatcgcatttgtgacgggggggagcggggcggaatcggcagcaagggcctgccgccgtcttgctctaaaaagcgcgcatgtttttggtcggtgacattaatatgaaggcgcagaaaaaacagcggccgagattaatgatcaatacggtgcagaacgagcttacgccgtccgcatggatgtgacgaaagaagaggaggttcagacggccttcgaggaaatcgccctcaaatacggcgggattgacatccttgtcaacaatgcgggccttgcgacatcaagcccgcttgatgaaacgacgctcgaagaatggaacctgaatatgaatgtactcggaacaggatatttcctcgtggccagagaagcttttaagcaaatgaaaaaacaaggttcaggcggcagcatggtgtttgtcggttcgaaaaattccgtttatgcaggcaaaaacgcatcagcatacagctctgcaaaagcgcttgaggttcatttggcgagatgcatcgcggctgaaggcggaccgtacggaatccgtgcgaattcagttcttccggatgcggtgcttcaagggtcggccatctgggactccaaatggcgcgaagaaagagccgccgcctacgggattgaacccgaccggcttgaagagcattaccgcaaacgtacggctctttccgtcaacatttatcccgccgacattgccgaggcgatcgcttatttcgcttcagaaaaaacggcaaaaacgacgggatgcatgctgacggttgacgggggagtgccggccgcattttcaaggt

SEQ ID NO: 2637 - DNA, 1197 bp, Bacillus licheniformis
agccgccagagattcagggacggcaaaaagcggcctttatgttgaaaaggtttcagggcttcgcaaggattttataaaaggggttgatgtttcgagcatcatcgctttggaagagagcggcgtcgccttttacaatgaatccggaaagaaacaggatatattcaaaacgctgaaggaagcaggcgtcaattatgtccgggtgcgcatatggaatgatccctatgatgccaacggcaacggctacggagggggcaataatgatctggaaaaagcgattcagatcggaaaacgggccactgccaacggaatgaagctgctggcggatttccactattccgatttctgggcggacccggcgaaacagaaagcgccgaaagcatgggcgaacctaaactttgaagataaaaagacggcgctttatcaatatacaaaacaaagccttaaagcgatgaaagcagcgggcatcgacatcggcatggtgcaggtcggtaacgaaacaaacgggggccttgccggtgaaacggattgggcgaagatgagccaattattcaacgccgggagtcaagcggtgcgagagacggattcgaatatcctagtcgccttgcattttaccaatccggagacgtcaggaaggtacgcttggattgccgagacgcttcatcggcatcatgtagactacgatgtgtttgcaagctcgtattatccgttttggcatggcacgctgaagaatttaacatccgtcctgacatctgtcgcagatacgtacggcaaaaaagtcatggttgctgagacatcttatacgtatacggctgaagacggagacggacacggaaatacagctccgaaaaacggccaaacgctgaataatccggtcaccgttcaagggcaggcgaacgcggtccgtgatgtgattcaagcggtcagcgacgtaggtgaagccggaatcggcgttttctattgggaaccggcatggattccggtaggaccggctcaccggctcgagaaaaataaagcgctttgggagacatacggatcaggctgggctacaagctatgctgctgaatatgacccggaagacgcaggaaagtggtttggcggcagcgccgtagacaatcaggcattgtttgattttaaaggacgtccattgccgtcgcttcatgtgtttcaatatgttgatacgggaacaccattcaaaaa

SEQ ID NO: 2638 - DNA, 1166 bp, Bacillus licheniformis
atgaaagcgctttgtttggcacttttagtgatcttctctatgagcatagcgtcgttttcagaaaagacccgtgcagcttctgctgaagaatatcctcataattatgctgaactgctgcaaaagtctttgttattttatgaagcacagcgctcgggaagacttccggaaaacagccggctgaattggagaggagactccgggcttgaggacggataagacgtcggcctcgatttaccgggagggtggtatgatgccggcgaccacgtgaagttcggtctgccgatggcttattctgccgcaatcctgtcatggtcggtctatgagtaccgaggtgcctacaaagaatcgggtcagcttgatgcggcgctggacaatattaaatgggcgacagactactttcttaaagcccatacggctccttatgaattgtggggccaagtcggaaatggcgctctagaccacgcatggtgggggccggccgaagtaatgccgatgaagcgccctgcctataagatcgatgccggctgtccggggtcagaccttgctggtggtacagccgcagcgctagcatcagcatcaattattttcaagccgacagattcttcttactctgaaaaattactggctcatgccaagcaattgtatgattttgccgaccgctaccgcggcaaatattcagactgcattacagacgcacagcaatattataattcgtggagcgggtataaagatgaactgacatggggagctgtctggctctacttggcaacagaagaacaacaatatttggataaagcccttgcttcggtctcagattggggcgatcccgcaaactggccttaccgctggacgctttcctgggatgacgtcacttacggagcacagctgctgctcgctcgtctgacaaacgattcccgttttgtcaaatctgtcgaacgcaatcttgattattggtcgacaggctacagtcataatggaagcatagaacggatcacgtatacgccgggcggtttggcctggcttgagcagtggggatcattgcgatacgcttcgaatgccgcttttctcgctttcgtttattccgattgggtggatacagaaaaagcgaaaagatatcgggatgccgccggtcggaagacggagtatatactaggagataatccgca

SEQ ID NO: 2639 - DNA, 1154 bp, Bacillus licheniformis
atgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatattcgtgagcaaaaacgacttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatgggttctagcaactaacttacctgttgaaattcgaacacccaaacaacttgttaatatctattcgaagcgaatgcagattgaagaaaccttccgagacttgaaaagtcctgcctacggactaggcctacgccatagccgaacgagcagctcagagcgttttgatatcatgctgctaatcgccctgatgcttcaactaacatgttggcttgcgggcgttcatgctcagaaacaaggttgggacaagcacttccaggctaacacagtcagaaatcgaaacgtactctcaacagttcgcttaggcatggaagttttgcggcattctggctacacaataacaagggaagtgttattgctgtcttc

SEQ ID NO: 2640 - DNA, 1146 bp, Bacillus licheniformis
atgaacttttacaaaacgctcgccttatcaactcttgcggcatccttattgtctccctcatggagcattctcccccgtgccgaagcttcagcttataaggacttctcggtgactgccgatgcagagacagagccggtggatacccctgacgacgcggcagatgacccggcgatttgggttcatccgaagcagcctgaaaaaagccggctgatcacaacaaataaaaaatctggcttgatcgtttacgatttaaacggaaaacagctggcagcctatccgtttggcaaattaaacaacgtcgatctccgctacaattttccgctcgatggcaaaaaaattgatattgccggggcctcaaaccggtcagacggcaaaaacacggttgaaatatacgcctttgacggcgaaaaaaacaagctgaaaaacatcgtcaatcctcaaaaacctattcaaaccgatattgaggaggtgtatggtttcagcctgtatcacagccagaaaaccggcaagttctacgccatggtgaccggaaagaacggagaattcgagcaatacgaactgtttgacaacggaaaaggacaagtcgaaggcaaaaaggtccgctcattcaaaatgagctctcaaacagaagggcttgcagcagatgatgaatacggcaaaatgtacatcgctgaagaagacgctgcgatttggtctttcagcgccgagccaaacggcggagataaaggaaaaattgtcgatcgcgcaggcggaccgcatttaaccgctgatattgaagggctgacgatttactacggagaagacggcgaaggatatttgatcgcgtccagtcagggcgataaccgttatgccatctatgaccggcgcgggaaaaacgactatgtcgccgatttttcaattgatgacggtaaagaaatcgacgggacaagcgataccgatggaatcgacgtcatcggcttcggcctcggcaaaaaatatccatacggcatctttgtcgcccaagacggcgaaaatacggaaaatggacagccagccaatcagaacttcaaaattgtctcctgggaaaaaattgctgacgcgctggacgacaagcctgatatcgatgatcaggtcaatccccgaaaactgaaaaaacgagccaaataa

SEQ ID NO: 2641 - DNA, 1302 bp, Bacillus licheniformis
aatatcaacaatgaagcagaccgggcgcgcgcacaagatgagctcccccaaagtgccgctggcaaaaccattatgacaacctgaaccgaagtttgttccgaatcaggcaatgtcagttcatgtcagtgacggactcgatgtgaatataaggcttgtcgactgcgtcggctatactgtacccggggcaaagggatacgaggatgaaaacgggccgagaatgatcaatactccttggtatgaagagccgattccgtttcacgaagctgccgaaatcggcacgagaaaagtcatccaagagcactccacaatcggtgttgtgattacgactgacggcacgattggagaaatcgccagacaggattatgtcgaggctgaagaacgggtgatcgacgagttgaaagaggttggaaaaccgtttatcatggtcatcaattccgtaaggccgtatcatccggaaacagaagcgctcaggcaagaattgatggaaaagtacgacattccggtgctggcgatgagcgttgaaagcatgagggaagcggacgttctgagcgttctcagagaagcgctttacgaattccctgtgctcgaagtcaacgtcaatcttccaagctgggtgatggtattaaaagagaatcattggctcagggaaaactatcaagattccgttaaagaaaccgtcaaagatattaaaagactgagagatgtcgaccgcgtcgtcggacacttcagcgaatttgatttcatcgagcgcgcaagcctcgccggaattgaaatgggccaggggatcgcggaaatcgatttatacgcgccggattacctgtacgatgaaattttgagggaagtcgtcggcgttgaaatcagaggaaaagatcacctccttcagctcatgcaggattttgcccatgccaagaccgaatatgatcaagtctcagatgcattgaaaatggtgaaacaaaccggctatggaatcgcagctcccgcattaaccgatatgagcctggatgaaccggaaatcatcaggcagggttcaagattcggagtccggctgaaggcggtggcgccgtcgattcatatgatcaaagtcgatgtggaaagcgagtttgcgccgatcatcggaacagagaagcagagcgaagagcttgtccgctatttaatgcaggactttgaggacgatccgctgtcaatgtggaattccgacatattcggaagaagcttgagctcgatcgtcagagaagggattcaggcgaagctgtcactcatgcctgaaaatgcgagatatcagctgaagtagacgatggagcg

SEQ ID NO: 2642 - DNA, 3927 bp, Bacillus licheniformis
atgaaaacgatgttaagtcgtttagtacctatgacaaaagctcagtacgagacaatgcacgatcttggtctagtcacccttgatacttccgaagcttttaaacgtatggctgataaaggcttcaaaccagcgagtaaaaatatcggcgatatatacgaggcacttaacaagtatgttgaaaagacgacaggagcgaagcaagggaccgaaaagttcgagaaggcctttgacaaagccactcggagtcttggaatcatggacaataaatttttcgatgctaacggaaatattcggagtatgacagaaatatctggagagctttctaaggcgcttgacggtttgtccgcaaaagataaacaagaagccctttacaatattttcggtagtgacgctattcgaggcgcgttgattcttggtaaggaaggaagtaaaggcttcgataaaatggcggctgcaatggataaaattaaggccgataatgttgctgctgaaaaaatgaataaccttaagggtaaaatcgaagagctttccggtgccgtagaaactgcacaaatttcatttggtaatgcgctaaccccagctatctctgcactcgtttctgtgcttcagagcgcgacggactggtttaatggtctatctaaaggaatgcaatcgttcgtagctatttctttagcggttacaactgtaattatgggcattgttgcagcgttaggttttttaatgctaggtgtcggccaaatgatatctggactcgggactgtaagcggtcttttaaaaggtttgataaaaagtgaaaagttcataaaggttataggtgttgcattcggagcacttacgagtccgatcggccttacggttcttggcataaccgcggtaggagcagctcttgtaatcgcgtacaaaaagtctgagaaattccgtaattttgtaaacggcgcttttgaatcagtcagaaacgtgacggttacggcattcagcagtatttcggcagtggtaggcgacacatttaattttatacaaaaagcttcggtagccgggtgggagagattttctgacggcgtctccgttattgttccggcagtacgaaagcgatttgctaacgtggttaattcaataggtgaattcgtttcaaacatcggatcgtcgatcgcagatagattcggttccggactagcggatagaaccggctccgcagtagatttattcattcagaatttaagggctgcgttttcgagcgtgggcggaatcatatcgattttagcgccaaccgtgactgcgttagggctggcgatggccggagtttccggatctattggttttgtcatcacctctcttgttagtctagccggttttttattccgactatatcaaacaaacgaagagtttagagcgtctgtacagaacgcctggtcacagattatgtcggtgatcggtaacgttgtagttgcgattcagccaatcataaatcaatttatcgggtatttttcggatattgcagcagagcttgcacctgaattcgcgaaaacgggcgaagtcataatgtccagcattagttcgttaggaccaacgtttactgagctcggaaatgcttttggggaattgtggacaacgttaggtcaatcattctctgaaattgcggttcagatagcgccggtaatccaggaattaggcgtgactttcgcggcgtttctaccgcaagttgtaactttggttggacagttgattcagacatgggcatctttccaagtccaattcgcacaacttattatgcaagtcgcatcggtactattgccaatgttagctcaagcatttacatctttgcttccgctgattttacaaatcgtatcgtctgtacttccaatagtgctacagttgattcagtcccttgttccagtagtaaccactattgcgactaccttgttaccaattttgctacaggcgtttcagtcaattttcccgccagtactggcgataattcagtctgtagtgcctatcgtcgctaatctgttaacatcagttgctcaaatcttgagtcagttggctgtaaccttgctaccactcattctgcaagttgttcaggctgttttccctgttgtaacaagcatcattcagattgccatgcaggtagccgtaacggttttacagttagtggcaactataattcgtactgttcttatcccagcgatccaattcgtgctgaaaattgtgcaagtcgtgttccctgtagttgttagtgtaatccaaaacgcactcaatatcgtgatcaacgtagttaagtttttcactgcgctactaaaaggcaattggagtgcggtctggaatgcgatacttgggattctgaaaagtatttggaacataatcaccgcagtaatccgaggagctgtaaatgtagtcctcacactcttttctggattggtcaatggggcagttagcgcctggaatttcttgaaggacagaacagtaggtttgttcaaatcaatcgggaaatttgcggccgacacgttccacaacatgatcgagggagcaaaggcgctaccaggtgaaattggtgacggaataaaaaatatggccggcagagctctatccggagttaaatctctaggaaatacgatgatcggcggacttgaaggaattatcaatggcttgacgcaaaaagggattaacaagctactcgatacattcggggtggataaaaaactccggatccctaaactcgaaattccgaggttcgctaaaggtacgccagcaggtgggcacaaaggcggtcttgctatcttaggagatggaggcggtccggagttattccgtacaccttccggtttcacaggtttaagccctggaaccgacacgctctttaatctgccaaaggggacgcaagtcttgccgcataaagaaacacgcgaggtactatcttctggaatccccgcattcaggaaaggtacgaagaacaaaagtttcttcgattctgctatcgatgttggaaaatccgctgttgatgcgggtaaagctgccgtaaacagtgttaaggatttcgcttttgatgcgtgggaatacgtaagcaatccgtcaaaacttatcgctaaaacgatagaaagtctcggactgaagttgccggatatttccggagctttcgggacaattgcgaaaggtgccttcggtaaagtcaaagattccgccgtcagctttatgaaaaagaaactcgctgactttggtggagctttcggaagtggcgataaagcgtccggaaacgttaagcaatggattcgggcggcgatggctaaaacgaattcgccagcttcttggttcgctccactcgttacaattgcgatgaaagagtccggaggccgtacgggtccgtctacaattaatcgttgggactcgaactggagacgtggtacaccgtcaatgggacttatgcaaacgatcaaaccaacgtttgatgcgtataagcttccgggcatgggcgatatcatgaatccggtgcacaacgcggttgcggctatacgttatatcaaatctcgctatggaagcccgtttaatactccaggcatcagatcgatggagaaaggcggtccgtacaaaggatataaaatcggcgatattgtgacgcaaaagcagctcgcctggattgcggaagaaggtccagaagcgattattccgttgcaaaaccataggcagcgggcgcagcaattatggacggcggcaggaagagaaatcggtatggatccgtctggtggaagtaacgaagaagaactcgcgttgttgcgtggacagaacgcgctactcagacagacgaacacattgctaacggggattctacgcaaagatccgagtgtagttgtcgatacggcagcactaacggacagtgtagaaaaaggtcaggcacaaaacatcggattcaataagctgctgtggggtgatcggtaa

SEQ ID NO: 2643 - DNA, 1678 bp, Bacillus licheniformis
atggagtttgtcattggcttactggcgttatttttaatcttattcgctacgggctacttattcagaaaaaatatatataaagagatcgaccgtttagaagcttggaaaatcgaaatcatgaaccgttcgattgtggaagagatgtcaaaaatcaagcatctgaaaatgacggggcagactgaggaattctttgaaagatggcgccgggaatgggatgaaatcgtcacctcgcatatgcccaaagtcgaagagcttctgtttgaagccgaggattgcgccgacaaataccgttttcaaaaatcgaaacaggtgctcgcgcatattgagaatcttttatcagcggctgagtccaacattgaagacatcttaaaggaaatcgccgatcttgtctcaagcgaagagcagaaccgcaaagaaatcgaagaggtaaaagaacgttatacaaaagtgcggaaaaaccttttggcatacagccacctgtacggagacctctatgcgaaaattgaagccgacctcgataccgtgtgggaaggcattaaacagtttgaagaggaaacagaaggcggaaattacatagaagccagaaaggtgctgcttgcccaagaccgtttgcttgaagagcttcaatcatacatagacgatgtgccgaaactgcttgccagctgcaagcagacagttccgcaggaaatcgcaaaattgaaagccggctatcaggaaatgatcgataaagggtataagctcgatcatattcaagtggagaaggagctcgaaaaccttttgaaagaattgaagcgcgctgaagatgcgcttttggacgagcttgatttagaggaagccgccgcaatcgtgcagatcattgatgaaacgatccagacgctgtataaccagctcgagcatgaagtcgaagcagggcaggaaattttgggcaaagtgcctgagcttgccgctgcattggaaaagcttgaagcctccaaaaaggataccgaagctgaaaccgagctcgtcaagaaaggctacagactgactaccggcgaactggagaagcagcagtcatatgaaaagcgccttgaaatgatcgaaaagcagttcgaacaagtgagagaaaggcttgatcagaaacatgtcgcctactcgctgttaaaagaagagcttgccgatatcgaaaagcagatggaagccgcgcaacgggagcatgacgaatacagggacatgctgcaaatgctgagaaaagaagagcttcaggcaagagagcttctcaagcaattgaagcagacaatcaaggatacggcgcgcagcctggagaaaagcaatgttccaggcatcccggaggccataaccgaaaagatccgacagtcgcagacgactgtgcagaaagtgacagaacagttgaatgagctgccgctgaacatggatgcggtgaacgaacgtcttcaagaggcggaacagcttgtcacggaagtgaaaacaaagacggacgaactggttgaactggttttgctgatcgaacgcatcattcaatatggcaaccgcttcagaagccaggaccgtatcctttccgaacagctgaaagaagcagaaaactgtttttacgcatatcagtatgaagaggcttacgacatagccgccagagcggtggaaaaagcgtcgcctggagcagtggcccggcttgaagcggacg

SEQ ID NO: 2644 - DNA, 1449 bp, Bacillus licheniformis
atgaacatcaaaaacattgctaaaaaagcgtcagccttaaccgttgctgcggcactgctggccggaggtgcgccgcaaacctttgcaaaagaaacgcaggattacaagaaaagctacggattttctcatatcacaagacatgacatgctgaaaattcccgagcagcaaaagagcgaacaatttaaagttcctcaattcgatccgaaaacaatcaaaaacatcccttctgcaaaagggtataacaaaaatggagagctgatcgatttagacgtatgggacagctggccgctgcaaaatgccgacgggacggttgctacataccacggctacaatcttgttttcgcgctggcgggcgatccgaaagacgtcgatgacacatccatctatttgttctatcaaaagaaaggcgaaacttctatcgacagctggaaaaacgccggcagagtgtttaaagacagcgacaaatttgttccagacgatccgtacctcaaacatcaaacacaggaatggtcaggttctgccacgctgacaaaagacggaaaagtccgactgttttacacagctttttccggcacgcaatacggcaagcagacgctgacaacagctcaggtcaatttctctcagccggattcggacacgctcaaaattgacggtgtagaagatcataaatcggtctttgacggcgccgacggcacggtataccaaaacgttcagcaattcattgacgaaggaaactacagctccggcgacaaccatacgatgagagacccgcattatgtggaagaccgcggccataaatatctcgtatttgaagccaatacgggaacaaaaaccggctaccaaggagaagactccctattcaacagagcctactacgggggcagcaagaagttctttaaagaagaaagcagcaagctgctgcaaggtgcgaacaaaaagaacgcttcgctggctaacggcgctctcggaatcatcgaattaaataacgattatacactgaaaaaagtcatgaagcctttgatcgcctccaatacggtgacagatgaaatcgaacgggccaacctcttcaaaatgaatggaaaatggtatctgttcacagattcaagaggatcaaaaatgacaattgacggcatcggttcaaaagacatttatatgctcggctatgtatcaggttcattaaccggaccattcaagcctttaaacaaatccggacttgttttgcatatggaccaggattacaatgacatcacgtttacttattcacactttgccgtaccgcagaaaaaaggcgacgaagtcgtcattacaagctacatcacaaacagagggatttcgaacgagcatcacgccacgtttgcaccaagctttttgctgaagatcaaaggatcaaaaacatccgttgtcaaaaacagcatccttgaacagggacaactaacggtaaacaaataa

SEQ ID NO: 2645 - DNA, 1482 bp, Bacillus licheniformis
gcaaacggtaagagcgaaagtcatgaaatcccgttttcacgggcctgtaacaaaacaaatatatgaagatcaattttcggagatctacggcgatgatattatcgctccgccgtacaatttgaaagaattgaaagccattgccgaatattcttcaattcttcagcaatgcattgacgcctataaaacgaatattgcggggttcgggctcgatgtagaatacgcttttgatttcaacggggcggatgtgacgcccgatcggaaaaaagctgctgagtccgattggacaaggcttgaagatttttgccgccaccttcattttgacgaatcggctgaaacaattttaagccatatgatagaggaccgcgaaaaaaccgggaacgggtttttggaggtgctcagaaacggtgcggggcagccggccggaattgaatatctcgatgtcaaaaatatgcgggtatgcggattgacagaaccgatcgaagttgaattcgcctacatggaaaacggatcgctaaaaaacatcaagagggagaaaaggttccgcaaatacgttcagatgattgacggcaggaaagtgtactttaaagagtacggcgatccgcgcgtcatggatatgaccaccggagagtttgacaggcagactccccctgaacgaagcgcgaatgaagcgatccattttaaaatcggcagcggcgtctacggcgttccgcgctggatcggaaatattgtcaacctgtacggggcgcggaaagcggaagagctgaattatatgtacttcagacaaggccggcacgtacctgccgtcattacggttgaaaacggcatgctctcagaggcttcctacagagagctgcaggaatatatgaacgacttggaaggggttgaaaatgcccacaaatttttgctgatcgaagcggagggaatcgcacaggaaaaagacattcacggcagccaggacattacgccggtgaaggtggacatcaaatccctcgccgaaattttgcaggaagatgcgctgtttcttgaatatgacgagaaaacccggaataaaatccgctcttccttcaggctcccgccgctctacaccggtgatgcccatgaatataacagggcgacagccgataccgcccgcaaaatcaccgaagaacaggtttttgaaccggagcggaaaatattgatcggcaagctgaatacgctgtttctccgcgatttaaacattttccacgcgaggctccagctgaaaggaccggactttcgcgatccgcttgagatcgcaaaagtgctcggtccttttattcaggcaggagcagtatctgcaaatgatttgcgcgacctggccggcagagtgctcggcaagacgctagatgaatggccggaggaagaattcagcaggccgctcgtttaccaggaaagctcaaagcgtgcggaagcggaagcaggagcattgctgcctgaactgcaggaagccgtcgagacattgaa

SEQ ID NO: 2646 - DNA, 3519 bp, Bacillus licheniformis
atggccgatatgtggattttggacgacaaggacaaaaaacaaacaatcatatcaagcgaagcaaaagaagcatgtcgtttctatgatgcgccatttcgagaagaactgaatgtcggttcttctttttcttttgtcgcggacgcagatcacgaggatagcgttcatataaaaccggagaatcaggtcgttttcgaggacaggagaggaagaaaacgcaatttcgttataaaagagctggaagacgccgacgacggcgcgaatgcccgcattagggcctattgtgagccggcactgtcagagctatacgatgagtttgtgaccgacatcaggccgcaaaatagaacagcccagtacgttcttgaccgtattcttgagggtacaaggtggcgcgcgaatgttccggtcgatcttggcttgcattcaacgaatttttatcgcatcagtgtcatggaagccatcaaccagatattgcagatatggggcggcgagtattatgacgaagttgttttcgatgaaaatgacaatatcgttgatcgagtgatccatattctgccccgacgcggccaagataccgggaagcgtgcggaaatcgataaagacattcaggaaatcaccagaacggtactgagttacccggtaacagccctgtacggttacggcgcaagccttgaaaccgaaggcggcggcaacacccgttatattgatttctcggatgtcgaatgggtcaaagcgaacggcgacccggtagacaaaccaaaagggcaagaatgggtcggcgatcctgaccttttggagaagttcggccgaataatgtatgacggtcagacgaagcggcaccggttccagaaatggcaagacgacagcatcgaagacccggccgaattgcttagaaaaacatatgaagcgcttatcaatcatgaaatggtgcaagtcaattattctctaaagctggaactgcttgaatacatttcgggttatgagcatgaggcggttgatcttggcgatacaatgatcgcaattgacgacaattttcgacaccctatcgaggttcaaactagagtcattgcaatagaatacgatctatctgatcccgtgaatacggcacaggtagaaatggggcaatttttagacctgtattcaaccgaaaagcggatcaaagagcttgaaacgacaattgacacgaatcgcggcaaatgggacaacggcggcgacccgataatcggcgacgggagctttcctgataaagtgccgcctgttccgtcaaatattaaagtcgaatccttattccaaggggtttcgatcacatgggactataatccaagttcatatatagcggcatatcagattttcgcatcgccgaataaaggatttacgcctttggatgaaaatttgattttcagcggtaaattaagcggatacgagcatacgccgggcgttgatcaagtttggtattatcgaatgcgaacgatcaatacacacggcacgccaagcccatttacgcaagagttcacaggcgttaccagaaggattttgactgatgacatcgttttcggggcggttacggccgaaaaacttgccaatctatcagtcacggccgaaaaactttcacagaaattcgatgaatccaacattttgccgggttcagtattgcgtccgggtgaattaggtaacgtcaacggtgcatcatggagcgtgaaagaaggggaattcaacgaagtaactgtcactagaaaagcggacgatacgcgggccgggtttggttttagtgctttctatagatcaaccctgaggctgactaagggtgaaaaatatacattatcattcgaggttaaaaggaataacactcttaatatcaattttatttatttaaaagatgacagtggacaatatcaattggatgcacccgattttaacgacattagctctttcccttccgatgaatttgtaagggttgactatgtttttcagtcaccgatcacaaccgaaacagcccggctgtggttaggaggtaataaagtcggagacgaaaacccttccgtcacctatagaaaaattcaaattcgaaaaggcgatgtaagaaaagaattcgccttcagtccatacgacgtgatgctgactgaacaagcagtttcatcggccttaattgcgaaagcggccatccaatcggcccacatccaagaggcggccattacgacggcggccatcgcaaacggagccattacacgagcaaagctgggaacggctatcattggaacggctcagatcgaagacggggccatcacaaacgcgaaaatcgccaacctttcagccgacaagatcaacgccgggacgatcaaggggattacaattgaaggttcattgattcggggggctagaatcgagccgttatcgtcatccagtgcttacgaatcttacattgaagcaaacaagatttaccagcttagaaaaactagatatggtggttatcaagatcgatatgaagaactcgatatatcctccggtagtatcattcaagattatggcaataggcttgatgatgattcgcacgaatctttgaacaaagttgagatttcaaaagggaaagttgctctttcaagcgggaaaacattttctactggcactacatccagaatggaaatattctctcaacttgggactagcgataacggactgtacggcggcaattttatcactatgtatagaaatgacgaaaaagttttcgaacttcgacaggatagttggacagaccctgacactaatgtaatcatgccgcaaatgtcaatcagagcggagaaagtggatttcgtttcattctttgaagacgtttccgtttatagtgaaaagagtatataccattctgcagaaagaagtgtcgccttattttccaaagatggtccggtaactgtctacgcaaaggacggcatgaaacttaataggggaagcaacggcgaatatacaacatcgataactgctgatgatgctttaaagatcgcatctaaaggaacaatcacgctggaagatacagaatttaacggcgcaagtttatatcttggaacagacagcagaggcccgcgtatttggtcgtattcaattaataaaagaacaaccacagcggcggcaaacctccatatggaccagtacggaacctttcataaggtgacatcatcccaaaaatacaaaattaacatagaggaatttccgaacgatagagtggaaaatattttaaaactaaatcctaaaacatggtttgataaaaaagctgtggaagcatatgcagaaattttagagagcggacaagaagatgacgaaaacaagccatatttcgagcgaatcccgggattaattgccgaagaggtattcgaagccggtctaaaagaatttgtttttttcggaaagccggacgaaaacggaaaccgtgaaattgaaggaattatgtatgatcggctgttcgctttactcatccctattgtcagagacctgaaaacccggatcgaaaatatagaaagcacgttaaattaa

SEQ ID NO: 2647 - DNA, 1470 bp, Bacillus licheniformis
ttccgcgggacgcttacgaacggaatggagcggcattgtctggcttcacgccttgttctttcgatgaccgcatatgctttagccagacgatcacgagggtgtttgcctttgtcgggatgtacctgctgctgaaaagccatgtgattcgcgatgaaaaggcgtatttcatcagaatcgccgtatcgctggcatttgccctgacacccttttggccttcaggaatgcttagtacgcttggtcaccctttggccttatgggcttttttaaacatcagggcagggaacgactcatggaaagagtggtcaacccttgcgcttttaccgctttactcaagctttgtgctcggtttcttctttttccttgccgccgtttcgctgatttggctttatgatttggtcacaaagcgcagctttaaccttcgctttctcggaagtatcgctcttatgacaggcatattcctggcgatagaataccggcttgtttattcggttttcgcttcaggcgaaacgatgcatcgcgttgaatttatttcgtccaggcatgacatccttcattcgtttcggttgtcctttaaaaatttcgtgctcggccacaatcatgtcatgaccgtccatacggcagtgatactgcctttgattgtgctcactttcgggctcgtcgttgctagacaacgcaaaaagcggccaagcgaagaaaagctgttcatctttttattcattttaaattatgcgctttctttatggtatgccctctggttcaacaagctgtgggcgcttccaaagaaaagacagtctgctttcggcattcaatttcgcccgtttccctttttgcgccctcttgtgatatacgcaagctttgccgttgcatgctacatattgtggaaaatggggaagagatggcggcgttttgttcatgccgcactaatcgcccagctgcttgtgcttattccgtttcatgaagagctgacttacggcgcataccaccacgccccaagctttcgggaattttatgcatcagatcagtttaaacagatcaaacgattcatcggccgtcctaccgattcctaccgggtggcgagcatcggcctgcatccggcgattgcgcagtataacggcttctacacacttgatacgtatgccaatatttatccactgaaatacaagtatcaattccggaaaatcatcgccaaagagcttgataaaaatccggccctgaagcgctatttcgatgagtgggggagccgctgctacttgtttgttgacgagcttggaaaacattacgcgttcaaaaagagcacaaagaaaaaaatcacgaacctggagttaaacactgaagcattcaaaaaaatggggggacaatatattttttcttcagttccgattatgaatgcagaacaaaacaagcttgcgtttttaaagcggttcagccacccgcagtccgcttggaacatctatgtatatgaagcgaaat

SEQ ID NO: 2648 - DNA, 1722 bp, Bacillus licheniformis
tggttgacgcgacaaagttcggcgctgtcggcgacggcaaaacagactccacaaatgcgatcaacgaatgtttggcatggacaaagtcgatgggatacaacacggtatggataccgaacggcacgtacatgattgacgggacgaaaaacggcgacccgcgggctccgtttcgcggcgccggcatcaatgttcccggcaatattgaaattttgatggacgcggaggctgtcatcaaggtaaagccgaacagttcatggggatacgctgctttttatataggcggaacatccgatataaaaatatccggaggcagcatcattggtgaaagagatgaacacacatatacaccggccccgaggccgacccatgaatggggattcggaatttgcatcgaaggggcgtcaaatgtcgtcattgaacacgtgagaatagccgattttacaggagacggaatcattatcagcaacggaggagaagggtatagaccgtcagagcgtattcaggtaaccaattgcgatatcaggcgctccagaagaaataacttgtccatcacagggtgcgacaatgttcttgtagaaggatgcgaaattgcagatgcgggaacaggaaacggaaccgctccttgctttggcattgatatagaaggctatagtgaaggaagcatcgtctatgaagaacccgtcaatgtcatcatcagaaacaacgtgttaaaaggcaatgtcaatcatgccgtttccaacttcaacggtacttctgtcatcatcgaaggcaatgttgcagacggtaccatttcatacggctatggaacggggacgacgattgcaaacaatatcatcaagaaaaatcccgaattcaccgggcagagcactggaattaacggcctcggtgtaggggctttggaagaaagaagcgatgccgtaataaagggaaatttgatttccggttttacgacaggcatagatatccgcggaaaaagcgtttttgctacggggaataaaatccgtgattttgtaaatgccggaattcttgcttatcaagcgtcgcaagtcttcattgaaggaaattatattgaaaacgacgtacctgaacaaaggtccggcaccgctttcagcatcacgcaatcagacaatgtaacatgttccggcaatcatattgcaaatgtcgttcttgctgtcaggagcacagggaacgacgtccaaatcaagcataacgtcattaagcaattttccagaggcatatggatatctcaaggaaatgctgtaatagaaggaaactttatttcgccgaacggctttcaaacggtgccggagtcatatgctgtatccgtcacaaacacagcttcggcagttattcaacaaaacaccatcacacgcttcagaaactttccaatatactgctcgacaaatcagcatacaaaaattatcggaaactatattgaagattcaccgctgatcgtcacggtgtttctcacccgcggaacacacgaggttatcggcaatacgataacgctcagcaggccgtccttgccggctgtcctcatttatcttgaccaatcgtcggactcggcgatcctcaacaacacgcttcgaagcaatacggaagcaagagtaacggccattcaaaccaatacgtcaaggcaaacgctcatcatcggcaatacgattgtcaaaggaatgatccattcccaccaaacagatacagtcaatggaaatatcgaagttt

SEQ ID NO: 2649 - DNA, 1226 bp, Bacillus licheniformis
atgagtgctcaaaagcaagagaagacgaacgtattccttgatccttctaagaatgaagcgtatttcaagaagcgggtcggcatgggagaaagctttgaccttggcgtacggaaggtctttattctcggacatgaagttcagctttattatgtcaacggattgtgcgacacacaatacatcattcacctgttaagagaactggtgcatctgaatgataaagaaaaagaatcgggcgaggtcgaagacatcgtcgaaaacaggcttttgaaccagcaggtttcaaaagcggaaacgcttgatgaagctgtcgaccaagtgttgtcaggactggttgccatcatcgtcgaagatgcgggctttgcttttatcatcgatgtcagaagctacccgggcagaacgccggaagaacctgatacagaaaaagtcgtacgcggtgcaagggacggactcgtcgagaacatcatcgtcaacacagccctgattagacgccggatcagagatgagcgcttgcgctacaaaatgcttcatatcggtgaacgctctaaaacagacatctgcctctgctatttggaagacgttgcagatcccgatcttgttgaagtattaaaaaaagaaattgaagatgtgaagatcgacgggctgccgatgtcggataaatcggtagaggaattcctggtcggccaaggctacaatccgtttccgcttgtcaggtttacggaaagggcagacgtagccgcaagccatattttagaggggcatgtcatcgtgatcgtcgatacgtcgccaagcgtcatcatcacaccgaccactttgtttcaccatgttcagcatgctgaggaatacagacagacgccggctgttgggacgtttttaaggtgggtgcggtttttcggtattttggcctccacctttttgctgccgctttggctgctgtttgtcattcatccgtcgctcttgcctgataatttatcgtttatcgggttgaataaagacacccatattccgattatcatgcagattttcctggcggatctcggcgtcgaatttttaagaatggccgccattcatacgccgacggcgctttcgactgcaatgggcctgatcgccgctgtattgatcggcgatatcgcgatcaatgtcggcttgttttctcccgaagtcattttatacgtttccctctcggcaatcggagcctacacgacaccaagctacgagctgagcctggc

SEQ ID NO: 2650 - DNA, 1035 bp, Bacillus licheniformis
ggaggaatataatgaagaaattaatcagcatcatctttatctttgtattaggggttgtcgggtcattgacagcggcggtttcggcagaagcagcttctgccttaaactcgggcaaagtaaatccgcttgccgacttcagcttaaaaggctttgccgcactaaacggcggaacaacgggcggagaaggcggtcagacggtaaccgtaacaacgggagatcagctgattgcggcattaaaaaataagaatgcaaatacgcctttaaaaatttatgtcaacggcaccattacaacatcaaatacatccgcatcaaagattgacgtcaaagacgtgtcaaacgtatcgattgtcggatcagggaccaaaggggaactcaaagggatcggcatcaaaatatggcgggccaacaacatcatcatccgcaacttgaaaattcacgaggtcgcctcaggcgataaagacgcgatcggcattgaaggcccttctaaaaacatttgggttgatcataatgagctttaccacagcctgaacgttgacaaagattactatgacggattatttgacgtcaaaagagatgcggaatatattacattctcttggaactatgtgcacgatggatggaaatcaatgctgatgggttcatcggacagcgataattacaacaggacgattacattccatcataactggtttgagaatctgaattcgcgtgtgccgtcattccgtttcggagaaggccatatttacaacaactatttcaataaaatcatcgacagcggaattaattcgaggatgggcgcgcgcatcagaattgagaacaacctctttgaaaacgccaaagatccgattgtctcttggtacagcagttcaccgggctattggcatgtatccaacaacaaatttgtaaactctaggggcagtatgccgactacctctactacaacctataatccgccatacagctactcactcgacaatgtcgacaatgtaaaatcaatcgtcaagcaaaatgccggagtcggcaaaatcaatccat

SEQ ID NO: 2651 - DNA, 1569 bp, Bacillus licheniformis
atgagatggtggaaagcaaaaacgcgaagaatgatacagtcgtccaacaagccggataaacctaaaaatgaagtgccgtctgtggagtcaactgggtattttaccggcgattttgatcacgacttgaaactggccaaaacggctatggagaataactcagacgttcatttccgcgaattcaacttagggcgcaccggcatccgcgcggcgattgtatttgtcgaaatgcttgcggatcaagacctgattgacaagcatattatgaaatcccttatggatgatttttccaaagaatataaagttgaactttcttcattaagcagcaatgtgaccgacttaattaaaaagcaaattttatcaattagcggcgtatcagaggtaaaccatgtcaacgaagtggtgcccgaagtgttatccggtgcggccatgctgctgatcgacggttcagcggaagttttactgctgggaactgttaaaagaaatacaaggaacattgaagagcccgtatcagaatctttggtaagaggcgcgcgcgtcggctttacagaaacgatcggcaccaatacagcccttttgaggcagcacggcaaaaatcaaaacttgtctatggttcaatttcaagttgggaagcgagccgtcaaaaatcttgtcgtcgcttatatcaaagacattgcggaaccagggctggtggaagaagtcaaaaaaagaatcgaaaagattgatatagatgatgtccttgaatcaggttttgtcgaacagctgatcgaagacaattatctcagtccatttccgcaggtgcaaagcactgaacgtcttgacagggtaatgagtgcgttaatggagggaagagtggccattttattggacggaacgccttttgttttaatcgttccggttacattcagcatgctcctccaatcgcccgaggattattatgaacgctggctgccgagttccctgatccgcatcatgcgaatcggcgcagccatgatctcgctgcttgggccggctctatatatttcctttatttcgtttcatcccgggctgattccgagtgaacttgcgatttccattaccggaacgagggtaggtgtgccttttccatcgctgattgaagcgctcattatggaagtggcaattgaaattttgcgcgaggccggcctgcggcttccaaaaccaatcggtcccgcgatgggaatcgtcggcggtatcatcatcggggaggctgccgtgcaggcaggcatcgtcagcccgattatggtcatcgtcgttgccgtcaccgcgatttcttcatttgcgattcctcaatacagcgccggcatttcgctgcgcatgctgagatttgtagcgatgttttgtgcagccacgttcggtttgtacggggtgattatgtttttcctcatgcttgccagccacgcggtgaagctgaaaagctttggcgttccttatgcgagccctgccgttccttatcgtttgcgcgattggaaagacttcatcgttcgcatgccgatacagatgatgaaaaaacggccgaagctgttaaaaacagacgattcgacacgccagtag

SEQ ID NO: 2652 - DNA, 1087 bp, Bacillus licheniformis
atgtcactgcagcattttattcagaatgctttaagcaattggatgcggcaagaaggccctgagagtgacatcgtgcttagcagccggatccgtcttgcgcgcaatttggataaagtccgttttccaacgcttttttcaaatgaagaggcttcagcgattatagcattgtttgaagaacagttcacaggctatgaagtgcccggtatcgggaagtttgagcttgtgaaaatggatcaggtccagcctttggaaaaaagggttcttgtggaaaaacatctgatcagtccgcatttgacggaagcttcctttggcgcatgccttctttctgaaaatgaagaagtgagtattatgctgaatgaggaagatcatattcgcattcaatgtctatttccgggatttcagctgtcagaagcattgaaagcagcaaatcaggtggacgattggattgaagaccggatcgactacgctttttccgaacaaagaggctacttgaccagctgccctacaaatgtcggaacagggcttagagcttctgtcatgatgcaccttcctgctttagtgttaactaggcaaataaacagaattattccggcaattaatcaattagggcttgttgttagaggaatttacggtgaaggcagcgaagcattagggaatatctttcaaatttccaaccaaattaccctcggtaaatcggaacacgacattgtcgaagatctgaacagtgtcgttgctcagctgatcgaacaagagcgttcagcaagaaaggcgctttatcagacttcgcaaatcgaacttgaagaccgcgtctacagatcttacggcgtactgtccaattgccggatgatcgagtcgaaagaaacagcaagatgtctttcagacgttcgtcttggaattgacctggggataataaaaggtctttccagcaatatacttaatgagctgatgatcctgacacagcctggatttctccagcaatattccggaggagccttaaggccaaacgagagggacatcaggcgggctgctcttatcagggagcgcttgaaattagaaaacaacggcaatagacaggaggatgaaacga

SEQ ID NO: 2653 - DNA, 1097 bp, Bacillus licheniformis
ttggcagtaccggagcatccttttggattaatggctaaagtatacagagaggtttttccccttgttcatcaggaattggacaagtggaaacgaaaagctgaaacgattcaaaatcccgaactgaaaacgcaggcgaaagccagcatcagggataaaacctttcactgtgaaggcggcggcattatggcccttctttcaggagacaaaatcgagcagtcgatccggtttattacggcgtatcagacgataagcgactacctcgacaatctatgcgaccggagcacctcgcttgatccggatgatttcaccatgcttcaccagtcgatgaaagacgcgctgacagtcggggctgaattgaaaaactattaccggttcagggaagatcaggatgatcaaggctatttgcacgacttagtgaaaacatgtcaaggcgtgcttgcggaaattgagaactatgatctgatcaaggagcatctgattgagctttgcagctactattgcgacctgcaagttcataaacacgtagtggagcatgagcgtgttccccggctcgaagcgtggtttgagaattataaatcggctctgccgaaaatggaatggtatgagttctcggcctgtgcgggttcaacgctcggcatcttctgcctcgtatcgtattccgtccgtcccgattttactgaatcgatggccggaaagatccgcgacagctattttccgtacatacagggactgcacatcctgctcgattatttaattgaccaggaggaagatttaatcggcggggatttgaatttctgcacttattacccatcacattcagatatgatggaaaggctcgaatatttcatcgaaatggcggatgaacatttgcgcgggattccgcacgaaaactttcaccgtttgatcaacagaggactgttaggcgtttatttgtcggatgacaaagtagcgggccagaaggaaatcggccggcttgcgaaaaagctgattaaagcgagcggcaaaacatctttctttttctatattaacggcagggcataccgcaaaattcaaaaaatgccgtggatgaaaagctcgtaaagaaaagctcaaaccgt

SEQ ID NO: 2654 - DNA, 3222 bp, Bacillus licheniformis
atgcacgcgggaaaagataaaattcaagaattcacaaaggaaatcgaaggaagcggcggcacagctgaaagagtagccaaaaagcaaatggacaacctggctggctctattgagtatctgaaatctgctacaaacaatgctgttatcacttttggaaatcagttcttgcctgttatccgggctacagctgacggactaacaaagcttgtaacctggtttgattcattgcccccttctgtggcgagtaccattgcgattactggcggtgcagtcactgtattttccctcttaggcggcgcgttcttactgttgcttggctctttgccaaaagtagcagcaggctggaatatgcttcggaccgcgggcggctatttaacgcggaatgtaaatcaagcatcgggcagtcttggcgtttattctacggaagccattgcagcgggcgcagcttccaggacagcggctgcaggtatgacaacaacatctgcggcagcggcagcagcatccacacgaatggggcgttttcatcagtcagccaatctggcaacaaccagagtcgggaggcttgaacaatcatccagcagaagtgctaaagccatgcgaggcctaggcggtgcttcacgtgttgccggcgttggccttggattgtttggcgggccagttggttcaattgccgggctaatactttcatttgctcctgagctcttaaaattcggtgggaatattttaaaggttggagccaatgcaattaaaggcgctggcggctttatgaaattagcaaaaagcggttttggcctattcaacattctcaaaaaaggagcaggagttgtcggccttttacgtggcggattgagcttgttaggcggtccagttggtcttgctgtgacaggagtgacacttttaaccgaagctggtacaaagtattatgacaatctgaagaaaagggttcttccatcgactattgactttggtgagggagtatcgaaggctactgcaaaagctgtgaatgcatatgaagatatgaatattaaagttacggcaaagctcaatacccttcgagcaacaaatacaaagatcaccaaggatattgccgatgatgtgacaaagcagttcactgaaatgggaaactcgctgaaaaagggatttcaaacaagtgctgattccgccaccaaggtgttacaggaattttatgcttcaaatgataaaacgtcagataaagaagcagctaaaatcctcaataaaatcaaaaatggaaatgataagaaacagaaggaaatacaaggttatgtggatcgggtaaatgaaatttacagaaccgcggctgaagaaaatcgaaaaacaacagcgaaggaaaacagagaaatagcagagatacaggggaaaatgttggctcaaatggagacggctcttactcgaagcaaggacgagcaaattaaaatttcaaggaagctgaaggaagaatcctctaacttatctgctaaacaggctgctgctgttgtgaaaaatagtaataaagcaaaagaaaaaacaataaaggcggccgaaaagcagcgtgattccgttattgctgctgccgatgatcagtattatgtaaaaggcacaatttcaaagaaagagcacgatgacacagttggaaaagcaaaaagccaagccaaaaaaacaattaagcaagcagaaaagacgcataaaggtgtagtcaaggaggcaaagcttcaagcttatggacatattgatcaagttgattttgagacaggtgaagtccttggtaaatgggatatttttgttctcgacttagctggtgttgttaataagattaccggtggaattaacacggttcttgaatttatgcatatcccaaccattccagagtggaagcctaaaggttacaatggccggtctgaaaaaatgcaaattgcgccaggagctgcatatgcgaaaggtacagactttcaccctggaggaaaggcgcttgttggtgaaaaaggatgggaactggcccatacaccaggcatcggaatgtatgtagtcggtatgggcggcccgcaaatttgggacctaccgcgcggcacatctgtacttcctcatgatcagtcaaaagagcttgcagcttcggggcttcctggatatgcaggcggggtcggcgacttttttaaaaaagccgctgaaggctctaagaaaatggtcaatggagctatttctttcggaaaaggtgttgtggacaaagtcggggatgttagttcaagcgctatggacttgataatcaacggcccaggaaaattaattaaaaaactgtttagcggcctgatcccgtataaatcgggaaaaggtattgattcgtttggaaccggcatactcaagactttaaaaaatggtgcagctcaatttttgaaaggagtcatgccagagccgtccacatttaaagggaccggaggaacgaaagccgtaaaccaatgggttacagaggctgttggtatagcaggggtgccactttcatggattccagggcttgtgaccatcgccatgaaggaaagcggcggaaatccaaatgctatcaacttatgggattccaatgcgaaagcaggccatccttcacaggggttgatgcagacgatcccgagcacttttaacgccaataagtttcctggacataataacattttgaatccgatagataatacgttggctgcaattaactatatcaagcgcagatatggagacattagcaatcatccaggcttaaaatcaatggcccgaggtggcggctatgttggttatgcaaaaggtggtatctcacctggacggggtggctcaaaatgggccatcttaaatgaacgagggtatgatgaaacaacgatcacggaagatccttcatacagggagcgtaatattgggctatgggctcggattggtagcaaacttggcgtacttccggatttacaggatgggatgatttcaaaagcactactcctgcttcaaaaagtttcggaaaagcccaaacagcagctaccacctaatgatttttctgtagacatcagccgtgttgtaaagaatcaagaaaaacaaatcagtatgatggcaaagcaaattgattttctaaataaaaatgtgcagctcttgcagcgacttttactaaaagacaacaacacatatcttgatggcagaaaaattgaccaatcagccggggatcggtttactcgaacttcattcataaacggggtgagatag

SEQ ID NO: 2655 - DNA, 933 bp, Bacillus licheniformis
gaaaaaagcgggataaggagccgacaggaaagcttgaagaggcaaggctccgctcgaaagataatcaaaaggaacgggtcttgatcagagtcggttcgaacacaacgattatcgggctcggagatgatgcgaaaatcgtcggcggaggcctttatgtcaaaaacgcggaaaacgtcattatccgcaatatcgaattcgaaaacgcgtacgatttcttccctggctgggatccgacggatgggagcagcggtaactggaattcagaatatgacaacctgctgatcgaaatgtccaaaaatatttggatcgaccactgctcattcaatgacggagatcagcctgatgagctgactgaaacgcatttcgggcgcgaattccagcatcacgacggactgcttgatatcaaaaagcagtcggatttcattacggtgtcatacagcatattttcaggacattctaaaaacacgattatcggatcaagcgacagctacaaagcagacaacgggcatttaagggtgacattccaccacaatctctacgaaaatataaaagagcgggcaccgcgcgtccgctacggaaaagtgcacatttacaacaactattttaaaagcacgaaagacagctacaattattcatggggcgtaggctattcttcaaaaatttatgctgaggacaactactttgacctgccggaaggaacgaagcctcaaaaactgatgaaggtctttaaaggtgacgctttatatgaaaaagatacgatcgtaaacaaccaaaaaagcgtcgcaaaaattgatgttgtcagcacatacaacaaagcaaacaatgcgtctattaaaaaatcggccggctggaagccgacgctgtttgaaaaaatcgacgacgcagaagatgtgccggcaatcgttgaagcgcacgcaggcgcaggaaaactga

SEQ ID NO: 2656 - DNA, 1307 bp, Bacillus licheniformis
atggataagttcttaaacaatccctgggctgtcaaagttgtcgcgttattgttcgcgtttcttctttactttgcggtccacagcgctcaggcgccgactccgaagaaaccaggtgaatcgtttttcccgacatcgacaacagacgaagcgacgctcaccgatataccggtcaaatcgttttatgatgatgaaaactacgtcgtaacaggcgtgccgcagacggtgaatgtcacgattaaaggcccgaccggaaccgtcaagaaggtcagacaagtgaaggattttgagatttatgccgacatgcaaaacctgaaaacaggcaggcataaagtcgagctgaaggccagaaatgttgccgacggcctcactctgaccatcaatccatcggtgacaaccgtgacgatcgaagaaaaaacgacgaaggaattcccggtcgaggttgatttttataataaaaacaaaatgaaagacggctacacgccggagctgccgatcatcaacccgaaaaacgtcagcgtcaccggctcaaaagccgtgatcgacagaatccagaacatcaaggcgacgatcaatttagagggcgtcgaccagacggttgaaaaagaagccaagcttacagtatacgacaaggacggaaatgtcctgccggttgaagtcagcccttccgtcgttaaaatcaccgttccggtgacgagcccgagcaaaaagattccggtcaaagttgaccggaaaggcagccttccggacggcatcagcatttccagcctcgatataagtccgggagaggtgaccgtctacgggccgcaaaatgttcttgattcgttagaatttgtcgaggccgacgagattgatttaagtaaaataaaggatgatactgaattggaagccggcattaaagtgccggacggcgctaaaaaggtgtcacccgaaaaagtgaaaatcaaggtgaaagttgacaaggaagaagagaaaaaactgaaaaacgtttcaattaaaaccgcggggctgaatgacagccgggatcttgaatttctcgatccgaagtcaggcaagctggatatcacggcaaagggctcgacagccgcgatcgaaaaactccagccttccgacgtcgagctctatgtcaatgtggcggatctcgatgacggcgagcacaatgtaaagctggaagtaaacggtccgcagaacatgacatggtcgctgccgcggcaaagcattcgagtgaaaatctcatctcaaacaacccaaaacgaaaaaaacaatggtcaggatgaagaagaagagaatcattctgaaaaggattcaca

SEQ ID NO: 2657 - DNA, 1374 bp, Bacillus licheniformis
atggaaattgaattaacgtccgttcactttttatatttgggctttattgcagctattctcgcatttatgctacttcgtcttgataccacctttatatcgcttgtcgggatttttttcatctcattagccgcgacccattcagtcatggcgtctgtgatgggcatgtttaacagcttaatctacgccgccggggaacttcttccgactattttcatcatctgctttaccgtttcgatgagtgagctactggtaaagaccggcgtcaatgaagcaatggtcactccgatcgccaaatggatgaaaggccctgtcttggcctactggatcaccggagctttaatgtttatcatttcttcatttttttggccctccccggctgtcgcattggtcggcgccgtcctcctgcccgccgcgctgaaagccggcctctccccgatggcggtagcgtgcgccatgaatttattcggccacggtttcgctttatcaggcgattacatcatccaggcagcgcctaaattgaccggagatgcagccgggctgcccgttgcggaagtgatgtctgcaagcgttccgctcgtcttgatcatgggcttttcgacaacgggggcagcctttttgatgctccggaaagagaaaggcaatagagcagcggccagtaagcagctgcaaagcgagcctgagtggcttcttccccagacctccagaaaatggctcgcgctgttgattccggtcatttttttaggagatatcgccgcgatgctgatattggaactgcagggggacgaagcgacggcgcttgtcggaggaacggcagtcttcgtcatgattctcattcattttatcgtccacaaacaccggcgtcttgagaaaatcaccggctatttcattagcggatttcagtttggctttaaagtgtttgcccccgtcattccaatcgccgcctttttttacttgggcgatgcgggttttgaaaaagtactgacagcagagattcccggtttttctaataggatcgtgcaggacctcggctcggcctttgcccacagcgttccgctctctccggaaatcgccgctgttgcgctcactgtcacaggagcggtgaccggtcttgacggatccggattttcggggatttctctcgcaggatcagccgcttcgatgtttgctgcggcggttgacagcaatccagccgttctgactgcgctcggccaaatctcagccatttgggtcggcggcggtacgcttgtgccatgggcgctcattccagttgcagcgatttgcaaagttgacccgttcgatcttgccagaaaaaactttattcctgtagctgccggattaaccgtcacaacgattgccgccatttttcttctataa

SEQ ID NO: 2658 - DNA, 1221 bp, Bacillus licheniformis
aaaaagcaatctggctgcttgctggaatgtttgtcttcagtacactaaccgcagcagctgcctttccggacaaagaaaaaaaagcaaaggtctcaccgggtattgaagtgctcatgaacaaaaaaagcatattaaaaggaaaaagggtcggtctcattacaaatccaaccggtgtcaattcgacattaacaagcagcatcgatttgcttcaccaagcccccggtattgagctgaccgctctctatggtccagagcacggtgtaagaggagacgctcaagccggtgacaaggttgactcttatattgatgaaaaaaccggtctccccgtctacagcctctacggagatacgagaaagccgacaccggagatgttgaaaaacgttgacgtcctgctatttgatatccaagatgtcggaacacggttttacacttacatttacactatggcatatgcgatggaagcggcaaaagaaaatgatattccattcatcgtccttgaccgcccaaacccgcaaaacggcttaaaagttgaagggcctgtcctagatccggattattcttcatttgtcggaatgtatcccgtccctctaagtcacggaatgacggcaggagaattggcaaagctgtttaatgatgaatttaacatcggagccgacctaaccgtcataaaaatgaaaggctggaagcggcagatgttctttgaagacaccggtcttcctttcgtcctgccttccccgaacatgccgacgccggatacgagcatcgtctacccgggcacaggtttaattgaaggaaccaacatgtcagagggaaggggcacgacaaagccatttgaattgattggtgcgccttacatgaaaagtacggagctcgccgaaaaattaaacggtctgaagctgcctggcgtcagattcagagccgcctccttcaatccgacattttcaaagcatcagaataaactgtgccacggggtggagctttacgtgaccaacaggtccgcttttaagcctgtaaataccggtattgcgatcatcaaaaccgtccatgacctctacccggacgactttgagttcctcccttcaggcaatttcaaccgtctgatcgggaacggatgggtcaaaacaatgattgagcaaggcgcttcaattgatgaaatcgccaaaaaatacgaagcagagcaaaaacggtttatgaatatcagaaagaagtatttgctttatt

SEQ ID NO: 2659 - DNA, 2045 bp, Bacillus licheniformis
atgaaaaagctgcatcaaagatatgtttcacggcgtaaagggagtttttttaaaaaaagctttgtgatgatcctgctgattgcgtgtattcccggcttattgacgggtgcaggagtctatttgttttcggctgcgaaaattgaaaaagagctccaacatctgcacgagaaccaggtgaaacgccaaatcagccaaatcgatgacaagctggaagggcttgagatcatgctctcccagcttgcatatgatccgcgcctgatgaacggtctggccgatgccgatctgcaaacggattttcaaacgacgtacaagctctcaaaatcgctgtttttgcttcaggatcaaaatccgctcattcacaaggttgaactgttcattcaagggaaggagccgattctcttaaatccagaatacaacggactgaccgaccggaaaatcttgaaggcttatcattcgctgcttgaaggcggtcaaaacgtctattggaaagacatgagcggcgcttcatccggaatggcccttgtccataaaattccgggaggcatcttagaaccgttcggcgcgctgattttgacgcttgacgaaagagaattgggccggttgcttgagagcctttcgccgtattcaaagggaacagcgctcctttttcatcataatcagaagcctgtttcttggagcaatcgcggcaaaaccaactttgaaagcgccttaaaagaaaggcttgagaaacaaaaaaatccacagggctcctttgttatggattggagcggaggtgcgtattccgtttcatacggacgaatggacagattgaaccaggaatggacctatgtttcggcttcaccgatgtcggccattacggctccggtgctgtttttatcgaagctcatcgcgtcggtcagcatcgccgggatcgttcttgccttcattctggcatggtatgcgtcacacaaaatttattcacctgtcgcaaggctgatcaagctctgctccggagagggaaaggcggcctattttccggatgaatttcattggctcgagaagcgctgggaagacctatctgaggaaagcggcagactgaaaaaggaactgccccatgctgcaaacgttttttttcagcgccttctgagcggatactttgcagatgaatcagagaggaatttgagagatcgtctgaaaaggtggggctgggaagcaaaagacaatgtgtttaccatcatcgatgtccagctgacgggactctacgaaggaaacggatcttttacaaaaaaggatgaaagtctggcgggctttctgttgggaaacattacgcgcgaactggctggaaggacattcaaccatatttatatgacagatgtccgttcgctatcgcttgcggtgctgctggcgagcggccggaatacagccttcaaggaagaaatcgcccaatttgtgcgtgagctgacagatgtgatctacagcatatccaaactgcacgtcacagtgacggtatcaaaaaccgctgacaagttaaaagacattcccggcatttatgaagaggtgaaagaaggcaggcattacagacagttcgaaaacgccagccaggtgatcgatttaagccggcgggaagacatgcctcccgctgaatcatactatccgttcgctcttgaaaaagaggtagtcagggcgttgcggcttgaagaaagggatgaagtcgaaagaaggatcaggctgtttatccgggagctgtccgaaaaaggaaaaacggaaatccgcatccagccgggcatgatgcagctgttcgcaaagatccaagaagagatctttcattccggccttcacccctatgaattgttcagccgaaaaaacctgcttcaggagctttcggagctgaaggagccggaaagggctgtcggctggatgatggagcgaagaataagcccttatcttaaagagatggaaggaaggaaaaacagacagcaaaaacggcttgtccaacaggtgcttgacatgattcatcaggattatatgaacgatatctcgcttgaaagctgcgctgatcgggccgg

SEQ ID NO: 2660 - DNA, 3057 bp, Bacillus licheniformis
atgtgctgtagaaaggaagaaagcgaaatgacggaacaacaaaaaagcacgctgaaaattatcagcgccatcgtcacgatcatcttgctgcccgtcctgttttttcatttcatcggtgagaacccgacgaaaaaggtatcgaacgcgacaagggaaatcgccgttgtcaatgaggataccggcgttttgaaagatgacggaaccgttgatcaagatgcgctgctgggaaacgaaatctcggcttccctggttgaccgtccggattataaatggacggtcgtcaaccggagcgcagcagaaagcggacttgcggagaagcaatacgatgcgattgtctacattccgtcggacttttcgcaaaacattttaagctacaaccatgagcgtccgcaaaaagcggagctggaattcaaaattcaggaccagctcgacgccgtcaacaaggaaaaagtccagcgcgagcttcaggacgcgcaaaaaacggtgagcaagaaaatgtcttccctgtactggcgctttgtcaaacagggagtcaaaaaggtcagaaaagagtttgacagcatcgtaaacaaagagtcggagttccaaaacgcgatgtacaatttttacaagccgagctccaacaatttagctggcgaagtagaaagacaaaaagagatgatcgacagactgaaagaatcgatcaatgaaacagaaggcacatcaaaagaacgcaacgcaagcgtcgaagaatccaaaaaacaattggacagcttcgtcgacaacgtcaatcaatacaaacaatatcaagagaagcagtcggagctgctgatggctgcacaagcggacagcgaaggccagattcaagacggacttacggtgattaaggaaaagcagtccagcgcaacaagccgtttcaatgaacaaatgagcggcatggccgcttcgttcaacggcttgcaaaatcaattcagcctgactgcgaactcttttcaaaacctgcaaacgatgcgggaaaatcaggtgcctttacaggcgattgggattgaaagtattcagaaacagttgatcgatgattatcaggatcaaacgaaactagagagactcagagggcttcaacctgatttaatttcaatgcggtcagaactggctaaaggctcagaagatgattcaaatgataacccaggtaatgaagataaagaagatcaggataaaggtgatgaagaagaaccaaaagatctaaaaattgatcttcaagaacagcaagatgaattgaagagcattgcggctgatcttaaagaattatcggacgggctaaaggattcctcagggaatgaaggcgacaattcaggagataaagaaccatctgccggagacccgaatcaaggacaagaaccttcccctggaaccggggaaaacggtcagcaaggcgacgcggcaactccttcagatgagataaatgatcaagggacgggtgaagatgatcaacagctgaaacctggaaacgaacaaccggaagatgagaatgctaagttaaaagaacaattgaacgaagccgcagcaaggcttgaaaaattggaagaagatcttcgtgctaaacaggacactcataacgaagagctggaaaaacagattgaaaacttaaataagaaaattagtagtctgaaagaaaacattaaggatttaaagcatgaaatcaaagatttgaaggtggatattgagaatctcaataaaaattttgatgtaatctatgatagtattaaaaaaattgaaaatggcatattagagtatcttccgaaagatagtgatcgaagagaaacgttaagcaaggcttttgagtcaacgattcgtacgagagatgtagaccagttacttaaatactataagttactttcaaactatgaaacaacgctatacggatcagtagattatacaattaagaacaatgtcatctccgcgaaaaaagacagcgtgaataccgtccttaaaatcggtgaaaccgaagcggaaaaatggagcaatttaaaaaacaacatgctgtctacaaatgaagatattgaaaattatacaaaagacatgaccgatttcgtcaaaagctacggcgatttcattaatgagaagcagactgacgtgctgaatgagctcagcacgatttcagacagagcaaatgccgtatctgaacagctgcgcaatccggaaggcgccggaacagcagtcatgcagggagatgcgacagatggaacgatggtcatcagcatgcaggatacgcttggaaatgacattttgcagctgtccaacatgctcggttccttgtcggaaacgcaatcaggcgtcatcgagtacacgagcaatattcaggaaagtgtaaacgatgttcagaaaaaagcggataccctgaattcaaactggggtcaaaatgtcgcgacgacaaagcttatccgcggagacgtatacggcattctcggaaatgcgttcggaggaaacgacggatatgtatacgatcatctggcaagtccggtgaaaatcagcggggatgttccagagtcaaaagcgcaaaacgtaccgccggtcgtcattctcgtgattgtgatgctttccagcttgctgatcggatatttcagccaccattatcaaaatgctccgctcttagtcaggggcgcgctgttcggcattttgaatatcattgtcggactgatgatcagcctgttcggtttgaacatttactcactcgcagacgatcaggccgtcatgtggtcggtctttacgatcttgctgcttgtcgcaagttcagccattatccggacggcgtttatgctgggatcgatcgcaggcggaatcgcgacagccgccatggtgctgttctatgtagcgccgctgcttgacctggcgatgccgaacttcagctttaacaatccggtatcaaccgtatatatgtcgattcagtacggaactggaagccagtttgcactcggaatcggagcattaattttaatcacgatcatcgcaattgctgttccttttattgtcgattttgcaaaatcaagaacagaagaaagcgagactgaccatgatgcgtaa

SEQ ID NO: 2661 - DNA, 975 bp, Bacillus licheniformis
atggtgttttttagaaatcaatttgcaaatgtagtagagtgggatgaatttcgcgatgatatgattttctataaatggaacaaccgcgaaatcaaaaaggggagccggctgatcattcgccccggtcaggatgccgtctttttaaacaacggaaaaattgaaggcattttccaggatgagggcgactatgatattgaatccgaaattattccttttttatccactttaaaaggttttaaatttggctttaacagcgggatgcgcgccgaagtcctgtttgtcaacacgaaggaatttaccgtcaagtgggggacgaagaatgccatcaatatcccggctgcaggacttccgggcggcatgccgatcagggcgaacggaagatttaactttaaggtgaatgattatgtcgcattaatcgataaaattgccggtgtgaaagatcagtatgttgtggaagatatcaaaatacggatcacatccattctcgatcagcttctgatgaagtggatcacaaaagaaggaaaagatatgttcaaccttcaagccaacgcctttgatatcgcaaagggaatcaaggaagatcttgatatggagattgtcggcgacggcatgacgataacaggctttaacatcatgagtttcaattatccgaaagaagtccaggacatgatcacgaaaaacgcttcccacggcatggtcggcgatctgaacagatatcagcagatttcaatgacagacggcatggcttcaggaaagatgacaggcggcggtgccgcatctgacatggccggcatgatgatggggatgaacgtggcgaaccaaatgatgaatcagatgaaccaaaatcagcaggcgcaaacacagacgccaccaagcgcgccgcagccagcggcaaaaccgaacttctgtccaaactgcggaacgaaaacgggcgaagccaatttctgtccgaactgcggtcagaagctagtgtaa

SEQ ID NO: 2662 - DNA, 993 bp, Bacillus licheniformis
atggatccgtcaacactgtttcttttacttattatcgcagccggaatcatcctactagctgtcttctttacattcgtcccggtcatgctgtggatctcggctttggccgctggtgttaaaatcagcattttcacactgatcggaatgaggctccgccgcgtcattccaaaccgcgtggtgaacccgctcatcaaagcgcacaaagcgggacttgatgttgccatcaatcagctggaaagccactatcttgcagggggtaatgttgaccgggtcgtcaacgcgcttatcgctgcccaacgtgcaaacattgaacttacattcgccagatgtgcggccatcgatttagcgggccgtgacgtgcttgaagccgttcaaatgagcgttaatccgaaagtcatcgaaacgccgtttattgccggtgtagcaatggatggtatcgaagtgaaagcaaaagcgagaatcacggttcgcgctaacatcgaccgccttgtcgggggagcgggcgaagaaacgatcattgcccgtgtcggcgaagggatcgtttcgacaatcggttcttccgataatcataaaaaagtgcttgaaaacccagatatgatttcacaaaccgtattgagcaaagggttggattcaggtacagcgtttgaaattctatcgatcgatatcgctgacgttgacatcggcaaaaacatcggagcgattctgcaaaccgaccaggctgaagccgataaaaacatcgcccaggcgaaagcggaagagcgccgcgccatggcggttgcgcaagaacaggaaatgcgcgcccgcgtcgaagaaatgcgcgccaaagtcgtcgaagccgaagccgaagtgccgcttgcaatgtctgaagctctccgcagcggaaaaatcggcgtcatggactacctcaatatgaaaaacatcgacgccgacactgacatgcgcgattctttcggaaagatgacgaaagaccaaaatgaagaggatcataaataa

SEQ ID NO: 2663 - DNA, 987 bp, Bacillus licheniformis
atgatgaaaattaaagcaacgattgaacgtgtgccgggcggcatgatgatcattccgctctttctgggcgcaacgctgaatacatttgcaccgggaaccgcagagtttttcggcggatttacaggcgccctgattaccggaacgctgccgattttaggagtatttatcttttgcgttggcgcgacaatagattttcgttcttcaggatatattgcgaggaaggggctgacgcttctgatcggcaaagtcggctttgccgcattattgggtttgatcgcagcgcagttcattccagacgaaggcattcaaagcgggttttttgccggactgtccgtgctggcgatcgtagccgttatgaatgaaacgaacggcggtctgtatttggcgttaatgaatcacatgggaagaaaggaagacgccggtgcttttgcctttatcagcacggaatcaggcccgtttatgacgatggtcactttcggtgtgacagggcttgcggcatttccttgggagacgctggctgcaaccgtcatcccgtttttactcggctgcattctcggtaaccttgaccctgaattgcgcgatttgttcggaaaagtcgtaccggcgatcattccgttcttcgcattttcacttggaaacacgcttgattttaacatgttgattcaatccggccttttaggcattgttgtcggcgtatcagtcgtcattctctcgggtgcatctctatacttgctggaccgctttgtcgcaagaggagacggtgtcgcgggagtagcggcgtcatcaacggccggggctgcggtagccgtcccgtatgcacttgccgatgcaaaccccgtgtttgcgccggtagctgattcagcaaccgcgatcatcgcgacaagcgtcattgtcacctcgcttctgacgccgcttgcaaccgtctggatcgaaaaacggacgaaacaaagaaaatctccgaaacaaatgacgattgattacaagtaa

SEQ ID NO: 2664 - DNA, 1104 bp, Bacillus licheniformis
atggctgtctacatgttgaatatggggattgttttcgtctggtcatggtttgcgaaaatgtacggcagggaagatcacaggctgccgacgggctaccgtccgaatgcgatcctcaccgtcgttccgctcgcgtctttgattatcgttgccggcttaagatacaaggtcggaacggattaccacacatatatgctgctttacgaattagccggaaaatacaacagcatttgggagatattcggtttcggaacaggcaagtcgtcgacggacccgggatttaccgcactcttatggattttaaatcagatttcagccgatccggcgctcatgtttgccgtcgttgccgcgattacctatatctatattgtcaagacgctttatgtgtatggaaggccgtttgaattgagcatgtttctgtttatcggcatgtttcactattatgcttcgtttaacggcattcgccaatacatggcggcggccattctgttttgggcggtgcggtatctgatcgatgggaagctggtgcgctatatgatcgttgtactgatctgttcgctttttcattcttcggcattgatcatgattccggtttatttcatcgtcagaagaaaagcgtggtcgcctgtcctctggtgcctgatgctcgtctttttggcggggacttttctgtatcaaaaatttctgtccgtattcctagtcgtgcttgaaaacagtcaatacggacattatgaagaatggctgatgaagaatacaaacggcatgaacgttattaaaatcatcgttcttcttctcccgctcgcacttgccttttgcttcagggagcagctcagaaagcgctggcccgaagtcgattatatcgtaaacctttgtctgatcggtttcctgttcggaattttggcgacaaaggatgtcatttttgcgaggttcaacatttatttcgggctctatcagctgattctcgttccttattttgtacggatttttgaaccgaaatcaaacgcgcttctttatgttttgattttgatctgttacttcttatacagctttatgctcatgccgttcgactcgtcggtattgccgtacagaacgatttttgaacgttga

SEQ ID NO: 2665 - DNA, 1296 bp, Bacillus licheniformis
atggccatagcagccggtctcattttatcggcggtattcttcatattgttgtttctcggcgttccgatttctgtaagtattgcggcggcatccattgtaacaatgcttaccatttttccttttgatgttgccattttcacttcggcgcaaaaaatggtcactggaatcgacagctttgctttattagcggtgccgttcttcattttatcaggcattattatgaataatggcggtattgcaatgcggctcattaacttcgcaaaattgatcagcggcaggctgcccggttctctggcccatacaaatgttgtcggaaacatgttattcggttccatttccggttcgtctgtagctgctgctgctgcaatcggcggggtcatgtcgccgcttcaagaaaaggaaggatatgaccggacttactctgccgcagtaaatattgcttcagcaccaactggtttgcttattccgcctagcggtcttttgatcattttctcattagtcagcggcggaacatctgttgccgctttatttatggcgggctatttgccgggaatcttgtgggggctggctacgatggttgtcgcctgtatgattgcaaaaaagaaaaaataccctgttgcgccaaagattacgattagtcaaggttttaaagtgcttctcgatgcgattccaagcctgttgctcattgtaatcgtaatcgggggtattatcgccggtgtatttacagcaactgaaggagcagcaatagcggtggcttattccttattgttgtcgctcttttataggacattgaaatggaaacagctccccaaaatgctgctggaaacggtagaaatcacagccgttattatgtttttggttgggacatcaacgatgctgtcattggtcatggcgtttacaggcataccgacggcaatcagcaatggaattttagggattacagataacccaattttgatcctgctgatgatgaatatcatcttattaataatcggtacatttatggacatcactccggctgtactaattttcactccaatctttctgccaattgttgaaagctttggcatggatcccgtgcattttggaattatgatcgtatttaacctttgtatcggcaatatcactcctcctgtaggaagtgctctgtttgtaggatgcaccataggtaaagttgatattgaacgagtggttaaaccgattctgccattttatgctgcgatcatgatcgtccttttaattgttacctacattccacaaatcagcttagtgttgcctcaattatttggactttaa

SEQ ID NO: 2666 - DNA, 951 bp, Bacillus licheniformis
atgtcatttgcatcggaaacgaaaaaagaacttacaaaccttgaagtaaaggattgctgcgcgaaagcagagctctctgccctcattcggatgaacggttcattgtctttctcaaaccgaaaagtggttctcgacgtccagaccgagaacgcggccatcgccagaagaatttacacattgctgaagaaacaatacgatgtttccgttgaactgctcgttcgaaagaaaatgagactgaaaaaaaacaatgtctacatcgtacgcctgatcgaaaatgccaagccgattctcgaggacttgaaaatactcggagacaactttgtcattgccagaaacatctccgaagacttagtcaaaaaacgatgctgcaaacggtcttatatgagaggggcatttttagccgggggttctgtcaacaatcccgagacatcttcttaccacctcgagattttttcgctgtacaaagagcataatgattcattgtgcaggctcatgaatcagttccatttaaacagcaaaacgcttgagcggaaaaagggatacatcacgtatctgaaggaagccgaaaaaatcaccgagtttttgaatgtgatcggcgcgcataattcgctgctccgctttgaagacgtccggatcgtgcgcgatatgagaaactcggtcaaccggctcgtcaattgcgagaccgccaatttaaacaaaacgatcggcgcttctctgcggcaggtggaaaacatcaagctgatcgacgaaagaatcgggcttgatgcgctgccggaaaagctgagggaaatcgctcagctccgcattgattatcaggaagtaacattaaaggaactcggggaaatggtgtcgagcggaaaaatcagcaaatcgggcatcaaccaccgacttaggaaactggatgaaatagctgagcagctgcgttcaggacaatctgtctctttaaaatag

SEQ ID NO: 2667 - DNA, 1153 bp, Bacillus licheniformis
gtgaagcgttttctgttctggctcttggtcatcggaatcgtatgctttggagcgcataatgtacaagcttcgccaaaagaagcggagccggctggggaaaccgctgcagaagaatcggcagaagccattgcaagagagcaggctgaaggtttggaactagaccgggtcggggagttctggaacaacattttgacagagtatgggggacaccttcccgaaagtcaaaaaggaagcctgcttgaatttgtcaaaggagaaaagcacttttcgcctgaggaatggggcaaagcgctgttttcctacttgttccatgaagtgctggctaacgggaaactgctggggacgctgatcctgttgaccatcttctgcgtcctgcttcagcttttgcaaaacgcgtttcaacaaagcaccgtcagcaaagtggcgtatgcaattgtctacatggtgctgattattcttgcgctcaacagctttcgggttgccgtcacatatgcgaatgaagcgattcagacgatgacaagctttatcctgtcgctcgtacctctgcttctggcgctgatggcgacttcggggggagccgcctcagccgcattctttcatccggtcattctttttctcatgaacacgagcggcttgtttatccaatatatcgtgttgccgcttttatttttatcagcgattttaagcattgtcagcacgatgacggaccaatataaagtcacacagctggcccagctcctcagaaatgcggcgatcggcacgctggctgcatttttgaccgtattcctcggtgtcatctcggttcagggcgcctcagccgcagtgacggacggcattactttgcggacggcaaaattcattaccggaaacttcatccccgtattgggccgcatgtttaccgaagcgacagacacggtgatcagcgcgtctctcctgctgaaaaacaccgtcgggatactcggtgtggcaatcttaatttgcatcgcagcctttcccgcgatcaaaatcctttccctcgcgctcatatacaaaattgccgcggcggttctccagcctctcggaggcggcccggttatcagctgcctggatgtcatcagcaaaagcgtcatctacattttcgcggccatggccatcgtttcgctgatgtttttct

SEQ ID NO: 2668 - DNA, 784 bp, Bacillus licheniformis
gtgaaaaacaaccatttgctaaaatccattctgctatggggtgccgtatgcatcatagtgctggcagggccgctctcagcatttgccgcttcgtcatcaaacccgtcggataaattgtattttaaaaacaaaaaatactacatattcaacaatgtatggggagccgaccaggtcagcggctggtggcagaccatttatcataatagtgattcagatatgggctgggtgtggaattggccgagcaatacaagcacggtaaaagcttatccgtcgatcgtcagcggctggcattggactgaaggctatactgccggaagcggcttcccgacgcgattgtcagatcaaaaaaacatcaacacgaaagtcagctattcgatcagcgcaaacggcacatacaatgccgcatatgacatttggctccacaatacaaacaaggcgagctgggattcggctccaaccgatgagattatgatctggctcaataacacaaacgccggacctgccggttcctatgtcgaaactgtatcgattggcgggcacagttggaaagtatataaaggctatattgatgctggaggcggcaaagggtggaacgtgttttcatttatcagaacagcaaacacccaaagtgcgaacctgaatattcgggatttcacgaattatcttgccgactccaaacagtggctttccaaaacaaagtatgtcagcagtgtggaattcggtactgaagttttcggaggcacaggacaaattaatatttccaattgggacgtaacggtccgct

SEQ ID NO: 2669 - DNA, 3519 bp, Bacillus licheniformis; identical to SEQ ID NO: 2646

SEQ ID NO: 2670 - DNA, 1035 bp, Bacillus licheniformis
atgacaaagcttgtttttgatgaagaaaaactcaatcaagtgatcgacagaatcgttaagcggacatttgagatggatttcgaatgggattggccgggcggcgtcgcgttttacggcgtggctgaggcgtatgaagcaaccgaaaatgaagaatacctcgagcttttgaaaaactggacggatgaaaagcttgaagacggattgcctaagctgtcgatcaacggagtatccatcggccataccctcatatcgctctaccaggcgacaggagatgaccgttatctggacgccgcccggcaaatggcggactatgtgctccacgaagcgcctcggttcgcagacggggttttgcagcacaccgtcaactcagagaaacatgtattccctgaacaggcatgggtcgatacgatgatgatggcgggcttgttccttctccgaatcggaaagcttgtcggcagcgaggaatattttgaagacgggctgagccagtatcacggccatgaagaatttttgcaggatatggagaccaatctttattatcacgcatgggaccatgtggccaaaaacaacctgtcaggcatattttggggaaggggaaacggatgggcagctttaacgatggcaaaagcgctccctttaatcgatgttacgcatccgtcttatatgatcattgacggttcgctccgggacttgctgagcgcgcttgtcaggcttcagcatccctcaggtttatggcacaccgtactgacggacccggattcataccttgaagtgtcaggctctgccgggattgcatccggtttgctgtcaagaggctcgctataccacaaatccgttcagaaggcgctctcagccattacggatgcggtcgcgcctgacggaagggtggagcgcgtttctgcgggtacagcagtgatgcgggatgcgcagggttacaaagacgttccgtataaacggattcaaggctggggacaggggcttgccctgacctttttggcagatgtcgtccgctccaagtcgcgcgcgttccaatag

SEQ ID NO: 2671 - DNA, 1102 bp, Bacillus licheniformis
  misc_feature (1)...(1102): n = A,T,C or G
gtgaaaagaggcgataccctttaccaaatcgcgaatcgttaccgaacaacagttaatgaaattgtcgcgacgaatgaaattccgaacccgaatcggcttgttgtcggacaaaccatcgtgatcccgatcgccggcgagttttatgaggtcagacagggagatacattagcatcaatcggagcacgctttaatatttctccggctgaactggcgaggatcaaccgcattcaggttagcgccgttttaccggtcggactgctgctttacatcccccctcggccaagacggaacattgaaacaaacgcctatatcgaacctcggggagaaagcgtaagccccgctttgcagcaggcggcaagagaggcttcgccatacttgacctatctgggcgctttcagcttccaggcgaagcgggacggcacactcgaagaaccgccgctgaacaacttaaaagaaattgccgacagacatcggactacgatgatgatgattgtcaccaatctcgaaaatgaagctttcagcgacgaactcggcaggatcattctgacggaccagaatgtaaaaaacagattgctcgataacatcgttgcagcggccagaagatacggttttaaagacatccattttgacttcgaatacttaaggcccgaagatagagaagcctataatcagtttttacgggatgcccgggcccgcttcaggcaggaaggctggctcatctcaaccgcgcttgctccgaaaacgagagcggatcagcccggacaatggtatgaagcccatgattaccgggcccacggcgaaattgtcgatttcgtcgtgctgatgacatatgagtggggctacagcggagggcccccgatggcggtatcgccgatcgggcccgtccgggacgtgatcgaatacgcactcacggaaatgcccgccagcaaaatcgtcatgggacagaaactgtacggctatgactggacgctcncctatacgccangcggaccgctggccannagcatcancccccagcggggcgatgagatcgcgagcgagaaccatgcggcgatacagtacgatgaaacagctcaggctccaaacttncgctataccgacc

SEQ ID NO: 2672 - DNA, 1344 bp, Bacillus licheniformis
taaagctgatgatggatgtgttaagccagccggctgtattaattgcagccatttctcttatcggtcttctgcttcaaaaaaagcctgccaatgaaattgtgaaagggacgaccaaatcgtttttaggctttatcgtgatttcagccggggcgggcatccttgttggctcgcttgagccgttcggaaagatgtttcaagcagcctttcatgtgaacggcgtcgttccgaacaatgaagcgattgtcgcgatggcgctcaatgaatacgggacggcaacagcgctgatcatgtttttcgggatgctgtccaacatcttaattgcccgttttaccagattaaaatacatttttttgaccgggcatcacacattgtatatggcatgtttaatcgccgttatactggcggtggcgggtttgaagggcccgtttttgatcggcgtcggagctgtttcgctcggcttgacaatgagtttgtttccggcgatggttcagccttttatgaaaaagataaccggcaatgataaggtcgcgttcggccatttttcttcaatcggttacgctgtgtccgggttaatcggcaaagcggcaggcaagggctcgcgctcaactgaaaaaatccggtttccaaacggcctcggatttttaagggacagctctgtcagcattgcgctcactatgaccatcttgtacgttttgattgccttatttgcaggggcgggctatgtggagcgcgagttgagcggcggtacgcattatcttgtcttctccgttattcaagcggtcacatttgcggcaggggtgtttattattctttcgggagtcagactcgtgctcgcggagatcgttccggcttttaaaggcatatctgacaaactcgtaccggattccaagccggcactggattgtccgatcatttttccgtacgcgccaaacgccgtattaatcggctttttttgcagcttcattggcggcatcaccggcatgctgattctcggagcggccggagccgtcatcgttcttcccggagtggttccccactttttcacaggagcttcggccggcgtcttcggaaacgctgcaggggggatacggggagcggtcttggggtcttttgtcaacggtctgattatcacgtttttccctgtgttcctgctgccggtcatgggtgatttaggctttgccaatacgacattttccgataccgattttgccgcaacaggaatcgtgcttgggcatgcggtgaaactgctgggatctggaggcgttgtaattggaatcgcagcggtagtggttggcgcagtcttgttcggctttaaacgcggaaaggcggaaaagccagatcaga

(The sequence listing continues in the following parts.)

What is claimed is:

1. A method for monitoring differential expression of a plurality of genes in a first *Bacillus* cell relative to expression of the same genes in one or more second *Bacillus* cells, comprising:
   (a) adding a mixture of labeled nucleic acid probes isolated from the first *Bacillus* cell and the one or more second *Bacillus* cells to a substrate containing an array of *Bacillus licheniformis* genomic sequence tags (GSTs) under stringency conditions where the nucleic acids hybridize to complementary sequences of the *Bacillus licheniformis* GSTs in the array, wherein the nucleic acids from the first *Bacillus* cell and the one or more second *Bacillus* cells are labeled with a first reporter and one or more different second reporters, respectively, wherein the *Bacillus licheniformis* GSTs are selected from the group consisting of SEQ ID NOs. 1–4448, and wherein the stringency conditions are high or very high stringency conditions, and wherein the array contains SEQ ID NO.322; and
   (b) examining the array under conditions wherein the relative expression of the genes in the *Bacillus* cells is determined by the observed hybridization reporter signal of each spot in the array in which (i) the *Bacillus licheniformis* GSTs in the array that hybridize to the nucleic acids obtained from either the first *Bacillus* cell or the one or more second *Bacillus* cells produce a distinct first hybridization reporter signal or one or more second hybridization reporter signals, respectively, and (ii) the *Bacillus licheniformis* GSTs in the array that hybridize to the nucleic acids obtained from both the first and one or more second *Bacillus* cells produce a distinct combined hybridization reporter signal.

2. The method of claim 1, wherein the *Bacillus* cells are selected from the group consisting of a *Bacillus alkalophilus, Bacillus amyloliquefaciens, Bacillus brevis, Bacillus circulans, Bacillus clausii, Bacillus coagulans, Bacillus firmus, Bacillus lautus, Bacillus lentus, Bacillus licheniformis, Bacillus megaterium, Bacillus pumilus, Bacillus stearothermophilus, Bacillus subtilis,* and *Bacillus thuringiensis* cell.

3. The method of claim 1, wherein the *Bacillus* cells are the same cell.

4. The method of claim 1, wherein the first *Bacillus* cell is a *Bacillus licheniformis* cell.

5. The method of claim 1, wherein the one or more second *Bacillus* cells are *Bacillus licheniformis* cells.

6. The method of claim 1, wherein the *Bacillus* cells are one or more different cells.

7. The method of claim 1, wherein the reporters are colorimetric, radioactive, or fluorescent reporters.

* * * * *